(12) United States Patent
Mendrick et al.

(10) Patent No.: US 7,447,594 B2
(45) Date of Patent: Nov. 4, 2008

(54) MOLECULAR CARDIOTOXICOLOGY MODELING

(75) Inventors: Donna L. Mendrick, Gaithersburg, MD (US); Mark W. Porter, Gaithersburg, MD (US); Kory R. Johnson, Gaithersburg, MD (US); Brandon Higgs, Gaithersburg, MD (US); Arthur Castle, Gaithersburg, MD (US); Michael Elashoff, Gaithersburg, MD (US)

(73) Assignee: Ocimum Biosolutions, Inc., Indianapolis, IN (US)

( * ) Notice: Subject to any disclaimer, the term of this patent is extended or adjusted under 35 U.S.C. 154(b) by 465 days.

(21) Appl. No.: 10/338,044

(22) Filed: Jan. 8, 2003

(65) Prior Publication Data

US 2007/0082332 A1 Apr. 12, 2007

Related U.S. Application Data

(63) Continuation-in-part of application No. 10/191,803, filed on Jul. 10, 2002, now abandoned.

(60) Provisional application No. 60/303,819, filed on Jul. 10, 2001, provisional application No. 60/305,623, filed on Jul. 17, 2001, provisional application No. 60/369,351, filed on Apr. 3, 2002, provisional application No. 60/377,611, filed on May 6, 2002.

(51) Int. Cl.
*G06F 19/00* (2006.01)
(52) U.S. Cl. .................. 702/19; 435/6; 700/30; 702/22; 707/104.1
(58) Field of Classification Search ............. None
See application file for complete search history.

(56) References Cited

U.S. PATENT DOCUMENTS

| 5,811,231 | A | 9/1998 | Farr et al. ............ 435/6 |
| 5,858,659 | A | 1/1999 | Sapolsky et al. |
| 5,953,727 | A | 9/1999 | Maslyn et al. ............ 707/104 |
| 5,965,352 | A | 10/1999 | Stoughton et al. ............ 435/4 |
| 6,132,969 | A | 10/2000 | Stoughton et al. |
| 6,153,421 | A | 11/2000 | Yanagi et al. |
| 6,160,105 | A | 12/2000 | Cunningham et al. ...... 536/23.1 |
| 6,185,561 | B1 | 2/2001 | Balaban et al. ............ 707/6 |
| 6,203,987 | B1 | 3/2001 | Friend et al. ............ 435/6 |
| 6,218,122 | B1 | 4/2001 | Friend et al. ............ 435/6 |
| 6,228,589 | B1 | 5/2001 | Brenner ............ 435/6 |
| 6,229,911 | B1 | 5/2001 | Balaban et al. ............ 382/128 |
| 6,365,352 | B1 | 4/2002 | Yerramilli et al. ............ 435/6 |
| 6,372,431 | B1 | 4/2002 | Cunningham et al. ............ 435/6 |
| 6,403,778 | B1 | 6/2002 | Cunningham et al. ...... 536/22.1 |
| 6,421,612 | B1 | 7/2002 | Agrafiotis et al. |
| 6,461,807 | B1 | 10/2002 | Friend et al. |
| 2001/0039006 | A1 | 11/2001 | Snodgrass |
| 2001/0049139 | A1 | 12/2001 | Lagasse et al. |
| 2002/0019704 | A1 | 2/2002 | Tusher et al. |
| 2002/0111742 | A1 | 8/2002 | Rocke et al. |
| 2002/0119462 | A1 | 8/2002 | Mendrick |
| 2002/0142284 | A1 | 10/2002 | Raha et al. |
| 2002/0169562 | A1 | 11/2002 | Stephanopoulous et al. |
| 2002/0176821 | A1 | 11/2002 | Fogarty |
| 2003/0028327 | A1 | 2/2003 | Brunner et al. |
| 2003/0124552 | A1 | 7/2003 | Lindemann et al. |
| 2003/0154032 | A1 | 8/2003 | Pittman et al. |
| 2003/0180808 | A1 | 9/2003 | Natsoulis |
| 2004/0014040 | A1 | 1/2004 | Mendrick et al. |
| 2004/0072160 | A1 | 4/2004 | Mendrick et al. |
| 2004/0110193 | A1 | 6/2004 | Castle et al. |

FOREIGN PATENT DOCUMENTS

| WO | WO 93/01205 | 1/1993 |
| WO | WO 94/17208 | 4/1994 |
| WO | WO 94/17208 | 8/1994 |
| WO | WO 95/11755 | 5/1995 |
| WO | WO 97/13877 | 4/1997 |
| WO | WO 97/16732 | 5/1997 |
| WO | WO 99/12118 | 3/1999 |
| WO | WO 99/27090 | 6/1999 |
| WO | WO 99/32660 | 7/1999 |
| WO | WO 99/43345 | 9/1999 |
| WO | WO 99/58670 | 11/1999 |
| WO | WO 00/12760 | 3/2000 |
| WO | WO 00/28092 | 5/2000 |
| WO | WO 00/39336 | 7/2000 |
| WO | WO 00/47761 | 8/2000 |
| WO | WO 00/12760 | 9/2000 |
| WO | WO 00/63435 | 10/2000 |

(Continued)

OTHER PUBLICATIONS

Adamson & Harman et al., *Biochem. Pharmacol.*, 45: 2289-2294 (1993).

(Continued)

*Primary Examiner*—Carolyn L. Smith
(74) *Attorney, Agent, or Firm*—Cooley Godward Kronish LLP

(57) ABSTRACT

The present invention is based on the elucidation of the global changes in gene expression and the identification of toxicity markers in tissues or cells exposed to a known cardiotoxin. The genes may be used as toxicity markers in drug screening and toxicity assays. The invention includes a database of genes characterized by toxin-induced differential expression that is designed for use with microarrays and other solid-phase probes.

10 Claims, No Drawings

FOREIGN PATENT DOCUMENTS

| WO | WO 01/11076 | 2/2001 |
|---|---|---|
| WO | WO 01/14425 | 3/2001 |
| WO | WO 01/20043 | 3/2001 |
| WO | WO 01/23886 | 4/2001 |
| WO | WO 01/25473 | 4/2001 |
| WO | WO 01/32928 | 5/2001 |
| WO | WO 01/36684 | 5/2001 |
| WO | WO 01/38579 | 5/2001 |
| WO | WO 01/44512 | 6/2001 |
| WO | WO 01/63279 | 8/2001 |
| WO | WO 02/09500 | 2/2002 |
| WO | WO 02/10453 | 2/2002 |
| WO | WO 03/064624 | 8/2003 |
| WO | WO 03/068908 | 8/2003 |
| WO | WO 03/095624 | 11/2003 |
| WO | WO 2004/048598 | 6/2004 |
| WO | WO 2004/063334 | 7/2004 |
| WO | WO 2005/014793 | 2/2005 |

OTHER PUBLICATIONS

Afshari et al., *Cancer Res.*, 59: 4759-4760 (1999).
Ahotupa et al., *Carcinogenesis.*, 15: 863-868 (1994).
Al-Bayati & Stohs, *Arch. Environ. Contam. Toxicol.*, 20: 361-365 (1991).
Allan et al., *J. Biol. Chem..*, 276: 27272-27280 (2001).
Ameisen, *Nature*, 395: 117-119 (1998).
Andersen & Barton, *Environ. Health Perspect.*, 106: 349-355 (1998).
Anderson et al., *Mol. Carcinog.*, 26: 226-238 (1999).
Anderson et al., *Toxicol. Appl. Pharmacol.*, 137: 75-89 (1996).
Arano et al., *Arzneimittelforschung*, 46: 398-400 (1996).
Atchison et al., *Digestive Dis. Sci.*, 45: 614-620 (2000).
Bagetta et al., *Biochem. Biophys. Res. Commun.*, 197: 1132-1139 (1993).
Bajgar et al., *Neurochem. Int.*, 24: 555-558 (1994).
Baker et al., *Chem Res. Toxicol.*, 14: 1218-1231 (2001).
Barner & Gray, *Ann. Pharmacother.*, 32: 70-77 (1998).
Bartosiewicz et al., *J. Pharmacol. Exp. Ther.*, 297: 895-905 (2001).
Beck et al, *Arch. Toxicol.*, 64: 210-217 (1990).
Becker et al., *Alzheimer Dis. Assoc. Disord.*, 10: 124-131 (1996).
Bedard et al., *Antimicrob. Agents Chemother.*, 43: 557-567 (1999).
Bedossa et al., *Hepatology*, 19: 1262-1271 (1994).
Beierschmitt et al., *Toxicol. Sci.*, 63: 15-21 (2001).
Belury et al., *Toxicol. Appl. Pharmacol.*, 151: 254-261 (1998).
Berndt et al., *Proc. Natl. Acad. Sci. U.S.A..*, 95: 12556-12561 (1998).
Birge et al., *Toxicol. Appl. Pharmacol.*, 105: 472-482 (1990).
Boelsterli et al., *Cell Biol. Toxicol.*, 3: 231-250 (1987).
Bort et al., *J. Pharmacol. Exp. Ther.*, 288: 65-72 (1999).
Bosio and Borlak, *Innovations in Pharmaceutical Technology*, 65-75, 2001.
Bouchard et al., *Liver*, 13: 193-202 (1993).
Bruck et al., *Dig. Dis. Sci.*, 44: 1228-1235 (1999).
Burchiel et al., *Toxicol. Sci.*, 59: 193-195 (2001).
Burczynski et al., *Toxicol. Sci.*, 58: 399-415 (2000).
Bursch et al., *Arch. Toxicol.*, 69: 253-258 (1995).
Buttar et al., *Toxicology.*, 6: 9-20 (1976).
Butterworth et al., *Cancer Res.*, 49: 1075-1084 (1989).
Cai et al., *J. Med. Chem.*, 1970-1979 (1998).
Calabrese et al., *J. Amer. College Toxicol.*, 15: 62-69 (1996).
Castell et al., *Cell Biol. Toxicol.*, 13: 331-338 (1997).
Chan et al., *Proc. Natl. Acad. Sci. U.S.A..*, 98: 4611-4616 (2001).
Chanda et al., *Hepatology*, 21: 477-486 (1995).
Chen et al., *J. Biol. Chem..*, 275: 22619-22622 (2000).
Chisholm et al., *Am. J. Physiol.*, 276: G1165-G1173 (1999).
Chou et al., *Proc. Natl. Acad. Sci. U.S.A..*, 98: 8113-8118 (2001).
Christian et al., *Toxicol. Appl. Pharmacol.*, 82: 239-255 (1986).
Clive et al., *Fundam. Appl. Toxicol.*, 3: 587-602 (1983).
Coles et al., *Arch. Biochem. Biophys.*, 264: 253-260 (1988).
Conforti et al., *Agents Actions*, 40: 176-180 (1993).
Coni et al., *Hepatology*, 17: 1109-1116 (1993).
Corell et al., *Acta Pharmacol. Toxicol. (Copenh)*, 45: 232-239 (1979).
Corton & Stauber, *Toxicol. Sci.*, 58: 217-219 (2000).
Corton et al., *Cancer Lett.*, 134: 61-71 (1998).
Corton et al., *Cancer Lett.*, 137: 9-15 (1999).
Corton et al., *Mol. Pharmacol.*, 54: 463-473 (1998).
Crosby et al., *Toxicol. Appl. Pharmacol.*, 169: 205-221 (2000).
Cunningham et al., *Ann. N.Y. Acad. Sci.*, 919: 52-67 (2000).
D'Mello et al., *Exp. Toxicol. Pathol.*, 51: 549-553 (1999).
Davis et al., *Cancer Res.*, 60: 2887-2891 (2000).
De Fabiani et al., *J. Biol. Chem.*, 276: 30708-30716 (2001).
Del Giudice et al., *IL Farmaco.*, 51: 693-698 (1996).
Delaney & Timbrell, *Xenobiotica.*, 25: 1399-1410 (1995).
Diel et al., *J. Steroid Biochem. Mol. Biol.*, 73: 1-10 (2000).
Dodds & Rivory, *Mol. Pharmacol.*, 56: 1346-1353 (1999).
Dos Santos et al., *J. Am. Soc. Nephrol.*, 8: 361-367 (1997).
Duivenvoorden et al., *Biochem. Biophys. Res. Commun.*, 215: 598-605 (1995).
Dutar et al., *Brian Res.*, 527: 32-40 (1990).
Eadie et al., *Med. Toxicol. Adverse Drug Exp.*, 3: 85-106 (1988).
Eldridge et al., *Carcinogenesis*, 11: 2245-2251 (1990).
Ellis & Isaacs, *Cancer Res.*, 45: 6041-6050 (1985).
Emmison et al., *Biochim. Biophys. Acta*, 1083: 147-152 (1991).
Enomoto et al., *Toxicol. Sci.*, 59: 169-177 (2001).
Falzon et al., *Br. J. Exp. Pathol.*, 66: 527-534 (1985).
Fan & Rozman, *Toxicol. Lett.*, 75: 209-216 (1995).
Fan et al., *J. Biol. Chem..*, 271: 24698-24710 (1996).
Farag & Hassib, *Clin. Sci. (Lond)*, 84: 387-390 (1993).
Farr & Dunn, *Toxicol. Sci.*, 50: 1-9 (1999).
Fernandez-Tome & Sterin-Speziale, *Pharmacology*, 48: 341-348 (1994).
Ficazzola et al., *Carcinogenesis*, 22: 1271-1279 (2001).
Fielden & Zacharewski, *Toxicol. Sci.*, 60: 6-10 (2001).
Fitten et al., *J. Gerontol.*, 42: 681-685 (1987).
Fracasso et al., *Agents Actions*, 22: 3-4 (1987).
Fracasso et al., *Agents Actions*, 31: 313-316 (1990).
Froesch et al., *J. Biol. Chem..*, 274: 6469-6475 (1999).
Frueh et al., *Mol. Pharmacol.*, 51: 363-399 (1997).
Fulgencio et al., *Biochem. Pharmacol.*, 62: 439-446 (2001).
Furr, *Ann. N.Y. Acad. Sci.*, 761: 79-96 (1995).
Furr, *Eur. Urol.*, 29: 83-95 (1996).
Ganem & Jefcoate, *Toxicol. Appl. Pharmacol.*, 150: 68-75 (1998).
Garcia-Allan et al., *J. Biochem. Mol. Toxicol..*, 14: 65-72 (2000).
Gerhold et al., *Physiol. Genomics*, 5: 161-170 (2001).
Ghatineh et al., *Arch. Toxicol.*, 66: 660-668 (1992).
Goll et al., *Toxicol. Appl. Pharmacol.*, 160: 21-32 (1999).
Gram & Bentsen, *Acta Neurol. Scand. Suppl.*, 97: 81-90 (1983).
Greaves et al., *Cancer Res.*, 53: 3919-3924 (1993).
Green et al., *Toxicol. Appl. Pharmacol.*, 76: 139-149 (1984).
Guardavaccaro et al., *Mol. Cell. Biol.*, 20: 1797-17815 (2000).
Hamada et al., *Hepatology*, 21: 1455-1464 (1995).
Hamada et al., *J. Hepatol.*, 30: 807-818 (1999).
Hurgus et al., *Chem. Res. Toxicol.*, 7: 575-582 (1994).
Hurgus et al., *Chem. Res. Toxicol.*, 8: 993-996 (1995).
Harries et al., *Toxicol. In Vitro*, 15: 399-405 (2001).
Hartung & Wendel, *Biochem. Pharmacol.*, 42: 1129-1135 (1991).
He et al., *J. Biol. Chem..*, 276: 20858-20865 (2001).
Hellriegel et al., *Biochem. Pharmacol.*, 52: 1561-1568 (1996).
Hessel et al., *Braz. J. Med. Biol. Res.*, 29: 793-796 (1996).
Hillstrom et al., *Proc. Soc. Exp. Biol. Med.*, 200: 122-126, 1992.
Hissink et al., *Chem. Res. Toxicol.*, 9: 1249-1256 (1996).
Hogue, *Chemical and Engineering News*, 79: 33-34 (2001).
Hunter et al., *Br. J. Pharmacol.*, 98: 79-86 (1989).
Inohara et al., *EMBO J.*, 17: 2526-2533 (1998).
Iredale et al., *J. Clin. Invest.*, 102: 538-549 (1998).
Iswaran et al., *J. Toxicol. Sci.*, 22: 75-88 (1997).
Itoh et al., *Behav. Brain Res.*, 83: 165-167 (1997).
Itoh et al., *Eur. J. Pharmacol.*, 322: 11-19 (1997).
Izumi et al., *J. Biol. Chem..*, 272: 7381-7389 (1997).
Jean et al., *Toxicol. Lett.*, 95: 155-163 (1998).
Jenner & Timbrell, *Arch. Toxicol.*, 68: 349-357 (1994).
Johnston & Kroening, *Pharmacol. Toxicol.*, 83: 231-239 (1998).
Jover et al., *Toxic. in Vitro.*, 6: 47-52 (1992).

Kanaji et al., *J. Cell Biol.*, 151: 277-288 (2000).
Kannan et al., *Oncogene.*, 20: 2225-2234 (2001).
Karam & Ghanayem, *Carcinogenesis*, 18: 2077-2083 (1997).
Kasper & Mueller, *Carcinogenesis*, 17: 2271-2274 (1996).
Kesterson et al., *Hepatology*, 4: 1143-1152 (1984).
Kim & Ziegler, *Drug Metab. Dispos.*, 28: 1003-1006 (2000).
Kim et al., *Drug Metab. Dispos.*, 26: 66-72 (1998).
Kim et al., *Toxicol. Appl. Pharmacol.*, 102: 34-39 (1990).
Kinbara et al., *Scand. J. Gastroenterol.*, 32: 947-952 (1997).
Kingsley et al., *Epilepsia*, 21: 699-704 (1980).
Kingsley et al., *J. Clin. Pharmacol.*, 23: 178-185 (1983).
Knapp et al., *Am. J. Vet. Res.*, 56: 801-805 (1995).
Koga et al., *Fukuoka Igaku Zasshi*, 82: 197-206 (1991.
Kondo et al., *Cancer Res.*, 50: 6222-6228 (1990).
Kongo et al., *Toxicol. Lett.*, 105: 103-110 (1999).
Koopen et al., *Hepatology* 27: 537-545 (1998).
Koopen et al., *J. Lipid. Res.*, 40: 100-108 (1999).
Kossor et al., *Biochem. Pharmacol.*, 46: 2061-2066 (1993).
Kossor et al., *Fundam. Appl. Toxicol.*, 26: 51-62 (1995).
Kossor et al., *Toxicol. Appl. Pharmacol.*, 119: 108-114 (1993).
Kretz-Rommel & Boelsterli, *Toxicol. Appl. Pharmacol.*, 120: 155-161 (1993).
Kwak et al., *Mol. Med.*, 7: 135-145 (2001).
Lake et al., *Toxicology.*, 131: 9-20 (1998).
Lake, *Annu. Rev. Pharmacol. Toxicol.*, 35: 483-507 (1995).
Larsen & Jefcoate, *Arch. Biochem. Biophys.*, 321: 467-476 (1995).
Laskin et al., *Hepatology*, 21: 1045-1050 (1995).
Lauredo et al., *J. Appl. Physiol.*, 2298-2304 (1998).
Lazartigues et al., *Eur. J. Pharmacol.*, 361: 61-71 (1998).
Lee et al., *J. Pharm. Pharmacol.*, 52: 341-355 (2000).
Lewis et al., *Hepatology*, 2: 870-873 (1982).
Liang et al., *Zhonghua Gan Zang Bing Za Zhi*, 7: 72-73 (1999).
Liu et al., *Infect. Immun.*, 66: 5089-5098 (1998).
Liu et al., *Mol. Cell. Biol.*, 20: 6105-6113 (2000).
Liu et al., *Proc. Natl. Acad. Sci. U.S.A..*, 98: 6192-6197 (2001).
Liu et al., *SHOCK*, 14: 361-365 (2000).
Lock et al., *Toxicol. Lett.*, 10: 427-435 (1982).
Lorezini et al., *Carcinogenesis*, 17: 1323-1329 (1996).
Lovett, *Science*, 289: 536-537 (2000).
Lugovskoy et al., *Cell*, 99: 747-755 (1999).
Lullmann & Lullmann-Rauch, *Toxicol. Appl. Pharmacol.*, 61: 138-146 (1981).
Mann, *Toxicol. Pathol.*, 25: 72-79 (1997).
Manoukian & Carson, *Drug Saf.*, 15: 64-71 (1996).
Martelli et al., *Carcinogenesis*, 16: 1265-1269 (1995).
Masubuchi et al., *J. Pharmacol. Exp. Ther.*, 287: 208-213 (1998).
Masubuchi et al., *J. Pharmacol. Exp. Ther.*, 292: 982-987 (2000).
Mayeux & Sano, *N. Engl. J. Med.*, 341: 1670-1679 (1999).
Mayol et al., *Carcinogenesis*, 13: 2381-2388 (1992).
Maziasz et al., *Toxicol. Appl. Pharmacol.*, 110: 365-373 (1991).
McKillop et al., *Xenobiotica*, 28: 465-478 (1998).
Menegazzi et al., *Hepatology*, 25: 585-592 (1997).
Metz & Ritter, *J. Biol. Chem.*, 237: 5607-5614 (1998).
Metz et al., *Mol. Pharmacol.*, 58: 319-327 (2000).
Milam and Byard, *Toxicol. Appl. Pharmacol.*, 79: 342-347 (1985).
Minamide et al., *J. Pharm. Sci.*, 87: 640-646 (1998).
Mitchell & Acosta, *J. Toxicol. Environ. Health*, 7: 83-92 (1981).
Mitchell et al., *Ann. Intern. Med.*, 84: 181-192 (1976).
Monteith et al., *Drug Chem. Toxicol.*, 19: 71-84 (1996).
Moore et al., *Fundam. Appl. Toxicol.*, 3: 560-568 (1983).
Moran et al., *Immunopharmacology*, 12: 245-250 (1986).
Morigasaki et al., *Biochem. Biophys. Res. Commun.*, 273: 261-266 (2000).
Morooka et al., *J. Biol. Chem..*, 270: 30084-30092 (1995).
Motoki et al., *Cancer Lett.*, 135: 145-150 (1999).
Nicholls-Grzemski et al., *Toxicol. Sci.*, 56: 220-228 (2000).
Nims et al., *Carcinogenesis.*, 8: 67-71 (1987).
Nordberg & Svensson, *Drug Saf.*, 19: 465-480 (1998).
Nuwaisyr et al., *Mol. Carcinog.*, 24: 153-159 (1999).
Oberhammer et al., *Hepatology*, 23: 329-337 (1996).
Ohta et al., *Biochem. J.*, 324: 777-782 (1997).
Omiecinski et al., *Mol. Pharmacol.*, 38: 462-470 (1990).
Omogbai et al., *Drug Chem. Toxicol.*, 22: 629-242 (1999).
Ono et al., *Chem. Pharm. Bull. (Tokyo)*, 43: 1483-1487 (1995).
Ono et al., *Chem. Pharm. Bull. (Tokyo)*, 43: 1492-1496 (1995).
Orsler et al., *Toxicol. Sci.*, 47: 203-210 (1999).
Outinen et al., *Blood*, 94: 959-967 (1999).
Owen et al., *Biochem. J.*, 348 Pt 3: 607-614 (2000).
Park & Pirmohamed, *Toxicol. Lett.*, 120: 281-291 (2001).
Park et al., *Pharmacol. Ther.*, 68: 385-424 (1995).
Passreiter et al., *J. Cell Biol.*, 141: 373-383 (1998).
Pennie et al., *Toxicol. Lett.*, 120: 353-358 (2001).
Pennie et al., *Toxicol. Sci.* 54: 277-283 (2000).
Pennie, *Toxicol. Lett.*, 112-113: 473-477 (2000).
Perrone et al., *Toxicol. Appl. Pharmacol.*, 150: 277-286 (1998).
Pischedda et al., *Proc. Natl. Acad. Sci. U.S.A.*, 92: 3511-3515 (1995).
Pohl et al., *Arthritis Rheum.*, 37: 1557 (1994).
Pollenz et al., *Toxicol. Sci.*, 42: 117-128 (1998).
Poyet & Labrie, *Mol. Cell. Endocrinol.*, 42: 283-288 (1985).
Prevot et al. *J. Biol. Chem..*, 276: 9640-9648 (2001).
Pumford et al., *Drug Metab. Rev.*, 29: 39-57 (1997).
Ratanasavanh et al., *Xenobiotica.*, 18: 765-771 (1988).
Ray & Jena, *Arch. Toxicol.*, 73: 594-606 (2000).
Raymond et al., *J. Toxicol. Environ. Health*, 51: 463-479 (1997).
Reilly et al., *Biochem. Biophys. Res. Commun.*, 282: 321-328 (2001).
Reuter et al., *Life Sci.*, 55: 1-8 (1994).
Rice et al., *Carcinogenesis.*, 15: 395-402 (1994).
Rich et al., *Nature*, 407: 777-783 (2000).
Riekkinen et al., *Eur. J. Pharmacol.*, 322: 1-9 (1997).
Riekkinen et al., *Eur. J. Pharmacol.*, 323: 11-19 (1997).
Riendeau et al., *Br. J. Pharmacol.*, 121: 105-117 (1997).
Rininger et al., *Biochem. Pharmacol.*, 52: 1749-1755 (1996).
Rininger et al., *Drug Discov. Today*, 5: 560-568 (2000).
Roberts et al., *Toxicol. Appl. Pharmacol.*, 135: 192-199 (1995).
Rockett & Dix, *Environ. Health Perspect.*, 107: 681-685 (1999).
Rodrigues & Machinist, *Toxicol. Appl. Pharmacol.*, 137: 193-201 (1996).
Ruepp et al., *Toxicol. Sci.*, 65: 135-150 (2002).
Runge-Morris et al., *Drug Metab. Dispos.*, 26: 795-801 (1998).
Sachidanandam et al., *Nature*, 409: 928-933 (2001).
Safe, *Annu. Rev. Pharmacol. Toxicol.*, 38: 121-158 (1998).
Scales & Timbrell, *J. Toxicol. Environ. Health*, 10: 941-953 (1982).
Scali et al., *Pharmacol. Res.*, 36: 463-469 (1997).
Schiller et al., *Toxicol. Appl. Pharmacol.*, 81: 356-361 (1985).
Schiodt et al., *N. Engl. J. Med.*, 337: 1112-1117 (1997).
Scholer et al., *Am. J. Med.*, 80: 34-38 (1986).
Schulte-Hermann et al., *Cancer Res.*, 48: 2462-2468 (1988).
Seefeld et al., *Arch. Environ. Contam. Toxicol.*, 9: 317-327 (1980).
Servais & Galand, *Cell Biol. Int Rep.*, 16: 319-328 (1992).
Shannon et al., *J. Pharmacol. Exp. Ther.*, 255: 1071-1077 (1990).
Sidhu et al., *Arch. Biochem. Biophys.*, 301: 103-113 (1993).
Sinz & Woolf, *Biochem. Pharmacol.*, 54: 425-427 (1997).
Skouteris and McMenamin, *Biochem. J.*, 281: 729-733 (1992).
Skrtic et al., *J. Hepatol.*, 27: 903-911 (1997).
Smith, *Trends Pharmacol. Sci.*, 22: 281-285 (2001).
Snape et al., *Neuropharmacology*, 38: 181-193 (1999).
Somani & Dube, *Int. J. Clin. Pharmacol. Ther. Toxicol.*, 27: 367-387 (1989).
Somani, *Biopharm. Drug Dispos.*, 10: 187-203 (1989).
Soni et al., *Regul. Toxicol. Pharmacol.*, 29: 165-174 (1999).
Stachlewitz et al., *J. Pharmacol. Exp. Ther.*, 282: 1591-1599 (1997).
Stohs et al., *Biochem. Biophys. Res. Commun.*, 111:854-859 (1983).
Tanaka et al., *Clin. Exp. Pharmacol. Physiol.*, 20: 543-547 (1993).
Tarloff et al., *Fundam. Appl. Toxicol.*, 30: 13-22 (1996).
Tenniswood et al., *Mol. Cell. Endocrinol.*, 37: 153-158 (1984).
Timbrell et al., *J. Pharmacol. Exp. Ther.*, 213: 364-369 (1980).
Timbrell et al., *J. Toxicol. Environ. Health*, 10: 955-968 (1982).
Timbrell, *Arch. Toxicol. Suppl.*, 2: 1-8 (1979).
Tournier et al., *Lab. Invest.*, 59: 657-665 (1988).
Trauner et al., *N. Engl. J. Med.*, 339: 1217-1227 (1998).
Tucker et al., *Fundam. Appl. Toxicol.*, 3: 579-586 (1983).
Tucker, *Am. J. Med.*, 73: 27-30 (1982).
Tygstrup et al., *J. Hepatol.*, 25: 183-190 (1996).
Tygstrup et al., *J. Hepatol.*, 27: 156-162 (1997).
van Gijssel et al., *Carcinogenesis*, 18: 1027-1033 (1997).
Vance et al., *Epilepsia*, 35: 1016-1022 (1994).

Visen et al., *J. Pharmacol. Toxicol. Methods*, 40: 173-179 (1998).
Wang & Dickinson, *Drug Metab. Dispos.*, 26: 98-104 (1998).
Wang et al., *Neuroreport.*, 10: 789-793 (1999).
Waring & Ulrich, *Annu. Rev. Pharmacol. Toxicol.*, 40: 335-352 (2000).
Waring et al., *Toxicol. Appl. Pharmacol.*, 175: 28-42 (2001).
Waring et al., *Toxicol. Lett.*, 120: 359-368 (2001).
Waterfield et al., *Biochem. Pharmacol.*, 46: 589-595 (1993).
Werner et al., *Mutat. Res.*, 395: 179-187 (1997).
Aardema and MacGregor, Mutation Res., 499:13-25, (2002).
Ala-Kokko, et al., Biochem. J., 244:75-79, (1987).
Bandara, et al., Toxicol. Sci., 73:195-206, (2003).
Boess, et al., Toxicological Sciences, 73:386-402, (2003).
Boon, et al., Proc. Natl. Acad. Sci. USA, 99(17):11287-11292, (2002).
Bramow, Stephan, et al., Pharmacol. & Toxicol., 89:133-139, (2001).
Browne, et al., Targets, 1(2):59-65, (2002).
Burczynski (Editor), "An Introduction to Toxicogenomics," Wyeth Research, Andover, MA, CRC Press pp. 226-259, (Pub. 2003).
Castle, Carver & Mendrick, Drug Disc. Today, 7(13):728-736, (2002).
Cronin, M.T.D., IL Farmaco, 56:149-151, (2001).
Cunningham, M.J., J. of Pharmacol. And Toxicol. Methods, 44:291-300, (2000).
Cutler, P., et al., Electrophoresis, 20:3647-3658, (1999).
Demeule, Brossard and Beliveau, Am. J. Physiol. Renal Physiol. 277:F832-F840, (1999).
Diez-Fernandez, et al., Biochem. Pharmacol., 51:1159-1163, (1996).
Evans & Relling, Science, 286:487-491, (1991).
Farr et al., "Concise Review: gene expression applied to toxicology," Toxicol Sci 50(1):1-9, 1999.
Gallagher, et al., Toxicol. And Appl. Pharmacol. 134:81-91, (1995).
Gobe, G., et al., J. Am. Soc. Nephrol., 11:454-467, (2000).
Hamadah, et al., Toxicol. Sciences, 67:232-240, (2002).
Hamaya, Y., et al., Anesth. Analg., 90:1177-1183, (2000).
Hartmann, et al., J. of Pharma. And Experim. Therap., 303:273-281, (2002).
Henger and Kretzler, et al., Kidney Int'l, 65:904-917, (2004).
Hewitt, et al., J. Am. Soc. Nephrol. 15:1677-1689, (2004) Abstract only.
Huang, et al., Toxicol. Sciences, 63:196-207, (2001).
Hwang, et al., Biochem. And Biophys. Res. Commun., 146(1):87-93, (1987).
Iida, et al., Carcinogenesis, 24(4):757-770, (2003).
International Search Report in Applicant's corresponding PCT application, WO 02/095000 A3, published Nov. 28, 2002.
International Search Report in Applicants' PCT Application No. PCT/US01/23872, Mar. 21, 2003.
Jaeschke, et al., Toxicol. Sciences, 65:166-176, (2002).
Jansen, Muller, and Sturm, Hepatology, 34(6):1067-1074, (2001).
Johnson and McMillian, 23rd Annual Mtg. Of the Amer. College of Toxicology, p. 532 (2002) Abstract only.
Johnson and Wolfgang, Current Topics in Med. Chem., 1(4):233-245, (2001).
Kurota and Yamaguchi, Molec. And Cell. Biochem., 151:55-60, (1995).
Kwon, et al., Am. J. Physiol. Renal Physiol. 279:F552-F564, (2000).
Lashkari et al., PNAS 94:13057-13062, (1997).
LeBlank, G., et al., Cancer Research, 52:540-547, (1992).
Lecureur, V., et al., Toxicology, 153:203-219, (2000).
Leifeld, et al., Amer. J. of Pathol., 154(6):1711-1720, (1999).
Luhe, A., et al., Toxicol. Sciences, 73:315-328, (2003).
MacGregor, et al., Toxicol. Sciences, 59:17-36, (2001).
Mansfield, T., et al., Ann. Mtg. Of the Amer. College of Toxicol., p. 516, Abstract only, 2002.
Meneses-Lorente, et al., Chem. Res. Toxicol., 16(9):A-H, 1070-1077), (2003).
Meyer, K., et al., Carcinogenesis, 24(5):975-984, (2003).
Morgan, K.T., et al., Toxicol. Pathol., 30(4):435-451, (2002).
Nakamura, et al., Clinical Immun. And Immunopath., 66(1):33-42, (1993).

"Nephrotoxic" definition, Merriam-Webster online dictionary, 2005, on the world wide web at http://www.m-w.com/cgi-bin/dictionary?book=Dictionary&ya=nephrotoxic, 2 pages.
Newsholme, et al., Electrophoresis, 21:2122-2128, (2000).
O'Brien, et al., Toxicol. And Appl. Pharma., 171:27-37, (2001).
Olden & Gurthrie, Mutation Research, 473:3-10, (2001).
Pennie & Kimber, Toxicology in Vitro, 16:319-326, (2002).
Petricoin III, et al., Nature Genetics Supp., 32:474-479, (2002).
Plant, N., et al., Toxical. And Applied Pharma., 183:127-134, (2002).
Porter, M.W., et al., "Comparison of Microarray Data Generated from the Same RNA at 19 Different Processing Sites," Soc. Of Toxicol. Mtg., (2002).
Richert, L., et al., Toxicol. And Appl. Pharmacol., 191:130-146, (2003).
Salter and Nilsson, Drug Disc. and Dev., 6(1):117-122 (2003).
Sanz, et al., British J. of Cancer, 75(4):487-492, (1997).
Schuppe-Koistinen, et al., Toxicology, 179:197-219, (2002).
Shankar, K., et al., "PPAR-a Mediates Diabetes-Induced Resistance Against Acetaminophen Hepatotoxicity . . . ," Ann. Mtg. Of the Amer. College of Toxicol., p. 526 (2002) Abstract only.
Soffers, A.E.M.F., et al., Toxic. In Vitro, 15:539-551 (2001).
Sprankle, C., et al., Cancer Letters, 101:97-106, (1996).
Steiner, et al., Environ. Health Perspect., 112(12):1236-1248, (2004).
Su, et al., Proc. Natl. Acad. Sci. USA, 99(17):11181-11186, (2002).
Suter, et al., "Toxicogenomics: Correlation of acetaminophen-induced hepatoxicity with gene expression using DNA microarrays," Soc. Of Toxicogenomics Mtg., (2000).
Suzuki and Sudo, Japan J. Pharmacol., 49:43-51, (1989).
Thomas, R.S. et al., Molecular Pharmacol., 60(6):1189-1194, (2001).
Tu, Y., et al., Proc. Nat'l Acad. Sci. USA, 99(22):14031-14036, (2002).
Verstrepen, et al., Kidney Int'l, 43:1267-1279, (1993).
Waring, et al., Environ. Health Perspect, 111:863-870, (2003).
Wilson, et al. PNAS 96:12833-12838 (1999).
Zeeberg, et al., Genome biology, 4:R28:1-8, (2003).
Bogdan, "Human carbon catabolite repressor protein (CCR4)-associative factor 1: cloning, expression and characterization of its interaction with the B-cell translocation protein BTG1," Biochem. J. 336:471-481 (1998).
Bulera, S.J., et al., Hepatology, 33:1239-1258, (2001).
Castle, A., et al., "Effects of Multiple Cardiac Apex Necrosis Agents on Genome Wide Expression," Soc. Of Tox. Mtg. (2003) Abstract only.
Golub et al., "Molecular Classification of Cancer: Class Discovery and Class Prediction by gene Expression monitoring," Science 285:531-537 (1999).
Genes on Clontech Atlas Human Stress/Toxicology Array from e-mail website dated Oct. 29, 1998.
Grigg, Environmental Health Inst. to use gene chips to evaluate chemicals for potential harm to humans NEIHS, Feb. 29, 2000, entire document.
He, et al., J. Clin. Invest., 108: 1321-1330 (2001).
Higgs, B., et al., "Effects of Rat Gender and Strain on Elucidating Liver Toxicity," Soc. Of Tox. Mtg., (2003) Abstract only.
Kawamoto, et al., Gene, 174:151-158, (1996).
Kim et al., Toxicology and Applied Pharmacology 176:118-126 (2001).
Konstandi et al., "Stress-mediated modulation of B(alpha)P-induced heptaic CYPIA1: role of catecholamines," Chemico-Biological Interactions 147:abstract, (2004).
Lubman, et al., "What do the FDA and Pharma Companies Think of Toxicogenomics, Genotyping, and Clinical Stratification?," Robertson Stephens, Inc. Marketing Materials (2002).
Marketing Materials, "Symposium on Toxicogenomics Launches New National Academics Program," Emerging Issues, 2:1-7, (2003).
Mattes, W., et al., "Cross-Species Analysis of Phenobarbital-Induced Gene Expression Changes in Dog and Rat," Soc. Of Toxicol. Mtg. 2003, (2003) Abstract only.
MDS Pharma Services Marketing Materials, "Pharmotif Solutions: Smart Decisions in Discovery and New Applications for Existing Drugs," 1-6, (2003).
Nuwaysir, et al., Cancer Research, 56:3704-3710, (1996).

Omiecinski, et al., Toxicol. Sciences, 48:151-156, (1996).
Pfeffer et al., J Immunology 153(4):1789-1797 (1994).
Raats, et al., Am. J. Pathol. 156:1749-1765, (2000).
Rajeski, David, "Exploring and Genomics Frontier," Risk Policy Report, pp. 1-5, (2002).
Simmons, P.T. & Portier, C.J., Carcinogenesis, 23(6):903-905, (2002).
Sutter, , et al., Mol. Cancer Therapeutics, 1:1283-1292, (2002).
Xiong et al., "Feature (Gene) Selection in Gene Expression-Based Tumor Classification," Mol. Genet. Metab. 73:239-247 (2001).
Yang et al., Am J Physiology 277(1):F10-F16 (1999).
Bort et al., J. Pharmacol. Exp. Ther., 288: 65-72 (1999).
Jover et al., Toxic. in Vitro., 6: 47-52 (1992).
Zhao et al., J. Biol. Chem.., 276: 27432-27440 (2001).
Zarif et al., Inflammation, 20: 217-227 (1996).
Zhou et al., J. Clin. Invest., 108: 1167-1174 (2001).
Wiesenberg-Boettcher et al., Drugs Exp. Clin. Res., 15: 501-509 (1989).
Woodward & Timbrell, Toxicology., 30: 65-74 (1984).
Woolf et al., Drub Metab. Dispos., 21: 874-882 (1993).
Yata et al., J. Hepatol., 30: 419-424 (1999).
Agha & Gad, Pharmacol. Res., 32: 279-285 (1995).
White et al., Biochem. Pharmacol., 45: 21-30 (1993).
White et al., Carcinogenesis, 13: 2197-2203 (1992).
Weber et al., Fundam. Appl. Toxicol., 21: 523-534 (1993).
Weber et al., Toxicology, 66: 133-144 (1991).
"Nephrotoxic" definition, Merriam-Webster online dictionay, on the world wide web at http://www.m-w.com/cgi-bin/dictionary?book=Dictionary&va=nephrotoxic, 2 pages, printed Dec. 12, 2006.
Affymetrix Rat Toxicology U34 Datasheet, released Aug. 1999.
Ahotupa et al., Carcinogenesis., 15: 863-868 (1994).
Anton et al., Cell Biochem. Biophys., 32: 27-36 (2000) Abstract only.
Berbner et al., "induction of cytochrome P450 IA and NDA damage in isolated rainbow trout (*Onchorhynchus mykiss*) hepatocytes by 2, 3, 7, 8-tetrachlorodibenzo p-dioxin," Biomarkers 4: 214-228 (1999).
Bergeron et al., Xenobiotica, 28: 303-312 (1998).
Bissig et al., "Functional expression cloning of the canalicular sulfate transport system of rat hepatocytes," J Biol Chem 269(4):3017-3021, 1994.
Boorman et al., "Toxicogenomics, Drug Discovery, and the Pathologist," Toxicologic Pathology 30(1):15-27 (2002).
Burczynski & Penning, Cancer Res., 60: 908-915 (2000) Abstract only.
Burczynski et al., Toxicol. Sci., 58: 399-415 (2000).
Burris, Hicken and Farr, Genetic Engineering News, May 1, 1999, pp. 42-43, (1999).
Cadet, et al., Synapsel, 44:211-226 (2002).
Chen et al., J. Environ. Pathol. Toxicol. Oncol., 14: 83-99 (1995) Abstract only.
Chen, et al., Mol. Carcinog. 30:79-87, (2001).
Corton et al., Biochimie., 79: 151-162 (1997).
Daniels, K., "Toxicogenomics: Database Construction, Predictive Modeling & Biomarker Discovery," U.S. Army—7th Annual Health Protection Conf. (2004) Abstract only, Albequerque, NM.
Daniels, K., "Toxicogenomics: The Application of Gene Expression in Transforming Toxicology Screening," U.S. Army Center for Health Promotion & Preventive Medicine Seminar, (2004), 53 pages.
Database Geneseq [online]; "Sindbis virus genomic cDNA PCR primer SEQ ID No. 3," Database Accession No. AAZ92894, retrieved from EBI Accession No. GSN:AAZ92894 (2000).
Davila et al., Toxicology., 57: 267-286 (1989).
Davis et al., Cancer Res., 60: 2887-2891 (2000).
Eikmans, et al., Kidney Int'l, 62:1125-1135, (2002).
Farghali et al., Methods Find. Exp. Clin. Pharmacol., 6: 449-454 (1984).
Forestier et al., Biochem. Biophys. Res. Commun., 225: 377-383 (1996).
Frazier JM, Predictive Toxicodynamics: Empirical/mechanistic approaches. Toxicology in Vitro, 1997. pp. 465-472, vol. 11.
Geiger et al., Agents Actions, 38: Spec No. C69-72 (1993).
GenBank Accession No. AA799479 (Apr. 30, 1998).
GenBank Accession No. AA891812 (Jan. 25, 1999).
GenBank Accession No. AI177366 (Jan. 20, 1999).
GenBank Accession No. L23413, Bissig et al., "*Rattus norvegicus* sulfate anion transporter (sat-1) mRNA," Apr. 12, 1994.
GenBank Accession No. L26268, Raburn et al., "*Rattus norvegicus* anti-proliferative factor (BTG1) mRNA," Jan. 26, 1996.
GenBank Accession No. M25823 (Apr. 27, 1993).
Gombar et al. Assesment of Developmental Toxicity Potential of Chemicals by Quantitative Structure-Toxicity Relationship Models, Chemosphere, 1995, vol. 31, No. 1, pp. 2499-2510.
Gomez-Lechon, et al., Toxicol. Sciences, 65:299-308, (2002).
Gooderham et al., "Molecular and genetic toxicology of 2-amino-1-methyl-6-phenylimidazo[4,5-*b*]pyridine (PhIP)," Mutation Research 506-507:91-99 (2001).
Guarner et al., Liver, 5: 35-39 (1985).
Harris et al., "Comparison of basal gene expression profiles and effects of hepatocarcinogens on gene expression in cultured primary human hepatocytes and HepG2 cells," Mutation Research 539:79-99 (2004).
Hasegawa et al., Gan To Kagaku Ryoho 30:325-333 abstract (2003).
Hassett et al., Biochem. Pharmacol., 55: 1059-1069 (1998).
Hayashi et al., Biochim. Biophys. Acta., 879: 140-148 (1986) Abstract only.
Hildebrand et al., Arch. Toxicol., 73: 233-245 (1999) Abstract only.
Hoebe et al., Vet. Q., 22: 21-25 (2000) Abstract only.
Hogstrand et al., "Application of genomics and proteomics for study of the integrated response to zinc exposure in a non-model fish species, the rainbow trout," Comparative Biochemistry and Physiology Part B 133:523-535 (2002).
Hoshi et al., Jpn. J. Pharmacol., 50: 289-293 (1989) Abstract only.
Irizarry et al. (2003), "Summaries of Affymetrix GeneChip probe level data," Nucl Acids Res 31(4):e15, 8 pp.
Jakubczak et al., An Oncolytic Adenovirus Selective for Retinoblastoma Tumor Suppressor Protein Pathway-Defective Tumors, Cancer Research, Apr. 1, 2003, vol. 63, pp. 1490-1499.
Jenner & Timbrell, Arch. Toxicol., 68: 349-357 (1994).
Jeon et al., Toxicol. Appl. Pharmacol., 144: 27-35 (1997) Abstract only.
Johnson, K., et al., "Predictive Modeling of Hepatotoxicants Using Microarrays and a Linear Discrinimant Modeling Approach," ISMB Conf., Aug. 2002, 11 pages.
Kikuchi et al., Gene Expressions and Activities of Protein Phosphatases 1 alpha, 2A and 2C in Hepatocarcinogenesis and Regeneration After Partial Hepatectomy, Cancer Detection and Prevention, 1997, vol. 21(1), pp. 36-43.
Kocarek et al., Mol. Pharmacol., 54: 474-84 (1998).
Lang et al., Alcohol Clin. Exp. Res., 22: 823-829 (1998).
Lees et al., Lipids, 30: 221-226 (1995).
Libman, et al., "What do the FDA and Pharma Companies Think of Toxicogenomics, Genotyping, and Clinical Stratification?," Robertson Stephens, Inc. Marketing Materials May, 2002; 6 pages.
Lullmann & Lullmann-Rauch, Toxicol. Appl. Pharmacol., 61: 138-146 (1981).
Mahnke et al., Arch. Biochem. Biophys., 337: 62-68 (1997).
Markovich et al., "Heavy metals mercury, cadmium, and chromium inhibit the activity if the mammalian liver and kidney sulfate transporter sat-1," Toxicol. Appl. Pharmacol. 154:181-187 (1999), Abstract only.
Martelli et al., J. Pharmacol. Exp. Ther., 273: 113-120 (1995) Abstract only.
Mino et al., J. Histochem. Cytochem., 46: 1151-1160 (1998).
Nguyen et al. (2002), "Tumor classification by partial least squares using microarray gene expression data," Bioinformatics 18(1):39-50.
Olson et al., Fundam. Appl. Toxicol., 22: 631-640 (1994) Abstract only.
Ono et al., Biol. Pharm. Bull., 18: 1779-1783 (1995) Abstract only.
Panduro et al., Nephron, 65: 100-107 (1993).
Peng et al., JBC 271(6): 3324-3327 (1996).
Porter, Mark, "Comparison of Microarray data Generated from the same RNA at 15 Different Processing Sites," Soc. Of Toxicol. Mtg. Oct. 2003, (2003) Abstract only.
Raburn et al., "Stage-specific expression of B Cell Translocation Gene 1 in rat testis," Endocrinology 136(12):5769-5777, 1995.

Raychaudhuri et al., "Basic microarray analysis: grouping and feature reduction," Trends Biotechnol. 19:189-193 (2001), Abstract only.
Rodi et al., Toxicol. Pathol., 27: 107-110 (1999).
Rusyn, et al., Cancer Research, 64: 1050-1057. (2004).
Scassa et al., Exp. Cell Res., 244: 460-469 (1998).
Schiaffonati & Tiberio, Liver, 17: 183-191 (1997).
Schilter, B. et al. Activation of cytochrome P450 gene expression in rat brain by phenobarbital-like inducers. J Pharmacol Exp Ther 294(3):916-22 (Sep. 2000).
Sèurmen & Eryèurek, Toxicology, 75: 63-69 (1992) Abstract only.
Shao, "Linear Model Selection by Cross-Validation," J. Am. Statistical Assoc. 88:486-494 (1993).
Shervington, Biochem. Mol. Biol. Int., 45: 303-313 (1998).
Shiota et al., Res. Commun. Mol. Pathol. Pharmacol., 94: 141-146 (1996).
Shultz et al., Toxicol. Appl. Pharmacol., 154: 84-96 (1999).
Sidhu & Omiecinski, J. Biochem. Mol. Toxicol., 13: 1-9 (1999).
Sidhu & Omiecinski, J. Biol. Chem., 273: 4769-4475 (1998).
Tamura et al., Toxicology, 63: 199-213 (1996).
Tao, et al., Experimental Hermatology, 31:251-260 (2003), Abstract only.
Tygstrup, et al., Biochem. And Biophys. Res. Commun., 290(1):518-525, (2002).
Uhl et al., Mutat. Res., 468: 213-225 (2000).
Wan et al., Infect. Immun. 63: 2435-2442 (1995).
Wessely, S., et al., Human & Experimental Toxicology, 18:740-764, (1999).
Woodcroft & Novak, Drug Metab. Dispos., 26: 372-378 (1998).
Xiong et al., Life Sci., 65: 421-430 (1999), Abstract only.
Yamada et al., Life Sci., 61: 171-179 (1997).
Yamaki et al., "Cellular mechanism of lithiumk-induced nephrogenic diabetes insipidus in rats," Am. J. Physiol. Renal Physiol. 261:F505-F511, (1991), Abstract only.
Agha et al., Lipid Peroxidation and Lysosomal Integrity ; 31., 279-285 (1995).
Amelsen, Jean Claude., Setting death in motion, vol., (1998).
Anderson, Steven P., Hepatic Expression of Acute-Phase Protein, 26: 226-238 (1999).
Andersson et al; Anthraquinone-induced cell injury; 135: 11-20 (1999).
Arano et al., Arzneim-Forsch./Drug, 46 : 398-400 (1996).
Choudhary G., Human Health Perspectives on Environmental., 31 : 1., 1-5 (2000).
Copenhagen et al., Journal of Hepatology; 30: 1 pg. (1999).
Database Geneseq 'Online!, "Reverse transcription primer used in cDNA analysis technique," Database Accession No. AAQ75569, retrieved from EBI Accession No. GSN:AAQ75569 (1995).
International Search Report in Applicant's corresponding PCT application, WO 02/095000 A3, published Nov. 28, 2002.
International Search Report in Applicants' PCT Application No. PCT/US01/23872, Mar. 21, 2003.
Lake et al., Hepatic Effects of Phthalate Esters and Related., 67: pp. 283-290, (1986).
Li et al., Zhonghua Gan Zang Bing Za Zhi, 9: 103ψ(2001).
Mattes, W., et al., "Cross-Species Analysis of Phenobarbital-Induced Gene Expression Changes in Dog and Rat," Soc. Of Toxicol. Mtg. 2004, (2004).
Mendrick, D. L., ToxExpress, FDA-DIA Pharmacogenomics Workshop May 2002, (2002).
Mendrick DL, Effects of Rat Gender and Strain; pub. 168 (abstract) (2004).
Mendrick 1, Cysteine Protease Inhibitor (2004).
Mendrick, Extracellular Matrix Protein Dermatopontin., (2004).
Mendrick., Chemokine (2004).
Mendrick., Lipid Transporter (2004).
Mendrick., "General Biological Findings for 80 Genes" (2004).
Mendrick, "Genomic Search for Candidate Biomarkers" (2004).
Miracle et al., The Path from Molecular Indicators of Exposure., 12 : 457-462 (2003).
Orr, M, et al. "Challenges and Limitations of Gene Expression Profiling" 60: 6-10 (2001).
Orr, Michael, "Comparison of Liver Gene Dysregulation" 21: 253-262 (2002).
Ronchetti et al., "Robust Linear Model Selection by Cross-Validation," J. Am. Statistical Assoc. 92:1017-1023 (1997).
Venturelli et al., Overexpression of DR-nm23, 92: 7435-7439 (1995).
Weisenberg-Boettcher et al., A Novelty Highly Potent, 11/12: 501-509 (1989).
Zarif et al., The Effect of A Selective 5-Lipoxygenase, vol. 20, 217-227 (1996).
Zhao Y. et al, Activation of Pro-death Bcl-2 Family, vol. 276: 27432-27440 (2001).
Zhou G., et al, Role of AMP-activated protein kinase in mechanism, 108: 1167-1174, 2001.

MOLECULAR CARDIOTOXICOLOGY MODELING

RELATED APPLICATIONS

This application is a continuation-in-part of U.S. application Ser. No. 10/191,803, filed Jul. 10, 2002, now abandoned which claims priority to U.S. Provisional Application 60/303,819 filed on Jul. 10, 2001; 60/305,623 filed on Jul. 17, 2001; 60/369,351 filed on Apr. 3, 2002; and 60/377,611 filed on May 6, 2002, all of which are herein incorporated by reference in their entirety.

This application is also related to U.S. application Ser. Nos. 09/917,800; 10/060,087; 10/152,319; and 10/301,856, entitled "Molecular Nephrotoxicology Modeling", filed on Nov. 22, 2002, all of which are also herein incorporated by reference in their entirety.

SEQUENCE LISTING SUBMISSION ON COMPACT DISC

The Sequence Listing submitted concurrently herewith on compact disc under 37 C.F.R. §§ 1.821(c) and 1.821(e) is herein incorporated by reference in its entirety. Three copies of the Sequence Listing, one on each of three compact discs are provided. Copy 1 and Copy 2 are identical. Copies 1 and 2 are also identical to the CRF. Each electronic copy of the Sequence Listing was created on Jan. 2, 2003 with a file size of 4046 KB. The file names are as follows: Copy 1—g15090us01.txt; Copy 2—g15090us01.txt; and CRF—g15090us01.txt.

BACKGROUND OF THE INVENTION

The need for methods of assessing the toxic impact of a compound, pharmaceutical agent or environmental pollutant on a cell or living organism has led to the development of procedures which utilize living organisms as biological monitors. The simplest and most convenient of these systems utilize unicellular microorganisms such as yeast and bacteria, since they are the most easily maintained and manipulated. In addition, unicellular screening systems often use easily detectable changes in phenotype to monitor the effect of test compounds on the cell. Unicellular organisms, however, are inadequate models for estimating the potential effects of many compounds on complex multicellular animals, in part because they do not have the ability to carry out biotransformations to the extent or at levels found in higher organisms.

The biotransformation of chemical compounds by multicellular organisms is a significant factor in determining the overall toxicity of agents to which they are exposed. Accordingly, multicellular screening systems may be preferred or required to detect the toxic effects of compounds. The use of multicellular organisms as toxicology screening tools has been significantly hampered, however, by the lack of convenient screening mechanisms or endpoints, such as those available in yeast or bacterial systems. In addition, previous attempts to produce toxicology prediction systems have failed to provide the necessary modeling data and statistical information to accurately predict toxic responses (e.g., WO 00/12760, WO 00/47761, WO 00/63435, WO 01/32928, and WO 01/38579).

SUMMARY OF THE INVENTION

The present invention is based, in part, on the elucidation of the global changes in gene expression in tissues or cells exposed to known toxins, in particular cardiotoxins, as compared to unexposed tissues or cells as well as the identification of individual genes that are differentially expressed upon toxin exposure.

In various aspects, the invention includes methods of predicting at least one toxic effect of a compound, predicting the progression of a toxic effect of a compound, and predicting the cardiotoxicity of a compound. The invention also includes methods of identifying agents that modulate the onset or progression of a toxic response. Also provided are methods of predicting the cellular pathways that a compound modulates in a cell. The invention also includes methods of identifying agents that modulate protein activities.

In a further aspect, the invention includes probes comprising sequences that specifically hybridize to genes in Tables 1-5LL. Also included are solid supports comprising at least two of the previously mentioned probes. The invention also includes a computer system that has a database containing information identifying the expression level in a tissue or cell sample exposed to a cardiotoxin of a set of genes comprising at least two genes in Tables 1-5LL.

The invention further provides a core set of genes in Tables 5A-5LL from which probes can be made and attached to solid supports. These core genes serve as a preferred set of markers of cardiotoxicity and can be used with the methods of the invention to predict or monitor a toxic effect of a compound or to modulate the onset or progression of a toxic response.

DETAILED DESCRIPTION

Many biological functions are accomplished by altering the expression of various genes through transcriptional (e.g. through control of initiation, provision of RNA precursors, RNA processing, etc.) and/or translational control. For example, fundamental biological processes such as cell cycle, cell differentiation and cell death are often characterized by the variations in the expression levels of groups of genes.

Changes in gene expression are also associated with the effects of various chemicals, drugs, toxins, pharmaceutical agents and pollutants on an organism or cell(s). For example, the lack of sufficient expression of functional tumor suppressor genes and/or the over-expression of oncogene/protooncogenes after exposure to an agent could lead to tumorgenesis or hyperplastic growth of cells (Marshall (1991), *Cell* 64: 313-326; Weinberg (1991), *Science* 254: 1138-1146). Thus, changes in the expression levels of particular genes (e.g. oncogenes or tumor suppressors) may serve as signposts for the presence and progression of toxicity or other cellular responses to exposure to a particular compound.

Monitoring changes in gene expression may also provide certain advantages during drug screening and development. Often drugs are screened for the ability to interact with a major target without regard to other effects the drugs have on cells. These cellular effects may cause toxicity in the whole animal, which prevents the development and clinical use of the potential drug.

The present inventors have examined heart tissue from animals exposed to known cardiotoxins which induce detrimental heart effects, to identify global changes in gene expression and individual changes in gene expression induced by these compounds (Table 5-5LL). These global changes in gene expression, which can be detected by the production of expression profiles (an expression level of one or more genes), provide useful toxicity markers that can be used to monitor toxicity and/or toxicity progression by a test compound. Some of these markers may also be used to monitor or detect various disease or physiological states, disease progression, drug efficacy and drug metabolism.

Identification of Toxicity Markers

To evaluate and identify gene expression changes that are predictive of toxicity, studies using selected compounds with well characterized toxicity have been conducted by the present inventors to catalogue altered gene expression during exposure in vivo. In the present study, cyclophosphamide, ifosfamide, minoxidil, hydralazine, BI-QT, clenbuterol, isoproterenol, norepinephrine, epinephrine, adriamycin, amphotericin B, epirubicin, phenylpropanolamine, and rosiglitazone were selected as known cardiotoxins. Cisplatin, PAN, dopamine, acyclovir, carboplatin, etoposide, temozolomide, and vancomycin were selected as negative controls.

Cyclophosphamide, an alkylating agent, is highly toxic to dividing cells and is commonly used in chemotherapy to treat non-Hodgkin's lymphomas, Burkitt's lymphoma and carcinomas of the lung, breast, and ovary (*Goodman & Gilman's The Pharmacological Basis of Therapeutics* $9^{th}$ ed., p. 1234, 1237-1239, J. G. Hardman et al., Eds., McGraw Hill, New York, 1996). Additionally, cyclophosphamide is used as an immunosuppressive agent in bone marrow transplantation and following organ transplantation. Though cyclophosphamide is therapeutically useful, it is also associated with cardiotoxicity, nephrotoxicity, and hemorrhagic cystitis. Once in the liver, cyclophosphamide is hydroxylated by the cytochrome P450 mixed function oxidase system. The active metabolites, phosphoramide mustard and acrolein, cross-link DNA and cause growth arrest and cell death. Acrolein has been shown to decrease cellular glutathione levels (Dorr and Lagel (1994), *Chem Biol Interact* 93: 117-128).

The cardiotoxic effects of cyclophosphamide have been partially elucidated. One study analyzed plasma levels in 19 women with metastatic breast carcinoma who had been treated with cyclophosphamide, thiotepa, and carboplatin (Ayash et al. (1992), *J Clin Oncol* 10: 995-1000). Of the 19 women in the study, six developed moderate congestive heart failure. In another case study, a 10-year old boy, who had been treated with high-dose cyclophosphamide, developed cardiac arrhythmias and intractable hypotension (Tsai et al. (1990), *Am J Pediatr Hematol Oncol* 12: 472-476). The boy died 23 days after the transplantation.

Another clinical study examined the relationship between the amount of cyclophosphamide administered and the development of cardiotoxicity (Goldberg et al. (1986), *Blood* 68: 1114-1118). When the cyclophosphamide dosage was $\leq 1.55$ g/m$^2$/d, only 1 out of 32 patients had symptoms consistent with cyclophosphamide cardiotoxicity. Yet when the dosage was greater than 1.55 g/m$^2$/d, 13 out of 52 patients were symptomatic. Six of the high-dose patients died of congestive heart failure.

In a related study, Braverman et al. compared the effects of once daily low-dose administration of cyclophosphamide (87+/−11 mg/kg) and twice-daily high-dose treatment (174+/−34 mg/kg) on bone marrow transplantation patients (Braverman et al. (1991), *J Clin Oncol* 9: 1215-1223). Within a week, the high-dose patients had an increase in left ventricular mass index. Out of five patients who developed clinical cardiotoxicity, four were in the high-dose group.

Ifosfamide, an oxazaphosphorine, is an analog of cyclophosphamide. Whereas cyclophosphamide has two chloroethyl groups on the exocyclic nitrogen, ifosfamide contains one chloroethyl group on the ring nitrogen and the other on the exocyclic nitrogen. Ifosfamide is a nitrogen mustard and alkylating agent, commonly used in chemotherapy to treat testicular, cervical, and lung cancer, as well as sarcomas and lymphomas. Like cyclophosphamide, it is activated in the liver by hydroxylation, but it reacts more slowly and produces more dechlorinated metabolites and chloroacetaldehyde. Comparatively higher doses of ifosfamide are required to match the efficacy of cyclophosphamide.

Alkylating agents can cross-link DNA, resulting in growth arrest and cell death. Despite its therapeutic value, ifosfamide is associated with nephrotoxicity (affecting the proximal and distal renal tubules), urotoxicity, venooclusive disease, myelosuppression, pulmonary fibrosis and central neurotoxicity (*Goodman & Gilman's The Pharmacological Basis of Therapeutics* $9^{th}$ ed., p. 1234-1240, J. G. Hardman et al., Eds., McGraw Hill, New York, 1996). Ifosfamide can also cause acute severe heart failure and malignant ventricular arrhythmia, which may be reversible. Death from cardiogenic shock has also been reported (*Cecil Textbook of Medicine* $20^{th}$ ed., Bennett et al. eds., p. 331, W. B. Saunders Co., Philadelphia, 1996).

Studies of patients with advanced or resistant lymphomas or carcinomas showed that high-dose ifosfamide treatment produced various symptoms of cardiac disease, including dyspnea, tachycardia, decreased left ventricular contractility and malignant ventricular arrhythmia (Quezado et al. (1993), *Ann Intern Med* 118: 31-36; Wilson et al. (1992), *J Clin Oncol* 19: 1712-1722). Other patient studies have noted that ifosfamide-induced cardiac toxicity may be asymptomatic, although it can be detected by electrocardiogram and should be monitored (Pai et al. (2000), *Drug Saf* 22: 263-302).

Minoxidil is an antihypertensive medicinal agent used in the treatment of high blood pressure. It works by relaxing blood vessels so that blood may pass through them more easily, thereby lowering blood pressure. By applying minoxidil to the scalp, it has recently been shown to be effective at combating hair loss by stimulating hair growth. Once minoxidil is metabolized by hepatic sulfotransferase, it is converted to the active molecule minoxidil N—O sulfate (*Goodman & Gilman's The Pharmacological Basis of Therapeutics* $9^{th}$ ed., pp. 796-797, J. G. Hardman et al., Eds., McGraw Hill, New York, 1996). The active minoxidil sulfate stimulates the ATP-modulated potassium channel consequently causing hyperpolarization and relaxation of smooth muscle. Early studies on minoxidil demonstrated that following a single dose of the drug, patients suffering from left ventricular failure exhibited a slightly increased heart rate, a fall in the mean arterial pressure, a fall in the systemic vascular resistance, and a slight increase in cardiac index (Franciosa and Cohn (1981) *Circulation* 63: 652-657).

Some common side effects associated with minoxidil treatment are an increase in hair growth, weight gain, and a fast or irregular heartbeat. More serious side effects are numbness of the hands, feet, or face, chest pain, shortness of breath, and swelling of the feet or lower legs. Because of the risks of fluid retention and reflex cardiovascular effects, minoxidil is often given concomitantly with a diuretic and a sympatholytic drug.

While minoxidil is effective at lowering blood pressure, it does not lead to a regression of cardiac hypertrophy. To the contrary, minoxidil has been shown to cause cardiac enlargement when administered to normotensive animals (Moravec et al. (1994) *J Pharmacol Exp Ther* 269: 290-296). Moravec et al. examined normotensive rats that had developed myocardial hypertrophy following treatment with minoxidil. The authors found that minoxidil treatment led to enlargement of the left ventricle, right ventricle, and interventricular septum.

Another rat study investigated the age- and dose-dependency of minoxidil-induced cardiotoxicity (Herman et al. (1996) *Toxicology* 110: 71-83). Rats ranging in age from 3 months to 2 years were given varying amounts of minoxidil over the period of two days. The investigators observed interstitial hemorrhages at all dose levels, however the hemorrhages were more frequent and severe in the older animals. The 2 year old rats had vascular lesions composed of arteriolar damage and calcification.

Hydralazine, an antihypertensive drug, causes relaxation of arteriolar smooth muscle. Such vasodilation is linked to vigorous stimulation of the sympathetic nervous system, which in turn leads to increased heart rate and contractility, increased plasma renin activity, and fluid retention (*Goodman & Gilman's The Pharmacological Basis of Therapeutics* 9th ed., p. 794, J. G. Hardman et al., Eds., McGraw Hill, New York, 1996). The increased renin activity leads to an increase in angiotensin II, which in turn causes stimulation of aldosterone and sodium reabsorption.

Hydralazine is used for the treatment of high blood pressure (hypertension) and for the treatment of pregnant women suffering from high blood pressure (pre-eclampsia or eclampsia). Some common side effects associated with hydralazine use are diarrhea, rapid heartbeat, headache, decreased appetite, and nausea. Hydralazine is often used concomitantly with drugs that inhibit sympathetic activity to combat the mild pulmonary hypertension that can be associated with hydralazine usage.

In one hydralazine study, rats were given one of five cardiotoxic compounds (isoproterenol, hydralazine, caffeine, cyclophosphamide, or adriamycin) by intravenous injection (Kemi et al. (1996), *J Vet Med Sci* 58: 699-702). At one hour and four hours post-dose, early focal myocardial lesions were observed histopathologically. Lesions were observed in the rats treated with hydralazine four hours post-dose. The lesions were found in the inner one third of the left ventricular walls including the papillary muscles.

Another study compared the effects of isoproterenol, hydralazine and minoxidil on young and mature rats (Hanton et al. (1991), *Res Commun Chem Pathol Pharmacol* 71: 231-234). Myocardial necrosis was observed in both age groups, but it was more severe in the mature rats. Hypotension and reflex tachycardia were also seen in the hydralazine-treated rats.

BI-QT has been shown to induce QC prolongation in dogs and liver alterations in rats. Over a four week period, dogs treated with BI-QT exhibited sedation, decreased body weight, increased liver weight, and slightly increased levels of AST, ALP, and BUN. After three months of treatment, the dogs exhibited signs of cardiovascular effects.

Clenbuterol, a $\beta 2$ adrenergic agonist, can be used therapeutically as a bronchial dilator for asthmatics. It also has powerful muscle anabolic and lipolytic effects. It has been banned in the United States but continues to be used illegally by athletes to increase muscle growth. In a number of studies, rats treated with clenbuterol developed hypertrophy of the heart and latissimus dorsi muscle (Doheny et al. (1998), *Amino Acids* 15: 13-25; Murphy et al. (1999), *Proc Soc Exp Biol Med* 221: 184-187; Petrou et al. (1995), *Circulation* 92:11483-11489).

In one study, mares treated with therapeutic levels of clenbuterol were compared to mares that were exercised and mares in a control group (Sleeper et al. (2002), *Med Sci Sports Exerc* 34: 643-650). The clenbuterol-treated mares demonstrated significantly higher left ventricular internal dimension and interventricular septal wall thickness at end diastole. In addition, the clenbuterol-treated mares had significantly increased aortic root dimensions, which could lead to an increased chance of aortic rupture.

In another study, investigators reported a case of acute clenbuterol toxicity in a human (Hoffman et al. (2001), *J Toxicol* 39: 339-344). A 28-year old woman had ingested a small quantity of clenbuterol, and the patient developed sustained sinus tachycardia, hypokalemia, hypophosphatemia, and hypomagnesemia.

Catecholamines are neurotransmitters that are synthesized in the adrenal medulla and in the sympathetic nervous system. Epinephrine, norepinephrine, and isoproterenol are members of the catecholamine sympathomimetic amine family (*Casarett & Doull's Toxicology, The Basic Science of Poisons* 6th ed., p. 618-619, C. D. Klaassen, Ed., McGraw Hill, New York, 2001). They are chemically similar by having an aromatic portion (catechol) to which is attached an amine, or nitrogen-containing group.

Isoproterenol, an antiarrhythmic agent, is used therapeutically as a bronchodilator for the treatment of asthma, chronic bronchitis, emphysema, and other lung diseases. Some side effects of usage are myocardial ischemia, arrhythmias, angina, hypertension, and tachycardia. As a $\beta$ receptor agonist, isoproterenol exerts direct positive inotropic and chronotropic effects. Peripheral vascular resistance is decreased along with the pulse pressure and mean arterial pressure. However, the heart rate increases due to the decrease in the mean arterial pressure.

Norepinephrine, an $\alpha$ and $\beta$ receptor agonist, is also known as noradrenaline. It is involved in behaviors such as attention and general arousal, stress, and mood states. By acting on $\beta$-1 receptors, it causes increased peripheral vascular resistance, pulse pressure and mean arterial pressure. Reflex bradycardia occurs due to the increase in mean arterial pressure. Some contraindications associated with norepinephrine usage are myocardial ischemia, premature ventricular contractions (PVCs), and ventricular tachycardia.

Epinephrine, a potent $\alpha$ and $\beta$ adrenergic agonist, is used for treating bronchoconstriction and hypotension resulting from anaphylaxis as well as all forms of cardiac arrest. Injection of epinephrine leads to an increase in systolic pressure, ventricular contractility, and heart rate. Some side effects associated with epinephrine usage are cardiac arrhythmias, particularly PVCs, ventricular tachycardia, renal vascular ischemia, increased myocardial oxygen requirements, and hypokalemia.

Anthracyclines are antineoplastic agents used commonly for the treatment of breast cancer, leukemias, and a variety of other solid tumors. However, the usefulness of the drugs are limited due dose-dependent cardiomyopathy and ECG changes (*Casarett & Doull's Toxicology, The Basic Science of Poisons* 6th ed., p. 619, C. D. Klaassen, Ed., McGraw Hill, New York, 2001).

Adriamycin (doxorubicin) is a cytotoxic anthracycline antiobiotic that inhibits the action of topoisomerase II. It has a wide spectrum of antitumor activity, however dose-related cardiotoxicity is a major side effect. The toxic effects are most likely due to the generation of free radicals (DeAtley et al. (1999), *Toxicology* 134: 51-62). In one study, rats were given a dose of either adriamycin alone or a dose of adriamycin following a dose of captopril (al-Shabanah et al. (1998), *Biochem Mol Biol Int* 45: 419-427). Those rats that were only given adriamycin developed myocardial toxicity after 24 hours manifested biochemically by an elevation of serum enzymes such as aspartate transaminase, lactate dehydrogenase, and creatine phosphokinase. The rats that were pretreated with captopril exhibited a significant reduction in serum enzyme levels as well as restoration of white blood cell counts.

Epirubicin is a semisynthetic derivative of daunorubicin, an anthracycline, approved for the treatment of breast cancer (*Casarett & Doull's Toxicology The Basic Science of Poisons*

6th ed., p. 619, C. D. Klaassen, Ed., McGraw Hill, New York, 2001). Yet, it, too, may induce cardiotoxicity. In one observational study, 120 patients with advanced breast cancer were followed before, during, and after treatment with epirubicin (Jensen et al. (2002), *Ann Oncol* 13: 699-709). Approximately 59% of the patients experienced a 25% relative reduction in left ventricular ejection fraction three years after epirubicin treatment, and of these patients 20% had deteriorated into having congestive heart failure.

Amphotericin B is a polyene, antifungal antibiotic used to treat fungal infections. Its clinical utility is limited by its nephrotoxicity and cardiotoxicity. Amphotericin B may depress myocardial contractility by blocking activation of slow calcium channels and inhibiting the influx of sodium ions (*Casarett & Doull's Toxicology The Basic Science of Poisons* 6th ed., p. 621, C. D. Klaassen, Ed., McGraw Hill, New York, 2001). It has been shown to increase the permeability of the sarcolemmal membrane, and patients given amphotericin B have developed ventricular tachycardia and cardiac arrest. This drug has been shown to induce cardiac arrest in rats as well. In the current study, amphotericin B led to an increase in serum Troponin T levels and some early signs of cardiomyopathy within 24 hours of one intravenous bolus injection.

Phenylpropanolamine was used in over-the-counter decongestants until recently, but was withdrawn when its association with cardiac deaths became known. It is both a beta-1 and alpha adrenergic receptor agonist and has been shown to induce cardiotoxicity in rats. In one rat study, phenylpropanolamine was shown to cause myocardial contractile depression without altering global coronary artery blood flow (Zaloga et al. (2000), *Crit Care Med* 28: 3679-3683).

In another study, rats were given single intraperitoneal doses of 1, 2, 4, 8, 16, or 32 mg/kg of phenylpropanolamine (Pentel et al. (1987), *Fundam Appl Toxicol* 9: 167-172). The animals exhibited dose-dependent increased blood pressure and, following termination, myocardial necrosis.

Rosiglitazone (Avandia) is a thiazolidinedione medication used to treat Type 2 diabetes. It reduces plasma glucose levels and glucose production and increases glucose clearance (Wagstaff and Goa (2002), *Drugs* 62: 1805-1837). Some side effects associated with rosiglitazone treatment are fluid retention, congestive heart failure, and liver disease. In patients who have heart failure or use insulin, there is a potential for mild-to-moderate peripheral edema with rosiglitazone treatment. It has been shown that patients that do not have heart failure or use insulin can also develop moderate-to-severe edema while using rosiglitazone (Niemeyer and Janney (2002), *Pharmacotherapy* 22: 924-929).

Toxicity Prediction and Modeling

The genes and gene expression information, gene expression profiles, as well as the portfolios and subsets of the genes provided in Tables 1-5LL, such as the core toxicity markers in Tables 5A-5LL, may be used to predict at least one toxic effect, including the cardiotoxicity of a test or unknown compound. As used herein, at least one toxic effect includes, but is not limited to, a detrimental change in the physiological status of a cell or organism. The response may be, but is not required to be, associated with a particular pathology, such as tissue necrosis, myocarditis, arrhythmias, tachycardia, myocardial ischemia, angina, hypertension, hypotension, dyspnea, and cardiogenic shock. Accordingly, the toxic effect includes effects at the molecular and cellular level. Cardiotoxicity is an effect as used herein and includes but is not limited to the pathologies of tissue necrosis, myocarditis, arrhythmias, tachycardia, myocardial ischemia, angina, hypertension, hypotension, dyspnea, and cardiogenic shock. As used herein, a gene expression profile comprises any representation, quantitative or not, of the expression of at least one mRNA species in a cell sample or population and includes profiles made by various methods such as differential display, PCR, hybridization analysis, etc.

In general, assays to predict the toxicity or cardiotoxicity of a test agent (or compound or multi-component composition) comprise the steps of exposing a cell population to the test compound, assaying or measuring the level of relative or absolute gene expression of one or more of the genes in Tables 1-5LL and comparing the identified expression level(s) to the expression levels disclosed in the Tables and database(s) disclosed herein. Assays may include the measurement of the expression levels of about 2, 3, 4, 5, 6, 7, 8, 9, 10, 15, 20, 25, 30, 50, 75, 100 or more genes from Tables 1-5LL to create multi-gene expression profiles.

In the methods of the invention, the gene expression level for a gene or genes induced by the test agent, compound or compositions may be comparable to the levels found in the Tables or databases disclosed herein if the expression level varies within a factor of about 2, about 1.5 or about 1.0 fold. In some cases, the expression levels are comparable if the agent induces a change in the expression of a gene in the same direction (e.g., up or down) as a reference toxin.

The cell population that is exposed to the test agent, compound or composition may be exposed in vitro or in vivo. For instance, cultured or freshly isolated heart cells, in particular rat heart cells, may be exposed to the agent under standard laboratory and cell culture conditions. In another assay format, in vivo exposure may be accomplished by administration of the agent to a living animal, for instance a laboratory rat.

Procedures for designing and conducting toxicity tests in in vitro and in vivo systems are well known, and are described in many texts on the subject, such as Loomis et al., *Loomis's Essentials of Toxicology* 4th Ed., Academic Press, New York, 1996; Echobichon, *The Basics of Toxicity Testing*, CRC Press, Boca Raton, 1992; Frazier, editor, *In Vitro Toxicity Testing*, Marcel Dekker, New York, 1992; and the like.

In in vitro toxicity testing, two groups of test organisms are usually employed: one group serves as a control and the other group receives the test compound in a single dose (for acute toxicity tests) or a regimen of doses (for prolonged or chronic toxicity tests). Because, in some cases, the extraction of tissue as called for in the methods of the invention requires sacrificing the test animal, both the control group and the group receiving compound must be large enough to permit removal of animals for sampling tissues, if it is desired to observe the dynamics of gene expression through the duration of an experiment.

In setting up a toxicity study, extensive guidance is provided in the literature for selecting the appropriate test organism for the compound being tested, route of administration, dose ranges, and the like. Water or physiological saline (0.9% NaCl in water) is the solute of choice for the test compound since these solvents permit administration by a variety of routes. When this is not possible because of solubility limitations, vegetable oils such as corn oil or organic solvents such as propylene glycol may be used.

Regardless of the route of administration, the volume required to administer a given dose is limited by the size of the animal that is used. It is desirable to keep the volume of each dose uniform within and between groups of animals. When rats or mice are used, the volume administered by the oral route generally should not exceed about 0.005 ml per gram of animal. Even when aqueous or physiological saline solutions are used for parenteral injection, the volumes that are tolerated are limited, although such solutions are ordinarily thought of as being innocuous. The intravenous $LD_{50}$ of distilled water in the mouse is approximately 0.044 ml per gram and that of isotonic saline is 0.068 ml per gram of mouse. In some instances, the route of administration to the test animal should be the same as, or as similar as possible to, the route of administration of the compound to man for therapeutic purposes.

When a compound is to be administered by inhalation, special techniques for generating test atmospheres are necessary. The methods usually involve aerosolization or nebulization of fluids containing the compound. If the agent to be tested is a fluid that has an appreciable vapor pressure, it may be administered by passing air through the solution under controlled temperature conditions. Under these conditions, dose is estimated from the volume of air inhaled per unit time, the temperature of the solution, and the vapor pressure of the agent involved. Gases are metered from reservoirs. When particles of a solution are to be administered, unless the particle size is less than about 2 µm the particles will not reach the terminal alveolar sacs in the lungs. A variety of apparatuses and chambers are available to perform studies for detecting effects of irritant or other toxic endpoints when they are administered by inhalation. The preferred method of administering an agent to animals is via the oral route, either by intubation or by incorporating the agent in the feed.

When the agent is exposed to cells in vitro or in cell culture, the cell population to be exposed to the agent may be divided into two or more subpopulations, for instance, by dividing the population into two or more identical aliquots. In some preferred embodiments of the methods of the invention, the cells to be exposed to the agent are derived from heart tissue. For instance, cultured or freshly isolated rat heart cells may be used.

The methods of the invention may be used generally to predict at least one toxic response, and, as described in the Examples, may be used to predict the likelihood that a compound or test agent will induce various specific heart pathologies, such as tissue necrosis, myocarditis, arrhythmias, tachycardia, myocardial ischemia, angina, hypertension, hypotension, dyspnea, cardiogenic shock, or other pathologies associated with at least one of the toxins herein described. The methods of the invention may also be used to determine the similarity of a toxic response to one or more individual compounds. In addition, the methods of the invention may be used to predict or elucidate the potential cellular pathways influenced, induced or modulated by the compound or test agent due to the similarity of the expression profile compared to the profile induced by a known toxin (see Tables 5-5LL).

Diagnostic Uses for the Toxicity Markers

As described above, the genes and gene expression information or portfolios of the genes with their expression information as provided in Tables 1-5LL may be used as diagnostic markers for the prediction or identification of the physiological state of a tissue or cell sample that has been exposed to a compound or to identify or predict the toxic effects of a compound or agent. For instance, a tissue sample such as a sample of peripheral blood cells or some other easily obtainable tissue sample may be assayed by any of the methods described above, and the expression levels from a gene or genes from Tables 5-5LL may be compared to the expression levels found in tissues or cells exposed to the toxins described herein. These methods may result in the diagnosis of a physiological state in the cell, may be used to diagnose toxin exposure or may be used to identify the potential toxicity of a compound, for instance a new or unknown compound or agent that the subject has been exposed to. The comparison of expression data, as well as available sequence or other information may be done by researcher or diagnostician or may be done with the aid of a computer and databases as described below.

In another format, the levels of a gene(s) of Tables 5-5LL, its encoded protein(s), or any metabolite produced by the encoded protein may be monitored or detected in a sample, such as a bodily tissue or fluid sample to identify or diagnose a physiological state of an organism. Such samples may include any tissue or fluid sample, including urine, blood and easily obtainable cells such as peripheral lymphocytes.

Use of the Markers for Monitoring Toxicity Progression

As described above, the genes and gene expression information provided in Tables 5-5LL may also be used as markers for the monitoring of toxicity progression, such as that found after initial exposure to a drug, drug candidate, toxin, pollutant, etc. For instance, a tissue or cell sample may be assayed by any of the methods described above, and the expression levels from a gene or genes from Tables 5-5LL may be compared to the expression levels found in tissue or cells exposed to the cardiotoxins described herein. The comparison of the expression data, as well as available sequence or other information may be done by a researcher or diagnostician or may be done with the aid of a computer and databases.

Use of the Toxicity Markers for Drug Screening

According to the present invention, the genes identified in Tables 1-5LL may be used as markers or drug targets to evaluate the effects of a candidate drug, chemical compound or other agent on a cell or tissue sample. The genes may also be used as drug targets to screen for agents that modulate their expression and/or activity. In various formats, a candidate drug or agent can be screened for the ability to stimulate the transcription or expression of a given marker or markers or to down-regulate or counteract the transcription or expression of a marker or markers. According to the present invention, one can also compare the specificity of a drug's effects by looking at the number of markers which the drug induces and comparing them. More specific drugs will have less transcriptional targets. Similar sets of markers identified for two drugs may indicate a similarity of effects.

Assays to monitor the expression of a marker or markers as defined in Tables 1-5LL may utilize any available means of monitoring for changes in the expression level of the nucleic acids of the invention. As used herein, an agent is said to modulate the expression of a nucleic acid of the invention if it is capable of up- or down-regulating expression of the nucleic acid in a cell.

In one assay format, gene chips containing probes to one, two or more genes from Tables 1-5LL may be used to directly monitor or detect changes in gene expression in the treated or exposed cell. Cell lines, tissues or other samples are first exposed to a test agent and in some instances, a known toxin, and the detected expression levels of one or more, or preferably 2 or more of the genes of Tables 1-5LL are compared to the expression levels of those same genes exposed to a known toxin alone. Compounds that modulate the expression patterns of the known toxin(s) would be expected to modulate potential toxic physiological effects in vivo. The genes in Tables 1-5LL are particularly appropriate markers in these assays as they are differentially expressed in cells upon exposure to a known cardiotoxin. Tables 1 and 2 disclose those genes that are differentially expressed upon exposure to the named toxins and their corresponding GenBank Accession numbers. Table 3 discloses the human homologues and the corresponding GenBank Accession numbers of the differentially expressed genes of Tables 1 and 2.

In another format, cell lines that contain reporter gene fusions between the open reading frame and/or the transcriptional regulatory regions of a gene in Tables 1-5LL and any assayable fusion partner may be prepared. Numerous assayable fusion partners are known and readily available including the firefly luciferase gene and the gene encoding chloramphenicol acetyltransferase (Alam et al. (1990), *Anal Biochem* 188: 245-254). Cell lines containing the reporter gene fusions are then exposed to the agent to be tested under appropriate conditions and time. Differential expression of the reporter gene between samples exposed to the agent and control samples identifies agents which modulate the expression of the nucleic acid.

Additional assay formats may be used to monitor the ability of the agent to modulate the expression of a gene identified in Tables 5-5LL. For instance, as described above, mRNA expression may be monitored directly by hybridization of probes to the nucleic acids of the invention. Cell lines are exposed to the agent to be tested under appropriate conditions and time, and total RNA or mRNA is isolated by standard procedures such those disclosed in Sambrook et al. (*Molecular Cloning: A Laboratory Manual. 2nd Ed.,* Cold Spring Harbor Laboratory Press, Cold Spring Harbor, N.Y., 1989).

In another assay format, cells or cell lines are first identified which express the gene products of the invention physiologically. Cells and/or cell lines so identified would be expected to comprise the necessary cellular machinery such that the fidelity of modulation of the transcriptional apparatus is maintained with regard to exogenous contact of agent with appropriate surface transduction mechanisms and/or the cytosolic cascades. Further, such cells or cell lines may be transduced or transfected with an expression vehicle (e.g., a plasmid or viral vector) construct comprising an operable non-translated 5'-promoter containing end of the structural gene encoding the gene products of Tables 1-5LL fused to one or more antigenic fragments or other detectable markers, which are peculiar to the instant gene products, wherein said fragments are under the transcriptional control of said promoter and are expressed as polypeptides whose molecular weight can be distinguished from the naturally occurring polypeptides or may further comprise an immunologically distinct or other detectable tag. Such a process is well known in the art (see Sambrook et al., supra).

Cells or cell lines transduced or transfected as outlined above are then contacted with agents under appropriate conditions; for example, the agent comprises a pharmaceutically acceptable excipient and is contacted with cells comprised in an aqueous physiological buffer such as phosphate buffered saline (PBS) at physiological pH, Eagles balanced salt solution (BSS) at physiological pH, PBS or BSS comprising serum or conditioned media comprising PBS or BSS and/or serum incubated at 37° C. Said conditions may be modulated as deemed necessary by one of skill in the art. Subsequent to contacting the cells with the agent, said cells are disrupted and the polypeptides of the lysate are fractionated such that a polypeptide fraction is pooled and contacted with an antibody to be further processed by immunological assay (e.g., ELISA, immunoprecipitation or Western blot). The pool of proteins isolated from the "agent-contacted" sample is then compared with the control samples (no exposure and exposure to a known toxin) where only the excipient is contacted with the cells and an increase or decrease in the immunologically generated signal from the "agent-contacted" sample compared to the control is used to distinguish the effectiveness and/or toxic effects of the agent.

Use of Toxicity Markers to Identify Agents that Modulate Protein Activity or Levels Another embodiment of the present invention provides methods for identifying agents that modulate at least one activity of a protein(s) encoded by the genes in Tables 1-5LL. Such methods or assays may utilize any means of monitoring or detecting the desired activity.

In one format, the relative amounts of a protein (Tables 1-5LL) between a cell population that has been exposed to the agent to be tested compared to an unexposed control cell population and a cell population exposed to a known toxin may be assayed. In this format, probes such as specific antibodies are used to monitor the differential expression of the protein in the different cell populations. Cell lines or populations are exposed to the agent to be tested under appropriate conditions and time. Cellular lysates may be prepared from the exposed cell line or population and a control, unexposed cell line or population. The cellular lysates are then analyzed with the probe, such as a specific antibody.

Agents that are assayed in the above methods can be randomly selected or rationally selected or designed. As used herein, an agent is said to be randomly selected when the agent is chosen randomly without considering the specific sequences involved in the association of a protein of the invention alone or with its associated substrates, binding partners, etc. An example of randomly selected agents is the use a chemical library or a peptide combinatorial library, or a growth broth of an organism.

As used herein, an agent is said to be rationally selected or designed when the agent is chosen on a nonrandom basis which takes into account the sequence of the target site and/or its conformation in connection with the agent's action. Agents can be rationally selected or rationally designed by utilizing the peptide sequences that make up these sites. For example, a rationally selected peptide agent can be a peptide whose amino acid sequence is identical to or a derivative of any functional consensus site.

The agents of the present invention can be, as examples, peptides, small molecules, vitamin derivatives, as well as carbohydrates. Dominant negative proteins, DNAs encoding these proteins, antibodies to these proteins, peptide fragments of these proteins or mimics of these proteins may be introduced into cells to affect function. "Mimic" as used herein refers to the modification of a region or several regions of a peptide molecule to provide a structure chemically different from the parent peptide but topographically and functionally similar to the parent peptide (see G. A. Grant in: *Molecular Biology and Biotechnology,* Meyers, ed., pp. 659-664, VCH Publishers, New York, 1995). A skilled artisan can readily recognize that there is no limit as to the structural nature of the agents of the present invention.

Nucleic Acid Assay Formats

As previously discussed, the genes identified as being differentially expressed upon exposure to a known cardiotoxin (Tables 1-5LL) may be used in a variety of nucleic acid detection assays to detect or quantify the expression level of a gene or multiple genes in a given sample. The genes described in Tables 1-5LL may also be used in combination with one or more additional genes whose differential expression is associate with toxicity in a cell or tissue. In preferred embodiments, the genes in Tables 5-5LL may be combined with one or more of the genes described in prior and related application 60/303,819 filed on Jul. 10, 2001; 60/305,623 filed on Jul. 17, 2001; 60/369,351 filed on Apr. 3, 2002; and 60/377,611 filed on May 6, 2002; Ser. Nos. 09/917,800; 10/060,087; 10/152,319; 10/191,803, and 10/301,856, entitled "Molecular Nephrotoxicology Modeling" filed on Nov. 22, 2002, all of which are incorporated by reference.

Any assay format to detect gene expression may be used. For example, traditional Northern blotting, dot or slot blot, nuclease protection, primer directed amplification, RT-PCR, semi- or quantitative PCR, branched-chain DNA and differential display methods may be used for detecting gene expression levels. Those methods are useful for some embodiments of the invention. In cases where smaller numbers of genes are detected, amplification based assays may be most efficient. Methods and assays of the invention, however, may be most efficiently designed with hybridization-based methods for detecting the expression of a large number of genes.

Any hybridization assay format may be used, including solution-based and solid support-based assay formats. Solid supports containing oligonucleotide probes for differentially expressed genes of the invention can be filters, polyvinyl chloride dishes, particles, beads, microparticles or silicon or glass based chips, etc. Such chips, wafers and hybridization methods are widely available, for example, those disclosed by Beattie (WO 95/11755).

Any solid surface to which oligonucleotides can be bound, either directly or indirectly, either covalently or non-covalently, can be used. A preferred solid support is a high density array or DNA chip. These contain a particular oligonucleotide probe in a predetermined location on the array. Each predetermined location may contain more than one molecule of the probe, but each molecule within the predetermined location has an identical sequence. Such predetermined locations are termed features. There may be, for example, from 2, 10, 100, 1000 to 10,000, 100,000, 400,000 or 1,000,000 or more of such features on a single solid support. The solid support, or the area within which the probes are attached may be on the order of about a square centimeter. Probes corresponding to the genes of Tables 5-5LL or from the related applications described above may be attached to single or multiple solid support structures, e.g., the probes may be attached to a single chip or to multiple chips to comprise a chip set.

Oligonucleotide probe arrays for expression monitoring can be made and used according to any techniques known in the art (see for example, Lockhart et al. (1996), *Nat Biotechnol* 14: 1675-1680; McGall et al. (1996), *Proc Nat Acad Sci USA* 93: 13555-13460). Such probe arrays may contain at least two or more oligonucleotides that are complementary to or hybridize to two or more of the genes described in Tables 5-5LL. For instance, such arrays may contain oligonucleotides that are complementary to or hybridize to at least 2, 3, 4, 5, 6, 7, 8, 9, 10, 20, 30, 50, 70, 100 or more of the genes described herein. Preferred arrays contain all or nearly all of the genes listed in Tables 1-5LL, or individually, the gene sets of Tables 5-5LL. In a preferred embodiment, arrays are constructed that contain oligonucleotides to detect all or nearly all of the genes in any one of or all of Tables 1-5LL on a single solid support substrate, such as a chip.

The sequences of the expression marker genes of Tables 1-5LL are in the public databases. Table 1 provides the GenBank Accession Number for each of the sequences as well as a corresponding SEQ ID NO. in the sequence listing filed with this application. Table 3 provides the LocusLink and Unigene names and descriptions for the human homologues of the genes described in Tables 1 and 2. The sequences of the genes in the GenBank and/or RefSeq are expressly herein incorporated by reference in their entirety as of the filing date of this application, as are related sequences, for instance, sequences from the same gene of different lengths, variant sequences, polymorphic sequences, genomic sequences of the genes and related sequences from different species, including the human counterparts, where appropriate (see Table 3). These sequences may be used in the methods of the invention or may be used to produce the probes and arrays of the invention. In some embodiments, the genes in Tables 1-5LL that correspond to the genes or fragments previously associated with a toxic response may be excluded from the Tables.

As described above, in addition to the sequences of the GenBank Accession Numbers disclosed in the Tables 1-5LL, sequences such as naturally occurring variants or polymorphic sequences may be used in the methods and compositions of the invention. For instance, expression levels of various allelic or homologous forms of a gene disclosed in Tables 1-5LL may be assayed. Any and all nucleotide variations that do not significantly alter the functional activity of a gene listed in the Tables 1-5LL, including all naturally occurring allelic variants of the genes herein disclosed, may be used in the methods and to make the compositions (e.g., arrays) of the invention.

Probes based on the sequences of the genes described above may be prepared by any commonly available method. Oligonucleotide probes for screening or assaying a tissue or cell sample are preferably of sufficient length to specifically hybridize only to appropriate, complementary genes or transcripts. Typically the oligonucleotide probes will be at least about 10, 12, 14, 16, 18, 20 or 25 nucleotides in length. In some cases, longer probes of at least 30, 40, or 50 nucleotides will be desirable.

As used herein, oligonucleotide sequences that are complementary to one or more of the genes described in Tables 1-5LL refer to oligonucleotides that are capable of hybridizing under stringent conditions to at least part of the nucleotide sequences of said genes, their encoded RNA or mRNA, or amplified versions of the RNA such as cRNA. Such hybridizable oligonucleotides will typically exhibit at least about 75% sequence identity at the nucleotide level to said genes, preferably about 80% or 85% sequence identity or more preferably about 90% or 95% or more sequence identity to said genes.

"Bind(s) substantially" refers to complementary hybridization between a probe nucleic acid and a target nucleic acid and embraces minor mismatches that can be accommodated by reducing the stringency of the hybridization media to achieve the desired detection of the target polynucleotide sequence.

The terms "background" or "background signal intensity" refer to hybridization signals resulting from non-specific binding, or other interactions, between the labeled target nucleic acids and components of the oligonucleotide array (e.g., the oligonucleotide probes, control probes, the array substrate, etc.). Background signals may also be produced by intrinsic fluorescence of the array components themselves. A single background signal can be calculated for the entire array, or a different background signal may be calculated for each target nucleic acid. In a preferred embodiment, background is calculated as the average hybridization signal intensity for the lowest 5% to 10% of the probes in the array, or, where a different background signal is calculated for each target gene, for the lowest 5% to 10% of the probes for each gene. Of course, one of skill in the art will appreciate that where the probes to a particular gene hybridize well and thus appear to be specifically binding to a target sequence, they should not be used in a background signal calculation. Alternatively, background may be calculated as the average hybridization signal intensity produced by hybridization to probes that are not complementary to any sequence found in the sample (e.g. probes directed to nucleic acids of the opposite sense or to genes not found in the sample such as bacterial genes where the sample is mammalian nucleic acids). Background can also be calculated as the average signal intensity produced by regions of the array that lack any probes at all.

The phrase "hybridizing specifically to" or "specifically hybridizes" refers to the binding, duplexing, or hybridizing of a molecule substantially to or only to a particular nucleotide sequence or sequences under stringent conditions when that sequence is present in a complex mixture (e.g., total cellular) DNA or RNA.

Assays and methods of the invention may utilize available formats to simultaneously screen at least about 100, preferably about 1000, more preferably about 10,000 and most preferably about 100,000 or 1,000,000 or more different nucleic acid hybridizations.

As used herein a "probe" is defined as a nucleic acid, capable of binding to a target nucleic acid of complementary sequence through one or more types of chemical bonds, usually through complementary base pairing, usually through hydrogen bond formation. As used herein, a probe may include natural (i.e., A, G, U, C, or T) or modified bases (7-deazaguanosine, inosine, etc.). In addition, the bases in probes may be joined by a linkage other than a phosphodiester bond, so long as it does not interfere with hybridization. Thus, probes may be peptide nucleic acids in which the constituent bases are joined by peptide bonds rather than phosphodiester linkages.

The term "perfect match probe" refers to a probe that has a sequence that is perfectly complementary to a particular target sequence. The test probe is typically perfectly complementary to a portion (subsequence) of the target sequence. The perfect match (PM) probe can be a "test probe", a "normalization control" probe, an expression level control probe and the like. A perfect match control or perfect match probe is, however, distinguished from a "mismatch control" or "mismatch probe."

The terms "mismatch control" or "mismatch probe" refer to a probe whose sequence is deliberately selected not to be perfectly complementary to a particular target sequence. For each mismatch (MM) control in a high-density array there typically exists a corresponding perfect match (PM) probe that is perfectly complementary to the same particular target sequence. The mismatch may comprise one or more bases.

While the mismatch(es) may be located anywhere in the mismatch probe, terminal mismatches are less desirable as a terminal mismatch is less likely to prevent hybridization of the target sequence. In a particularly preferred embodiment, the mismatch is located at or near the center of the probe such that the mismatch is most likely to destabilize the duplex with the target sequence under the test hybridization conditions.

The term "stringent conditions" refers to conditions under which a probe will hybridize to its target subsequence, but with only insubstantial hybridization to other sequences or to other sequences such that the difference may be identified. Stringent conditions are sequence-dependent and will be different in different circumstances. Longer sequences hybridize specifically at higher temperatures. Generally, stringent conditions are selected to be about 5° C. lower than the thermal melting point (Tm) for the specific sequence at a defined ionic strength and pH.

Typically, stringent conditions will be those in which the salt concentration is at least about 0.01 to 1.0 M Na$^+$ ion concentration (or other salts) at pH 7.0 to 8.3 and the temperature is at least about 30° C. for short probes (e.g., 10 to 50 nucleotides). Stringent conditions may also be achieved with the addition of destabilizing agents such as formamide.

The "percentage of sequence identity" or "sequence identity" is determined by comparing two optimally aligned sequences or subsequences over a comparison window or span, wherein the portion of the polynucleotide sequence in the comparison window may optionally comprise additions or deletions (i.e., gaps) as compared to the reference sequence (which does not comprise additions or deletions) for optimal alignment of the two sequences. The percentage is calculated by determining the number of positions at which the identical submit (e.g. nucleic acid base or amino acid residue) occurs in both sequences to yield the number of matched positions, dividing the number of matched positions by the total number of positions in the window of comparison and multiplying the result by 100 to yield the percentage of sequence identity. Percentage sequence identity when calculated using the programs GAP or BESTFIT (see below) is calculated using default gap weights.

Probe Design

One of skill in the art will appreciate that an enormous number of array designs are suitable for the practice of this invention. The high density array will typically include a number of test probes that specifically hybridize to the sequences of interest. Probes may be produced from any region of the genes identified in the Tables and the attached representative sequence listing. In instances where the gene reference in the Tables is an EST, probes may be designed from that sequence or from other regions of the corresponding full-length transcript that may be available in any of the sequence databases, such as those herein described. See WO 99/32660 for methods of producing probes for a given gene or genes. In addition, any available software may be used to produce specific probe sequences, including, for instance, software available from Molecular Biology Insights, Olympus Optical Co. and Biosoft International. In a preferred embodiment, the array will also include one or more control probes.

High density array chips of the invention include "test probes." Test probes may be oligonucleotides that range from about 5 to about 500, or about 7 to about 50 nucleotides, more preferably from about 10 to about 40 nucleotides and most preferably from about 15 to about 35 nucleotides in length. In other particularly preferred embodiments, the probes are 20 or 25 nucleotides in length. In another preferred embodiment, test probes are double or single strand DNA sequences such as cDNA fragments. DNA sequences are isolated or cloned from natural sources or amplified from natural sources using native nucleic acid as templates. These probes have sequences complementary to particular subsequences of the genes whose expression they are designed to detect. Thus, the test probes are capable of specifically hybridizing to the target nucleic acid they are to detect.

In addition to test probes that bind the target nucleic acid(s) of interest, the high density array can contain a number of control probes. The control probes may fall into three categories referred to herein as 1) normalization controls; 2) expression level controls; and 3) mismatch controls.

Normalization controls are oligonucleotide or other nucleic acid probes that are complementary to labeled reference oligonucleotides or other nucleic acid sequences that are added to the nucleic acid sample to be screened. The signals obtained from the normalization controls after hybridization provide a control for variations in hybridization conditions, label intensity, "reading" efficiency and other factors that may cause the signal of a perfect hybridization to vary between arrays. In a preferred embodiment, signals (e.g., fluorescence intensity) read from all other probes in the array are divided by the signal (e.g., fluorescence intensity) from the control probes thereby normalizing the measurements.

Virtually any probe may serve as a normalization control. However, it is recognized that hybridization efficiency varies with base composition and probe length. Preferred normalization probes are selected to reflect the average length of the other probes present in the array, however, they can be selected to cover a range of lengths. The normalization control(s) can also be selected to reflect the (average) base composition of the other probes in the array, however in a preferred embodiment, only one or a few probes are used and they are selected such that they hybridize well (i.e., no secondary structure) and do not match any target-specific probes.

Expression level controls are probes that hybridize specifically with constitutively expressed genes in the biological sample. Virtually any constitutively expressed gene provides a suitable target for expression level controls. Typically expression level control probes have sequences complementary to subsequences of constitutively expressed "housekeeping genes" including, but not limited to the actin gene, the transferrin receptor gene, the GAPDH gene, and the like.

Mismatch controls may also be provided for the probes to the target genes, for expression level controls or for normalization controls. Mismatch controls are oligonucleotide probes or other nucleic acid probes identical to their corresponding test or control probes except for the presence of one or more mismatched bases. A mismatched base is a base selected so that it is not complementary to the corresponding base in the target sequence to which the probe would otherwise specifically hybridize. One or more mismatches are selected such that under appropriate hybridization conditions (e.g., stringent conditions) the test or control probe would be expected to hybridize with its target sequence, but the mismatch probe would not hybridize (or would hybridize to a significantly lesser extent). Preferred mismatch probes contain a central mismatch. Thus, for example, where a probe is a 20 mer, a corresponding mismatch probe will have the identical sequence except for a single base mismatch (e.g., substituting a G, a C or a T for an A) at any of positions 6 through 14 (the central mismatch).

Mismatch probes thus provide a control for non-specific binding or cross hybridization to a nucleic acid in the sample other than the target to which the probe is directed. For example, if the target is present the perfect match probes should be consistently brighter than the mismatch probes. In addition, if all central mismatches are present, the mismatch probes can be used to detect a mutation, for instance, a mutation of a gene in the accompanying Tables 1-5LL. The difference in intensity between the perfect match and the mismatch probe provides a good measure of the concentration of the hybridized material.

Nucleic Acid Samples

Cell or tissue samples may be exposed to the test agent in vitro or in vivo. When cultured cells or tissues are used, appropriate mammalian cell extracts, such as liver cell extracts, may also be added with the test agent to evaluate agents that may require biotransformation to exhibit toxicity.

The genes which are assayed according to the present invention are typically in the form of mRNA or reverse transcribed mRNA. The genes may or may not be cloned. The genes may or may not be amplified and cRNA produced. The cloning and/or amplification do not appear to bias the representation of genes within a population. In some assays, it may be preferable, however, to use polyA+ RNA as a source, as it can be used with less processing steps.

As is apparent to one of ordinary skill in the art, nucleic acid samples used in the methods and assays of the invention may be prepared by any available method or process. Methods of isolating total mRNA are well known to those of skill in the art. For example, methods of isolation and purification of nucleic acids are described in detail in Chapter 3 of *Laboratory Techniques in Biochemistry and Molecular Biology*, Vol. 24, Hybridization With Nucleic Acid Probes: Theory and Nucleic Acid Probes, P. Tijssen, Ed., Elsevier Press, New York, 1993. Such samples include RNA samples, but also include cDNA synthesized from a mRNA sample isolated from a cell or tissue of interest. Such samples also include DNA amplified from the cDNA, and RNA transcribed from the amplified DNA (cRNA). One of skill in the art would appreciate that it is desirable to inhibit or destroy RNase present in homogenates before homogenates are used.

Biological samples may be of any biological tissue or fluid or cells from any organism as well as cells raised in vitro, such as cell lines and tissue culture cells. Frequently the sample will be a tissue or cell sample that has been exposed to a compound, agent, drug, pharmaceutical composition, potential environmental pollutant or other composition. In some formats, the sample will be a "clinical sample" which is a sample derived from a patient. Typical clinical samples include, but are not limited to, sputum, blood, blood-cells (e.g., white cells), tissue or fine needle biopsy samples, urine, peritoneal fluid, and pleural fluid, or cells therefrom. Biological samples may also include sections of tissues, such as frozen sections or formalin fixed sections taken for histological purposes.

Forming High Density Arrays

Methods of forming high density arrays of oligonucleotides with a minimal number of synthetic steps are known. The oligonucleotide analogue array can be synthesized on a single or on multiple solid substrates by a variety of methods, including, but not limited to, light-directed chemical coupling, and mechanically directed coupling (see Pirrung, U.S. Pat. No. 5,143,854).

In brief, the light-directed combinatorial synthesis of oligonucleotide arrays on a glass surface proceeds using automated phosphoramidite chemistry and chip masking techniques. In one specific implementation, a glass surface is derivatized with a silane reagent containing a functional group, e.g., a hydroxyl or amine group blocked by a photolabile protecting group. Photolysis through a photolithographic mask is used selectively to expose functional groups which are then ready to react with incoming 5' photoprotected nucleoside phosphoramidites. The phosphoramidites react only with those sites which are illuminated (and thus exposed by removal of the photolabile blocking group). Thus, the phosphoramidites only add to those areas selectively exposed from the preceding step. These steps are repeated until the desired array of sequences have been synthesized on the solid surface. Combinatorial synthesis of different oligonucleotide analogues at different locations on the array is determined by the pattern of illumination during synthesis and the order of addition of coupling reagents.

In addition to the foregoing, additional methods which can be used to generate an array of oligonucleotides on a single substrate are described in PCT Publication Nos. WO 93/09668 and WO 01/23614. High density nucleic acid arrays can also be fabricated by depositing pre-made or natural nucleic acids in predetermined positions. Synthesized or natural nucleic acids are deposited on specific locations of a substrate by light directed targeting and oligonucleotide directed targeting. Another embodiment uses a dispenser that moves from region to region to deposit nucleic acids in specific spots.

Hybridization

Nucleic acid hybridization simply involves contacting a probe and target nucleic acid under conditions where the probe and its complementary target can form stable hybrid duplexes through complementary base pairing. See WO 99/32660. The nucleic acids that do not form hybrid duplexes are then washed away leaving the hybridized nucleic acids to be detected, typically through detection of an attached detectable label. It is generally recognized that nucleic acids are denatured by increasing the temperature or decreasing the salt concentration of the buffer containing the nucleic acids. Under low stringency conditions (e.g., low temperature and/or high salt) hybrid duplexes (e.g., DNA:DNA, RNA:RNA, or RNA:DNA) will form even where the annealed sequences are not perfectly complementary. Thus, specificity of hybridization is reduced at lower stringency. Conversely, at higher stringency (e.g., higher temperature or lower salt) successful hybridization tolerates fewer mismatches. One of skill in the art will appreciate that hybridization conditions may be selected to provide any degree of stringency.

In a preferred embodiment, hybridization is performed at low stringency, in this case in 6×SSPET at 37° C. (0.005% Triton X-100), to ensure hybridization and then subsequent washes are performed at higher stringency (e.g., 1×SSPET at 37° C.) to eliminate mismatched hybrid duplexes. Successive washes may be performed at increasingly higher stringency (e.g., down to as low as 0.25×SSPET at 37° C. to 50° C.) until a desired level of hybridization specificity is obtained. Stringency can also be increased by addition of agents such as formamide. Hybridization specificity may be evaluated by comparison of hybridization to the test probes with hybridization to the various controls that can be present (e.g., expression level control, normalization control, mismatch controls, etc.).

In general, there is a tradeoff between hybridization specificity (stringency) and signal intensity. Thus, in a preferred embodiment, the wash is performed at the highest stringency that produces consistent results and that provides a signal intensity greater than approximately 10% of the background intensity. Thus, in a preferred embodiment, the hybridized array may be washed at successively higher stringency solutions and read between each wash. Analysis of the data sets thus produced will reveal a wash stringency above which the hybridization pattern is not appreciably altered and which provides adequate signal for the particular oligonucleotide probes of interest.

Signal Detection

The hybridized nucleic acids are typically detected by detecting one or more labels attached to the sample nucleic acids. The labels may be incorporated by any of a number of means well known to those of skill in the art. See WO 99/32660.

Databases

The present invention includes relational databases containing sequence information, for instance, for the genes of Tables 1-5LL, as well as gene expression information from tissue or cells exposed to various standard toxins, such as those herein described (see Tables 5-5LL). Databases may also contain information associated with a given sequence or tissue sample such as descriptive information about the gene associated with the sequence information (see Tables 1 and 2), or descriptive information concerning the clinical status of the tissue sample, or the animal from which the sample was derived. The database may be designed to include different parts, for instance a sequence database and a gene expression database. Methods for the configuration and construction of such databases and computer-readable media to which such databases are saved are widely available, for instance, see U.S. Pat. No. 5,953,727, which is herein incorporated by reference in its entirety.

The databases of the invention may be linked to an outside or external database such as GenBank; KEGG; SPAD; HUGO; Swiss-Prot; Prosite; OMIM; and GDB. In a preferred embodiment, as described in Tables 1-3, the external database is GenBank and the associated databases maintained by the National Center for Biotechnology Information (NCBI).

Any appropriate computer platform, user interface, etc. may be used to perform the necessary comparisons between sequence information, gene expression information and any other information in the database or information provided as an input. For example, a large number of computer workstations are available from a variety of manufacturers, such has those available from Silicon Graphics. Client/server environments, database servers and networks are also widely available and appropriate platforms for the databases of the invention.

The databases of the invention may be used to produce, among other things, electronic Northerns that allow the user to determine the cell type or tissue in which a given gene is expressed and to allow determination of the abundance or expression level of a given gene in a particular tissue or cell.

The databases of the invention may also be used to present information identifying the expression level in a tissue or cell of a set of genes comprising one or more of the genes in Tables 5-5LL, comprising the step of comparing the expression level of at least one gene in Tables 5-5LL in a cell or tissue exposed to a test agent to the level of expression of the gene in the database. Such methods may be used to predict the toxic potential of a given compound by comparing the level of expression of a gene or genes in Tables 5-5LL from a tissue or cell sample exposed to the test agent to the expression levels found in a control tissue or cell samples exposed to a standard toxin or cardiotoxin such as those herein described. Such methods may also be used in the drug or agent screening assays as described herein.

Kits

The invention further includes kits combining, in different combinations, high-density oligonucleotide arrays, reagents for use with the arrays, protein reagents encoded by the genes of the Tables, signal detection and array-processing instruments, gene expression databases and analysis and database management software described above. The kits may be used, for example, to predict or model the toxic response of a test compound, to monitor the progression of heart disease states, to identify genes that show promise as new drug targets and to screen known and newly designed drugs as discussed above.

The databases packaged with the kits are a compilation of expression patterns from human or laboratory animal genes and gene fragments (corresponding to the genes of Tables 1-5LL). In particular, the database software and packaged information that may contain the databases saved to a computer-readable medium include the expression results of Tables 1-5LL that can be used to predict toxicity of a test agent by comparing the expression levels of the genes of Tables 1-5LL induced by the test agent to the expression levels presented in Tables 5-5LL. In another format, database and software information may be provided in a remote electronic format, such as a website, the address of which may be packaged in the kit.

Databases and software designed for use with microarrays is discussed in PCT/US99/20449, filed Sep. 8, 1999, Genomic Knowledge Discovery, PCT/IB00/00863, filed Jun. 28, 2000, Biological Data Processing, and in Balaban et al., U.S. Pat. No. 6,229,911, a computer-implemented method for managing information, stored as indexed tables, collected from small or large numbers of microarrays, and U.S. Pat. No. 6,185,561, a computer-based method with data mining capability for collecting gene expression level data, adding additional attributes and reformatting the data to produce answers to various queries. Chee et al., U.S. Pat. No. 5,974,164, disclose a software-based method for identifying mutations in a nucleic acid sequence based on differences in probe fluorescence intensities between wild type and mutant sequences that hybridize to reference sequences.

The kits may be used in the pharmaceutical industry, where the need for early drug testing is strong due to the high costs associated with drug development, but where bioinformatics, in particular gene expression informatics, is still lacking. These kits will reduce the costs, time and risks associated with traditional new drug screening using cell cultures and laboratory animals. The results of large-scale drug screening of pre-grouped patient populations, pharmacogenomics testing, can also be applied to select drugs with greater efficacy and fewer side-effects. The kits may also be used by smaller biotechnology companies and research institutes who do not have the facilities for performing such large-scale testing themselves.

Without further description, it is believed that one of ordinary skill in the art can, using the preceding description and the following illustrative examples, make and utilize the compounds of the present invention and practice the claimed methods. The following working examples therefore, specifically point out the preferred embodiments of the present invention, and are not to be construed as limiting in any way the remainder of the disclosure.

EXAMPLES

Example 1

Identification of Toxicity Markers

The cardiotoxins adriamycin, amphotericin B, epirubicin, phenylpropanolamine, and rosiglitazone were administered to male Sprague-Dawley rats at various timepoints using administration diluents, protocols, and dosing regimes as indicated in Table 6. The cardiotoxins cyclophosphamide, ifosfamide, minoxidil, hydralazine, BI-QT, clenbuterol, isoproterenol, norepinephrine, and epinephrine and control compositions were administered to male Sprague-Dawley rats at various timepoints using administration diluents, protocols and dosing regimes as previously described in the art and previously described in the priority applications discussed above. The low and high dose level for each compound are provided in the chart below.

| Heart Toxin | Low Dose (mg/kg) | High Dose mg/kg |
| --- | --- | --- |
| Cyclophosphamide | 20 | 200 |
| Ifosfamide | 5 | 100 |
| Minaxidil | 12 mg/L | 120 mg/L |
| Hydralazine | 2.5 | 25 |
| BI-QT | 10 | 50 |
| Clenbuteral | 0.4 | 4 |
| Isopraterenal | 0.05 | 0.5 |
| Norepinephrine | 0.05 | 0.5 |
| Epinephrine | 0.1 | 1 |
| Adriamycin | 1.3 | 12.8 |
| Amphatericin B | 0.25 | 2.5 |
| Epirubicin | 1.2 | 12 |
| Phenylpropanolamine | 6.4 | 64 |
| Rosiglitazone | 18 | 180 |

After administration, the dosed animals were observed and tissues were collected as described below:

| OBSERVATION OF ANIMALS | |
| --- | --- |
| 1. Clinical Observations- | Twice daily: mortality and moribundity check. Cage Side Observations - skin and fur, eyes and mucous membrane, respiratory system, circulatory system, autonomic and central nervous system, somatomotor pattern, and behavior pattern. Potential signs of toxicity, including tremors, convulsions, salivation, diarrhea, lethargy, coma or other atypical behavior or appearance, were recorded as they occurred and included a time of onset, degree, and duration. |
| 2. Physical Examinations- | Prior to randomization, prior to initial treatment, and prior to sacrifice. |
| 3. Body Weights- | Prior to randomization, prior to initial treatment, and prior to sacrifice. |

| CLINICAL PATHOLOGY | |
| --- | --- |
| 1. Frequency | Prior to necropsy. |
| 2. Number of animals | All surviving animals. |
| 3. Bleeding Procedure | Blood was obtained by puncture of the orbital sinus while under 70% $CO_2$/30% $O_2$ anesthesia. |
| 4. Collection of Blood Samples | Approximately 0.5 mL of blood was collected into EDTA tubes for evaluation of hematology parameters. Approximately 1 mL of blood was collected into serum separator tubes for clinical chemistry analysis. Approximately 200 uL of plasma was obtained and frozen at ~−80° C. for test compound/metabolite estimation. An additional ~2 mL of blood was collected into a 15 mL conical polypropylene vial to which ~3 mL of Trizol was immediately added. The contents were immediately mixed with a vortex and by repeated inversion. The tubes were frozen in liquid nitrogen and stored at ~−80° C. |

Termination Procedures

Terminal Sacrifice

At the sampling times indicated in Tables 5A-5LL and Table 6 for each cardiotoxin, and as previously described in the related applications mentioned above, rats were weighed, physically examined, sacrificed by decapitation, and exsanguinated. The animals were necropsied within approximately five minutes of sacrifice. Separate sterile, disposable instruments were used for each animal, with the exception of bone cutters, which were used to open the skull cap. The bone cutters were dipped in disinfectant solution between animals.

Necropsies were conducted on each animal following procedures approved by board-certified pathologists.

Animals not surviving until terminal sacrifice were discarded without necropsy (following euthanasia by carbon dioxide asphyxiation, if moribund). The approximate time of death for moribund or found dead animals was recorded.

Postmortem Procedures

Fresh and sterile disposable instruments were used to collect tissues. Gloves were worn at all times when handling tissues or vials. All tissues were collected and frozen within approximately 5 minutes of the animal's death. The liver sections and kidneys were frozen within approximately 3-5 minutes of the animal's death. The time of euthanasia, an interim time point at freezing of liver sections and kidneys, and time at completion of necropsy were recorded. Tissues were stored at approximately −80° C. or preserved in 10% neutral buffered formalin.

Tissue Collection and Processing

Liver
1. Right medial lobe—snap frozen in liquid nitrogen and stored at ~−80° C.
2. Left medial lobe—Preserved in 10% neutral-buffered formalin (NIBF) and evaluated for gross and microscopic pathology.
3. Left lateral lobe—snap frozen in liquid nitrogen and stored at ~−80° C.

Heart
A sagittal cross-section containing portions of the two atria and of the two ventricles was preserved in 10% NBF. The remaining heart was frozen in liquid nitrogen and stored at ~−80° C.

Kidneys (Both)
1. Left—Hemi-dissected; half was preserved in 10% NBF and the remaining half was frozen in liquid nitrogen and stored at ~−80° C.
2. Right—Hemi-dissected; half was preserved in 10% NBF and the remaining half was frozen in liquid nitrogen and stored at ~−80° C.

Testes (Both)
A sagittal cross-section of each testis was preserved in 10% NBF. The remaining testes were frozen together in liquid nitrogen and stored at ~−80° C.

Brain (Whole)
A cross-section of the cerebral hemispheres and of the diencephalon was preserved in 10% NBF, and the rest of the brain was frozen in liquid nitrogen and stored at ~−80° C.

Microarray sample preparation was conducted with minor modifications, following the protocols set forth in the Affymetrix GeneChip Expression Analysis Manual. Frozen tissue was ground to a powder using a Spex Certiprep 6800 Freezer Mill. Total RNA was extracted with Trizol (Gibco-BRL) utilizing the manufacturer's protocol. The total RNA yield for each sample was 200-500 µg per 300 mg tissue weight. mRNA was isolated using the Oligotex mRNA Midi kit (Qiagen) followed by ethanol precipitation. Double stranded cDNA was generated from mRNA using the SuperScript Choice system (GibcoBRL). First strand cDNA synthesis was primed with a T7-(dT24) oligonucleotide. The cDNA was phenol-chloroform extracted and ethanol precipitated to a final concentration of 1 µg/ml. From 2 fig of cDNA, cRNA was synthesized using Ambion's T7 MegaScript in vitro Transcription Kit.

To biotin label the cRNA, nucleotides Bio-11-CTP and Bio-16-UTP (Enzo Diagnostics) were added to the reaction. Following a 37° C. incubation for six hours, impurities were removed from the labeled cRNA following the RNeasy Mini kit protocol (Qiagen). cRNA was fragmented (fragmentation buffer consisting of 200 mM Tris-acetate, pH 8.1, 500 mM KOAc, 150 mM MgOAc) for thirty-five minutes at 94° C. Following the Affymetrix protocol, 55 µg of fragmented cRNA was hybridized on the Affymetrix rat array set for twenty-four hours at 60 rpm in a 45° C. hybridization oven. The chips were washed and stained with Streptavidin Phycoerythrin (SAPE) (Molecular Probes) in Affymetrix fluidics stations. To amplify staining, SAPE solution was added twice with an anti-streptavidin biotinylated antibody (Vector Laboratories) staining step in between. Hybridization to the probe arrays was detected by fluorometric scanning (Hewlett Packard Gene Array Scanner). Data was analyzed using Affymetrix GeneChip® version 2.0 and Expression Data Mining (EDMT) software (version 1.0), Gene Logic's GeneExpress® 2000 software and S-Plus™ software.

Tables 1 and 2 disclose those genes that are differentially expressed upon exposure to the named toxins and their corresponding GenBank Accession and Sequence Identification numbers, the identities of the metabolic pathways in which the genes function, the gene names if known, and the unigene cluster titles. The human homologues of the rat genes in Tables 1 and 2 are indicated in Table 3. The model codes in Tables 1-3 represent the various toxicity or heart pathology states that differential expression of each gene is able to identify, as well as the individual toxin or toxin type associated with differential expression of each gene. The model codes are defined in Table 4. The GLGC ID is the internal Gene Logic identification number.

Tables 5A-5LL disclose a core set of genes, along with the summary statistics for each of the comparisons performed as indicated in these tables, i.e., expression levels of a particular gene in toxicity group samples compared to non-toxicity group samples in response to exposure to a particular toxin, or as measured in a particular disease state. Each of these tables contains a set of predictive genes and creates a model for predicting the cardiotoxicity of an unknown, i.e., untested compound. Each gene is identified by its Gene Logic identification number and can be cross-referenced to a gene name and representative sequence identification number in Tables 1 and 2 or in one or more related applications, as mentioned on page 1.

For each comparison of gene expression levels between samples in the toxicity group (samples affected by exposure to a specific toxin) and samples in the non-toxicity group (samples not affected by exposure to that same specific toxin), the tox mean (for toxicity group samples) is the mean signal intensity, as normalized for the various chip parameters that are being assayed. The non-tox mean represents the mean signal intensity, as normalized for the various chip parameters that are being assayed, in samples from animals other than those treated with the high dose of the specific toxin. These animals were treated with a low dose of the specific toxin, or with vehicle alone, or with a different toxin. Samples in the toxicity groups were obtained from animals sacrificed at the timepoint(s) indicated in the Table 5-5LL headings, while samples in the non-toxicity groups were obtained from animals sacrificed at all time points in the experiments. For individual genes, an increase in the tox mean compared to the non-tox mean indicates up-regulation upon exposure to a toxin. Conversely, a decrease in the tox mean compared to the non-tox mean indicates down-regulation.

The mean values are derived from Average Difference (AveDiff) values for a particular gene, averaged across the corresponding samples. Each individual Average Difference value is calculated by integrating the intensity information from multiple probe pairs that are tiled for a particular fragment. The normalization multiplies each expression intensity for a given experiment (chip) by a global scaling factor. The intent of this normalization is to make comparisons of individual genes between chips possible. The scaling factor is calculated as follows:

1. From all the unnormalized expression values in the experiment, delete the largest 2% and smallest 2% of the values. That is, if the experiment yields 10,000 expression values, order the values and delete the smallest 200 and largest 200.

2. Compute the trimmed mean, which is equal to the mean of the remaining values.

3. Compute the scale factor SF=100/(trimmed mean)

Values greater than 2.0*SD noise are assumed to come from expressors. For these values, the standard deviation SD log (signal) of the logarithms is calculated. The logarithms are then multiplied by a scale factor proportional to 1/SD log (signal) and exponentiated. The resulting values are then multiplied by another scale factor, chosen so there will be no discontinuity in the normalized values from unscaled values on either side of 2.0*SD noise. Some AveDiff values may be negative due to the general noise involved in nucleic acid hybridization experiments. Although many conclusions can be made corresponding to a negative value on the GeneChip platform, it is difficult to assess the meaning behind the negative value for individual fragments. Our observations show that, although negative values are observed at times within the predictive gene set, these values reflect a real biological phenomenon that is highly reproducible across all the samples from which the measurement was taken. For this reason, those genes that exhibit a negative value are included in the predictive set. It should be noted that other platforms of gene expression measurement may be able to resolve the negative numbers for the corresponding genes. The predictive ability of each of those genes should extend across platforms, however. Each mean value is accompanied by the standard deviation for the mean. The linear discriminant analysis score (discriminant score, or LDA), as disclosed in the tables, measures the ability of each gene to predict whether or not a sample is toxic. The discriminant score is calculated by the following steps:

Calculation of a Discriminant Score

Let $X_i$ represent the AveDiff values for a given gene across the non-tox samples, $i=1 \ldots n$.

Let $Y_i$ represent the AveDiff values for a given gene across the tox samples, $i=1 \ldots t$.

The calculations proceed as follows:

1. Calculate mean and standard deviation for $X_i$'s and $Y_i$'s, and denote these by $m_X$, $m_Y$, $s_X$, $s_Y$.

2. For all $X_i$'s and $Y_i$'s, evaluate the function $f(z)=((1/s_Y)*\exp(-0.5*((z-m_Y)/s_Y)^2))/(((1/s_Y)*\exp(-0.5*((z-m_Y)/s_Y)^2))+((1/s_X)*\exp(-0.5*((z-m_X)/s_X)^2)))$.

3. The number of correct predictions, say P, is then the number of $Y_i$'s such that $f(Y_i)>0.5$ plus the number of $X_i$'s such that $f(X_i)<0.5$.

4. The discriminant score is then $P/(n+t)$.

Linear discriminant analysis uses both the individual measurements of each gene and the calculated measurements of all combinations of genes to classify samples. For each gene a weight is derived from the mean and standard deviation of the toxic and nontox groups. Every gene is multiplied by a weight and the sum of these values results in a collective discriminate score. This discriminant score is then compared against collective centroids of the tox and nontox groups. These centroids are the average of all tox and nontox samples respectively. Therefore, each gene contributes to the overall prediction. This contribution is dependent on weights that are large positive or negative numbers if the relative distances between the tox and nontox samples for that gene are large and small numbers if the relative distances are small. The discriminant score for each unknown sample and centroid values can be used to calculate a probability between zero and one as to the group in which the unknown sample belongs.

Example 2

General Toxicity Modeling

Samples were selected for grouping into tox-responding and non-tox-responding groups by examining each study individually with Principal Components Analysis (PCA) to determine which treatments had an observable response. Only groups where confidence of their tox-responding and non-tox-responding status was established were included in building a general tox model (Tables 5A-5LL).

Linear discriminant models were generated to describe toxic and non-toxic samples. The top discriminant genes and/or EST's were used to determine toxicity by calculating each gene's contribution with homo and heteroscedastic treatment of variance and inclusion or exclusion of mutual information between genes. Prediction of samples within the database exceeded 80% true positives with a false positive rate of less than 5%. It was determined that combinations of genes and/or EST's generally provided a better predictive ability than individual genes and that the more genes and/or EST used the better predictive ability. Although the preferred embodiment includes fifty or more genes, many pairings or greater combinations of genes and/or EST can work better than individual genes. All combinations of two or more genes from the selected list (Tables 5A-5LL) could be used to predict toxicity. These combinations could be selected by pairing in an agglomerate, divisive, or random approach. Further, as yet undetermined genes and/or EST's could be combined with individual or combination of genes and/or EST's described here to increase predictive ability. However, the genes and/or EST's described here would contribute most of the predictive ability of any such undetermined combinations.

Other variations on the above method can provide adequate predictive ability. These include selective inclusion of components via agglomerate, divisive, or random approaches or extraction of loading and combining them in agglomerate, divisive, or random approaches. Also the use of composite variables in logistic regression to determine classification of samples can also be accomplished with linear discriminate analysis, neural or Bayesian networks, or other forms of regression and classification based on categorical or continual dependent and independent variables.

Example 3

Modeling with Core Gene Set

As described in Examples 1 and 2, above, the data collected from microarray hybridization experiments were analyzed by LDA and by PCA. The genes in Tables 5G, 5I, 5K, 5M, 5O, 5Q, 5T, 5V, 5X, 5Y, 5Z, 5BB, 5DD, 5FF, and 5KK constitute a core set of markers for predicting the cardiotoxicity of a compound. Each gene fragment in Tables 1-5LL is assigned an LDA score, and those gene fragments in the core set are those with the highest LDA scores. The gene fragments in Tables 5A-5LL were determined to give greater than 80% true positive results and less than 5% false positive results. Gene expression profiles prepared from expression data for these genes, in the presence and absence of toxin treatment, can be used a controls in assays of compounds whose toxic properties have not been examined. Comparison of data from test compound-exposed and test compound-unexposed animals with the data in Tables 5A-5LL, or with data from the core gene set controls, allows the prediction of toxic effects—or no toxic effects—upon exposure to the test compound. Thus, with a smaller gene set than in Table 1 and as described in Example 1, the core gene set can be used to examine the biological effects of a compound whose toxic properties following exposure are not known and to predict the toxicity in liver tissue of this compound.

Example 4

Modeling Methods

The above modeling methods provide broad approaches of combining the expression of genes to predict sample toxicity. One could also provide no weight in a simple voting method or determine weights in a supervised or unsupervised method using agglomerate, divisive, or random approaches. All or selected combinations of genes may be combined in ordered, agglomerate, or divisive, supervised or unsupervised clustering algorithms with unknown samples for classification. Any form of correlation matrix may also be used to classify unknown samples. The spread of the group distribution and discriminate score alone provide enough information to enable a skilled person to generate all of the above types of models with accuracy that can exceed discriminate ability of individual genes. Some examples of methods that could be used individually or in combination after transformation of data types include but are not limited to: Discriminant Analysis, Multiple Discriminant Analysis, logistic regression, multiple regression analysis, linear regression analysis, conjoint analysis, canonical correlation, hierarchical cluster analysis, k-means cluster analysis, self-organizing maps, multidimensional scaling, structural equation modeling, support vector machine determined boundaries, factor analysis, neural networks, bayesian classifications, and resampling methods.

Example 5

Individual Compound Markers

Samples were grouped into individual pathology classes based on known toxicological responses and observed clinical chemical and pathology measurements or into early and late phases of observable toxicity within a compound (Tables 1-5LL). The top 10, 25, 50, 100 genes based on individual discriminate scores were used in a model to ensure that combination of genes provided a better prediction than individual genes. As described above, all combinations of two or more genes from this list could potentially provide better prediction than individual genes when selected in any order or by ordered, agglomerate, divisive, or random approaches. In addition, combining these genes with other genes could provide better predictive ability, but most of this predictive ability would come from the genes listed herein.

Samples may be considered toxic if they score positive in any individual compound represented here or in any modeling method mentioned under general toxicology models based on combination of individual time and dose grouping of individual toxic compounds obtainable from the data. Most logical groupings with one or more genes and one or more sample dose and time points should produce better predictions of general toxicity or similarity to known toxicant than individual genes.

Although the present invention has been described in detail with reference to examples above, it is understood that various modifications can be made without departing from the spirit of the invention. Accordingly, the invention is limited only by the following claims. All cited patents, patent applications and publications referred to in this application are herein incorporated by reference in their entirety.

TABLE 1

| SEQ ID | GLGC ID | GenBank Accession No. | Model Code | Known Gene Name | Unigene Sequence Cluster Title |
|---|---|---|---|---|---|
| 13 | 25120 | A03913 | f | | |
| 14 | 6917 | AA012709 | b | | ESTs, Highly similar to splicing factor 3b, subunit 1, 155 kDa [*Mus musculus*] [*M. musculus*] |
| 15 | 25098 | AA108277 | e | | |
| 16 | 25103 | AA685876 | cc, dd | | |
| 17 | 25104 | AA685903 | d, e, r | | ESTs, Weakly similar to HS9B_RAT Heat shock protein HSP 90-beta (HSP 84) [*R.norvegicus*] |
| 18 | 14580 | AA686870 | jj, kk | | ESTs |
| 19 | 19222 | AA799279 | f, g | | ESTs, Highly similar to mitochondrial carrier homolog 2 [*Mus musculus*] [*M. musculus*] |
| 20 | 18272 | AA799294 | e | | ESTs |
| 21 | 22646 | AA799301 | d | | ESTs, Highly similar to LIGA_MOUSE Ligatin [*M. musculus*] |
| 22 | 21997 | AA799325 | jj, kk | | ESTs |
| 23 | 18396 | AA799330 | a, p, q, y | | ESTs, Weakly similar to T47122 cell division protein pelota [imported] - fruit fly (*Drosophila melanogaster*) [*D.melanogaster*] |
| 24 | 15082 | AA799396 | p, q | | ESTs |
| 24 | 15083 | AA799396 | b, p, q | | ESTs |
| 25 | 15084 | AA799397 | b, l, m | | ESTs |
| 26 | 6581 | AA799412 | e | | ESTs, Weakly similar to I67424 hERR-2 homolog - rat (fragment) [*R.norvegicus*] |
| 27 | 20042 | AA799420 | h, l | | ESTs |
| 28 | 2882 | AA799423 | ll | nexilin | nexilin |
| 29 | 17137 | AA799438 | ee, ff, jj, kk | | ESTs, Weakly similar to S68418 protein phosphatase 1M chain M110 isoform - rat (fragment) [*R.norvegicus*] |

TABLE 1-continued

| SEQ ID | GLGC ID | GenBank Accession No. | Model Code | Known Gene Name | Unigene Sequence Cluster Title |
|---|---|---|---|---|---|
| 30 | 18365 | AA799442 | cc, dd, gg | | ESTs |
| 31 | 18160 | AA799448 | e | | ESTs |
| 32 | 18706 | AA799471 | d | | ESTs, Highly similar to TELT_MOUSE Telethonin (Titin cap protein) [*M. musculus*] |
| 33 | 23294 | AA799472 | b | | ESTs, Moderately similar to AD16_HUMAN Protein AD-016 (Protein CGI-116) (x0009) [*H. sapiens*] |
| 34 | 11350 | AA799488 | cc, dd, ll | | ESTs |
| 35 | 8289 | AA799494 | e | | ESTs, Highly similar to T46500 hypothetical protein DKFZp434D098.1 - human (fragment) [*H. sapiens*] |
| 36 | 18290 | AA799497 | hh | | ESTs |
| 37 | 17612 | AA799511 | ll | | ESTs, Weakly similar to DDRT helix-destabilizing protein - rat [*R.norvegicus*] |
| 38 | 15303 | AA799518 | w, x | | ESTs, Highly similar to hypothetical protein FLJ13725; KIAA1930 protein [*Homo sapiens*] [*H. sapiens*] |
| 39 | 16942 | AA799520 | e | | ESTs, Highly similar to ITMB_MOUSE integral membrane protein 2B (E25B protein) [*M. musculus*] |
| 40 | 21120 | AA799526 | p, q, gg | | ESTs, Highly similar to RIKEN cDNA 1700043E15 [*Mus musculus*] [*M. musculus*] |
| 41 | 17687 | AA799531 | g | | ESTs, Weakly similar to M18.3.p [*Caenorhabditis elegans*] [*C. elegans*] |
| 41 | 17688 | AA799531 | f, g | | ESTs, Weakly similar to M18.3.p [*Caenorhabditis elegans*] [*C. elegans*] |
| 42 | 15560 | AA799538 | s, t | | ESTs, Highly similar to SFR2_MOUSE Splicing factor, arginine/serine-rich 2 (Splicing factor SC35) (SC-35) (Splicing component, 35 kDa) (PR264 protein) [*M. musculus*] |
| 43 | 17599 | AA799539 | c | | ESTs, Weakly similar to KEAP_RAT Kelch-like ECH-associated protein 1 (Cytosolic inhibitor of Nrf2) (INrf2) [*R.norvegicus*] |
| 44 | 24628 | AA799542 | ii | | ESTs |
| 45 | 11353 | AA799569 | d | | ESTs |
| 46 | 17212 | AA799571 | ll | | *Rattus norvegicus* mRNA for ribosomal protein L35 |
| 47 | 20971 | AA799576 | c | | ESTs, Highly similar to T46259 hypothetical protein DKFZp761E0323.1 - human (fragment) [*H. sapiens*] |
| 48 | 20972 | AA799580 | r, jj, kk | | ESTs |
| 49 | 17712 | AA799598 | f, g | | ESTs |
| 50 | 20975 | AA799599 | cc, dd | | ESTs |
| 51 | 15844 | AA799600 | ii | | ESTs, Highly similar to hypothetical protein DKFZp586I021 [*Homo sapiens*] [*H. sapiens*] |
| 52 | 13926 | AA799601 | ll | | ESTs |
| 53 | 16696 | AA799607 | h, l | | ESTs |
| 54 | 17380 | AA799612 | w, x | ubiquitin conjugating enzyme | ubiquitin conjugating enzyme |
| 55 | 18333 | AA799614 | e | | ESTs, Moderately similar to sirtuin 2 (silent mating type information regulation 2, homolog) 2 (*S. cerevisiae*) [*Rattus norvegicus*] [*R.norvegicus*] |
| 56 | 20980 | AA799633 | l, m | | ESTs, Moderately similar to hypothetical protein MGC13016 [*Homo sapiens*] [*H. sapiens*] |
| 57 | 20981 | AA799636 | y | | ESTs |
| 58 | 20092 | AA799637 | r, ll | | ESTs, Weakly similar to A55071 hydrogen peroxide-inducible protein hic-5 mouse [*M. musculus*] |
| 59 | 18226 | AA799641 | l | | ESTs, Moderately similar to I53063 testicular tumor overexpressed protein - mouse [*M. musculus*] |
| 60 | 20982 | AA799657 | d, e, ii | | ESTs, Weakly similar to S68418 protein phosphatase 1M chain M110 isoform - rat (fragment) [*R.norvegicus*] |
| 61 | 17759 | AA799663 | c, hh | | ESTs, Highly similar to S37488 gene T10 protein - mouse [*M. musculus*] |
| 61 | 17760 | AA799663 | c | | ESTs, Highly similar to S37488 gene T10 protein - mouse [*M. musculus*] |

TABLE 1-continued

| SEQ ID | GLGC ID | GenBank Accession No. | Model Code | Known Gene Name | Unigene Sequence Cluster Title |
|---|---|---|---|---|---|
| 62 | 20994 | AA799717 | cc, dd | | ESTs, Highly similar to RPB9__HUMAN DNA-directed RNA polymerase II 14.5 kDa polypeptide (RPB9) (RPB14.5) [*H. sapiens*] |
| 63 | 14250 | AA799729 | j, k | Phosphodiesterase 4B, cAMP-specific (dunce (*Drosophila*)-homolog phosphodiesterase E4) | ESTs, Phosphodiesterase 4B, cAMP-specific (dunce (*Drosophila*)-homolog phosphodiesterase E4) |
| 64 | 18061 | AA799735 | r | RuvB-like protein 1 | RuvB-like protein 1 |
| 65 | 18349 | AA799744 | j, p, q, y, z | | ESTs |
| 66 | 17494 | AA799751 | w, x | | ESTs |
| 67 | 17875 | AA799755 | cc, dd | | ESTs, Weakly similar to carboxypeptidase E [*Rattus norvegicus*] [*R.norvegicus*] |
| 68 | 4133 | AA799762 | e, p, q, ii | | ESTs |
| 69 | 20997 | AA799764 | hh | | ESTs |
| 70 | 18360 | AA799771 | u, jj, kk | | ESTs |
| 71 | 11530 | AA799773 | a, o, q, y, ee, ff, hh, jj, kk | | ESTs, Weakly similar to A37098 gelation factor ABP-280, long form - human [*H. sapiens*] |
| 71 | 11531 | AA799773 | a, o, q, z, ff, hh kk | | ESTs, Weakly similar to A37098 gelation factor ABP-280, long form - human [H. sapiens] |
| 72 | 6425 | AA799784 | f, aa, bb | | ESTs |
| 73 | 13683 | AA799788 | e | HHs:Cell division cycle 34 | ESTs, Moderately similar to I54552 hypothetical serine proteinase - rat [*R.norvegicus*] |
| 74 | 20998 | AA799803 | b, l, m | | ESTs, Weakly similar to JC6554 complement subcomponent C1s (EC 3.4.21.42) precursor [similarity] - rat [*R.norvegicus*] |
| 75 | 14504 | AA799804 | f, g, cc, dd | | ESTs |
| 76 | 11422 | AA799812 | a, ee, ff, jj, kk | | ESTs, Moderately similar to PTN3__HUMAN Protein tyrosine phosphatase, non-receptor type 3 (Protein-tyrosine phosphatase H1) (PTP-H1) [*H. sapiens*] |
| 76 | 11423 | AA799812 | a, jj, kk, ll | | ESTs, Moderately similar to PTN3__HUMAN Protein tyrosine phosphatase, non-receptor type 3 (Protein-tyrosine phosphatase H1) (PTP-H1) [*H. sapiens*] |
| 77 | 21000 | AA799816 | h, l | | ESTs, Highly similar to T46306 hypothetical protein DKFZp434D2411.1 - human (fragment) [*H. sapiens*] |
| 78 | 21002 | AA799832 | gg | | ESTs |
| 79 | 21007 | AA799861 | d | | ESTs, Highly similar to IRF7__MOUSE interferon regulatory factor 7 (IRF-7) [*M. musculus*] |
| 80 | 18378 | AA799888 | hh | | ESTs, Highly similar to nuclear localization signal protein absent in velo-cardio-facial patients [*Mus musculus*] [*M. musculus*] |
| 81 | 15011 | AA799893 | hh | | ESTs, Highly similar to DDRT helix-destabilizing protein - rat [*R.norvegicus*] |
| 82 | 21027 | AA799964 | h | | ESTs |
| 83 | 18400 | AA799991 | aa, bb | | ESTs |
| 84 | 18881 | AA799992 | c, h, l, n, o, w, x | | ESTs, Moderately similar to predicted gene ICRFP703B1614Q5.6; ICRFP703N2430Q5.6; C11orf17 [*Mus musculus*] [*M. musculus*] |
| 84 | 18883 | AA799992 | c, n, o, kk | | ESTs, ESTs, Moderately similar to predicted gene ICRFP703B1614Q5.6; ICRFP703N2430Q5.6; C11orf17 [*Mus musculus*] [*M. musculus*] |
| 85 | 16712 | AA800015 | e | integrin-linked kinase | integrin-linked kinase |
| 86 | 23343 | AA800016 | cc, dd | | ESTs, Weakly similar to Yeast ABD1 protein like [*Caenorhabditis elegans*] [*C. elegans*] |
| 87 | 23344 | AA800034 | s, t | | ESTs |
| 88 | 11352 | AA800036 | f, jj, kk, ll | | ESTs |
| 89 | 19177 | AA800062 | ll | | ESTs |
| 90 | 13568 | AA800169 | h, l | | ESTs |
| 91 | 21065 | AA800179 | s, t | | ESTs, Highly similar to NOC4__MOUSE Neighbor of COX4 [*M. musculus*] |

TABLE 1-continued

| SEQ ID | GLGC ID | GenBank Accession No. | Model Code | Known Gene Name | Unigene Sequence Cluster Title |
|---|---|---|---|---|---|
| 92 | 4832 | AA800190 | a, e, ii, kk | HHs:phosphorylase, glycogen; brain | ESTs, Highly similar to S37300 glycogen phosphorylase (EC 2.4.1.1), brain - rat [*R.norvegicus*] |
| 93 | 16420 | AA800191 | f, g | | ESTs |
| 94 | 18430 | AA800197 | gg | | ESTs |
| 95 | 21069 | AA800200 | l, m, ee, ff, jj, kk | | ESTs |
| 96 | 21656 | AA800202 | s, t | | ESTs |
| 97 | 3692 | AA800210 | hh, jj, kk | | ESTs |
| 98 | 600 | AA800222 | g, bb | | ESTs |
| 99 | 4130 | AA800298 | c, g, kk | | ESTs |
| 100 | 21086 | AA800305 | cc, dd | | ESTs, Moderately similar to RB5A__HUMAN Ras-related protein Rab-5A [*H. sapiens*] |
| 101 | 24228 | AA800318 | b, m | | ESTs, Moderately similar to IC1__MOUSE Plasma protease C1 inhibitor precursor (C1 Inh) (C1Inh) [*M. musculus*] |
| 102 | 12253 | AA800549 | r, ii | | ESTs |
| 103 | 6892 | AA800551 | e, ee, ff, ii | DnaJ-like protein | DnaJ-like protein |
| 104 | 13930 | AA800613 | j, k, p, q, y, z | | EST |
| 105 | 4843 | AA800651 | f, g | | ESTs |
| 106 | 17997 | AA800671 | u | | ESTs, Moderately similar to A54854 Ras GTPase activating protein-related protein - human [*H. sapiens*] |
| 107 | 5257 | AA800673 | s | | ESTs, Highly similar to KIAA0164 gene product [*Homo sapiens*] [*H. sapiens*] |
| 108 | 23368 | AA800678 | a, j, k, jj, kk | | ESTs |
| 109 | 21377 | AA800719 | w, x | | ESTs |
| 110 | 17648 | AA800735 | cc, dd | | ESTs, Weakly similar to VIL1__MOUSE Villin 1 [*M. musculus*] |
| 110 | 17649 | AA800735 | cc, dd | | ESTs, Weakly similar to VIL1__MOUSE Villin 1 [*M. musculus*] |
| 111 | 8137 | AA800749 | g | | ESTs |
| 112 | 19101 | AA800787 | aa, bb, ll | | ESTs |
| 113 | 12797 | AA800790 | p, q | | ESTs |
| 114 | 22386 | AA800844 | g | | ESTs, Moderately similar to LYOX__RAT Protein-lysine 6-oxidase precursor (Lysyl oxidase) [*R.norvegicus*] |
| 115 | 17658 | AA800853 | d, j, k, s, t | | ESTs |
| 116 | 10320 | AA800855 | b, l, m | | ESTs, ESTs, Highly similar to MLF2__MOUSE Myeloid leukemia factor 2 (Myelodysplasia-myeloid leukemia factor 2) [*M. musculus*] |
| 117 | 15213 | AA800908 | hh | | ESTs |
| 118 | 21416 | AA800962 | hh | | ESTs, Highly similar to S11661 talin-mouse [*M. musculus*] |
| 119 | 11901 | AA801058 | d | aldehyde dehydrogenase family 9, subfamily A1 | aldehyde dehydrogenase family 9, subfamily A1 |
| 120 | 12086 | AA801116 | a | | ESTs |
| 121 | 16852 | AA801130 | h, l | growth factor receptor bound protein 2 | growth factor receptor bound protein 2 |
| 122 | 23115 | AA801165 | c | Testis-specific histone 2a | Testis-specific histone 2a |
| 123 | 21427 | AA801181 | cc, dd | | ESTs, Highly similar to P52K__HUMAN 52 kDa repressor of the inhibitor of the protein kinase (p58IPK-interacting protein) (58 kDa interferon-induced protein kinase-interacting protein) (P52rIPK) (Death associated protein 4) [*H. sapiens*] |
| 124 | 22318 | AA801187 | h, l | | |
| 125 | 10549 | AA801255 | r, kk | | ESTs |
| 126 | 12399 | AA801307 | gg, ll | | ESTs, Weakly similar to TAC1__HUMAN Transforming acidic coiled-coil-containing protein 1 [*H. sapiens*] |
| 127 | 16388 | AA801310 | e | | ESTs |
| 128 | 11166 | AA801346 | n, o | | ESTs, Weakly similar to plexin B3; plexin 6 [*Mus musculus*] [*M. musculus*] |
| 129 | 11995 | AA801352 | n, o | | ESTs, Moderately similar to S63540 protein DS 1, 24K - human [*H. sapiens*] |
| 130 | 24237 | AA817726 | kk | | ESTs |
| 131 | 18796 | AA817761 | e | | ESTs |
| 132 | 23725 | AA817816 | a | | ESTs |
| 133 | 23828 | AA817823 | ii | HHs:UDP-Gal:betaGlcNAc beta 1,4- | ESTs, Weakly similar to glycoprotein galactosyltransferase beta 1,4; beta-1,4-GalT; galactosyltransferase 2 beta 1,4; B- |

TABLE 1-continued

| SEQ ID | GLGC ID | GenBank Accession No. | Model Code | Known Gene Name | Unigene Sequence Cluster Title |
|---|---|---|---|---|---|
| | | | | galactosyltransferase, polypeptide 2 | 1,4-GalT1; beta-1,4-GalT1 [*Mus musculus*] [*M. musculus*] |
| 134 | 1754 | AA817837 | kk | potassium channel, subfamily K, member 2 | potassium channel, subfamily K, member 2 |
| 135 | 1802 | AA817841 | e, bb | | ESTs |
| 136 | 1901 | AA817849 | n, o | | ESTs |
| 137 | 1998 | AA817864 | e | | ESTs |
| 138 | 14101 | AA817867 | ii | | ESTs, Highly similar to I48253 beta-N-acetylhexosaminidase (EC 3.2.1.52) alpha chain precursor - mouse [*M. musculus*] |
| 139 | 2143 | AA817892 | r | guanine nucleotide binding protein beta 2 subunit | guanine nucleotide binding protein beta 2 subunit |
| 140 | 6550 | AA817947 | d, jj, kk | | ESTs |
| 141 | 5982 | AA817999 | r | | ESTs |
| 142 | 5996 | AA818065 | ii | | ESTs |
| 143 | 16756 | AA818089 | ll | HHs:glycyl-tRNA synthetase | ESTs, Highly similar to SYG_HUMAN Glycyl-tRNA synthetase (Glycine--tRNA ligase) (GlyRS) [*H. sapiens*] |
| 144 | 6014 | AA818153 | ii | | ESTs |
| 145 | 6015 | AA818158 | l | | ESTs |
| 146 | 6522 | AA818261 | r | | ESTs, Moderately similar to A47318 RNA-binding protein Raly - mouse [*M. musculus*] |
| 147 | 6037 | AA818288 | ll | | ESTs |
| 148 | 367 | AA818342 | hh | | ESTs |
| 149 | 8058 | AA818475 | n, o, w, x | | ESTs, Highly similar to RIKEN cDNA 2310008M10 [*Mus musculus*] [*M. musculus*] |
| 150 | 6226 | AA818521 | ll | | ESTs |
| 151 | 8728 | AA818615 | h, t | | ESTs |
| 152 | 6053 | AA818655 | t | | EST |
| 153 | 6054 | AA818658 | p, q, ee, ff | Diphtheria toxin receptor (heparin binding epidermal growth factor - like growth factor) | Diphtheria toxin receptor (heparin binding epidermal growth factor - like growth factor) |
| 154 | 11864 | AA818717 | w, x | | ESTs |
| 155 | 4330 | AA818747 | r, bb, ll | | ESTs |
| 156 | 19723 | AA818761 | p, q | | ESTs |
| 157 | 6829 | AA818784 | ii | | ESTs |
| 158 | 4491 | AA818798 | w, x | | *Rattus norvegicus* mRNA for cathepsin Y, partial cds |
| 159 | 6073 | AA818818 | c | | EST |
| 160 | 12690 | AA818820 | ii | | ESTs |
| 161 | 13428 | AA818861 | jj, kk | | ESTs |
| 162 | 6092 | AA818897 | b | | ESTs |
| 163 | 19729 | AA818910 | d | | ESTs |
| 164 | 6094 | AA818911 | t | | ESTs |
| 165 | 6098 | AA818935 | n, o | | ESTs |
| 166 | 6136 | AA819086 | cc, dd | | ESTs |
| 167 | 5863 | AA819111 | jj, kk | | ESTs |
| 168 | 12305 | AA819220 | aa, bb | | ESTs |
| 169 | 9083 | AA819332 | j, k | | ESTs |
| 170 | 9310 | AA819367 | cc, dd | | ESTs |
| 171 | 6281 | AA819517 | hh | | ESTs, Weakly similar to JC5707 HYA22 protein - human [*H. sapiens*] |
| 172 | 6282 | AA819523 | bb | | ESTs |
| 173 | 6168 | AA819606 | aa, bb | | ESTs |
| 174 | 6176 | AA819657 | v | | EST |
| 175 | 16971 | AA819691 | n, o | protein phosphatase 2 (formerly 2A), regulatory subunit B (PR 52), alpha isoform | protein phosphatase 2 (formerly 2A), regulatory subunit B (PR 52), alpha isoform |
| 176 | 11021 | AA819767 | p, q | | ESTs |
| 177 | 19451 | AA819788 | c | | ESTs, Weakly similar to 28kD interferon alpha responsive protein [*Mus musculus*] [*M. musculus*] |
| 178 | 18427 | AA819891 | gg | | ESTs, Weakly similar to B36579 inositol 1,4,5-triphosphate receptor 2 - rat [*R.norvegicus*] |
| 179 | 320 | AA819905 | hh | stearoyl-Coenzyme A desaturase 1 | stearoyl-Coenzyme A desaturase 1 |
| 180 | 9815 | AA848218 | p, q | | ESTs |

TABLE 1-continued

| SEQ ID | GLGC ID | GenBank Accession No. | Model Code | Known Gene Name | Unigene Sequence Cluster Title |
|---|---|---|---|---|---|
| 181 | 17614 | AA848306 | b | | ESTs, Weakly similar to DDRT helix-destabilizing protein - rat [R.norvegicus] |
| 182 | 23521 | AA848407 | h, l | | ESTs |
| 183 | 11160 | AA848470 | ii | | ESTs |
| 184 | 2324 | AA848545 | r | | ESTs, Weakly similar to T19253 hypothetical protein C14A4.11 - Caenorhabditis elegans [C. elegans] |
| 185 | 25110 | AA848546 | cc, dd | | ESTs, Weakly similar to T19253 hypothetical protein C14A4.11 - Caenorhabditis elegans [C. elegans] |
| 186 | 14654 | AA848795 | jj, kk | | ESTs |
| 187 | 7749 | AA848804 | kk | | ESTs, Highly similar to BTF3_MOUSE Transcription factor BTF3 (RNA polymerase B transcription factor 3) [M. musculus] |
| 188 | 14604 | AA848828 | c | | ESTs |
| 189 | 12102 | AA848902 | ii | | ESTs, Weakly similar to S12207 hypothetical protein (B2 element) - mouse [M. musculus] |
| 190 | 18673 | AA849028 | t | proteasome (prosome, macropain) subunit, alpha type 3 | proteasome (prosome, macropain) subunit, alpha type 3 |
| 191 | 8619 | AA849317 | jj, kk | | ESTs |
| 192 | 2075 | AA849394 | u, v | | ESTs, Weakly similar to DDRT helix-destabilizing protein - rat [R.norvegicus] |
| 193 | 18909 | AA849426 | h, l | | ESTs, Weakly similar to YLC4_CAEEL Hypothetical 81.0 kDa protein C35D10.4 in chromosome III [C. elegans] |
| 194 | 11726 | AA849518 | t | | ESTs |
| 194 | 11727 | AA849518 | t | | ESTs |
| 195 | 21264 | AA849731 | cc, dd | | ESTs |
| 196 | 24128 | AA849766 | bb | | ESTs, Highly similar to T08750 hypothetical protein DKFZp586E1519.1 - human (fragment) [H. sapiens] |
| 197 | 21275 | AA849796 | d | | ESTs |
| 198 | 8515 | AA849917 | b, v | | ESTs |
| 199 | 11355 | AA849957 | ll | | ESTs |
| 200 | 22026 | AA850060 | n, o | | ESTs, Moderately similar to 0806162L protein URF5 [Mus musculus] [M. musculus] |
| 200 | 22028 | AA850060 | cc, dd | | ESTs, Moderately similar to 0806162L protein URF5 [Mus musculus] [M. musculus] |
| 201 | 21353 | AA850247 | d | | ESTs |
| 202 | 19071 | AA850524 | k | | ESTs, Highly similar to I49257 NF2d9 - mouse [M. musculus] |
| 203 | 6649 | AA850563 | aa, bb | | ESTs |
| 204 | 19545 | AA850735 | e | | ESTs |
| 205 | 5668 | AA850743 | jj, kk | | ESTs |
| 206 | 21754 | AA850824 | ii | | ESTs |
| 207 | 21761 | AA850872 | h, l | | ESTs |
| 208 | 21766 | AA850916 | kk | | ESTs |
| 1 | 19424 | AA850922 | h, l | Rattus norvegicus mitochondrial genome. 9/22Length = 16, 3 | dimethylarginine dimethylaminohydrolase 1 |
| 209 | 21782 | AA851034 | u, v | | ESTs |
| 210 | 4490 | AA851184 | n, o | | Rattus norvegicus mRNA for cathepsin Y, partial cds |
| 211 | 4163 | AA851210 | gg | | ESTs, Weakly similar to T33304 hypothetical protein R01B10.5 - Caenorhabditis elegans [C. elegans] |
| 212 | 21456 | AA851239 | cc, dd | | ESTs, Moderately similar to exostoses (multiple)-like 2; Exostoses, multiple, like 2 [Homo sapiens] [H. sapiens] |
| 213 | 21465 | AA851273 | h, l | | ESTs, Weakly similar to retinoic acid receptor responder (tazarotene induced) 2 [Homo sapiens] [H. sapiens] |
| 214 | 19214 | AA851364 | u, v | | ESTs |
| 215 | 16934 | AA851403 | b | | ESTs, Highly similar to RIKEN cDNA 2900010I05 [Mus musculus] [M. musculus] |
| 216 | 13627 | AA851493 | aa, bb | claudin 7 | claudin7 |
| 217 | 21713 | AA851637 | e, r | Lutheran blood group (Auberger b antigen included) | Lutheran blood group (Auberger b antigen included) |

TABLE 1-continued

| SEQ ID | GLGC ID | GenBank Accession No. | Model Code | Known Gene Name | Unigene Sequence Cluster Title |
|---|---|---|---|---|---|
| 218 | 21514 | AA851660 | ee, ff | | ESTs |
| 219 | 19136 | AA851788 | e | | ESTs |
| 220 | 12187 | AA851820 | e | | ESTs |
| 221 | 19159 | AA851953 | u, v | | ESTs, Moderately similar to T12501 hypothetical protein DKFZp434O171.1 - human (fragment) [*H. sapiens*] |
| 222 | 15260 | AA858518 | f, g | | ESTs, Weakly similar to T51146 ring-box protein 1 [imported] - human [*H. sapiens*] |
| 223 | 15283 | AA858548 | a, kk | | ESTs |
| 224 | 23069 | AA858572 | u, v | | ESTs |
| 225 | 1801 | AA858636 | n, o | | ESTs, Highly similar to mini chromosome maintenance deficient 7 (*S. cerevisiae*) [*Mus musculus*] [*M. musculus*] |
| 226 | 18350 | AA858674 | p, q, ee, ff | | ESTs |
| 227 | 12829 | AA858695 | gg | | ESTs, Moderately similar to mitochondrial ribosomal protein S33; mitochondrial 28S ribosomal protein S33 [*Homo sapiens*] [*H. sapiens*] |
| 228 | 13802 | AA858853 | b, l, m | | ESTs, Weakly similar to NTC1_RAT Neurogenic locus notch homolog protein 1 precursor (Notch 1) [*R.norvegicus*] |
| 229 | 17236 | AA858903 | s, t, gg | Tissue inhibitor of metalloproteinase 3 | Tissue inhibitor of metalloproteinase 3 |
| 230 | 5867 | AA858953 | kk | | ESTs, Moderately similar to SYN_HUMAN Asparaginyl-tRNA synthetase, cytoplasmic (Asparagine--tRNA ligase) (AsnRS) [*H. sapiens*] |
| 231 | 14209 | AA858955 | j, k | | EST |
| 232 | 17361 | AA859114 | kk | | ESTs |
| 233 | 6158 | AA859284 | f, g | procollagen, type I, alpha 2 | procollagen, type I, alpha 2 |
| 234 | 6458 | AA859319 | b, l, m | | ESTs |
| 235 | 15157 | AA859343 | j, k | | ESTs |
| 236 | 15160 | AA859346 | u, v | | ESTs, Moderately similar to RP38_HUMAN Ribonuclease P protein subunit p38 (RNaseP protein p38) [*H. sapiens*] |
| 237 | 16314 | AA859348 | p, q | | ESTs |
| 238 | 22605 | AA859447 | q | | ESTs |
| 239 | 23142 | AA859479 | f | | ESTs |
| 240 | 13595 | AA859508 | b, s | | ESTs |
| 241 | 23340 | AA859519 | d, h, l | | ESTs, Highly similar to JC6127 RNA-binding protein type 1 - human [*H. sapiens*] |
| 242 | 15150 | AA859562 | d, hh | | ESTs |
| 243 | 4809 | AA859616 | gg | | ESTs, Weakly similar to FYVE zinc finger [*Caenorhabditis elegans*] [*C. elegans*] |
| 244 | 16228 | AA859643 | c | | ESTs |
| 245 | 11635 | AA859645 | j, k, ll | attractin | attractin |
| 246 | 16318 | AA859648 | p, q | | ESTs, Weakly similar to DJA1_MOUSE DnaJ homolog subfamily A member 1 (Heat shock 40 kDa protein 4) (DnaJ protein homolog 2) (HSJ-2) [*R.norvegicus*] |
| 247 | 22406 | AA859680 | y, z | | ESTs |
| 247 | 22407 | AA859680 | s, t | | ESTs |
| 248 | 20582 | AA859688 | w, hh | | ESTs, Highly similar to AU RNA-binding enoyl-coenzyme A hydratase; AU RNA-binding protein/enoyl-coenzyme A hydratase [*Mus musculus*] [*M. musculus*] |
| 249 | 21440 | AA859719 | l, m | | ESTs |
| 250 | 22670 | AA859750 | y, z, hh | | ESTs, Weakly similar to ERF_MOUSE ETS-domain transcription factor ERF [*M. musculus*] |
| 251 | 2262 | AA859757 | hh | collagen, type V, alpha 1 | collagen, type V, alpha 1 |
| 252 | 22385 | AA859805 | g, s, t | | ESTs, Moderately similar to LYOX_RAT Protein-lysine 6-oxidase precursor (Lysyl oxidase) [*R.norvegicus*] |
| 253 | 14213 | AA859827 | a, y, z, ee, ff | | ESTs, Moderately similar to URK1_MOUSE URIDINE KINASE (URIDINE MONOPHOSPHOKINASE) [*M. musculus*] |
| 254 | 22630 | AA859848 | gg | | ESTs |
| 255 | 22739 | AA859877 | h, l, ll | | ESTs |
| 256 | 22773 | AA859885 | c, r, bb | | ESTs |
| 257 | 15165 | AA859919 | ii | | ESTs |

TABLE 1-continued

| SEQ ID | GLGC ID | GenBank Accession No. | Model Code | Known Gene Name | Unigene Sequence Cluster Title |
|---|---|---|---|---|---|
| 257 | 15166 | AA859919 | hh | | ESTs |
| 258 | 22940 | AA859922 | n, o | | ESTs |
| 259 | 18468 | AA859966 | l, m | | ESTs, Moderately similar to TNP1_HUMAN Tumor necrosis factor, alpha-induced protein 1, endothelial (B12 protein) [*H. sapiens*] |
| 260 | 23336 | AA859981 | ee, ff, jj, kk | HHs:inositol(myo)-1 (or 4)-monophosphatase 2 | ESTs, Weakly similar to MYOP_RAT Myo-inositol-1 (or 4)-monophosphatase (IMPase) (IMP) (Inositol monophosphatase) (Lithium-sensitive myo-inositol monophosphatase A1) [*R.norvegicus*] |
| 261 | 14206 | AA859994 | a | | ESTs |
| 262 | 23347 | AA860015 | aa, bb | | ESTs, Weakly similar to T50607 hypothethical protein DKFZp434I1016.1 - human (fragment) [*H. sapiens*] |
| 263 | 4222 | AA860024 | h, l, w, x | | ESTs, Highly similar to EF1G_MOUSE Elongation factor 1-gamma (EF-1-gamma) (eEF-1B gamma) [*M. musculus*] |
| 264 | 23585 | AA860029 | aa | | ESTs |
| 265 | 13974 | AA860030 | n, o, w, x, ll | | *Rattus norvegicus* mRNA for class I beta-tubulin, complete cds |
| 266 | 15846 | AA866250 | b, l, m | | ESTs |
| 267 | 15884 | AA866276 | d, f, g, r | | ESTs, Weakly similar to A60543 protein kinase (EC 2.7.1.37), cAMP-dependent, catalytic chain - rat (fragment) [*R. norvegicus*] |
| 268 | 17217 | AA866299 | a, j, k, w, x, y, z, jj, kk | | ESTs |
| 268 | 17218 | AA866299 | gg, jj, kk | | ESTs |
| 269 | 17742 | AA866302 | c | 4-hydroxyphenylpyruvic acid dioxygenase | 4-hydroxyphenylpyruvic acid dioxygenase |
| 270 | 15935 | AA866345 | kk | | ESTs |
| 271 | 16607 | AA866364 | r | | ESTs |
| 272 | 11865 | AA866383 | d, ee, ff, kk | | ESTs |
| 273 | 15980 | AA866426 | s, ii | | ESTs |
| 274 | 15990 | AA866439 | b | | ESTs |
| 275 | 16001 | AA866452 | bb, cc, dd | Actin, alpha, cardiac | Actin, alpha, cardiac |
| 276 | 309 | AA866460 | b | | ESTs, Weakly similar to T42737 gp330 protein precursor - rat [*R.norvegicus*] |
| 277 | 9391 | AA866477 | r | | ESTs, Moderately similar to COXM_MOUSE Cytochrome c oxidase polypeptide VIIb, mitochondrial precursor [*M. musculus*] |
| 278 | 16029 | AA874803 | j, k | | ESTs, Moderately similar to 0806162L protein URF5 [*Mus musculus*] [*M. musculus*] |
| 278 | 16030 | AA874803 | j, k | | ESTs, Moderately similar to 0806162L protein URF5 [*Mus musculus*] [*M. musculus*] |
| 279 | 16070 | AA874873 | cc, dd | | ESTs, |
| 280 | 16074 | AA874874 | p, q | HMm:alcohol dehydrogenase 5 | ESTs, Highly similar to ADHX_RAT ALCOHOL DEHYDROGENASE CLASS III (ALCOHOL DEHYDROGENASE 2) (GLUTATHIONE-DEPENDENT FORMALDEHYDE DEHYDROGENASE) (FDH) (FALDH) (ALCOHOL DEHYDROGENASE-B2) [*R.norvegicus*] |
| 281 | 18563 | AA874875 | ii | | |
| 282 | 16082 | AA874887 | ii | | ESTs, Weakly similar to segregation of mitotic chromosomes b; SMC (segregation of mitotic chromosomes 1)-like 1 (yeast) [*Rattus norvegicus*] [*R.norvegicus*] |
| 283 | 16084 | AA874889 | r | | ESTs |
| 284 | 22781 | AA874926 | hh | | ESTs, Weakly similar to dual-specificity phosphatase [*Mus musculus*] [*M. musculus*] |
| 285 | 16139 | AA874927 | cc, dd | | ESTs |
| 286 | 15116 | AA874928 | f | | ESTs, Highly similar to SNX4_HUMAN Sorting nexin 4 [*H. sapiens*] |
| 287 | 16177 | AA874952 | ll | | ESTs |
| 288 | 17303 | AA874990 | u, v, w, x | | ESTs, Weakly similar to RIKEN cDNA 6330407G11 [*Mus musculus*] [*M. musculus*] |

TABLE 1-continued

| SEQ ID | GLGC ID | GenBank Accession No. | Model Code | Known Gene Name | Unigene Sequence Cluster Title |
|---|---|---|---|---|---|
| 289 | 16192 | AA874995 | jj, kk | | ESTs |
| 290 | 16215 | AA874999 | h, l, n, o | | ESTs, Highly similar to protein translocation complex beta; protein transport protein SEC61 beta subunit [*Homo sapiens*] [*H. sapiens*] |
| 291 | 16241 | AA875019 | l, m | | ESTs, Highly similar to ZAP3_MOUSE Nuclear protein ZAP3 [*M. musculus*] |
| 292 | 15573 | AA875023 | b, l, m | | ESTs |
| 293 | 16312 | AA875032 | j, k, p, q, bb, kk | ESTs | |
| 294 | 16319 | AA875047 | e | | ESTs, Highly similar to TCPZ_MOUSE T-complex protein 1, zeta subunit (TCP-1-zeta) (CCT-zeta) (CCT-zeta-1) [*M. musculus*] |
| 295 | 16342 | AA875060 | s, t, jj, kk | | ESTs |
| 296 | 1190 | AA875089 | hh | Calpastatin | Calpastatin |
| 297 | 16416 | AA875098 | n, o | | ESTs, Highly similar to RIKEN cDNA 1110002O23 [*Mus musculus*] [*M. musculus*] |
| 298 | 16419 | AA875102 | d | | ESTs, Highly similar to RUXE_HUMAN Small nuclear ribonucleoprotein E (snRNP E) (Sm protein E) (Sm-E) (SmE) [*M. musculus*] |
| 299 | 4339 | AA875121 | jj, kk | CCAAT binding factor of CBF-C/NFY-C | CCAAT binding factor of CBF-C/NFY-C |
| 300 | 15310 | AA875123 | u, v | | EST |
| 301 | 15311 | AA875124 | ii | | EST |
| 302 | 11857 | AA875132 | d, ii | | ESTs |
| 303 | 14285 | AA875194 | ii | | ESTs |
| 304 | 15372 | AA875205 | y, z | | ESTs, Highly similar to IF39_HUMAN Eukaryotic translation initiation factor 3 subunit 9 (eIF-3 eta) (eIF3 p116) (eIF3 p110) [*H. sapiens*] |
| 305 | 18897 | AA875207 | t | Hemoglobin, beta | Hemoglobin, beta |
| 306 | 15384 | AA875217 | cc, dd | | ESTs |
| 307 | 15887 | AA875225 | e | GTP-binding protein (G-alpha-i2) | GTP-binding protein (G-alpha-i2) |
| 307 | 15888 | AA875225 | e, gg | GTP-binding protein (G-alpha-i2) | GTP-binding protein (G-alpha-i2) |
| 308 | 15402 | AA875261 | d, jj, kk | | ESTs |
| 309 | 15410 | AA875268 | jj, kk | | ESTs, Highly similar to NUKM_HUMAN NADH-ubiquinone oxidoreductase 20 kDa subunit, mitochondrial precursor (Complex I-20KD) (CI-20KD) (PSST subunit) [*H. sapiens*] |
| 310 | 15440 | AA875316 | h, l | | ESTs |
| 311 | 15446 | AA875327 | n, o, s, t | | ESTs |
| 312 | 15510 | AA875428 | a, s, t, x, ee, ff, ll | ESTs | |
| 313 | 15513 | AA875431 | n, o | | ESTs, Weakly similar to synbindin; syndecan binding protein 2 [*Mus musculus*] [*M. musculus*] |
| 314 | 18864 | AA875470 | b | | ESTs, Highly similar to COP9 (constitutive photomorphogenic) homolog, subunit 7a (*Arabidopsis thaliana*); DNA segment, Chr 6, ERATO Doi 35, expressed; COP9 complex S7a; COP9 (constitutive photomorphogenic), subunit 7a (*Arabidopsis*) [*Mus musculus*] [*M. musculus*] |
| 315 | 15412 | AA875500 | r | | ESTs |
| 316 | 24470 | AA875523 | aa, bb | | ESTs, Highly similar to MLES_RAT Myosin light chain alkali, smooth-muscle isoform (MLC3SM) [*R.norvegicus*] |
| 316 | 24471 | AA875523 | ii | | ESTs, Highly similar to MLES_RAT Myosin light chain alkali, smooth-muscle isoform (MLC3SM) [*R.norvegicus*] |
| 316 | 24472 | AA875523 | ii | | ESTs, Highly similar to MLES_RAT Myosin light chain alkali, smooth-muscle isoform (MLC3SM) [*R.norvegicus*] |
| 2 | 6153 | AA875531 | g, j, k | *Rattus norvegicus* mitochondrial genome. 9/22Length = 16, 3 | *Rattus norvegicus* CDK110 mRNA, procollagen, type I, alpha 2 |
| 317 | 15558 | AA875537 | y, z | | ESTs, Highly similar to SFR2_MOUSE Splicing factor, arginine/serine-rich 2 (Splicing factor SC35) (SC-35) (Splicing |

TABLE 1-continued

| SEQ ID | GLGC ID | GenBank Accession No. | Model Code | Known Gene Name | Unigene Sequence Cluster Title |
|---|---|---|---|---|---|
| | | | | | component, 35 kDa) (PR264 protein) [*M. musculus*] |
| 318 | 13051 | AA875559 | hh | | ESTs |
| 319 | 15617 | AA875620 | ee, ff, jj, kk | | ESTs |
| 319 | 15618 | AA875620 | y, z, ee, ff | | ESTs |
| 320 | 15629 | AA875629 | n, o, ll | | ESTs |
| 321 | 15638 | AA875633 | r, gg | | ESTs |
| 322 | 2846 | AA875639 | a | | ESTs, Weakly similar to FAS_RAT FATTY ACID SYNTHASE [INCLUDES: EC 2.3.1.38; EC 2.3.1.39; EC 2.3.1.41; EC 1.1.1.100; EC4.2.1.61; EC 1.3.1.10; EC 3.1.2.14] [*R.norvegicus*] |
| 323 | 15688 | AA875664 | aa | | ESTs, Highly similar to mitochondria associated granulocyte macrophage CSF signaling molecule [*Mus musculus*] [*M. musculus*] |
| 324 | 19388 | AA891032 | r | | EST, Moderately similar to S37488 gene T10 protein - mouse [*M. musculus*] |
| 325 | 5384 | AA891041 | j, k, p, q, y, z, kk | jun B proto-oncogene | jun B proto-oncogene |
| 326 | 17057 | AA891049 | c | | ESTs, Highly similar to PFD2_MOUSE Prefoldin subunit 2 [*M. musculus*] |
| 327 | 19646 | AA891054 | c, p | | ESTs |
| 328 | 11940 | AA891108 | p, q, y, ee, ff | | ESTs |
| 329 | 18582 | AA891207 | u, ee, ff | | ESTs |
| 330 | 24814 | AA891209 | n, o, w, x | | ESTs, Highly similar to interleukin 25; lymphocyte antigen 6 complex, locus E ligand [*Mus musculus*] [*M. musculus*] |
| 331 | 21917 | AA891220 | h, l | | ESTs |
| 332 | 21928 | AA891302 | b, l, m | | ESTs, Weakly similar to A53714 protein kinase (EC 2.7.1.37) BL44 - human [*H. sapiens*] |
| 333 | 16446 | AA891423 | ii | | ESTs |
| 334 | 21938 | AA891439 | c | | ESTs |
| 335 | 13789 | AA891476 | jj, kk | | ESTs |
| 336 | 21951 | AA891535 | cc, dd | | ESTs, Highly similar to hippocampus abundant gene transcript 1 [*Mus musculus*] [*M. musculus*] |
| 337 | 19238 | AA891542 | d | | ESTs |
| 338 | 21905 | AA891546 | s | | ESTs |
| 339 | 15414 | AA891551 | p | | ESTs |
| 340 | 11949 | AA891580 | e | | ESTs |
| 341 | 11950 | AA891595 | e | | ESTs |
| 342 | 4447 | AA891596 | e, aa, bb | | ESTs |
| 343 | 4448 | AA891631 | ee, ff, jj, kk | | ESTs |
| 344 | 19321 | AA891666 | cc, dd | melanoma antigen, family D, 1 | melanoma antigen, family D, 1 |
| 345 | 11387 | AA891677 | h, l, ll | | ESTs |
| 346 | 4459 | AA891721 | w, x | | ESTs |
| 347 | 17039 | AA891727 | aa | | ESTs |
| 348 | 23058 | AA891733 | a, l, m, ee, ff, jj, kk | | ESTs |
| 349 | 17255 | AA891734 | e, hh | | ESTs |
| 350 | 11959 | AA891735 | s | | ESTs |
| 351 | 17693 | AA891737 | u, v | | ESTs |
| 352 | 6535 | AA891746 | l, m | | ESTs, Highly similar to endothelial differentiation-related factor 1; hypothetical protein 1-9 [*Mus musculus*] [*M. musculus*] |
| 353 | 18269 | AA891769 | e | | ESTs, Weakly similar to SC65 synaptonemal complex protein [*Rattus norvegicus*] [*R.norvegicus*] |
| 354 | 9905 | AA891774 | l, m | | ESTs |
| 355 | 21672 | AA891789 | f, g | | ESTs, Highly similar to MRGX_HUMAN Transcription factor-like protein MRGX (MORF-related gene X protein) [*H. sapiens*] |
| 356 | 11966 | AA891800 | hh, jj, kk | | ESTs, Weakly similar to F22G12.5.p [*Caenorhabditis elegans*] [*C. elegans*], ESTs, Weakly similar to IPYR_HUMAN Inorganic pyrophosphatase (Pyrophosphate phospho-hydrolase) (PPase) [*H. sapiens*] |

TABLE 1-continued

| SEQ ID | GLGC ID | GenBank Accession No. | Model Code | Known Gene Name | Unigene Sequence Cluster Title |
|---|---|---|---|---|---|
| 356 | 18128 | AA891800 | n, o | | ESTs, Weakly similar to IPYR_HUMAN inorganic pyrophosphatase (Pyrophosphate phospho-hydrolase) (PPase) [*H. sapiens*] |
| 357 | 23083 | AA891802 | cc, dd | | ESTs |
| 358 | 23011 | AA891803 | hh | | ESTs |
| 359 | 7050 | AA891824 | n, o | | *Rattus norvegicus* clone ZG52 mRNA sequence |
| 360 | 16023 | AA891872 | w, x | | ESTs, Highly similar to NNTM_MOUSE NAD(P) transhydrogenase, mitochondrial precursor (Pyridine nucleotide transhydrogenase) (Nicotinamide nucleotide transhydrogenase) [*M. musculus*] |
| 361 | 19319 | AA891937 | f | | ESTs, Highly similar to S66254 dolichyl-diphosphooligosaccharide--protein glycotransferase (EC 2.4.1.119) 50K chain - human [*H. sapiens*] |
| 362 | 1159 | AA891949 | kk | | ESTs |
| 363 | 9826 | AA891950 | jj, kk | | ESTs |
| 364 | 4472 | AA891962 | ll | | ESTs |
| 365 | 4473 | AA891965 | jj, kk | | ESTs, Highly similar to fructosamine 3 kinase [*Mus musculus*] [*M. musculus*] |
| 366 | 4474 | AA891969 | b, l, m | | ESTs |
| 367 | 17374 | AA891978 | w, x, jj, kk | | ESTs |
| 368 | 15087 | AA892010 | s, t | | ESTs, Weakly similar to T22242 hypothetical protein F45G2.10 - *Caenorhabditis elegans* [*C. elegans*] |
| 369 | 17345 | AA892014 | hh | HLA-B associated transcript 1A | HLA-B associated transcript 1A |
| 370 | 13420 | AA892042 | d, t, y, z | | ESTs |
| 371 | 8139 | AA892094 | ii | | ESTs |
| 372 | 23892 | AA892120 | s, t | | ESTs |
| 373 | 16899 | AA892127 | u, v | | ESTs |
| 374 | 12010 | AA892137 | jj, kk | | ESTs, Highly similar to open reading frame 12 [*Mus musculus*] [*M. musculus*] |
| 375 | 11384 | AA892149 | c, w | | ESTs |
| 376 | 20917 | AA892238 | f, ll | | ESTs |
| 377 | 17350 | AA892240 | l, m, ii | | ESTs, Weakly similar to 2008109A set gene [*Rattus norvegicus*] [*R.norvegicus*] |
| 378 | 22903 | AA892250 | d | | ESTs, Highly similar to SYK_HUMAN Lysyl-tRNA synthetase (Lysine--tRNA ligase) (LysRS) [*H. sapiens*] |
| 379 | 9073 | AA892273 | b | | ESTs |
| 380 | 18190 | AA892280 | a, s, t, w, x | | ESTs |
| 381 | 11982 | AA892284 | ii | | ESTs |
| 382 | 18209 | AA892318 | s, t | | ESTs, Highly similar to JC7219 nuclear protein SR-25 - mouse [*M. musculus*] |
| 383 | 13647 | AA892367 | w, x, cc, dd | | ESTs, Highly similar to RL3_RAT 60S RIBOSOMAL PROTEIN L3 (L4) [*R.norvegicus*] |
| 384 | 15492 | AA892376 | f | | ESTs |
| 385 | 3473 | AA892378 | e | | ESTs, Weakly similar to F13B9.8.p [*Caenorhabditis elegans*] [*C. elegans*] |
| 385 | 3474 | AA892378 | e, gg | | ESTs, Weakly similar to F13B9.8.p [*Caenorhabditis elegans*] [*C. elegans*] |
| 386 | 2832 | AA892388 | b, u, v | CD59 antigen | CD59 antigen |
| 387 | 22868 | AA892391 | ee, ff | | ESTs, Weakly similar to TC17_RAT Zinc finger protein 354A (Transcription factor 17) (Renal transcription factor Kid-1) (Kidney, ischemia, and developmentally regulated protein-1) [*R.norvegicus*] |
| 388 | 14754 | AA892414 | gg | | ESTs |
| 389 | 23194 | AA892417 | gg | ephrin A1 | ephrin A1 |
| 390 | 9254 | AA892470 | e | | ESTs, Highly similar to S03644 histone H2A.Z - rat [*R.norvegicus*] |
| 391 | 11992 | AA892485 | f | dihydrolipoamide acetyltransferase | dihydrolipoamide acetyltransferase |
| 392 | 1522 | AA892486 | c | | ESTs, Weakly similar to A36690 sucrose alpha-glucosidase (EC 3.2.1.48) - rat (fragment) [*R.norvegicus*] |
| 393 | 24873 | AA892498 | jj, kk | | ESTs, Weakly similar to CD63_RAT CD63 antigen (AD1 antigen) [*R.norvegicus*] |

TABLE 1-continued

| SEQ ID | GLGC ID | GenBank Accession No. | Model Code | Known Gene Name | Unigene Sequence Cluster Title |
|---|---|---|---|---|---|
| 394 | 14066 | AA892504 | s, t, u | | ESTs |
| 395 | 11994 | AA892507 | hh | | ESTs, Moderately similar to S63540 protein DS 1, 24K - human [*H. sapiens*] |
| 396 | 23888 | AA892520 | w, x | | ESTs |
| 396 | 23889 | AA892520 | w, x | | ESTs |
| 397 | 8599 | AA892522 | r | | ESTs |
| 398 | 17468 | AA892545 | t | | ESTs, Moderately similar to organic cationic transporter-like 2 [*Mus musculus*] [*M. musculus*] |
| 399 | 16507 | AA892547 | cc, dd | | ESTs, Highly similar to hypothetical protein CL25022 [*Homo sapiens*] [*H. sapiens*] |
| 400 | 11202 | AA892554 | r | | ESTs |
| 400 | 11203 | AA892554 | j, k | | ESTs |
| 401 | 13574 | AA892557 | jj, kk | | ESTs |
| 402 | 18274 | AA892572 | gg, hh | | ESTs, Highly similar to RIKEN cDNA 1110001J03 [*Mus musculus*] [*M. musculus*] |
| 402 | 18275 | AA892572 | hh | | ESTs, Highly similar to RIKEN cDNA 1110001J03 [*Mus musculus*] [*M. musculus*] |
| 403 | 4512 | AA892578 | j, k, p, q | | ESTs |
| 404 | 15876 | AA892582 | g, w, x | | ESTs, Highly similar to RL8_HUMAN 60S ribosomal protein L8 [*R.norvegicus*] |
| 405 | 19085 | AA892598 | j, k, y, z, ee, ff, kk | | ESTs, Weakly similar to putative nucleotide binding protein, estradiol-induced [*Homo sapiens*] [*H. sapiens*] |
| 405 | 19086 | AA892598 | j, k, p, q, y, z | | ESTs, Weakly similar to putative nucleotide binding protein, estradiol-induced [*Homo sapiens*] [*H. sapiens*] |
| 406 | 2119 | AA892607 | gg | | ESTs |
| 407 | 4517 | AA892642 | f | | ESTs |
| 408 | 20065 | AA892647 | c, d, r | germinal histone H4 gene | germinal histone H4 gene |
| 409 | 23783 | AA892773 | w, x | | ESTs |
| 410 | 12118 | AA892775 | a, n, x | Lysozyme | Lysozyme |
| 411 | 21972 | AA892791 | ii | | ESTs, Highly similar to ERC1_MOUSE DNA EXCISION REPAIR PROTEIN ERCC-1 [*M. musculus*] |
| 412 | 11997 | AA892828 | f, h, l | HMm:pyruvate dehydrogenase (lipoamide) beta | ESTs, Highly similar to S15892 pyruvate dehydrogenase (lipoamide) (EC 1.2.4.1) beta chain - rat [*R.norvegicus*] |
| 413 | 7148 | AA892842 | f, g | | ESTs, Weakly similar to CAZ3_RAT F-actin capping protein alpha-3 subunit (CAPZ alpha-3) [*R.norvegicus*] |
| 414 | 17923 | AA892843 | b | | ESTs, Moderately similar to hypothetical protein FLJ20917 [*Homo sapiens*] [*H. sapiens*] |
| 415 | 17589 | AA892851 | p, q, s, t | | ESTs |
| 415 | 17590 | AA892851 | a, j, k | | ESTs |
| 416 | 22871 | AA892859 | gg | | ESTs, Weakly similar to PLO1_RAT Procollagen-lysine, 2-oxoglutarate 5-dioxygenase 1 precursor (Lysyl hydroxylase 1) (LH1) [*R.norvegicus*] |
| 417 | 18888 | AA892860 | a | | ESTs |
| 418 | 1031 | AA892863 | t | | ESTs |
| 419 | 12848 | AA892916 | s, t | | ESTs, Weakly similar to J07260 strictosidine synthase (EC 4.3.3.2) homolog 2 - fruit fly (*Drosophila melanogaster*) [*D.melanogaster*] |
| 420 | 24279 | AA892919 | d | nucleolar phosphoprotein p130 | nucleolar phosphoprotein p130 |
| 421 | 16482 | AA892940 | gg | | ESTs, Weakly similar to EF2_RAT Elongation factor 2 (EF-2) [*R.norvegicus*] |
| 422 | 15956 | AA892942 | d | | ESTs |
| 423 | 19124 | AA893022 | ii | | ESTs, Weakly similar to GSHH_RAT Phospholipid hydroperoxide glutathione peroxidase, mitochondrial precursor (PHGPx) (GPX-4) [*R.norvegicus*] |
| 424 | 14360 | AA893043 | h, l | | ESTs |
| 425 | 12022 | AA893105 | u, v, ii | | ESTs |
| 426 | 22423 | AA893164 | m | | ESTs |
| 427 | 17731 | AA893194 | c, f | | ESTs, Moderately similar to hypothetical protein MGC10974 [*Homo sapiens*] [*H. sapiens*] |

TABLE 1-continued

| SEQ ID | GLGC ID | GenBank Accession No. | Model Code | Known Gene Name | Unigene Sequence Cluster Title |
|---|---|---|---|---|---|
| 428 | 13323 | AA893212 | hh | | ESTs |
| 429 | 4243 | AA893217 | f | | ESTs |
| 430 | 3879 | AA893237 | e | | ESTs, Moderately similar to hypothetical protein MBC3205 [*Homo sapiens*] [*H. sapiens*] |
| 431 | 20985 | AA893242 | ll | fatty acid Coenzyme A ligase, long chain 2 | fatty acid Coenzyme A ligase, long chain 2 |
| 431 | 20986 | AA893242 | ll | fatty acid Coenzyme A ligase, long chain 2 | fatty acid Coenzyme A ligase, long chain 2 |
| 432 | 17752 | AA893244 | ii | | ESTs |
| 433 | 21652 | AA893267 | u, v | | ESTs, Weakly similar to S46992 protein p130 - rat [*R.norvegicus*] |
| 434 | 16168 | AA893280 | a, y, z | | ESTs, Moderately similar to ADFP_MOUSE ADIPOPHILIN (ADIPOSE DIFFERENTIATION-RELATED PROTEIN) (ADRP) [*M. musculus*] |
| 435 | 11935 | AA893328 | gg | | ESTs, Moderately similar to C54354 calnexin precursor - rat [*R.norvegicus*] |
| 436 | 22355 | AA893338 | b, u, v | | *Rattus norvegicus* hypothetical RNA binding protein RDA288 mRNA, complete cds |
| 437 | 9082 | AA893357 | gg | | ESTs |
| 438 | 18542 | AA893493 | g | | ESTs, Highly similar to RL26_RAT 60S RIBOSOMAL PROTEIN L26 [*R.norvegicus*] |
| 439 | 2689 | AA893515 | ll | | ESTs, Highly similar to translocation protein 1; Dtrp1 protein; membrane protein SEC62, *S.cerevisiae*, homolog of [*Homo sapiens*] [*H. sapiens*] |
| 440 | 22891 | AA893581 | f | | ESTs |
| 441 | 22149 | AA893607 | s, t | | ESTs |
| 441 | 22150 | AA893607 | b, l, m | | ESTs |
| 442 | 4541 | AA893612 | e | | ESTs |
| 443 | 19505 | AA893634 | r, ii | | ESTs, Moderately similar to coatomer protein complex, subunit zeta 1; nonclathrin coat protein zeta1-COP [*Mus musculus*] [*M. musculus*] |
| 444 | 3623 | AA893663 | jj, kk | | ESTs |
| 445 | 4544 | AA893664 | h, l | TEMO | TEMO |
| 446 | 19411 | AA893667 | cc, dd | | ESTs, Weakly similar to T46904 hypothetical protein DKFZp761D081.1 - human [*H. sapiens*] |
| 447 | 9084 | AA893717 | d | | ESTs |
| 448 | 22731 | AA893743 | f, g | | ESTs |
| 449 | 4556 | AA893811 | aa, bb | | ESTs |
| 450 | 12031 | AA893860 | y, z | HHs:threonyl-tRNA synthetase | ESTs, Moderately similar to SYTC_HUMAN Threonyl-tRNA synthetase, cytoplasmic (Threonine--tRNA ligase) (ThrRS) [*H. sapiens*] |
| 451 | 17896 | AA893905 | ii | | ESTs |
| 452 | 3446 | AA893970 | h, aa, bb | | ESTs |
| 453 | 22145 | AA893980 | ii | | ESTs |
| 454 | 4565 | AA893994 | b, l, m | | EST |
| 455 | 23731 | AA894004 | l, n, o, kk, ll | | ESTs, Highly similar to CAPG_MOUSE Macrophage capping protein (Myc basic motif homolog-1) (Actin-capping protein GCAP39) [*M. musculus*] |
| 456 | 22583 | AA894009 | b, l, m | | |
| 456 | 22584 | AA894009 | aa, bb, ii | | ESTs |
| 457 | 10540 | AA894027 | r | | |
| 458 | 15913 | AA894092 | n, o | | ESTs |
| 459 | 16485 | AA894104 | jj, kk | | ESTs, Weakly similar to T20253 hypothetical protein F53E4.1 - *Caenorhabditis elegans* [*C. elegans*] |
| 460 | 9388 | AA894173 | c | | ESTs |
| 461 | 16434 | AA894174 | h, l | | ESTs, Highly similar to A31568 electron transfer flavoprotein alpha chain precursor - rat [*R.norvegicus*] |
| 462 | 21989 | AA894188 | cc, dd | | ESTs |
| 463 | 2133 | AA894193 | r | | ESTs |
| 464 | 24473 | AA894200 | b | | ESTs, Highly similar to MLES_RAT Myosin light chain alkali, smooth-muscle isoform (MLC3SM) [*R.norvegicus*] |

TABLE 1-continued

| SEQ ID | GLGC ID | GenBank Accession No. | Model Code | Known Gene Name | Unigene Sequence Cluster Title |
|---|---|---|---|---|---|
| 465 | 22783 | AA894207 | r | | ESTs, Weakly similar to dual-specificity phosphatase [*Mus musculus*] [*M. musculus*] |
| 466 | 3929 | AA894233 | s | | ESTs |
| 467 | 17336 | AA894297 | j, k, s, t | | ESTs |
| 468 | 3910 | AA894345 | f, j, k, r, gg | | ESTs, Weakly similar to 2021425A MAT1 gene [*Mus musculus*] [*M. musculus*] |
| 469 | 4107 | AA899109 | d | | ESTs |
| 470 | 24329 | AA899253 | aa, bb | Myristoylated alanine-rich protein kinase C substrate | Myristoylated alanine-rich protein kinase C substrate |
| 471 | 22490 | AA899289 | d | | ESTs, Moderately similar to KIAA1049 protein [*Homo sapiens*] [*H. sapiens*] |
| 472 | 4636 | AA899491 | e | | ESTs, Highly similar to SYW_MOUSE Tryptophanyl-tRNA synthetase (Tryptophan--tRNA ligase) (TrpRS) [*M. musculus*] |
| 473 | 22308 | AA899535 | u, v | | ESTs |
| 474 | 20038 | AA899797 | bb, ll | | EST |
| 475 | 2559 | AA899828 | l, m | | ESTs |
| 476 | 23778 | AA899854 | c | topoisomerase (DNA) II alpha | topoisomerase (DNA) II alpha |
| 477 | 17243 | AA899894 | r | | ESTs, Highly similar to S30034 translocating chain-associating membrane protein - human [*H. sapiens*] |
| 478 | 21639 | AA899911 | ll | | ESTs |
| 479 | 9114 | AA899951 | cc, dd | | ESTs |
| 480 | 17355 | AA899959 | l, m | | ESTs, Highly similar to S63993 acrosomal protein AZ1 - mouse [*M. musculus*] |
| 481 | 18890 | AA899964 | e, r | | ESTs |
| 482 | 11268 | AA899969 | l, m | | ESTs, Highly similar to T08712 hypothetical protein DKFZp566C0424.1 - human (fragment) [*H. sapiens*] |
| 483 | 3903 | AA899986 | w, x | polypyrimidine tract binding protein | polypyrimidine tract binding protein |
| 484 | 22480 | AA900230 | u, v | | ESTs, Weakly similar to T12B3.4.p [*Caenorhabditis elegans*] [*C. elegans*] |
| 485 | 4725 | AA900290 | t, y, z, ee, ff | HMm:carbon catabolite repression 4 homolog (*S. cerevisiae*) | ESTs, Highly similar to A2MG_RAT ALPHA-2-MACROGLOBULIN PRECURSOR (ALPHA-2-M) [*R.norvegicus*] |
| 486 | 4730 | AA900326 | d, jj, kk | | ESTs |
| 487 | 4732 | AA900343 | cc, dd | | ESTs, Weakly similar to T47146 hypothetical protein DKFZp761C169.1 - human (fragment) [*H. sapiens*] |
| 488 | 4750 | AA900469 | u, v | | ESTs |
| 489 | 16753 | AA900474 | w, x | | ESTs, Moderately similar to T50619 hypothetical protein DKFZp762M136.1 - human (fragment) [*H. sapiens*] |
| 490 | 4774 | AA900762 | ii | | ESTs |
| 491 | 4779 | AA900825 | u, v | | ESTs |
| 492 | 14712 | AA900860 | ee, ff | | ESTs, Weakly similar to COPP_RAT Coatomer beta' subunit (Beta'-coat protein) (Beta'-COP) (p102) [*R.norvegicus*] |
| 493 | 3822 | AA900863 | kk | | ESTs, Weakly similar to HE47_RAT Probable ATP-dependent RNA helicase p47 [*R.norvegicus*] |
| 494 | 4790 | AA900875 | ee, ff | Cbp/p300-interacting transactivator, with Glu/Asp-rich carboxy-terminal domain, 4 | Cbp/p300-interacting transactivator, with Glu/Asp-rich carboxy-terminal domain, 4 |
| 495 | 23038 | AA900881 | a, j, k, y, z | branched chain aminotransferase 1, cytosolic | branched chain aminotransferase 1, cytosolic |
| 496 | 4797 | AA900967 | j, k | | ESTs |
| 497 | 22666 | AA900974 | a, t, y, z, ee, ff | | ESTs, Highly similar to p34SEI-1; PHD zinc finger- and bromodomain-interacting protein 1 [*Mus musculus*] [*M. musculus*] |
| 498 | 26075 | AA900993 | s, t | | |
| 499 | 4827 | AA901058 | gg | | ESTs |
| 500 | 11467 | AA901069 | j, k | | |
| 501 | 22898 | AA901107 | kk | | ESTs |
| 502 | 4858 | AA901238 | w, x | | ESTs, Weakly similar to S53358 ubiquitin-conjugating enzyme E2.17kB - rat [*R.norvegicus*] |

TABLE 1-continued

| SEQ ID | GLGC ID | GenBank Accession No. | Model Code | Known Gene Name | Unigene Sequence Cluster Title |
|---|---|---|---|---|---|
| 503 | 4861 | AA901290 | y, z, kk | | ESTs |
| 504 | 16976 | AA901341 | j, k | | ESTs, Highly similar to sialyltransferase 7 ((alpha-N-acetylneuraminyl 2,3-beta-galactosyl-1,3)-N-acetyl galactosaminde alpha-2,6-sialyltransferase B; ST6GalNAc II [*Mus musculus*] [*M. musculus*] |
| 505 | 4866 | AA901350 | d | | ESTs |
| 506 | 4874 | AA923850 | kk | | ESTs |
| 507 | 4893 | AA923996 | h, l | | EST |
| 508 | 18162 | AA924013 | r | | ESTs |
| 509 | 17644 | AA924036 | c, kk | | ESTs |
| 510 | 4907 | AA924091 | r | | ESTs, Weakly similar to growth supressor 1; leprecan [*Rattus norvegicus*] [*R.norvegicus*] |
| 511 | 4909 | AA924097 | jj, kk | | ESTs |
| 512 | 17231 | AA924107 | ii | Tissue inhibitor of metalloproteinase 3 | Tissue inhibitor of metalloproteinase 3 |
| 513 | 4917 | AA924140 | l, m | | ESTs, Weakly similar to Y193__HUMAN Hypothetical protein KIAA0I93 [*H. sapiens*] |
| 514 | 4930 | AA924251 | c | | ESTs |
| 515 | 22914 | AA924335 | h, l, ll | | ESTs |
| 516 | 12346 | AA924346 | d, aa, bb | | ESTs |
| 517 | 23096 | AA924352 | b, v | | ESTs, Weakly similar to Prostatic Acid Phosphatase (E.C.3.1.3.2) Complexed With Tartaric Acid [*R.norvegicus*] |
| 518 | 4945 | AA924415 | n, o | | ESTs |
| 519 | 4954 | AA924444 | u, v | | ESTs |
| 520 | 18251 | AA924548 | jj, kk | | ESTs, Highly similar to RL9__RAT 60S RIBOSOMAL PROTEIN L9 [*R.norvegicus*] |
| 521 | 4975 | AA924571 | l, m | | ESTs |
| 522 | 24310 | AA924578 | g, ll | | ESTs |
| 523 | 18891 | AA924598 | e | | ESTs |
| 524 | 5002 | AA924689 | ii | | ESTs |
| 525 | 23123 | AA924794 | a, kk | | ESTs |
| 526 | 5030 | AA924802 | e | | ESTs |
| 527 | 2888 | AA924902 | w, x | | ESTs |
| 528 | 20953 | AA924926 | h, l, jj, kk | | ESTs |
| 529 | 22911 | AA924943 | l, m | | ESTs |
| 530 | 168 | AA924985 | e | calsequestrin 2 | calsequestrin 2 |
| 531 | 5070 | AA925031 | r | | ESTs |
| 532 | 23173 | AA925057 | h, l, w, x | | ESTs, Highly similar to GYRTI cysteine-rich intestinal protein - rat [*R.norvegicus*] |
| 533 | 17363 | AA925150 | ll | | ESTs, Moderately similar to 2118320A neurodegeneration-associated protein 1 [*Rattus norvegicus*] [*R. norvegicus*] |
| 534 | 18271 | AA925267 | e | | ESTs |
| 535 | 23452 | AA925289 | gg | | ESTs, Moderately similar to hypothetical protein MGC8974 [*Homo sapiens*] [*H. sapiens*] |
| 536 | 16499 | AA925300 | p, ee, ff, gg | HHs:mitogen-activated protein kinase kinase kinase 3 | ESTs, Weakly similar to mitogen activated protein kinase kinase kinase 1 [*Rattus norvegicus*] [*R.norvegicus*] |
| 537 | 5129 | AA925335 | t | | ESTs |
| 538 | 5132 | AA925342 | h, l | | ESTs, Highly similar to MYM1__MOUSE Myomesin 1 (Skelemin) [*M. musculus*] |
| 539 | 23978 | AA925352 | kk, ll | | ESTs |
| 540 | 21500 | AA925353 | w, x, cc, dd | | ESTs |
| 541 | 14945 | AA925364 | n, o | | ESTs |
| 542 | 5167 | AA925529 | ee, ff | | EST |
| 543 | 4285 | AA925708 | r, y, z, jj, kk | | ESTs, Moderately similar to WDR1__MOUSE WD-repeat protein 1 (Actin interacting protein 1) [*M. musculus*] |
| 544 | 5206 | AA925755 | ll | Glutaminase | Glutaminase |
| 545 | 3997 | AA925771 | ii | | ESTs, Highly similar to T12483 hypothetical protein DKFZp564B0769.1 - human (fragment) [*H. sapiens*] |
| 546 | 23464 | AA925876 | l, m | | ESTs |
| 547 | 5227 | AA925924 | l, o, kk | | ESTs, Highly similar to cytokine receptor-like factor 1; cytokine receptor like molecule 3 [*Mus musculus*] [*M. musculus*] |
| 548 | 20345 | AA925938 | gg | | ESTs |
| 549 | 5258 | AA926089 | t | | ESTs, Highly similar to KIAA0164 gene product [*Homo sapiens*] [*H. sapiens*] |

TABLE 1-continued

| SEQ ID | GLGC ID | GenBank Accession No. | Model Code | Known Gene Name | Unigene Sequence Cluster Title |
|---|---|---|---|---|---|
| 550 | 17157 | AA926129 | cc | | ESTs |
| 551 | 16468 | AA926137 | hh | | ESTs, Moderately similar to UCRY_HUMAN Ubiquinol-cytochrome C reductase complex 6.4 kDa protein (Complex III subunit XI) [*H. sapiens*] |
| 552 | 20327 | AA926265 | cc, dd | | EST, Weakly similar to ADP-ribosylation factor-like 5 [*Rattus norvegicus*] [*R.norvegicus*] |
| 553 | 893 | AA926305 | h, l | | ESTs |
| 553 | 894 | AA926305 | h, l, n, o | | ESTs |
| 554 | 3817 | AA926328 | p, q | Tyrosine 3-monooxygenase/tryptophan 5-monooxygenase activation protein, zeta polypeptide | Tyrosine 3-monooxygenase/tryptophan 5-monooxygenase activation protein, zeta polypeptide |
| 555 | 9942 | AA942697 | d | | ESTs, Highly similar to hypothetical protein MGC3133 [*Homo sapiens*] [*H. sapiens*] |
| 556 | 16909 | AA942704 | g | | ESTs, Moderately similar to SUR2_MOUSE Surfeit locus protein 2 (Surf-2) [*M. musculus*] |
| 557 | 6039 | AA942716 | d | | ESTs, Highly similar to hematological and neurological expressed sequence 1 [*Mus musculus*] [*M. musculus*] |
| 558 | 22677 | AA942718 | s, t, kk | B cell lymphoma 2 like | B cell lymphoma 2 like |
| 559 | 23005 | AA942770 | e, y, z | | ESTs |
| 560 | 17003 | AA942930 | ll | | ESTs |
| 561 | 19016 | AA943015 | cc, dd | | ESTs |
| 562 | 3952 | AA943016 | u, v | | ESTs |
| 563 | 22130 | AA943020 | jj, kk | | ESTs |
| 564 | 6691 | AA943028 | r, w, x | | ESTs, Highly similar to KFMS_RAT Macrophage colony stimulating factor I receptor precursor (CSF-1-R) (Fms proto-oncogene) (c-fms) [*R.norvegicus*] |
| 565 | 2675 | AA943099 | cc, dd | | ESTs |
| 566 | 23822 | AA943114 | ll | | ESTs |
| 567 | 22187 | AA943229 | u, v | | EST |
| 568 | 12261 | AA943240 | gg | | ESTs, Weakly similar to one twenty two protein; hypothetical protein FLJ12479 [*Homo sapiens*] [*H. sapiens*] |
| 569 | 22218 | AA943409 | e | | ESTs |
| 570 | 22223 | AA943440 | w, x | | EST |
| 571 | 21990 | AA943524 | b | | ESTs |
| 572 | 22247 | AA943537 | y, z | zyxin | zyxin |
| 572 | 22248 | AA943537 | y, z | zyxin | zyxin |
| 573 | 22261 | AA943573 | d | | ESTs |
| 574 | 19220 | AA943740 | jj, kk | | ESTs |
| 575 | 9658 | AA943748 | t | | ESTs |
| 576 | 22317 | AA943766 | j, k | | ESTs, Moderately similar to ASPG_MOUSE N(4)-(beta-N-acetylglucosaminyl)-L-asparaginase precursor (Glycosylasparaginase) (Aspartylglucosaminidase) (N4-(N-acetyl-beta-glucosaminyl)-L-asparagine amidase) (AGA) [*M. musculus*] |
| 577 | 11412 | AA943981 | ii | | ESTs |
| 577 | 11413 | AA943981 | r | | ESTs |
| 578 | 16447 | AA944188 | gg | | ESTs |
| 579 | 22378 | AA944212 | a, y, z, ee, ff, kk | | ESTs |
| 580 | 22381 | AA944216 | j, k | | ESTs |
| 581 | 22405 | AA944341 | u, v | | ESTs |
| 582 | 15596 | AA944353 | jj, kk | | ESTs |
| 583 | 12289 | AA944383 | gg | | ESTs |
| 584 | 20795 | AA944397 | e, ee | HMm:heat shock protein, 86 kDa 1 | ESTs, Moderately similar to HS9B_RAT Heat shock protein HSP 90-beta (HSP 84) [*R.norvegicus*] |
| 585 | 21998 | AA944398 | gg | | ESTs, Highly similar to A49457 fibulin-2 precursor - mouse [*M. musculus*] |
| 586 | 22681 | AA944413 | p, q | | ESTs |
| 587 | 15476 | AA944426 | h, l | Calmodulin III | Calmodulin III |
| 588 | 19480 | AA944442 | r, bb | | ESTs, Weakly similar to SLI3_RAT SKELETAL MUSCLE LIM-PROTEIN 3 (SLIM 3) (LIM-DOMAIN PROTEIN DRAL) (FOUR AND A HALF LIM DOMAINS PROTEIN 2) (FHL-2) [*R.norvegicus*] |

TABLE 1-continued

| SEQ ID | GLGC ID | GenBank Accession No. | Model Code | Known Gene Name | Unigene Sequence Cluster Title |
|---|---|---|---|---|---|
| 589 | 21522 | AA944449 | gg | | ESTs, Moderately similar to SR68_HUMAN Signal recognition particle 68 kDa protein (SRP68) [*H. sapiens*] |
| 590 | 22431 | AA944463 | r | | ESTs |
| 591 | 14763 | AA944481 | p, q | | ESTs, Weakly similar to FCN2_RAT Ficolin 2 precursor (Collagen/fibrinogen domain-containing protein 2) (Ficolin-B) (Ficolin B) (Serum lectin P35) (EBP-37) (Hucolin) [*R.norvegicus*] |
| 592 | 2661 | AA944493 | d | | ESTs |
| 593 | 22438 | AA944498 | l, m | | ESTs |
| 594 | 22678 | AA944556 | jj, kk | | ESTs |
| 595 | 12303 | AA944786 | t | | ESTs |
| 596 | 22536 | AA944803 | r | | ESTs |
| 597 | 22081 | AA944818 | j, k, jj, kk | | ESTs |
| 598 | 21581 | AA944828 | bb | | ESTs, Highly similar to RIKEN cDNA 2610524G07 [*Mus musculus*] [*M. musculus*] |
| 599 | 21973 | AA944840 | s, t | | ESTs, Weakly similar to T19073 hypothetical protein C08B11.9 - Caenorhabditis elegans [*C. elegans*] |
| 600 | 22667 | AA945069 | p, q, y, z | | ESTs, Highly similar to p34SEI-1; PHD zinc finger- and bromodomain-interacting protein 1 [*Mus musculus*] [*M. musculus*] |
| 601 | 22556 | AA945100 | w, x | | ESTs |
| 3 | 19421 | AA945152 | bb | *Rattus norvegicus* mitochondrial genome. 9/22Length = 16, 3 | dimethylarginine dimethylaminohydrolase 1 |
| 602 | 22283 | AA945172 | e | HHs:leucine aminopeptidase 3 | ESTs, Highly similar to AMPL_HUMAN Cytosol aminopeptidase (Leucine aminopeptidase) (LAP) (Leucyl aminopeptidase) (Proline aminopeptidase) (Prolyl aminopeptidase) [*H. sapiens*] |
| 603 | 14352 | AA945181 | gg | | ESTs |
| 604 | 4207 | AA945591 | n, o, w, x | | ESTs, Weakly similar to JC5105 stromal cell-derived factor 2 - mouse [*M. musculus*] |
| 605 | 22266 | AA945601 | hh | | ESTs |
| 605 | 22267 | AA945601 | gg | | ESTs |
| 606 | 24521 | AA945636 | g, h, l | | ESTs, Highly similar to R5RT12 acidic ribosomal protein P1, cytosolic [validated] rat [*R.norvegicus*] |
| 607 | 22615 | AA945643 | kk | | ESTs, Moderately similar to C3L1_MOUSE Chitinase-3 like protein 1 precursor (Cartilage glycoprotein-39) (GP-39) (BRP39 protein) [*M. musculus*] |
| 608 | 11871 | AA945679 | j, k | | ESTs |
| 609 | 22625 | AA945704 | p, q, ee, ff, ii | | ESTs |
| 610 | 23035 | AA945712 | t | | ESTs |
| 611 | 20619 | AA945737 | d, r, aa, bb | Chemokine receptor (LCR1) | Chemokine receptor (LCR1) |
| 612 | 14955 | AA945750 | t | | ESTs |
| 613 | 3637 | AA945878 | u, v | | ESTs |
| 614 | 11256 | AA945898 | gg | | ESTs |
| 615 | 22682 | AA945910 | cc, dd | | ESTs |
| 616 | 21351 | AA945932 | t | Annexin A3 | Annexin A3 |
| 617 | 22692 | AA945986 | jj, kk | | ESTs |
| 618 | 22697 | AA945996 | j, k, kk | | ESTs |
| 619 | 20832 | AA946040 | hh | | ESTs, Highly similar to COXG_MOUSE Cytochrome c oxidase polypeptide VIb (AED) [*M. musculus*] |
| 620 | 18337 | AA946046 | l, m | | ESTs |
| 621 | 22708 | AA946063 | u, v | | ESTs, Highly similar to ubiquitin-like 3 [*Homo sapiens*] [*H. sapiens*] |
| 622 | 22711 | AA946072 | r, y, z, kk | | ESTs, Highly similar to catenin alpha-like 1; alpha-catenin related protein [*Mus musculus*] [*M. musculus*] |
| 623 | 12324 | AA946203 | n, o | | ESTs |
| 624 | 23237 | AA946224 | ii | | ESTs |
| 625 | 23027 | AA946264 | aa, bb | | ESTs |
| 626 | 19387 | AA946275 | a | | ESTs, Highly similar to AR21_HUMAN ARP2/3 complex 21 kDa subunit (P21-ARC) (Actin-related protein 2/3 complex subunit 3) [*H. sapiens*] |

TABLE 1-continued

| SEQ ID | GLGC ID | GenBank Accession No. | Model Code | Known Gene Name | Unigene Sequence Cluster Title |
|---|---|---|---|---|---|
| 627 | 22755 | AA946323 | ii | | ESTs |
| 628 | 884 | AA946362 | ii | | ESTs, Highly similar to SNX5_MOUSE Sorting nexin 5 [*M. musculus*] |
| 629 | 9629 | AA946415 | gg | | ESTs |
| 630 | 22771 | AA946432 | b, l, m | casein kinase I delta | casein kinase I delta |
| 631 | 643 | AA946439 | d | | ESTs, Highly similar to HSRT4 histone H4 - rat [*R.norvegicus*] |
| 632 | 2363 | AA946469 | hh | | ESTs |
| 633 | 22042 | AA946476 | e | | ESTs |
| 634 | 23471 | AA955162 | j, k, s, t | | ESTs |
| 635 | 9452 | AA955206 | y, z, ee, ff | | ESTs |
| 636 | 22439 | AA955213 | ii | | ESTs |
| 637 | 23498 | AA955248 | w, x | | ESTs |
| 638 | 22596 | AA955298 | y, z | | ESTs, Weakly similar to T46637 transcription factor 1, neural - rat [*R.norvegicus*] |
| 639 | 23326 | AA955415 | n, o | | ESTs |
| 640 | 23626 | AA955540 | p, q | | ESTs |
| 641 | 12928 | AA955564 | e | | ESTs, Weakly similar to T21697 hypothetical protein F40E10.6 - *Caenorhabditis elegans* [*C. elegans*] |
| 642 | 23673 | AA955684 | s, t | | ESTs |
| 643 | 5111 | AA955729 | f, g, l, m | | EST, ESTs, Highly similar to OKRT2R protein kinase (EC 2.7.1.37), cAMP-dependent, type II-alpha regulatory chain - rat (fragment) [*R.norvegicus*] |
| 644 | 12426 | AA955760 | u, v | | ESTs, Weakly similar to LIS1_MOUSE Platelet-activating factor acetylhydrolase IB alpha subunit (PAF acetylhydrolase 45 kDa subunit) (PAF-AH 45 kDa subunit) (PAF-AH alpha) (PAFAH alpha) (Lissencephaly-1 protein) (LIS-1) [*R.norvegicus*] |
| 645 | 6658 | AA955857 | b, c, l, m | | ESTs, Highly similar to TRBP_MOUSE TAR RNA-binding protein 2 (Protamine-1 RNA binding protein) (PRM-1 RNA binding protein) [*M. musculus*] |
| 646 | 17540 | AA955914 | a | | EST, EST, Moderately similar to FBRL_MOUSE Fibrillarin (Nucleolar protein 1) [*M. musculus*], ESTs, Highly similar to S38342 fibrillarin - mouse [*M. musculus*] |
| 647 | 14327 | AA956111 | h, l | | ESTs, Moderately similar to T43493 hypothetical protein DKFZp434C119.1 - human [*H. sapiens*] |
| 648 | 23357 | AA956114 | cc, dd | | ESTs, Highly similar to ubiquitin conjugating enzyme [*Rattus norvegicus*] [*R.norvegicus*] |
| 649 | 498 | AA956278 | aa, bb | | ESTs |
| 650 | 23409 | AA956294 | e | | ESTs |
| 651 | 5210 | AA956550 | j, k | | ESTs |
| 652 | 22899 | AA956555 | r, kk | | ESTs |
| 653 | 23840 | AA956689 | l, m | | EST |
| 654 | 18296 | AA956703 | w, x | | ESTs |
| 655 | 17495 | AA956733 | b | | ESTs |
| 656 | 16543 | AA956758 | l, m | | EST |
| 657 | 5990 | AA956907 | u, v | | ESTs, Highly similar to IF3A_MOUSE EUKARYOTIC TRANSLATION INITIATION FACTOR 3 SUBUNIT 10 (EIF-3 THETA) (EIF3 P167) (EIF3 P180) (EIF3 P185) (P162 PROTEIN) (CENTROSOMIN) [*M. musculus*] |
| 658 | 23927 | AA957007 | g | glutathione S-transferase, mu 5 | glutathione S-transferase, mu 5 |
| 659 | 23952 | AA957096 | gg | | ESTs |
| 660 | 23957 | AA957123 | c | | ESTs, Weakly similar to NADE_HUMAN p75NTR-associated cell death executor (Nerve growth factor receptor associated protein 1) (Ovarian granulosa cell 13.0 kDa protein HGR74) [*H. sapiens*] |
| 661 | 23963 | AA957139 | kk | | ESTs |
| 662 | 19283 | AA957259 | l, m | | EST |
| 663 | 23314 | AA957270 | p, q, ee, ff | | ESTs |
| 664 | 24012 | AA957335 | b, d | | ESTs |

TABLE 1-continued

| SEQ ID | GLGC ID | GenBank Accession No. | Model Code | Known Gene Name | Unigene Sequence Cluster Title |
|---|---|---|---|---|---|
| 665 | 12529 | AA957362 | d | transforming growth factor beta 1 induced transcript 1 | transforming growth factor beta 1 induced transcript 1 |
| 666 | 24040 | AA957422 | n, o, w, x | | ESTs, Highly similar to FCEG_RAT High affinity immunoglobulin epsilon receptor gamma-subunit precursor (FcERI) (IgE Fc receptor gamma-subunit) (Fc-epsilon RI-gamma) [R.norvegicus] |
| 667 | 24051 | AA957452 | a, jj, kk | | ESTs |
| 668 | 3669 | AA957535 | a | | ESTs |
| 669 | 23732 | AA957653 | ee, ff | | ESTs, Weakly similar to RNB6 [Rattus norvegicus] [R.norvegicus] |
| 670 | 24135 | AA957736 | n, o | | ESTs, Weakly similar to FBL5_RAT Fibulin-5 precursor (FIBL-5) (Developmental arteries and neural crest EGF-like protein) (Dance) (Embryonic vascular EGF repeat-containing protein) (EVEC) [R.norvegicus] |
| 671 | 23644 | AA957808 | gg | | ESTs, Weakly similar to SNX9_HUMAN Sorting nexin 9 (SH3 and PX domain-containing protein 1) (SDP1 protein) [H. sapiens] |
| 672 | 24171 | AA957835 | jj, kk, ll | | ESTs |
| 673 | 23831 | AA963094 | d | | ESTs |
| 674 | 11500 | AA963171 | cc, dd | | ESTs, Weakly similar to heterogeneous nuclear ribonucleoprotein A/B [Rattus norvegicus] [R.norvegicus] |
| 675 | 23289 | AA963173 | ii | | ESTs |
| 676 | 3953 | AA963260 | s, t | | ESTs, Moderately similar to A46613 protein 4.1, P4.1 - mouse [M. musculus] |
| 677 | 2173 | AA963627 | w, x | | ESTs |
| 678 | 24246 | AA963703 | a | | ESTs, Highly similar to P2G4_MOUSE Proliferation-associated protein 2G4 (Proliferation-associated protein 1) (Protein p38-2G4) [M. musculus] |
| 679 | 2195 | AA963746 | r | | ESTs |
| 680 | 6276 | AA963767 | b, c, u, v | | ESTs |
| 681 | 2211 | AA963834 | l, m | | ESTs, Highly similar to S105_MOUSE S100 calcium-binding protein A5 (S-100D protein) [R.norvegicus] |
| 682 | 2214 | AA963838 | b | | ESTs |
| 683 | 2301 | AA964206 | a | | ESTs |
| 684 | 2321 | AA964265 | ll | | ESTs |
| 685 | 2095 | AA964362 | cc, dd | | ESTs |
| 686 | 2373 | AA964455 | jj, kk | | ESTs |
| 687 | 18830 | AA964496 | a, z | | ESTs, Highly similar to ACTB_HUMAN Actin, cytoplasmic 1 (Beta-actin) [R.norvegicus] |
| 688 | 2378 | AA964501 | t | | ESTs |
| 689 | 2142 | AA964526 | c | | ESTs, Weakly similar to C35D10.4.p [Caenorhabditis elegans] [C. elegans] |
| 690 | 2410 | AA964589 | kk | | EST, ESTs |
| 691 | 14342 | AA964595 | h, l, s, t | | ESTs, Moderately similar to treacle [Mus musculus] [M. musculus] |
| 692 | 19145 | AA964613 | l, m | | ESTs |
| 693 | 2424 | AA964617 | u, v | | ESTs |
| 694 | 2459 | AA964755 | a, q, y, z, ee, ff | | ESTs |
| 695 | 2476 | AA964841 | cc, dd | | EST |
| 696 | 2492 | AA964866 | u, v | | ESTs, Moderately similar to A49947 interferon gamma receptor beta subunit - mouse [M. musculus] |
| 697 | 17232 | AA965161 | ll | Tissue inhibitor of metalloproteinase 3 | Tissue inhibitor of metalloproteinase 3 |
| 698 | 2582 | AA965164 | gg | | ESTs, Moderately similar to RIKEN cDNA 1810017F10 [Mus musculus] [M. musculus] |
| 699 | 15885 | AA965207 | t | | ESTs, Highly similar to T14795 hypothetical protein DKFZp434E171.1 - human (fragment) [H. sapiens] |
| 700 | 2803 | AA996451 | r, jj, kk | | ESTs |
| 701 | 2861 | AA996583 | ee, ff | | ESTs, Weakly similar to T18768 hypothetical protein B0491.7 - Caenorhabditis elegans [C. elegans] |
| 702 | 2880 | AA996658 | b | | EST |

TABLE 1-continued

| SEQ ID | GLGC ID | GenBank Accession No. | Model Code | Known Gene Name | Unigene Sequence Cluster Title |
|---|---|---|---|---|---|
| 703 | 19396 | AA996740 | n, o | | EST, Moderately similar to A54981 TBD-associated factor 30 - human [*H. sapiens*] |
| 704 | 17492 | AA996832 | l, m | | ESTs, Moderately similar to hypothetical protein FLJ11219 [*Homo sapiens*] [*H. sapiens*] |
| 705 | 2962 | AA996953 | u, v | | ESTs |
| 706 | 16496 | AA996955 | w, x | | ESTs |
| 707 | 8786 | AA996993 | d | | EST, Moderately similar to RED_MOUSE Red protein (RER protein) [*M. musculus*, ESTs, Highly similar to RED_MOUSE Red protein (RER protein) [*M. musculus*] |
| 708 | 3132 | AA997191 | h, l | | EST |
| 709 | 3162 | AA997289 | gg | | ESTs |
| 710 | 3003 | AA997330 | e, t, kk | | ESTs |
| 711 | 21942 | AA997341 | e | | ESTs |
| 712 | 3165 | AA997386 | n, o | | ESTs, Weakly similar to S27393 sphingomyelin phosphodiesterase (EC 3.1.4.12), acidic, splice form 1 precursor-mouse [*M. musculus*] |
| 713 | 14582 | AA997412 | r | | ESTs |
| 714 | 3207 | AA997466 | j, k, ee, ff, kk | | ESTs |
| 715 | 3242 | AA997596 | d | | ESTs |
| 716 | 21119 | AA997655 | b | | ESTs, Highly similar to hypothetical protein FLJ14566 [*Homo sapiens*] [*H. sapiens*] |
| 717 | 3043 | AA997694 | jj, kk | | ESTs |
| 718 | 3250 | AA997765 | h, i, ll | fibrillin-1 | fibrillin-1 |
| 719 | 3257 | AA997766 | ii | | ESTs |
| 720 | 3265 | AA997784 | u, v | | EST |
| 721 | 3269 | AA997800 | c | | ESTs, Moderately similar to T30249 cell proliferation antigen Ki-67 - mouse [*M. musculus*] |
| 722 | 2757 | AA997851 | bb, ll | | ESTs, Weakly similar to A41220 transforming growth factor beta receptor type III precursor - rat [*R.norvegicus*] |
| 723 | 3290 | AA997883 | ee, ff | | ESTs |
| 724 | 26114 | AA997904 | aa, bb | | |
| 725 | 10614 | AA997985 | cc, dd | | ESTs |
| 726 | 3332 | AA998006 | ll | | ESTs |
| 727 | 3353 | AA998053 | ii | | ESTs, ESTs, Weakly similar to MOZ_HUMAN Monocytic leukemia zinc finger protein (Zinc finger protein 220) [*H. sapiens*] |
| 728 | 3511 | AA998152 | ee, ff | brain-specific angiogenesis inhibitor 1-associated protein 2 | brain-specific angiogenesis inhibitor 1-associated protein 2 |
| 729 | 16533 | AA998174 | kk | | ESTs |
| 730 | 3390 | AA998195 | u, v | | ESTs, Weakly similar to S37694 gene PC326 protein - mouse [*M. musculus*] |
| 731 | 6789 | AA998207 | b, d | | ESTs |
| 732 | 3738 | AA998256 | y, z | | ESTs |
| 733 | 19458 | AA998345 | w, x | | EST |
| 734 | 3781 | AA998375 | b, u, v | | ESTs |
| 735 | 3505 | AA998430 | w, x | adrenergic receptor kinase, beta 1 | adrenergic receptor kinase, beta 1 |
| 736 | 2782 | AA998565 | c, l, m | | ESTs, Moderately similar to CDNC_MOUSE CYCLIN-DEPENDENT KINASE INHIBITOR 1C (CYCLIN-DEPENDENT KINASE INHIBITOR P57) (P57KIP2) [*M. musculus*] |
| 737 | 22737 | AA998660 | ii | | ESTs |
| 738 | 2526 | AA998979 | u, v | | ESTs, Moderately similar to T00051 hypothetical protein KIAA0404 - human (fragment) [*H. sapiens*] |
| 739 | 12664 | AA999110 | a, ee, ff, kk | | ESTs, Weakly similar to MAPE_HUMAN Melanoma antigen preferentially expressed in tumors (Preferentially expressed antigen of melanoma) (OPA-interacting protein 4) (OIP4) [*H. sapiens*] |
| 740 | 25137 | AB005540 | cc, dd | | |
| 741 | 11745 | AB006450 | hh, jj, kk | translocator of inner mitochondrial membrane 17 kDa, a | translocator of inner mitochondrial membrane 17 kDa, a |

TABLE 1-continued

| SEQ ID | GLGC ID | GenBank Accession No. | Model Code | Known Gene Name | Unigene Sequence Cluster Title |
|---|---|---|---|---|---|
| 742 | 21666 | AB012214 | n, o | DNA (cytosine-5)-methyltransferase 1 | ESTs, Highly similar to JE0378 DNA (cytosine-5-)-methyltransferase (EC 2.1.1.37) - rat [*R.norvegicus*] |
| 743 | 17963 | AB012231 | jj, kk | nuclear factor I/B | nuclear factor I/B |
| 744 | 15772 | AB015645 | cc, dd | | *Rattus norvegicus* mRNA for G protein-coupled receptor, complete cds |
| 745 | 22567 | AB017544 | aa | peroxisomal membrane anchor protein | peroxisomal membrane anchor protein |
| 746 | 3799 | AF002281 | p, u, v, ee, ff, kk, ll | actinin alpha 2 associated LIM protein | actinin alpha 2 associated LIM protein |
| 747 | 1097 | AF016296 | e, j, k, cc, dd, kk | | *Rattus norvegicus* neurophilin mRNA, complete cds |
| 748 | 19649 | AF016387 | jj, kk | retinoid X receptor gamma ( | retinoid X receptor gamma ( |
| 748 | 19650 | AF016387 | jj, kk | retinoid X receptor gamma ( | retinoid X receptor gamma ( |
| 749 | 23044 | AF034218 | j, k | hyaluronidase 2 | hyaluronidase 2 |
| 750 | 19058 | AF054618 | ee, ff | cortactin isoform B | cortactin isoform B |
| 751 | 2881 | AF056034 | b, d, u, v | nexilin | nexilin |
| 752 | 16006 | AF062594 | gg | nucleosome assembly protein 1-like 1 | nucleosome assembly protein 1-like 1 |
| 752 | 16007 | AF062594 | hh | nucleosome assembly protein 1-like 1 | nucleosome assembly protein 1-like 1 |
| 753 | 20741 | AF084186 | s, t | alpha-fodrin | alpha-fodrin |
| 754 | 21957 | AF087437 | f | core binding factor beta | ESTs |
| 755 | 18731 | AF093139 | d | tip associating protein | tip associating protein |
| 756 | 2947 | AF099093 | u, v | ubiquitin-conjugating enzyme UBC7 | ubiquitin-conjugating enzyme UBC7 |
| 757 | 25232 | AF110508 | b | | |
| 758 | 21757 | AI007656 | d | | ESTs |
| 759 | 9976 | AI007744 | e, jj, kk | | ESTs |
| 760 | 4018 | AI007770 | j, k | | ESTs |
| 4 | 1804 | AI007824 | j | | *Rattus norvegicus* mitochondrial genome. 9/22Length = 16, 3 |
| 761 | 10108 | AI007857 | u, v | HGF-regulated tyrosine kinase substrate | HGF-regulated tyrosine kinase substrate |
| 762 | 11728 | AI007884 | t | | ESTs |
| 763 | 11368 | AI007948 | l, m | | ESTs, Highly similar to RIKEN cDNA 1500006O09 [*Mus musculus*] [*M. musculus*] |
| 764 | 15849 | AI008074 | r, ll | | ESTs, ESTs, Highly similar to HS9B__RAT Heat shock protein HSP 90-beta (HSP 84) [*R.norvegicus*] |
| 765 | 4052 | AI008095 | jj, kk | | ESTs |
| 766 | 2657 | AI008275 | u, v | | ESTs, Weakly similar to YJ95__CAEEL HYPOTHETICAL 52.8 KD PROTEIN T05E11.5 IN CHROMOSOME IV [*C. elegans*] |
| 767 | 21229 | AI008371 | r | | ESTs |
| 768 | 21889 | AI008393 | u, v | | ESTs, Highly similar to UBX domain-containing 2 [*Mus musculus*] [*M. musculus*] |
| 769 | 3808 | AI008643 | p, q, ee, ff | | ESTs, Weakly similar to DJB1__MOUSE DnaJ homolog subfamily B member 1 (Heat shock 40 kDa protein 1) (Heat shock protein 40) (HSP40) [*M. musculus*] |
| 770 | 11325 | AI008647 | y, z | | ESTs |
| 771 | 12398 | AI008689 | s, t | | ESTs, Weakly similar to TAC1__HUMAN Transforming acidic coiled-coil-containing protein 1 [*H. sapiens*] |
| 772 | 3931 | AI008697 | n, o | | ESTs, Highly similar to ACES__RAT Acetylcholinesterase precursor (AChE) [*R.norvegicus*] |
| 773 | 16034 | AI008701 | u, v | | ESTs |
| 774 | 7785 | AI008758 | jj, kk | Dipeptidyl peptidase 4 | Dipeptidyl peptidase 4 |
| 775 | 18125 | AI008787 | f, g | | ESTs, Highly similar to S16788 probable reverse transcriptase - rat [*R.norvegicus*] |
| 776 | 12828 | AI008796 | cc, dd | | ESTs |
| 777 | 3832 | AI008985 | n, o | | ESTs |
| 778 | 3278 | AI008988 | y, z | HHs:breakpoint cluster region | ESTs, Weakly similar to chimerin (chimaerin) 1 [*Rattus norvegicus*] [*R.norvegicus*] |
| 779 | 16652 | AI009019 | b | | ESTs, Moderately similar to EAR2__RAT Orphan nuclear receptor EAR-2 (V-erbA |

TABLE 1-continued

| SEQ ID | GLGC ID | GenBank Accession No. | Model Code | Known Gene Name | Unigene Sequence Cluster Title |
|---|---|---|---|---|---|
| 780 | 23337 | AI009096 | l, m | double-stranded RNA-binding protein p74 | related protein EAR-2) (Ovalbumin upstream promoter gamma nuclear receptor rCOUPg) [*R.norvegicus*] double-stranded RNA-binding protein p74 |
| 781 | 21632 | AI009167 | a, y, z, ee, ff | | ESTs, Highly similar to BAG2_HUMAN BAG-family molecular chaperone regulator-2 [*H. sapiens*] |
| 782 | 21596 | AI009168 | j, k | | ESTs, Weakly similar to rhoB gene [*Rattus norvegicus*] [*R.norvegicus*] |
| 783 | 22801 | AI009197 | e | | ESTs, Moderately similar to hypothetical protein IMAGE3455200 [*Homo sapiens*] [H sapiens] |
| 784 | 9150 | AI009198 | h, l | | ESTs, Highly similar to UNRI_MOUSE UNR-interacting protein (Serine-threonine kinase receptor-associated protein) [*M. musculus*] |
| 785 | 3755 | AI009208 | h, l | | ESTs |
| 786 | 7524 | AI009350 | d | | ESTs, Weakly similar to C37H5.3.p [*Caenorhabditis elegans*] [*C. elegans*] |
| 787 | 3979 | AI009368 | s, t | | ESTs |
| 788 | 10820 | AI009411 | g, h, l | | ESTs, Highly similar to RS3_MOUSE 40S ribosomal protein S3 [*R.norvegicus*] |
| 789 | 3836 | AI009420 | aa, bb | synaptic vesicle glycoprotein 2 b | synaptic vesicle glycoprotein 2 b |
| 790 | 4154 | AI009467 | kk | | ESTs |
| 791 | 9746 | AI009555 | r | | *Rattus norvegicus* dynein light intermediate chain 1 mRNA, complete cds |
| 792 | 10532 | AI009602 | ii | | ESTs |
| 793 | 895 | AI009614 | h, l | | ESTs |
| 794 | 4168 | AI009654 | ll | | ESTs |
| 795 | 16154 | AI009661 | a | | ESTs, Moderately similar to AF1Q_MOUSE Protein AF1Q [*M. musculus*] |
| 796 | 19358 | AI009675 | b, c, v | | EST |
| 797 | 22464 | AI009713 | t | | ESTs |
| 798 | 22545 | AI009747 | a | transducer of ERBB2, 1 | transducer of ERBB2, 1 |
| 799 | 15089 | AI009752 | gg | | ESTs |
| 800 | 6844 | AI009770 | j, k | | ESTs |
| 801 | 23092 | AI009819 | u, v | | ESTs |
| 802 | 2605 | AI009843 | j, k | | ESTs |
| 803 | 26133 | AI009950 | g | | EST |
| 804 | 18680 | AI010084 | l, m | | ESTs |
| 805 | 15988 | AI010108 | s, t | | ESTs |
| 806 | 4177 | AI010123 | aa, bb | | ESTs |
| 807 | 3316 | AI010237 | ii | | ESTs |
| 808 | 2612 | AI010241 | aa, bb | | ESTs |
| 809 | 15644 | AI010256 | kk | H3 histone, family 3B | H3 histone, family 3B |
| 810 | 6897 | AI010275 | ll | | ESTs |
| 811 | 3271 | AI010303 | g | | ESTs |
| 812 | 15924 | AI010312 | l, m | | ESTs |
| 813 | 21825 | AI010418 | cc, dd | | ESTs |
| 814 | 19778 | AI010455 | w, x | | ESTs, Weakly similar to DNA-directed RNA polymerase I like [*Caenorhabditis elegans* C. elegans] |
| 815 | 17524 | AI010568 | jj, kk | Growth hormone receptor | Growth hormone receptor |
| 816 | 6936 | AI010593 | t | | ESTs |
| 817 | 18691 | AI010605 | b | | ESTs, Moderately similar to S63665 titin protein - human (fragment) [*H. sapiens*] |
| 818 | 3211 | AI010612 | n, o, hh | | ESTs |
| 819 | 23857 | AI010616 | e | | ESTs |
| 820 | 3139 | AI010618 | ee, ff | | ESTs |
| 821 | 6946 | AI010642 | jj, kk, ll | | ESTs |
| 822 | 11227 | AI010660 | c | | ESTs |
| 823 | 17761 | AI010662 | c, r | | ESTs, Highly similar to S37488 gene T10 protein - mouse [*M. musculus*] |
| 824 | 6984 | AI010848 | f, g | | ESTs |
| 825 | 24089 | AI010865 | e, n, o | | ESTs |
| 826 | 11684 | AI010917 | a | | ESTs |
| 827 | 18438 | AI010930 | e, r | ribosomal protein L14 | ribosomal protein L14 |
| 828 | 11424 | AI010936 | jj, kk | | ESTs, Moderately similar to PTN3_HUMAN Protein tyrosine phosphatase, non-receptor type 3 (Protein-tyrosine phosphatase H1) (PTP-H1) [*H. sapiens*] |

TABLE 1-continued

| SEQ ID | GLGC ID | GenBank Accession No. | Model Code | Known Gene Name | Unigene Sequence Cluster Title |
|---|---|---|---|---|---|
| 829 | 13296 | AI011020 | ll | | ESTs, Moderately similar to MTM1_MOUSE Myotubularin [*M. musculus*] |
| 830 | 5983 | AI011070 | aa, bb, gg | | ESTs |
| 5 | 22030 | AI011177 | h, l | *Rattus norvegicus* mitochondrial genome. 9/22Length = 16, 3 | ESTs, Moderately similar to 0806162L protein URF5 [*Mus musculus*] [*M. musculus*] |
| 831 | 13787 | AI011462 | cc, dd | | ESTs, Highly similar to CU59_HUMAN Protein C21orf59 [*H. sapiens*] |
| 832 | 24022 | AI011474 | a, ee, ff, ll | | ESTs, Moderately similar to T00637 hypothetical protein H_GS541B18.1 - human (fragment) [*H. sapiens*] |
| 833 | 15917 | AI011498 | b | SWI/SNF related, matrix associated, actin dependent regulator of chromatin, subfamily d, member 2 | SWI/SNF related, matrix associated, actin dependent regulator of chromatin, subfamily d, member2 |
| 834 | 7060 | AI011547 | b | | ESTs, Highly similar to T47183 hypothetical protein DKFZp434K1822.1 - human (fragment) [*H. sapiens*] |
| 835 | 3941 | AI011598 | t, kk | | ESTs, Moderately similar to LMA5_MOUSE Laminin alpha-5 chain precursor [*M. musculus*] |
| 836 | 4350 | AI011644 | e | | ESTs |
| 837 | 21468 | AI011749 | cc, dd | | ESTs |
| 838 | 2519 | AI011770 | y, z | | ESTs |
| 839 | 17830 | AI011943 | c | Hemoglobin, beta | Hemoglobin, beta |
| 840 | 14625 | AI011949 | cc, dd | | ESTs |
| 841 | 2531 | AI011991 | n, o | Ras homolog gene family, member G | Ras homolog gene family, member G |
| 842 | 24038 | AI012109 | w, x | | ESTs, Highly similar to LSP1_MOUSE Lymphocyte-specific proteins LSP1 and S37 (PP52 protein) (52 kDa phosphoprotein) (Lymphocyte-specific antigen WP34) (S37 protein) [*M. musculus*] |
| 843 | 2341 | AI012144 | d | | ESTs |
| 844 | 13093 | AI012177 | h, l | | ESTs, Highly similar to S14538 transition protein - mouse [*M. musculus*] |
| 845 | 14668 | AI012185 | bb | | ESTs |
| 846 | 11752 | AI012208 | jj, kk | | ESTs |
| 847 | 21796 | AI012221 | a, n, o, x, z, kk | | ESTs, Weakly similar to intracellular chloride ion channel protein p64H1 [*Rattus norvegicus*] [*R.norvegicus*] |
| 848 | 3932 | AI012271 | d | | ESTs |
| 849 | 6606 | AI012308 | a, n, o, x, hh, kk | | ESTs |
| 850 | 11408 | AI012353 | u, v | | ESTs |
| 851 | 24200 | AI012356 | j, k, gg | | ESTs |
| 852 | 17471 | AI012379 | p, q | | ESTs |
| 853 | 23385 | AI012380 | b | | ESTs, Weakly similar to hypothetical protein 24432 [*Homo sapiens*] [*H. sapiens*] |
| 854 | 7120 | AI012393 | v | | ESTs, Weakly similar to JE0343 terf protein - rat [*R.norvegicus*] |
| 855 | 2456 | AI012423 | ii | | ESTs |
| 856 | 22651 | AI012434 | e | | ESTs |
| 857 | 5595 | AI012467 | u, v | | ESTs, Weakly similar to UBP2_MOUSE Ubiquitin carboxyl-terminal hydrolase 2 (Ubiquitin thiolesterase 2) (Ubiquitin-specific processing protease 2) (Deubiquitinating enzyme 2) (41 kDa ubiquitin-specific protease) [*M. musculus*] |
| 858 | 3304 | AI012471 | jj, kk | | ESTs, Weakly similar to Y48B6A.6.p [*Caenorhabditis elegans*] [*C. elegans*] |
| 859 | 14431 | AI012516 | h, l | | ESTs, Weakly similar to T47155 hypothetical protein DKFZp564B0982.1 - human [*H. sapiens*] |
| 860 | 17489 | AI012566 | d | unconventional myosin Myr2 I heavy chain | unconventional myosin Myr2 I heavy chain |
| 861 | 23025 | AI012621 | j, kk | | ESTs, Weakly similar to T00357 hypothetical protein KIAA0685 - human [*H. sapiens*] |
| 862 | 6489 | AI012636 | ll | | ESTs, Weakly similar to RBMA_RAT RNA-binding protein 10 (RNA binding motif protein 10) (S1-1 protein) [*R.norvegicus*] |

TABLE 1-continued

| SEQ ID | GLGC ID | GenBank Accession No. | Model Code | Known Gene Name | Unigene Sequence Cluster Title |
|---|---|---|---|---|---|
| 863 | 7044 | AI012641 | l, m | | ESTs, Highly similar to I48722 zinc finger protein - mouse (fragment) [*M. musculus*] |
| 864 | 7171 | AI012761 | cc, dd | | ESTs |
| 865 | 20924 | AI012832 | ii, ll | stannin | stannin |
| 866 | 4232 | AI012958 | w, x | | ESTs |
| 867 | 7193 | AI013033 | gg | | ESTs |
| 868 | 3191 | AI013075 | l, m | | ESTs, Moderately similar to hypothetical protein FLJ14621 [*Homo sapiens*] [*H. sapiens*] |
| 869 | 7220 | AI013098 | t | | ESTs |
| 870 | 16686 | AI013160 | u, v | | ESTs, Weakly similar to I63168 gene Ube1x protein - rat (fragment) [*R.norvegicus*] |
| 871 | 16984 | AI013161 | aa, bb | | ESTs, Highly similar to EF1G__MOUSE Elongation factor 1-gamma (EF-1-gamma) (eEF-1B gamma) [*M. musculus*] |
| 872 | 1332 | AI013222 | e | Platelet-derived growth factor A chain | ESTs, Platelet-derived growth factor A chain |
| 873 | 20086 | AI013260 | z | lamin A | lamin A |
| 874 | 3088 | AI013369 | bb | | ESTs |
| 875 | 6758 | AI013394 | d, jj, kk | heparan sulfate (glucosamine) 3-O-sulfotransferase 1 | heparan sulfate (glucosamine) 3-O-sulfotransferase 1 |
| 876 | 26148 | AI013396 | cc, dd | | |
| 877 | 19467 | AI013397 | ii | | ESTs |
| 878 | 23444 | AI013448 | d | | ESTs, Highly similar to chromosome 20 open reading frame 30; HSPC274 protein [*Homo sapiens*] [*H. sapiens*] |
| 879 | 22493 | AI013466 | cc, dd | | ESTs, Moderately similar to KIAA1049 protein [*Homo sapiens*] [*H. sapiens*] |
| 880 | 12233 | AI013474 | y, z, ee, ff | | ESTs, Highly similar to HPS1__HUMAN Protein PHPS1-2 [*H. sapiens*] |
| 881 | 1906 | AI013477 | gg | | Rat VL30 element mRNA |
| 882 | 12796 | AI013495 | u, v, cc, dd | | ESTs, Weakly similar to R10D12.12.p [*Caenorhabditis elegans*] [*C. elegans*] |
| 883 | 7264 | AI013499 | u, v | | EST |
| 884 | 9551 | AI013558 | t | | ESTs |
| 885 | 4253 | AI013566 | jj, kk | | ESTs, Weakly similar to FIBB__RAT Fibrinogen beta chain precursor [Contains: Fibrinopeptide B] [*R.norvegicus*] |
| 886 | 3445 | AI013724 | e | | ESTs, Weakly similar to T46337 hypothetical protein DKFZp434O2413.1 - human (fragment) [*H. sapiens*] |
| 887 | 22592 | AI013740 | n, o, w, x | | ESTs, Moderately similar to S32567 A4 protein - human [*H. sapiens*] |
| 888 | 16584 | AI013765 | w, x | Arrestin, beta 2 | Arrestin, beta 2 |
| 889 | 21950 | AI013861 | a, h, l | 3-hydroxyisobutyrate dehydrogenase | 3-hydroxyisobutyrate dehydrogenase |
| 890 | 12802 | AI013865 | d | | ESTs |
| 891 | 2708 | AI013882 | r, y, z | | ESTs, Highly similar to S53612 gene MSSP-2 protein - human [*H. sapiens*] |
| 892 | 7299 | AI013911 | t | | ESTs, Weakly similar to cold inducible RNA-binding protein [*Rattus norvegicus*] [*R.norvegicus*] |
| 893 | 21604 | AI013913 | ii | | ESTs |
| 894 | 15786 | AI013924 | b, l, m | | ESTs |
| 895 | 15904 | AI013971 | l, m | neurofascin | neurofascin |
| 896 | 7212 | AI014065 | gg | | ESTs, Weakly similar to PMX1__MOUSE Paired mesoderm homeobox protein 1 (PRX-1) (Paired related homeobox protein 1) (Homeobox protein MhoX) (Homeobox protein K-2) (Rhox) [*R.norvegicus*] |
| 897 | 15494 | AI014094 | s, t | | ESTs, Weakly similar to DPSD__CAEEL Putative phosphatidylserine decarboxylase proenzyme [*C. elegans*] |
| 6 | 19372 | AI014135 | h | *Rattus norvegicus* mitochondrial genome. 9/22Length = 16, 3 | beta-carotene 15, 15'-dioxygenase |
| 6 | 1808 | AI014135 | e, u, v | *Rattus norvegicus* mitochondrial genome. 9/22Length = 16, 3 | beta-carotene 15, 15'-dioxygenase |
| 898 | 15247 | AI014169 | aa, bb | upregulated by 1,25-dihydroxyvitamin D-3 | upregulated by 1,25-dihydroxyvitamin D-3 |

TABLE 1-continued

| SEQ ID | GLGC ID | GenBank Accession No. | Model Code | Known Gene Name | Unigene Sequence Cluster Title |
|---|---|---|---|---|---|
| 899 | 7315 | AI028831 | j, k, kk | | ESTs, Weakly similar to mitogen activated protein kinase kinase kinase 5; MEK kinase 5 [*Mus musculus*] [*M. musculus*] |
| 900 | 16631 | AI028856 | j, k, y, z | | ESTs |
| 901 | 12805 | AI028870 | b, l, m, u, v | | ESTs |
| 902 | 3625 | AI028954 | ii | | ESTs, Weakly similar to P10194 protein-tyrosine kinase (EC 2.7.1.112) tyro-12 - rat (fragment) [*R.norvegicus*] |
| 903 | 17957 | AI028975 | s, t | Adaptor protein complex AP-1, beta 1 subunit | Adaptor protein complex AP-1, beta 1 subunit |
| 904 | 5422 | AI028998 | u, v | | ESTs, Weakly similar to sequence-specific single-stranded-DNA-binding protein [*Rattus norvegicus*] [*R.norvegicus*] |
| 905 | 11326 | AI029015 | ee, ff | | ESTs |
| 906 | 7362 | AI029026 | kk | | ESTs |
| 907 | 12387 | AI029051 | e | | ESTs |
| 908 | 9317 | AI029174 | a, jj, kk | | ESTs |
| 909 | 12662 | AI029179 | d, ee, ff, jj, kk, ll | | ESTs |
| 910 | 7447 | AI029432 | u, v | | ESTs |
| 911 | 12819 | AI029437 | jj, kk | | ESTs |
| 912 | 7451 | AI029450 | y, z | | ESTs, Moderately similar to SYEP_HUMAN Bifunctional aminoacyl-tRNA synthetase [includes: Glutamyl-tRNA synthetase (Glutamate--tRNA ligase); Prolyl-tRNA synthetase (Proline--tRNA ligase)] [*H. sapiens*] |
| 913 | 7493 | AI029608 | y, z | | ESTs |
| 914 | 18885 | AI029827 | d | | ESTs, Weakly similar to S46814 ribosomal protein YmS2, mitochondrial - yeast (*Saccharomyces cerevisiae*) [*S.cerevisiae*] |
| 915 | 10650 | AI029942 | jj, kk | | ESTs, Highly similar to CAV1_MOUSE Caveolin-1 [*M. musculus*] |
| 916 | 10658 | AI030028 | e | | ESTs |
| 917 | 10665 | AI030067 | gg | | ESTs |
| 918 | 7615 | AI030163 | t | | ESTs |
| 919 | 10685 | AI030213 | cc, dd | | ESTs |
| 920 | 10690 | AI030276 | u, v | | ESTs |
| 921 | 6192 | AI030301 | gg | | ESTs |
| 922 | 665 | AI030430 | r | | ESTs |
| 923 | 10710 | AI030494 | ee, ff | | ESTs |
| 924 | 7698 | AI030527 | u, v | | ESTs |
| 925 | 7715 | AI030599 | l, m, ii | | ESTs |
| 926 | 7665 | AI030668 | a | nucleosome assembly protein 1-like 1 | nucleosome assembly protein 1-like 1 |
| 927 | 7751 | AI030750 | p, q | | ESTs |
| 928 | 19257 | AI030775 | m | | Rat (diabetic BB) MHC class II alpha chain RT1.D alpha (u) |
| 929 | 17013 | AI030797 | aa, bb | | ESTs |
| 930 | 7760 | AI030806 | kk | | ESTs |
| 931 | 17552 | AI030833 | u, v | | ESTs |
| 932 | 22614 | AI031004 | t | | ESTs, Weakly similar to B39066 proline-rich protein 15 - rat [*R.norvegicus*] |
| 933 | 23950 | AI031019 | s, t | translation initiation factor eIF-2B alpha-subunit | translation initiation factor eIF-2B alpha-subunit |
| 934 | 7842 | AI031052 | aa, bb | | ESTs |
| 935 | 7844 | AI031058 | h, l | | ESTs, Highly similar to GDP-mannose pyrophosphorylase B, isoform 2; mannose-1-phosphate guanylyltransferase [*Homo sapiens*] [*H. sapiens*] |
| 936 | 7846 | AI031059 | ll | | ESTs |
| 937 | 7852 | AI043636 | aa, bb, gg | | ESTs |
| 938 | 7867 | AI043695 | t | phosphoribosyl pyrophosphate amidotransferase | phosphoribosyl pyrophosphate amidotransferase |
| 939 | 7880 | AI043714 | ii | | ESTs, Weakly similar to T17271 hypothetical protein DKFZp434B0335.1 - human [*H. sapiens*] |
| 940 | 7584 | AI043724 | gg | | ESTs |
| 941 | 18915 | AI043798 | f, g | | ESTs |
| 942 | 7903 | AI043805 | ii | | ESTs |
| 943 | 7913 | AI043849 | ee, ff | | ESTs, Weakly similar to ELL_MOUSE RNA POLYMERASE II ELONGATION |

TABLE 1-continued

| SEQ ID | GLGC ID | GenBank Accession No. | Model Code | Known Gene Name | Unigene Sequence Cluster Title |
|---|---|---|---|---|---|
| | | | | | FACTOR ELL (ELEVEN-NINETEEN LYSINE-RICH LEUKEMIA PROTEIN) [*M. musculus*] |
| 944 | 3899 | AI043904 | u, v | | ESTs |
| 945 | 6766 | AI043914 | h, l | | ESTs |
| 946 | 7961 | AI044042 | l, m | | ESTs, Weakly similar to TC17_RAT Zinc finger protein 354A (Transcription factor 17) (Renal transcription factor Kid-1) (Kidney, ischemia, and developmentally regulated protein-1) [*R.norvegicus*] |
| 947 | 5370 | AI044087 | u, v | | EST |
| 948 | 5371 | AI044089 | cc, dd | | EST |
| 949 | 19121 | AI044101 | gg | | ESTs |
| 950 | 5378 | AI044112 | l, m | | ESTs |
| 951 | 9838 | AI044124 | ii | | ESTs |
| 952 | 12778 | AI044211 | cc, dd | | ESTs |
| 953 | 5430 | AI044253 | d | | EST |
| 954 | 6745 | AI044258 | ii | | ESTs |
| 955 | 5433 | AI044271 | u, v | | ESTs |
| 956 | 5442 | AI044299 | y, z, ee, ff | | ESTs |
| 957 | 5454 | AI044330 | cc, dd | | ESTs |
| 958 | 5461 | AI044338 | a, y, z, kk | | ESTs |
| 959 | 5486 | AI044397 | gg | | ESTs |
| 960 | 5513 | AI044521 | ii | | EST |
| 961 | 6997 | AI044539 | c | | ESTs |
| 962 | 9876 | AI044553 | l, m | | ESTs |
| 963 | 5553 | AI044632 | l, m | | ESTs |
| 964 | 5710 | AI044740 | u, v | | ESTs |
| 965 | 5596 | AI044747 | g, kk | | ESTs |
| 966 | 2348 | AI044794 | j, k | | ESTs |
| 967 | 5322 | AI044801 | c | | ESTs |
| 968 | 7992 | AI044845 | cc, dd, gg | | ESTs, Weakly similar to T12482 hypothetical protein DKFZp564P0662.1 - human (fragments) [*H. sapiens*] |
| 969 | 9914 | AI044855 | aa, bb | | ESTs |
| 970 | 5615 | AI044861 | e | | ESTs |
| 971 | 6496 | AI044887 | u, v | | ESTs |
| 972 | 20983 | AI044900 | a, h, l, ee, ff, kk | fatty acid Coenzyme A ligase, long chain 2 | fatty acid Coenzyme A ligase, long chain 2 |
| 973 | 5675 | AI045026 | j, k, p, q, ee, ff, kk | | ESTs |
| 974 | 24290 | AI045040 | cc, dd | | ESTs, Weakly similar to T15251 hypothetical protein K07B1.4 - *Caenorhabditis elegans* [*C. elegans*] |
| 975 | 5689 | AI045075 | d | | ESTs, Weakly similar to Exonuclease [*Caenorhabditis elegans*] [*C. elegans*] |
| 976 | 5726 | AI045194 | b, u, v | | ESTs |
| 977 | 5775 | AI045378 | ee, ff, gg | | ESTs |
| 978 | 5795 | AI045441 | ll | | ESTs |
| 979 | 16752 | AI045475 | d, jj, kk | | ESTs |
| 980 | 10004 | AI045509 | gg, ii | | ESTs |
| 981 | 6808 | AI045600 | w, x | | ESTs, Highly similar to S30034 translocating chain-associating membrane protein - human [*H. sapiens*] |
| 982 | 10020 | AI045632 | k, y, z | | ESTs |
| 983 | 2662 | AI045686 | e | | ESTs, Weakly similar to CBP_MOUSE CREB-binding protein [*M. musculus*] |
| 984 | 10028 | AI045707 | n, o | | ESTs |
| 985 | 16335 | AI045744 | b, u, v | Solute carrier family 4, member 1, anion exchange protein 1 (kidney band 3) | Solute carrier family 4, member 1, anion exchange protein 1 (kidney band 3) |
| 986 | 5890 | AI045836 | u, v | | ESTs |
| 987 | 2360 | AI045911 | cc, dd | | ESTs |
| 988 | 5913 | AI045929 | b | | ESTs |
| 989 | 10053 | AI045948 | n, o | | ESTs |
| 990 | 3319 | AI045989 | b, l, m | | ESTs |
| 991 | 8012 | AI058330 | ee, ff, kk | decay-accelerating factor | decay-accelerating factor |
| 992 | 6828 | AI058359 | s, t | | ESTs, Weakly similar to T46465 hypothetical protein DKFZp434A0530.1 - human [*H. sapiens*] |
| 993 | 8039 | AI058419 | u, v, aa, bb | | ESTs |
| 994 | 6737 | AI058451 | u, v | | ESTs |
| 995 | 8627 | AI058453 | l, m | | ESTs |

TABLE 1-continued

| SEQ ID | GLGC ID | GenBank Accession No. | Model Code | Known Gene Name | Unigene Sequence Cluster Title |
|---|---|---|---|---|---|
| 996 | 10070 | AI058505 | u, v | | EST, Weakly similar to RRM2_HUMAN Putative ribosomal RNA methyltransferase 2 (rRNA (uridine-2'-O-)-methyltransferase) [*H. sapiens*] |
| 997 | 10072 | AI058507 | a | | ESTs, Highly similar to Nedd4 WW binding# protein 4; Nedd4 WW-binding protein 4 [*Mus musculus*] [*M. musculus*] |
| 998 | 8612 | AI058527 | v | | ESTs |
| 999 | 8103 | AI058653 | u, v | | |
| 1000 | 8110 | AI058665 | d | | ESTs |
| 1001 | 10096 | AI058772 | n, o | | EST |
| 1002 | 8158 | AI058824 | u, v | | ESTs |
| 1003 | 19093 | AI058869 | l, m | | ESTs, Highly similar to SUI1_MOUSE Protein translation factor SUI1 homolog [*M. musculus*] |
| 1004 | 10115 | AI058890 | r | | ESTs |
| 1005 | 5549 | AI058942 | u, v | | ESTs |
| 1006 | 8539 | AI059175 | e | pericentriolar material 1 | pericentriolar material 1 |
| 1007 | 10171 | AI059209 | u, v | | EST |
| 1008 | 8265 | AI059246 | cc, dd | | EST |
| 1009 | 8285 | AI059298 | cc, dd | | ESTs |
| 1010 | 8290 | AI059312 | ee, ff | | ESTs |
| 1011 | 8291 | AI059313 | b | | EST |
| 1012 | 8303 | AI059352 | s, t | | ESTs |
| 1013 | 8314 | AI059386 | p, q | | ESTs |
| 1014 | 8729 | AI059485 | w, x | | ESTs, Weakly similar to NCP1_RAT Nck-associated protein 1 (NAP 1) (p125Nap1) (Membrane-associated protein HEM-2) [*R.norvegicus*] |
| 1015 | 8347 | AI059519 | n, o | | ESTs, Weakly similar to EGRT epidermal growth factor precursor - rat [*R.norvegicus*] |
| 1016 | 8356 | AI059543 | b | | ESTs, Weakly similar to pseudouridylate synthase; orf, hypothetical protein [Escherichia coli K12] [*E.coli*] |
| 1017 | 7970 | AI059549 | l, m | | ESTs |
| 1018 | 10233 | AI059664 | ii | | ESTs |
| 1019 | 8423 | AI059728 | cc, dd | | EST |
| 1020 | 10277 | AI059925 | u, v | | EST, Weakly similar to T42092 s-afadin - rat [*R.norvegicus*] |
| 1021 | 8494 | AI059968 | a | | ESTs |
| 1022 | 8495 | AI059971 | a, t | | ESTs, Weakly similar to 2205324A lymphotoxin beta receptor [*Mus musculus*] [*M. musculus*] |
| 1023 | 10302 | AI060137 | cc, dd | | EST |
| 1024 | 8557 | AI060221 | u, v | | ESTs |
| 1025 | 8745 | AI069939 | t | | ESTs |
| 1026 | 17506 | AI070068 | p, q | HHs:growth arrest and DNA-damage-inducible, beta | ESTs, Weakly similar to 2104282A Gadd45 gene [*Rattus norvegicus*] [*R.norvegicus*] |
| 1027 | 2742 | AI070173 | a | | ESTs |
| 1028 | 4967 | AI070179 | w, x | | ESTs, Highly similar to JC7218 glia maturation factor-gamma - rat [*R.norvegicus*] |
| 1029 | 18 | AI070195 | w, x | | ESTs, Highly similar to T42648 hypothetical protein DKFZp434C1415.1 - human [*H. sapiens*] |
| 1030 | 17796 | AI070214 | l, m | | ESTs |
| 1031 | 8854 | AI070285 | aa, bb | | ESTs |
| 1032 | 21364 | AI070392 | b, u, v | | ESTs |
| 1033 | 23277 | AI070508 | ii | | ESTs |
| 1034 | 8938 | AI070590 | a, ee, ff, kk | | ESTs |
| 1035 | 8965 | AI070660 | gg | | EST |
| 1036 | 10453 | AI070697 | b, u, v | | EST |
| 1037 | 8980 | AI070710 | d | | ESTs |
| 1038 | 21195 | AI070726 | h, l | | ESTs |
| 1039 | 18598 | AI070775 | a | | ESTs |
| 1040 | 10345 | AI071049 | d | | ESTs |
| 1041 | 9554 | AI071131 | u, v | | ESTs |
| 1042 | 23437 | AI071166 | r | | ESTs |
| 1043 | 9579 | AI071174 | d | | ESTs |
| 1044 | 9583 | AI071185 | y, z, kk | | ESTs |
| 1045 | 11017 | AI071222 | c, r | | ESTs |
| 1046 | 9604 | AI071230 | ee, ff, gg | | ESTs, Weakly similar to I48842 testin - mouse [*M. musculus*] |

TABLE 1-continued

| SEQ ID | GLGC ID | GenBank Accession No. | Model Code | Known Gene Name | Unigene Sequence Cluster Title |
|---|---|---|---|---|---|
| 1047 | 11024 | AI071285 | ii | | ESTs |
| 1048 | 9649 | AI071429 | d | | ESTs |
| 1049 | 9668 | AI071538 | r | | ESTs |
| 1050 | 22929 | AI071578 | ee, ff, kk | | ESTs, Moderately similar to S29993 P311 protein - mouse [*M. musculus*] |
| 1050 | 22930 | AI071578 | g, jj, kk | | ESTs, Moderately similar to S29993 P311 protein - mouse [*M. musculus*) |
| 1051 | 8099 | AI071586 | gg | | ESTs |
| 1052 | 11086 | AI071698 | hh | | ESTs |
| 1053 | 11088 | AI071703 | p, q | | ESTs |
| 1054 | 8712 | AI071935 | b, u, v | | ESTs, Highly similar to RIKEN cDNA 1110003N24 [*Mus musculus*] [*M. musculus*] |
| 1055 | 9788 | AI071958 | b | | ESTs |
| 1056 | 8665 | AI071965 | ee, ff | | ESTs, Moderately similar to T17342 hypothetical protein DKFZp586K1924.1 - human (fragment) [*H. sapiens*], *R.norvegicus* hsp70.2 mRNA for heat shock protein 70 |
| 1057 | 9801 | AI072019 | b | | ESTs |
| 1058 | 9806 | AI072036 | aa, bb | | ESTs |
| 1059 | 9808 | AI072050 | n, o | | ESTs |
| 1060 | 18198 | AI072063 | n, o | | ESTs, Moderately similar to S11276 alpha adaptin c - rat [*R.norvegicus*] |
| 1061 | 9186 | AI072088 | b | | ESTs |
| 1062 | 5740 | AI072092 | l, m | | ESTs, Highly similar to DYNC_HUMAN Dynactin complex 50 kDa subunit (50 kDa dynein-associated polypeptide) (Dynamitin) (DCTN-50) [*H. sapiens*] |
| 1063 | 10837 | AI072144 | y, z, ee, ff | | ESTs |
| 1064 | 7516 | AI072183 | p, q | | ESTs |
| 1065 | 9218 | AI072197 | n, o | | EST |
| 1066 | 9305 | AI072520 | aa, bb | | ESTs |
| 1067 | 10900 | AI072594 | ii | | EST |
| 1068 | 6548 | AI072658 | a, t, kk, ll | | ESTs |
| 1069 | 10918 | AI072733 | r | | EST |
| 1070 | 9380 | AI072738 | d | | ESTs |
| 1071 | 10919 | AI072744 | h, l, w, x | | ESTs |
| 1072 | 9408 | AI072835 | cc, dd | | ESTs |
| 1073 | 9409 | AI072841 | b | | ESTs, Moderately similar to S69000 laminin gamma 2 chain - mouse [*M. musculus*] |
| 1074 | 10930 | AI072900 | c | | EST |
| 1075 | 9454 | AI072992 | ll | | ESTs |
| 1076 | 9611 | AI073040 | a | | ESTs |
| 1077 | 9485 | AI073109 | ll | | ESTs, Highly similar to BANP homolog; putative transcription factor; Btg3 associated nulcear protein [*Mus musculus*] [*M. musculus*] |
| 1078 | 9466 | AI073135 | cc, dd | | ESTs |
| 1079 | 10970 | AI073207 | n, o | | ESTs |
| 1080 | 10971 | AI073212 | g, j, k | | ESTs |
| 1081 | 19371 | AI100841 | cc, dd | | ESTs |
| 1082 | 15192 | AI101099 | j, k | | ESTs, Highly similar to SMRT2 metallothionein II - rat [*R.norvegicus*] |
| 1083 | 7868 | AI101229 | jj, kk | | ESTs |
| 1084 | 5421 | AI101270 | aa, bb | HMm:Rho, GDP dissociation inhibitor (GDI) beta | ESTs, Highly similar to I49687 GDP-dissociation inhibitor - mouse [*M. musculus*] |
| 1085 | 4027 | AI101330 | e | | ESTs |
| 1086 | 11634 | AI101338 | n, o | | ESTs |
| 1087 | 2292 | AI101362 | hh | | ESTs |
| 1088 | 18212 | AI101494 | cc, dd | | ESTs |
| 1089 | 6640 | AI101500 | e | | ESTs |
| 1090 | 22786 | AI101659 | gg | | ESTs, Weakly similar to dual-specificity phosphatase [*Mus musculus*] [*M. musculus*] |
| 1091 | 13267 | AI101847 | h, l | Potassium (K+) channel protein alpha 5 | Potassium (K+) channel protein alpha 5 |
| 1092 | 4432 | AI101851 | t | | ESTs |
| 1093 | 2042 | AI101921 | s, t | | ESTs |
| 1094 | 11399 | AI101924 | r, jj, kk | | ESTs |
| 1095 | 11598 | AI102007 | h, l | | ESTs |
| 1096 | 3085 | AI102046 | c | | ESTs |
| 1097 | 3996 | AI102061 | r | | ESTs |

TABLE 1-continued

| SEQ ID | GLGC ID | GenBank Accession No. | Model Code | Known Gene Name | Unigene Sequence Cluster Title |
|---|---|---|---|---|---|
| 1098 | 10227 | AI102248 | kk | | ESTs |
| 1099 | 16596 | AI102486 | ee, ff, kk | | ESTs, Weakly similar to S37583 RING finger protein rfp - mouse (fragment) [*M. musculus*] |
| 1100 | 11953 | AI102505 | hh | cytochrome c oxidase, subunit VIIIa | cytochrome c oxidase, subunit VIIIa |
| 1100 | 11954 | AI102505 | hh | cytochrome c oxidase, subunit VIIIa | cytochrome c oxidase, subunit VIIIa |
| 1101 | 2125 | AI102519 | n, o, w, x | | ESTs, Highly similar to TYRO protein tyrosine kinase binding protein; killer cell activating receptor associated protein [*Mus musculus*] [*M. musculus*] |
| 1102 | 5969 | AI102520 | b, i, m, bb, kk | | ESTs, Weakly similar to GABA(A) receptor-associated protein like 2; ganglioside expression factor 2 [*Rattus norvegicus*] [*R.norvegicus*] |
| 1103 | 4102 | AI102524 | gg | | ESTs, Highly similar to CBX2_MOUSE Chromobox protein homolog 2 (Modifier 3 protein) (M33) [*M. musculus*] |
| 1104 | 11563 | AI102560 | b, e, l, m | | ESTs |
| 1105 | 22487 | AI102578 | e | | ESTs, Highly similar to I49523 tumor necrosis factor alpha-induced protein 2- mouse [*M. musculus*] |
| 1106 | 19011 | AI102618 | p, q | | ESTs |
| 1107 | 19379 | AI102711 | w, x | | ESTs, Highly similar to RIKEN cDNA 0610010I12 [*Mus musculus*] [*M. musculus*] |
| 1108 | 22171 | AI102734 | w, x | | ESTs, Moderately similar to JC4965 elk1 protein - mouse [*M. musculus*] |
| 1109 | 5891 | AI102745 | cc, dd | | ESTs |
| 1110 | 11724 | AI102812 | c | | ESTs |
| 1111 | 18916 | AI102819 | e | | ESTs |
| 1112 | 11723 | AI102896 | aa, bb | | ESTs |
| 1113 | 24229 | AI102972 | r | | ESTs |
| 1114 | 10659 | AI103059 | j, k | | ESTs |
| 1115 | 8124 | AI103071 | s, t, ii | | ESTs |
| 1116 | 2316 | AI103084 | hh | | ESTs, Moderately similar to selective hybridizing clone [*Mus musculus*] [*M. musculus*] |
| 1117 | 3584 | AI103106 | r | | ESTs |
| 1118 | 17642 | AI103357 | cc, dd | | ESTs |
| 1119 | 11721 | AI103391 | ee, ff | | ESTs, Highly similar to phosphatidylinositol 3-kinase, regulatory subunit, polypeptide [*Rattus norvegicus*] [*R.norvegicus*] |
| 7 | 14980 | AI103396 | l, m | *Rattus norvegicus* mitochondrial genome. 9/22Length = 16, 3 | *Rattus norvegicus* CDK110 mRNA |
| 7 | 14981 | AI103396 | e | *Rattus norvegicus* mitochondrial genome. g/22Length = 16, 3 | *Rattus norvegicus* CDK110 mRNA |
| 1120 | 3905 | AI103403 | a | polypyrimidine tract binding protein | polypyrimidine tract binding protein |
| 1121 | 15841 | AI103465 | t | | ESTs, Moderately similar to RP29_HUMAN Ribonuclease P protein subunit p29 [*H. sapiens*] |
| 1122 | 4873 | AI103531 | l, m, ee, ff | | ESTs, Highly similar to toll-associated serine protease [*Mus musculus*] [*M. musculus*] |
| 1123 | 7528 | AI103548 | r | | ESTs, Moderately similar to T24634 hypothetical protein T07C4.10b - *Caenorhabditis elegans* [*C. elegans*] |
| 1124 | 21579 | AI103572 | p, q | | ESTs |
| 1125 | 15942 | AI103738 | h, l | | ESTs |
| 1126 | 17762 | AI103854 | c | | ESTs, Highly similar to S37488 gene T10 protein - mouse [*M. musculus*] |
| 1127 | 4402 | AI103874 | r | | ESTs, Weakly similar to FKB1_RAT FK506-BINDING PROTEIN (FKBP-12) (PEPTIDYL-PROLYL CIS-TRANS ISOMERASE) (PPIASE) (ROTAMASE) (IMMUNOPHILIN FKBP12) [*R.norvegicus*] |
| 1128 | 11516 | AI103962 | dd | | ESTs |
| 1129 | 16136 | AI103983 | p, q | unknown Glu-Pro dipeptide repeat protein | unknown Glu-Pro dipeptide repeat protein |
| 1130 | 26213 | AI104113 | f, g | | |

TABLE 1-continued

| SEQ ID | GLGC ID | GenBank Accession No. | Model Code | Known Gene Name | Unigene Sequence Cluster Title |
|---|---|---|---|---|---|
| 1131 | 21927 | AI104117 | w, x | | *Rattus norvegicus* LIM-domain protein LMP-1 mRNA, complete cds |
| 1132 | 8458 | AI104239 | gg | | ESTs |
| 1133 | 3527 | AI104278 | n, o | | ESTs |
| 1134 | 11522 | AI104303 | y, z | | ESTs |
| 1135 | 15416 | AI104340 | d | | ESTs |
| 1136 | 2856 | AI104349 | d | | ESTs |
| 1137 | 18831 | AI104357 | bb | | ESTs, Highly similar to ACTB_HUMAN Actin, cytoplasmic 1 (Beta-actin) [*R.norvegicus*] |
| 1138 | 23574 | AI104520 | hh | Cytochrome c oxidase subunit VIa (liver) | Cytochrome c oxidase subunit VIa (liver) |
| 1139 | 18509 | AI104528 | hh | | ESTs, Weakly similar to NADH dehydrogenase (ubiquinone) 1 beta subcomplex, 6 (17kD, B17) [*Homo sapiens*] [*H. sapiens*] |
| 1140 | 4782 | AI104570 | r | | ESTs |
| 1141 | 11680 | AI104605 | jj, kk | | ESTs |
| 1142 | 4626 | AI104744 | j, k, l, m | | ESTs |
| 1143 | 14464 | AI104848 | kk | | ESTs |
| 1144 | 6205 | AI104907 | g | TEMO | TEMO |
| 1145 | 8273 | AI104908 | ii | | ESTs |
| 1146 | 24375 | AI104979 | j, k | | ESTs, Moderately similar to EBNA1 binding protein 2; nucleolar protein p40; homolog of yeast EBNA1-binding protein; nuclear FGF3 binding protein; EBNA1-binding protein 2 [*Homo sapiens*] [*H. sapiens*] |
| 1147 | 3802 | AI105044 | gg | | *Rattus norvegicus* 250 kDa estrous-specific protein mRNA, partial cds |
| 1148 | 21361 | AI105161 | d | | ESTs |
| 1149 | 2196 | AI105243 | jj, kk | | ESTs |
| 1150 | 23596 | AI105435 | bb | HHs:glutaryl-Coenzyme A dehydrogenase | ESTs, Highly similar to GCDH_MOUSE Glutaryl-CoA dehydrogenase, mitochondrial precursor (GCD) [*M. musculus*] |
| 1151 | 15197 | AI105444 | d, kk | | ESTs |
| 1152 | 15291 | AI111401 | hh | multiple inositol polyphosphate histidine phosphatase 1 | multiple inositol polyphosphate histidine phosphatase 1 |
| 1153 | 4479 | AI111599 | i, k, jj, kk | | ESTs |
| 1154 | 18439 | AI111877 | r | ribosomal protein L14 | ribosomal protein L14 |
| 1155 | 2539 | AI111960 | e, kk | | ESTs, Weakly similar to FKB5_MOUSE 51 kDa FK506-binding protein (FKBP51) (Peptidyl-prolyl cis-trans isomerase) (PPiase) (Rotamase) [*M. musculus*] |
| 1156 | 12887 | AI112095 | hh | | ESTs, Highly similar to JC5556 adhalin - mouse [*M. musculus*] |
| 1157 | 4143 | AI112107 | gg | | ESTs |
| 1158 | 14434 | AI112291 | ll | | ESTs, Weakly similar to T46612 multi PDZ domain protein 1 - rat [*R.norvegicus*] |
| 1159 | 22744 | AI112512 | h, l | | ESTs |
| 1160 | 12969 | AI112969 | p, q | | ESTs |
| 1161 | 2296 | AI112979 | w, x | | ESTs, Highly similar to SAP3_MOUSE Ganglioside GM2 activator precursor (GM2-AP) (Cerebroside sulfate activator protein) (Shingolipid activator protein 3) (SAP-3) [*M. musculus*] |
| 1162 | 4969 | AI113008 | l, k, n, o | | ESTs, Weakly similar to vitronectin [*Rattus norvegicus*] [*R.norvegicus*] |
| 1163 | 23428 | AI113320 | ll | | ESTs, Moderately similar to JC4365 arginine--tRNA ligase (EC 6.1.1.19) - human [*H. sapiens*] |
| 1164 | 6166 | AI136516 | r, kk | | ESTs |
| 1165 | 21019 | AI136547 | y, z | | ESTs |
| 1166 | 10780 | AI136555 | c | | *Rattus norvegicus* mRNA for Castration Induced Prostatic Apoptosis Related protein-1 (CIPAR-1) |
| 1167 | 24212 | AI136747 | cc, dd | | ESTs, Highly similar to H33_HUMAN Histone H3.3 (H3.A) (H3.B) (H3.3Q) [*M. musculus*] |
| 1168 | 13080 | AI136842 | e | | ESTs |
| 1169 | 13082 | AI136848 | c | | ESTs, Weakly similar to T34013 hypothetical protein Y4C6B.5 - *Caenorhabditis elegans* [*C. elegans*] |

TABLE 1-continued

| SEQ ID | GLGC ID | GenBank Accession No. | Model Code | Known Gene Name | Unigene Sequence Cluster Title |
|---|---|---|---|---|---|
| 1170 | 13090 | AI136977 | cc, dd | | ESTs, Highly similar to S14538 transition protein - mouse [M. musculus] |
| 1171 | 12878 | AI137114 | hh | | ESTs |
| 1172 | 13717 | AI137131 | n, o | | ESTs, Moderately similar to S21976 probable RNA-directed DNA polymerase (EC 2.7.7.49) (clone MH2C) - rat retrotransposon L1 (fragment) [R.norvegicus] |
| 1173 | 13291 | AI137286 | ee, ff | | ESTs |
| 1174 | 15969 | AI137302 | cc, dd | | ESTs, Weakly similar to ZF37_RAT Zinc finger protein 37 (Zfp-37) [R.norvegicus] |
| 1175 | 9166 | AI137406 | kk | | ESTs, Moderately similar to A55945 endothelial cell protein C receptor precursor - mouse [M. musculus] |
| 1176 | 11238 | AI137410 | ee, ff | | ESTs, Moderately similar to hypothetical protein FLJ12888 [Homo sapiens] [H. sapiens] |
| 1177 | 7122 | AI137468 | gg | | ESTs, Weakly similar to GPV_RAT Platelet glycoprotein V precursor (GPV) (CD42D) [R.norvegicus] |
| 1178 | 18943 | AI137495 | d | | ESTs, Highly similar to H2A1_RAT Histone H2A.1 [R.norvegicus] |
| 1179 | 17402 | AI137553 | ee, ff | Transforming growth factor beta stimulated clone 22 | Transforming growth factor beta stimulated clone 22 |
| 1180 | 6638 | AI137579 | bb | | ESTs |
| 1181 | 7414 | AI137586 | a | | ESTs, Highly similar to IMB3_HUMAN Importin beta-3 subunit (Karyopherin beta-3 subunit) (Ran-binding protein 5) [H. sapiens] |
| 1182 | 12654 | AI137864 | cc, dd | | ESTs, Highly similar to MG15_HUMAN Transcription factor-like protein MRG15 (MORF-related gene 15 protein) (MSL3-1 protein) (Protein HSPC008/HSPC061) [H. sapiens] |
| 1183 | 13227 | AI137925 | hh | | ESTs |
| 1184 | 12356 | AI137931 | l, m | | ESTs |
| 1185 | 23687 | AI137958 | g | | ESTs |
| 1186 | 14524 | AI137974 | d | | ESTs, Highly similar to I57019 H3 histone - rat [R.norvegicus] |
| 1187 | 11372 | AI137995 | c | | ESTs |
| 1188 | 13161 | AI138093 | g | | ESTs |
| 1189 | 13181 | AI144948 | r | | ESTs |
| 1190 | 6364 | AI145058 | gg | | ESTs |
| 1191 | 14458 | AI145095 | kk | | ESTs |
| 1192 | 13786 | AI145106 | hh | | ESTs |
| 1193 | 18206 | AI145282 | a, jj, kk | | ESTs, Weakly similar to NUCL_RAT Nucleolin (Protein C23) [R.norvegicus] |
| 1194 | 5732 | AI145362 | ll | | ESTs |
| 1195 | 13375 | AI145454 | cc, dd | | ESTs |
| 1196 | 11331 | AI145556 | t | | ESTs |
| 1197 | 23631 | AI145650 | j, k | | ESTs |
| 1198 | 8339 | AI145761 | w, x | | ESTs, Weakly similar to T21659 hypothetical protein F32D8.4 - Caenorhabditis elegans [C. elegans] |
| 1199 | 5531 | AI145859 | t | | ESTs |
| 1200 | 11337 | AI145968 | l, m | | ESTs, Highly similar to RB6K_MOUSE Rabkinesin-6 (RAB6-interacting kinesin-like protein) (Kinesin-like protein 174) [M. musculus] |
| 1201 | 11346 | AI145991 | jj, kk | | ESTs, Highly similar to T46266 hypothetical protein DKFZpJ61A179.1 - human (fragment) [H. sapiens] |
| 1202 | 11363 | AI145997 | hh | | ESTs, Moderately similar to 2206377B MHR23B gene [Mus musculus] [M. musculus] |
| 1203 | 18472 | AI168975 | j, k | | ESTs, Weakly similar to Yeast hypothetical 52.9 KD protein like [Caenorhabditis elegans] [C. elegans] |
| 1203 | 18473 | AI168975 | j, k, kk, ll | | ESTs, Weakly similar to Yeast hypothetical 52.9 KD protein like [Caenorhabditis elegans] [C. elegans] |
| 1204 | 21523 | AI169104 | e | | ESTs, Highly similar to A26774 platelet factor 4 precursor - rat [R.norvegicus] |

TABLE 1-continued

| SEQ ID | GLGC ID | GenBank Accession No. | Model Code | Known Gene Name | Unigene Sequence Cluster Title |
|---|---|---|---|---|---|
| 1205 | 17914 | AI169159 | hh | HMm:ATPase, H+ transporting, lysosomal 31 kDa, V1 subunit E | ESTs, Moderately similar to VATE_MOUSE Vacuolar ATP synthase subunit E (V-ATPase E subunit) (Vacuolar proton pump E subunit) (V-ATPase 31 kDa subunit) (P31) [*M. musculus*] |
| 1206 | 23152 | AI169170 | r | HHs:eukaryotic translation initiation factor 4A, isoform 2 | ESTs, Highly similar to S00985 translation initiation factor eIF-4A II - mouse [*M. musculus*] |
| 1207 | 12979 | AI169177 | a, p, q, y, z | | ESTs, Highly similar to S33363 gly96 protein - mouse [*M. musculus*] |
| 1208 | 2607 | AI169211 | r | | ESTs, Highly similar to A47318 RNA-binding protein Raly - mouse [*M. musculus*] |
| 1209 | 22661 | AI169265 | gg | ATPase, H+ transporting, lysosomal (vacuolar proton pump), subunit 1 | ATPase, H+ transporting, lysosomal (vacuolar proton pump), subunit 1 |
| 1210 | 149 | AI169272 | cc, dd | | ESTs |
| 1211 | 13240 | AI169311 | j, k | | ESTs |
| 1212 | 14525 | AI169512 | d | | ESTs |
| 1213 | 11550 | AI169591 | r | | ESTs, Highly similar to S57447 HPBRII-7 protein - human [*H. sapiens*] |
| 1214 | 4480 | AI169601 | hh | | ESTs |
| 1215 | 6888 | AI169615 | s, t | vesicle-associated membrane protein, associated protein A (33 kDa) | vesicle-associated membrane protein, associated protein A (33 kDa) |
| 1216 | 23110 | AI169640 | t | | ESTs, Highly similar to chromosome 11 hypothetical protein ORF3 [*Homo sapiens*] [*H. sapiens*] |
| 1217 | 24146 | AI169668 | ii | | ESTs, Weakly similar to ATP-binding cassette, sub-family F, member 2 [*Homo sapiens*] [*H. sapiens*] |
| 1218 | 21660 | AI169751 | a, kk | | *Rattus norvegicus* interferon-inducible protein variant 10 mRNA, complete cds |
| 1219 | 804 | AI169756 | j, k, p, q | | ESTs, Highly similar to G33_RAT GENE 33 POLYPEPTIDE [*R.norvegicus*] |
| 1220 | 13427 | AI169993 | aa, bb | | ESTs |
| 1221 | 21185 | AI170056 | a | | ESTs |
| 1222 | 21254 | AI170059 | d | | ESTs |
| 1223 | 6969 | AI170244 | hh | | ESTs, Moderately similar to gl-related zinc finger protein [*Mus musculus*] [*M. musculus*] |
| 1224 | 22942 | AI170251 | aa, bb | | ESTs |
| 1225 | 3547 | AI170279 | ii | | ESTs, Weakly similar to S54303 zinc transport protein ZnT-1 - rat [*R.norvegicus*] |
| 1226 | 3486 | AI170313 | gg | | ESTs |
| 1227 | 2729 | AI170363 | e, j, k, t, ee, ff | | ESTs |
| 1228 | 5297 | AI170379 | a, p, q, y, z | | ESTs |
| 1229 | 22707 | AI170384 | cc, dd | | ESTs |
| 1230 | 16916 | AI170406 | h, l | | ESTs |
| 1231 | 18744 | AI170407 | d, kk | | ESTs |
| 1232 | 11585 | AI170502 | r | HMm:glycogen synthase 3, brain | ESTs, Weakly similar to A35362 UDPglucose--glycogen glucosyltransferase (EC 2.4.1.11), hepatic - rat [*R.norvegicus*] |
| 1233 | 18811 | AI170525 | ii | | ESTs |
| 1234 | 16689 | AI170561 | cc, dd | | ESTs |
| 1235 | 2534 | AI170632 | aa, bb, ii | | ESTs |
| 1236 | 15393 | AI170663 | cc, dd | HHs:sterol regulatory element binding transcription factor 2 | ESTs, Weakly similar to A48085 transcription factor ADD1 - rat [*R.norvegicus*] |
| 1237 | 13365 | AI170676 | ee, ff | | ESTs |
| 1238 | 3973 | AI170687 | hh | | ESTs |
| 1239 | 6982 | AI170793 | kk | | ESTs, Weakly similar to DCC_MOUSE Tumor suppressor protein DCC precursor [*M. musculus*] |
| 1240 | 21284 | AI170842 | hh | | ESTs, Weakly similar to A57291 cytokine inducible nuclear protein C193 - human [*H. sapiens*] |
| 1241 | 12695 | AI170948 | q | | ESTs, Moderately similar to A57641 G protein-coupled receptor 4 - human [*H. sapiens*] |
| 1242 | 7011 | AI171019 | aa, bb | | ESTs |
| 1243 | 13702 | AI171064 | n, o | | ESTs |

TABLE 1-continued

| SEQ ID | GLGC ID | GenBank Accession No. | Model Code | Known Gene Name | Unigene Sequence Cluster Title |
|---|---|---|---|---|---|
| 1244 | 22033 | AI171165 | aa, bb | | ESTs |
| 1245 | 17783 | AI171206 | ee, ff | | ESTs, Weakly similar to 2118320A neurodegeneration-associated protein 1 [*Rattus norvegicus*] [*R.norvegicus*] |
| 1246 | 21771 | AI171209 | n, o | | ESTs |
| 1247 | 5953 | AI171231 | s, t | amino acid transporter system A2 | amino acid transporter system A2 |
| 1248 | 22432 | AI171263 | a, z | | ESTs, Highly similar to S38342 fibrillarin - mouse [*M. musculus*] |
| 1249 | 11426 | AI171305 | a, jj, kk | | ESTs, Moderately similar to PTN3_HUMAN Protein tyrosine phosphatase, non-receptor type 3 (Protein-tyrosine phosphatase H1) (PTP-H1) [*H. sapiens*] |
| 1250 | 14960 | AI171319 | w, x | guanine nucleotide binding protein (G protein), beta polypeptide 2-like 1 | ESTs, Highly similar to SWI/SNF related, matrix associated, actin dependent regulator of chromatin, subfamily b, member 1; integrase interactor 1 [*Mus musculus*] [*M. musculus*], guanine nucleotide binding protein (G protein), beta polypeptide 2-like 1 |
| 1251 | 14117 | AI171350 | e, p, q | | ESTs |
| 1252 | 18047 | AI171359 | bb | | ESTs, Weakly similar to DnaJ-like protein [*Rattus norvegicus*] [*R.norvegicus*] |
| 1253 | 16599 | AI171366 | ee, ff, jj, kk | | ESTs, Weakly similar to S37583 RING finger protein rfp - mouse (fragment) [*M. musculus*] |
| 1254 | 22958 | AI171374 | p, q, t | | ESTs, Moderately similar to MEA6_HUMAN Meningioma-expressed antigen 6/11 (MEA6) (MEA11) [*H. sapiens*] |
| 1255 | 17529 | AI171460 | h, l | | ESTs, Weakly similar to HCD2_RAT 3-hydroxyacyl-CoA dehydrogenase type II (Type II HADH) (Endoplasmic reticulum-associated amyloid beta-peptide binding protein) [*R.norvegicus*] |
| 1256 | 13453 | AI171518 | r | | ESTs |
| 1257 | 17220 | AI171521 | c | | ESTs |
| 1258 | 11761 | AI171526 | d | | ESTs |
| 1259 | 15292 | AI171607 | t | | ESTs |
| 1260 | 6667 | AI171646 | gg | | ESTs |
| 1261 | 2795 | AI171655 | e | | ESTs |
| 1262 | 11696 | AI171774 | jj, kk | | ESTs, Weakly similar to TMOD_MOUSE Tropomodulin [*M. musculus*] |
| 1263 | 15449 | AI171799 | jj, kk | | ESTs |
| 1264 | 4420 | AI171916 | a, z | | ESTs |
| 1265 | 24220 | AI171978 | r | | ESTs |
| 1266 | 22239 | AI171982 | e | | ESTs, Moderately similar to 148672 p8 MTCP-1 - mouse [*M. musculus*] |
| 1267 | 6645 | AI171998 | jj, kk | | ESTs |
| 1268 | 1506 | AI172051 | n, o | | ESTs, Highly similar to A29440 signal recognition particle receptor - human [*H. sapiens*] |
| 1269 | 19012 | AI172056 | p, q, gg | | ESTs |
| 1270 | 9538 | AI172097 | l, m | heat shock transcription factor 1 | heat shock transcription factor 1 |
| 1271 | 12367 | AI172126 | gg | | ESTs |
| 1272 | 16293 | AI172183 | c | | ESTs, Weakly similar to RTN1_RAT Reticulon 1 (Neuroendocrine-specific protein) (S-rex) [*R.norvegicus*] |
| 1273 | 6974 | AI172263 | d, r | | ESTs |
| 1274 | 23703 | AI172265 | cc, dd | | ESTs |
| 1275 | 23313 | AI172271 | r | | ESTs |
| 1276 | 2140 | AI172272 | hh | | ESTs, Weakly similar to A53004 transcription elongation factor S-II - rat [*R.norvegicus*] |
| 1277 | 24268 | AI172281 | g | | ESTs |
| 1278 | 1287 | AI172299 | kk | | ESTs |
| 1279 | 4278 | AI172304 | e | HMm:interleukin 2 receptor, gamma chain | ESTs, Highly similar to 149280 interleukin-2 receptor gamma chain precursor - mouse [*M. musculus*] |
| 1280 | 11702 | AI172305 | e | | ESTs |
| 1281 | 13266 | AI172326 | j, k, ii | | ESTs |
| 1282 | 23390 | AI172328 | e | RNA binding protein p45AUF1 | RNA binding protein p45AUF1 |

TABLE 1-continued

| SEQ ID | GLGC ID | GenBank Accession No. | Model Code | Known Gene Name | Unigene Sequence Cluster Title |
|---|---|---|---|---|---|
| 1283 | 12117 | AI172352 | hh, jj, kk | | ESTs |
| 1284 | 24209 | AI172423 | a, h, l, o, hh | | ESTs |
| 1285 | 2208 | AI172472 | cc, dd | | ESTs, Weakly similar to HCCA2 protein [Homo sapiens] [H. sapiens] |
| 1286 | 17291 | AI172491 | gg | | ESTs, Weakly similar to A54756 isocitrate dehydrogenase (NADP+) (EC 1.1.1.42), cytosolic - rat [R.norvegicus] |
| 1287 | 12043 | AI172567 | ii | | ESTs |
| 1288 | 13070 | AI172569 | h, l | | EST |
| 1289 | 11897 | AI112598 | jj, kk | | ESTs |
| 1290 | 11173 | AI175005 | r | | ESTs |
| 1291 | 7740 | AI175011 | r, hh | | ESTs, Moderately similar to COF1_RAT COFILIN, NON-MUSCLE ISOFORM [R.norvegicus] |
| 1292 | 17679 | AI175025 | hh | | ESTs, Moderately similar to WS3_HUMAN WS-3 PROTEIN [H. sapiens] |
| 1293 | 8053 | AI175033 | p, q | | ESTs |
| 1294 | 2331 | AI175045 | j, k, p, q, ee, ff, jj, kk | | ESTs |
| 1295 | 3982 | AI175100 | h, l, kk, ll | | ESTs |
| 1296 | 19118 | AI175281 | hh | Guanidinoacetate methyltransferase | Guanidinoacetate methyltransferase |
| 1297 | 21252 | AI175328 | n, o | | ESTs, Weakly similar to S08464 T-cell alloantigen RT6.1 - rat [R.norvegicus] |
| 1298 | 2448 | AI175348 | jj, kk | | ESTs |
| 1299 | 13460 | AI175375 | a, y, z, ee, ff, kk | | ESTs |
| 1300 | 4445 | AI175466 | r | | ESTs, Weakly similar to RASH_RAT TRANSFORMING PROTEIN P21/H-RAS-1 (C-H-RAS) [R.norvegicus] |
| 1301 | 13353 | AI175508 | j, k | | ESTs |
| 1302 | 18507 | AI175551 | h, l, w, x, kk | | ESTs, Highly similar to EF1B_MOUSE Elongation factor 1-beta (EF-1-beta) [M. musculus] |
| 1303 | 9979 | AI175594 | ii | | ESTs |
| 1304 | 2261 | AI175619 | ii | | ESTs, Weakly similar to A53237 I(3)S12 protein - fruit fly (Drosophila melanogaster) (fragment) [D.melanogaster] |
| 1305 | 15984 | AI175777 | j, k | | ESTs |
| 1306 | 19004 | AI175875 | aa, bb | | Ratttus norvegicus Sprague-Dawley lipid-binding protein mRNA, complete cds |
| 1306 | 19005 | AI175875 | ii | | Rattus norvegicus Sprague-Dawley lipid-binding protein mRNA, complete cds |
| 1307 | 21755 | AI175977 | r | | ESTs |
| 1308 | 4074 | AI175990 | a, x | | ESTs |
| 1309 | 22451 | AI175992 | r | | ESTs, Highly similar to beta-catenin-interacting protein ICAT [Mus musculus] [M. musculus] |
| 1310 | 2046 | AI176004 | f, g | | ESTs |
| 1311 | 22311 | AI176007 | y, z | | ESTs, Highly similar to PM5P_HUMAN Protein pM5 precursor [H. sapiens] |
| 1312 | 12298 | AI176055 | aa, bb | | ESTs |
| 1313 | 5876 | AI176117 | hh | HMm:pyruvate dehydrogenase (lipoamide) beta | ESTs, ESTs, Highly similar to S15892 pyruvate dehydrogenase (lipoamide) (EC 1.2.4.1) beta chain - rat [R.norvegicus] |
| 1314 | 4585 | AI176121 | f, g | | ESTs |
| 1315 | 6686 | AI176130 | d, jj, kk | | ESTs |
| 1316 | 17223 | AI176140 | r | | ESTs, Highly similar to testis expressed gene 189 [Mus musculus] [M. musculus] |
| 1317 | 18581 | AI176160 | n, o | | ESTs |
| 1318 | 6782 | AI176170 | e | FK506-binding protein 1 (12 kD) | FK506-binding protein 1 (12 kD) |
| 1319 | 10182 | AI176185 | p, q, gg | FBJ murine osteosarcoma viral (v-fos) oncogene homolog | FBJ murine osteosarcoma viral (v-fos) oncogene homolog |
| 1320 | 22765 | AI176265 | j, k, p, q, kk | | ESTs |
| 1321 | 12999 | AI176276 | h, l, p, q, y, z, gg | | ESTs, Highly similar to UAP1_HUMAN UDP-N-acetylhexosamine pyrophosphorylase (Antigen X) (AGX) (Sperm-associated antigen 2) [Includes: UDP-N-acetylgalactosamine pyrophosphorylase (AGX-1); UDP-N-acetylglucosamine pyrophosphorylase (AGX-2) [H. sapiens] |

TABLE 1-continued

| SEQ ID | GLGC ID | GenBank Accession No. | Model Code | Known Gene Name | Unigene Sequence Cluster Title |
|---|---|---|---|---|---|
| 1322 | 16438 | AI176294 | cc, dd | | ESTs, Highly similar to B Chain B, Crystal Structure Of The D1d2 Sub-Complex From The Human Snrnp Core Domain [*H. sapiens*] |
| 1323 | 13339 | AI176308 | s, t | | ESTs, Weakly similar to CO1B_RAT Coronin 1B (Coronin 2) [*R.norvegicus*] |
| 1324 | 13511 | AI176331 | l, m | | ESTs |
| 1325 | 13504 | AI176354 | gg | | ESTs, Weakly similar to YQT3_CAEEL HYPOTHETICAL 42.0 KD PROTEIN F25B5.3 IN CHROMOSOME III [*C. elegans*] |
| 1326 | 3014 | AI176362 | a, y, z, bb, kk, ll | | ESTs |
| 1327 | 19006 | AI176393 | aa, bb, ll | | *Rattus norvegicus* Sprague-Dawley lipid-binding protein mRNA, complete cds |
| 1328 | 17920 | AI176422 | ll | | ESTs, Highly similar to S41115 probable flavoprotein-ubiquinone oxidoreductase (EC 1.6.5.-) - human [*H. sapiens*] |
| 1329 | 24314 | AI176434 | hh | | ESTs |
| 1330 | 15191 | AI176456 | h, l, j, k, y, z, ee, ff, kk | | ESTs, Highly similar to SMRT2 metallothionein II - rat [*R.norvegicus*] |
| 1331 | 24763 | AI176488 | jj, kk | nuclear factor I/B | nuclear factor I/B |
| 1332 | 22716 | AI176500 | f, g | | ESTs, Highly similar to NIDO_RAT NIDOGEN (ENTACTIN) [*R.norvegicus*] |
| 1333 | 8609 | AI176505 | hh | | ESTs |
| 1334 | 15959 | AI176540 | d, r | | ESTs |
| 1335 | 16518 | AI176546 | d, ee, ff, jj, kk | HMm:heat shock protein, 86 kDa 1 | ESTs, Moderately similar to HS9B_RAT Heat shock protein HSP 90-beta (HSP 84) [*R.norvegicus*] |
| 1336 | 5507 | AI176584 | c | | *Rattus norvegicus* insulin-like growth factor binding protein 5 mRNA, 3' UTR |
| 1337 | 3619 | AI176588 | j, k | | ESTs, Weakly similar to tumor protein p53-binding protein; topoisomerase I binding protein [*Homo sapiens*] [*H .sapiens*] |
| 1338 | 18525 | AI176792 | d | | ESTs |
| 1339 | 21740 | AI176810 | e, j, k, kk | | ESTs |
| 1340 | 6821 | AI176841 | ii | | ESTs |
| 1341 | 16917 | AI176951 | h, l | | ESTs |
| 1342 | 10310 | AI176961 | n, o | ribosomal protein, mitochondrial, L12 | ribosomal protein, mitochondrial, L12 |
| 1343 | 16124 | AI176963 | p, q , r, bb, ee, ff, jj, kk | Cbp/p300-interacting transactivator, with Glu/Asp-rich carboxy-terminal domain, 2 | Cbp/p300-interacting transactivator, with Glu/Asp-rich carboxy-terminal domain, 2 |
| 1344 | 7292 | AI176995 | c | | ESTs, Moderately similar to T13963 formin related protein, lymphocyte specific - mouse [*M. musculus*] |
| 1345 | 16493 | AI177049 | d | | ESTs |
| 1346 | 3969 | AI177055 | ii | | ESTs |
| 1347 | 2852 | AI177059 | c, g, kk | | ESTs |
| 1348 | 22077 | AI177099 | hh | | ESTs |
| 1349 | 5943 | AI177105 | j, k | | ESTs, Weakly similar to OAF_DROME Out at first protein [Contains: Out at first short protein] [*D.melanogaster*] |
| 1350 | 13310 | AI177119 | kk | | ESTs, Weakly similar to 549158 complement protein C1q beta chain precursor - rat [*R.norvegicus*] |
| 1351 | 12582 | AI177183 | c | | ESTs |
| 1352 | 7163 | AI177256 | h, l | | ESTs |
| 1353 | 13539 | AI177280 | w, x | | ESTs, Weakly similar to GMCR_MOUSE Granulocyte-macrophage colony-stimulating factor receptor alpha chain precursor (GM-CSF-R-alpha) (GMR) [*M. musculus*] |
| 1354 | 21785 | AI177312 | a | | ESTs |
| 1355 | 26254 | AI177357 | r | | |
| 1356 | 14989 | AI177366 | f, g, l, m, kk | Integrin, beta 1 | Integrin, beta 1 |
| 1357 | 17826 | AI177403 | w, x | | ESTs, Weakly similar to KLR6_MOUSE Killer cell lectin-like receptor 6 (T-cell surface glycoprotein LY-49F) (LY49-F antigen) [*M. musculus*] |
| 1358 | 24129 | AI177590 | b | | ESTs, Highly similar to T08750 hypothetical protein DKFZpS86E1519.1 - human (fragment) [*H. sapiens*] |

TABLE 1-continued

| SEQ ID | GLGC ID | GenBank Accession No. | Model Code | Known Gene Name | Unigene Sequence Cluster Title |
|---|---|---|---|---|---|
| 1359 | 17570 | AI177683 | n, o, hh | | *Rattus norvegicus* mRNA for hnRNP protein, partial |
| 1360 | 9521 | AI177706 | b, u, v | | ESTs |
| 1361 | 6562 | AI177734 | t | | ESTs |
| 1362 | 6334 | AI177765 | b | | ESTs, Weakly similar to T20254 hypothetical protein C55A6.1 - *Caenorhabditis elegans* [*C. elegans*] |
| 1363 | 22882 | AI177804 | aa, bb | | ESTs, Moderately similar to acid sphingomyelinase-like phosphodiesterase 3a [*Mus musculus*] [*M. musculus*] |
| 1364 | 11791 | AI177843 | aa, bb | | ESTs, Highly similar to SAS_HUMAN Sarcoma amplified sequence [*H. sapiens*] |
| 1365 | 547 | AI177871 | gg | | ESTs, Highly similar to CDK1_MOUSE Cyclin-dependent kinase 2-associated protein 1 (CDK2-associated protein 1) (Putative oral cancer suppressor) (Deleted in oral cancer-1) (DOC-1) [*M. musculus*] |
| 1366 | 15315 | AI177911 | h, l | calpactin I heavy chain | calpactin I heavy chain |
| 1367 | 5929 | AI177962 | hh | | ESTs, Moderately similar to 523251 protein-tyrosine kinase (EC 2.7.1.112) ark precursor - mouse [*M. musculus*] |
| 1368 | 22691 | AI177967 | r, aa, bb | | ESTs, Weakly similar to transforming growth factor-beta (TGF-beta) masking protein large subunit [*Rattus norvegicus*] [*R.norvegicus*] |
| 1369 | 19184 | AI178025 | p, q, kk | | ESTs, Highly similar to TGIF_MOUSE 5'-TG-3' INTERACTING FACTOR (HOMEOBOX PROTEIN TGIF) [*M. musculus*] |
| 1370 | 17320 | AI178069 | kk | | ESTs |
| 1371 | 17847 | AI178214 | hh | | ESTs |
| 1372 | 23929 | AI178222 | ii | | ESTs |
| 1373 | 6059 | AI178245 | c | | ESTs, Moderately similar to T13963 formin related protein, lymphocyte specific - mouse [*M. musculus*] |
| 1374 | 4073 | AI178272 | hh | | ESTs, Weakly similar to S51973 hypothetical protein YAL046c - yeast (*Saccharomyces cerevisiae*) [*S.cerevisiae*] |
| 1375 | 3740 | AI178277 | d | | ESTs |
| 1376 | 6502 | AI178283 | r | HMm:phenylalanine-tRNA synthetase-like | ESTs, Highly similar to SYFB_MOUSE Phenylalanyl-tRNA synthetase beta chain (Phenylalanine--tRNA ligase beta chain) (PheRS) [*M. musculus*] |
| 1377 | 5760 | AI178361 | n, o | | ESTs |
| 1378 | 2479 | AI178384 | hh | | ESTs |
| 1379 | 8445 | AI178394 | c | | ESTs |
| 1380 | 22197 | AI178527 | a, y, z | | ESTs |
| 1381 | 21311 | AI178688 | s, t | | ESTs |
| 1382 | 14530 | AI178738 | b | | ESTs |
| 1383 | 15091 | AI178740 | cc, dd | | ESTs, Highly similar to A56418 transcription factor delta - mouse [*M. musculus*] |
| 1384 | 23567 | AI178746 | p, q, y, z | | ESTs |
| 1385 | 16668 | AI178751 | ii | sialyltransferase 5 | sialyltransferase 5 |
| 1386 | 18848 | AI178816 | n, o | eukaryotic translation initiation factor 4E | eukaryotic translation initiation factor 4E |
| 1387 | 13592 | AI178914 | ii | | ESTs, Weakly similar to T23419 hypothetical protein K07F5.14 - *Caenorhabditis elegans* [*C. elegans*] |
| 1388 | 23043 | AI178968 | b | | ESTs, Weakly similar to S70642 ubiquitin ligase Nedd4 - rat (fragment) [*R.norvegicus*] |
| 1389 | 18907 | AI178971 | c, v | Hemoglobin, alpha 1 | Hemoglobin, alpha 1 |
| 1390 | 17358 | AI179147 | g | | ESTs, Highly similar to B Chain B, Three-Dimensional Structure Of Human Electron Transfer Flavoprotein To 2.1 A Resolution [*H. sapiens*] |
| 8 | 14983 | AI179150 | bb, cc, dd | *Rattus norvegicus* mitochondrial genome. 9/22Length = 16, 3 | *Rattus norvegicus* CDK110 mRNA |
| 1391 | 8477 | AI179167 | j, k, y, z | | ESTs |
| 1392 | 4080 | AI179227 | ii | | ESTs |
| 1393 | 11242 | AI179260 | kk | | ESTs |

TABLE 1-continued

| SEQ ID | GLGC ID | GenBank Accession No. | Model Code | Known Gene Name | Unigene Sequence Cluster Title |
|---|---|---|---|---|---|
| 1394 | 7213 | AI179356 | w, x | plysia ras-related homolog A2 | plysia ras-related homolog A2 |
| 1395 | 4188 | AI179366 | ee, ff | | ESTs |
| 1396 | 12011 | AI179380 | c | | ESTs, Highly similar to open reading frame 12 [*Mus musculus*] [*M. musculus*] |
| 1397 | 19783 | AI179388 | f, g | | ESTs, Highly similar to RIKEN cDNA 0610040D20 [*Mus musculus*] [*M. musculus*] |
| 1398 | 13029 | AI179391 | e, t, kk | | ESTs |
| 1399 | 15438 | AI179399 | e, g | collagen type V, alpha 2 | collagen type V, alpha 2 |
| 1400 | 15042 | AI179422 | a, j, k | | ESTs |
| 1401 | 13619 | AI179464 | j, k | | ESTs |
| 1402 | 16081 | AI179610 | a, p, q, r, y, z, gg, kk | Heme oxygenase | Heme oxygenase |
| 1403 | 3094 | AI179700 | b, l, m | | ESTs, Weakly similar to AGRT agrin - rat [*R.norvegicus*] |
| 1404 | 6251 | AI179854 | ii | | ESTs |
| 1405 | 18895 | AI179916 | b, l, m | | ESTs, Highly similar to HSPC038 protein [*Homo sapiens*] [*H. sapiens*] |
| 1406 | 1686 | AI179971 | c | Hemoglobin, alpha 1 | Hemoglobin, alpha 1 |
| 1406 | 1687 | AI179971 | b, c, v | Hemoglobin, alpha 1 | Hemoglobin, alpha 1 |
| 1407 | 6455 | AI179984 | aa, bb | | ESTs, Weakly similar to CPI3__RAT CONTRAPSIN-LIKE PROTEASE INHIBITOR 3 PRECURSOR (CPI-23) (SERINE PROTEASE INHIBITOR 1) (SPI-1) [*R.norvegicus*] |
| 1408 | 15892 | AI179988 | j, k, kk | | ESTs |
| 1409 | 4189 | AI180081 | cc, dd | | ESTs |
| 1410 | 19828 | AI180087 | d | | ESTs, Weakly similar to OZF__RAT Zinc finger protein OZF (POZF-1) [*R.norvegicus*] |
| 1411 | 24028 | AI180239 | kk | | ESTs |
| 1412 | 5482 | AI180252 | e, r | | ESTs |
| 1413 | 17089 | AI180281 | b, l, m | | ESTs, Moderately similar to JC4978 oxidative stress protein AI70 - mouse [*M. musculus*] |
| 1414 | 3352 | AI180334 | b, u, v | | ESTs |
| 1415 | 8180 | AI180353 | hh | | ESTs, Weakly similar to LYOX__RAT Protein-lysine 6-oxidase precursor (Lysyl oxidase) [*R.norvegicus*] |
| 1416 | 14337 | AI180414 | b, c, l, m | | ESTs, Weakly similar to T14106 probable GTPase-activating protein SPA-1 - rat [*R.norvegicus*] |
| 1417 | 7117 | AI227612 | ll | ESTs | |
| 1418 | 13664 | AI227639 | ll | | ESTs |
| 1419 | 1377 | AI227715 | a, ee, ff | Retinoblastoma-related gene | Retinoblastoma-related gene |
| 1420 | 23015 | AI227724 | l, s, t, ll | | ESTs |
| 1421 | 2055 | AI227751 | ii | | ESTs |
| 1422 | 13673 | AI227763 | gg | | ESTs, Highly similar to S26650 DNA-binding protein 5 - human [*H. sapiens*] |
| 1423 | 22845 | AI227887 | e, aa, bb | cell division cycle 42 | cell division cycle 42 |
| 1424 | 19474 | AI227961 | c, ii | | EST |
| 1425 | 8109 | AI228147 | gg | | ESTs |
| 1426 | 6715 | AI228284 | j, k | | ESTs |
| 1427 | 12946 | AI228291 | a, ee, ff, kk, ll | | ESTs |
| 1428 | 22915 | AI228299 | bb | | ESTs, Highly similar to craniofacial development protein 1 [*Mus musculus*] [*M. musculus*] |
| 1429 | 8917 | AI228301 | ee, ff, jj, kk | | ESTs |
| 1430 | 6102 | AI228335 | ee, ff | | ESTs |
| 1431 | 17892 | AI228438 | b, v | | ESTs |
| 1432 | 13741 | AI228462 | cc, dd | | ESTs |
| 1433 | 1473 | AI228548 | aa | | ESTs, Highly similar to S10A__RAT S-100 protein, alpha chain [*R.norvegicus*] |
| 1434 | 16053 | AI228596 | a, p, q, y, z, ee, ff | | ESTs, Weakly similar to T16757 hypothetical protein R144.3 - Caenorhabditis elegans [*C. elegans*] |
| 1435 | 3557 | AI228672 | gg | | ESTs |
| 1436 | 13270 | AI228760 | t | | ESTs |
| 1437 | 15078 | AI228830 | j, k | stearoyl-Coenzyme A desaturase 2 | Rat DNA polymerase alpha mRNA, 3' end, stearoyl-Coenzyme A desaturase 2 |
| 1438 | 2210 | AI228963 | hh | | ESTs, Weakly similar to T26088 hypothetical protein W02B12.7 - Caenorhabditis elegans [*C. elegans*] |

TABLE 1-continued

| SEQ ID | GLGC ID | GenBank Accession No. | Model Code | Known Gene Name | Unigene Sequence Cluster Title |
|---|---|---|---|---|---|
| 1439 | 16203 | AI229196 | w, x, cc, dd | Synaptobrevin 1, Vesicle-associated membrane protein (synaptobrevin 2) | Synaptobrevin 1, Vesicle-associated membrane protein (synaptobrevin 2) |
| 1440 | 13826 | AI229304 | h, l, hh, jj, kk | | ESTs |
| 1441 | 13831 | AI229354 | h, l | | ESTs |
| 1442 | 23435 | AI229502 | n, o | | ESTs |
| 1443 | 18643 | AI229702 | aa, bb | | ESTs |
| 1444 | 13977 | AI229707 | r | | *Rattus norvegicus* mRNA for class I beta-tubulin, complete cds |
| 1445 | 15212 | AI229753 | p, q, t, y, z, ee, ff | ADP-ribosylation factor 2 | ADP-ribosylation factor 2 |
| 1446 | 24117 | AI229785 | cc, dd | | ESTs, Highly similar to 2202300B keratin:ISOTYPE = K19 [*Rattus norvegicus* [*R.norvegicus*] |
| 1447 | 2936 | AI229843 | kk | | ESTs |
| 1448 | 21446 | AI229854 | hh | | ESTs |
| 1449 | 13886 | AI230116 | gg | | ESTs |
| 1450 | 23042 | AI230130 | s, t, ii | ectonucleoside triphosphate diphosphohydrolase 2 | ectonucleoside triphosphate diphosphohydrolase 2 |
| 1451 | 7650 | AI230142 | w, x | | ESTs, Weakly similar to KUCR_RAT Kupifer cell receptor [*R.norvegicus*] |
| 1452 | 13887 | AI230156 | b | | ESTs |
| 1453 | 18528 | AI230284 | c | | ESTs |
| 1454 | 2372 | AI230373 | j, k | | ESTs |
| 1455 | 6217 | AI230381 | p, q | | ESTs |
| 1456 | 23937 | AI230430 | ii | | ESTs |
| 1457 | 6560 | AI230440 | t | | ESTs |
| 1458 | 14257 | AI230460 | c | MARCKS-like protein | MARCKS-like protein |
| 1459 | 19944 | AI230479 | b | | ESTs |
| 1460 | 23998 | AI230578 | s, t, ii | | ESTs |
| 1461 | 22484 | AI230591 | ll | | ESTs, Weakly similar to TES1_RAT TESTIN 1/2 PRECURSOR (CMB-22/CMB-23) [*R.norvegicus*] |
| 1462 | 9412 | AI230691 | f, g | | ESTs, Moderately similar to RL34·RAT 60S RIBOSOMAL PROTEIN L34 [*R.norvegicus*] |
| 1463 | 18529 | AI230716 | a, ll | | ESTs |
| 1464 | 23013 | AI230743 | hh | actin-related protein 3 | actin-related protein 3 |
| 1465 | 9171 | AI230747 | b | | ESTs |
| 1466 | 22387 | AI230753 | f, g | | ESTs, Highly similar to B13_MOUSE Brain protein I3 [*M. musculus*] |
| 1467 | 24270 | AI230758 | n, o | | ESTs, Moderately similar to cargo selection protein (mannose 6 phosphate receptor binding pr; cargo selection protein (mannose 6 phosphate receptor binding protein) [*Homo sapiens*] [H .sapiens] |
| 1468 | 14430 | AI230798 | r | HHs:cyclin-dependent kinase inhibitor 3 (CDK2-associated dual specificity phosphatase) | ESTs, Moderately similar to cyclin-dependent kinase inhibitor 3; CDK2-associated dual specificity phophatase; cyclin-dependent kinase interacting protein 2; kinase-associated phosphatase; cyclin-dependent kinase interactor 1 [*Homo sapiens*] [H. sapiens] |
| 1469 | 13915 | AI230826 | n, o | | ESTs |
| 1470 | 7520 | AI230830 | ii | | ESTs |
| 1471 | 8036 | AI230884 | r | | ESTs, Highly similar to HMBA-inducible [*Homo sapiens*] [H. sapiens] |
| 1472 | 23730 | AI230915 | gg | | ESTs |
| 1473 | 13928 | AI230939 | aa, bb | | ESTs |
| 1474 | 11893 | AI230951 | w, x | | ESTs |
| 1475 | 16087 | AI231011 | cc, dd | | ESTs |
| 1476 | 19082 | AI231038 | s, t | | ESTs |
| 1477 | 13934 | AI231044 | w, x | | ESTs |
| 1478 | 17903 | AI231083 | t | | ESTs |
| 1479 | 24072 | AI231093 | g | | ESTs |
| 1480 | 20845 | AI231140 | w, x | | ESTs, Highly similar to R3RT3A ribosomal protein L23a, cytosolic [validated] - rat [*R.norvegicus*] |
| 1481 | 21816 | AI231217 | ll | | ESTs, Highly similar to S611_HUMAN Protein transport protein Sec61 alpha subunit isoform 1 (Sec61 alpha-1) [*R.norvegicus*] |

TABLE 1-continued

| SEQ ID | GLGC ID | GenBank Accession No. | Model Code | Known Gene Name | Unigene Sequence Cluster Title |
|---|---|---|---|---|---|
| 1482 | 24327 | AI231292 | gg | Cystatin C (cysteine proteinase inhibitor) | Cystatin C (cysteine proteinase inhibitor) |
| 1483 | 23304 | AI231310 | ee, ff | prolyl 4-hydroxylase alpha subunit | prolyl 4-hydroxylase alpha subunit |
| 1484 | 13966 | AI231421 | d, t | | ESTs |
| 1485 | 15572 | AI231472 | f, g | procollagen, type I, alpha 1 | procollagen, type I, alpha 1 |
| 1486 | 8004 | AI231532 | r | | ESTs, Highly similar to Z183__HUMAN Zinc finger protein 183 [*H. sapiens*] |
| 1487 | 13092 | AI231547 | jj, kk | | ESTs, Highly similar to S14538 transition protein - mouse [*M. musculus*] |
| 1488 | 19271 | AI231566 | s, t | | ESTs, Highly similar to MAX__RAT MAX protein [*R.norvegicus*] |
| 1489 | 2422 | AI231615 | r | | ESTs |
| 1490 | 23012 | AI231724 | c | | ESTs |
| 1491 | 18402 | AI231778 | ii | | ESTs |
| 1492 | 6412 | AI231787 | a | | ESTs |
| 1493 | 15171 | AI231792 | ee, ff | | ESTs, Highly similar to BAG3__MOUSE BAG-family molecular chaperone regulator-3 (BCL-2 binding athanogene-3) (BAG-3) (Bcl-2-binding protein Bis) [*M. musculus*] |
| 1494 | 2339 | AI231798 | hh | | ESTs, Highly similar to T-complex expressed gene 2 [*Mus musculus*] [*M. musculus*] |
| 1495 | 23165 | AI231799 | y, z | | ESTs, Moderately similar to I68673 gene X123 protein - human (fragment) [*H. sapiens*] |
| 1496 | 7036 | AI231801 | n, o, cc, dd | | ESTs, Weakly similar to A55190 transitional endoplasmic reticulum ATPase (EC 3.6.1.-) [validated] - rat [*R.norvegicus*] |
| 1497 | 12435 | AI231810 | j, k, jj, kk, ll | | ESTs |
| 1498 | 13116 | AI231812 | c | | ESTs, Weakly similar to Y55B1AL.2.p [*Caenorhabditis elegans*] [*C. elegans*] |
| 1499 | 21189 | AI231822 | h, l | | ESTs, Highly similar to mitochondrial carrier homolog 1; mitochondrial carrier homolog 1 isoform b [*Mus musculus*] [*M. musculus*] |
| 1500 | 22591 | AI231827 | a | | ESTs |
| 1501 | 15173 | AI231846 | d | | ESTs |
| 1502 | 14013 | AI231992 | hh | | EST |
| 1503 | 3434 | AI232014 | y, z, ee, ff | | ESTs |
| 1504 | 19094 | AI232021 | g | | ESTs, Highly similar to SUI1__MOUSE Protein translation factor SUI1__homolog [*M. musculus*] |
| 1505 | 8959 | AI232128 | cc, dd | | ESTs |
| 1506 | 14028 | AI232184 | d, gg | | ESTs |
| 1507 | 409 | AI232268 | r | low density lipoprotein receptor-related protein associated protein 1 | low density lipoprotein receptor-related protein associated protein 1 |
| 1508 | 2085 | AI232270 | hh | | ESTs, Weakly similar to JC4914 anti-sigma cross-reacting protein homolog I beta precursor - human [*H. sapiens*] |
| 1509 | 14031 | AI232295 | e | | ESTs, Moderately similar to B53434 cell surface glycoprotein gp49B form 2 precursor - mouse [*M. musculus*] |
| 1510 | 4716 | AI232313 | c, r | purinergic receptor P2X, ligand-gated ion channel 4 | purinergic receptor P2X, ligand-gated ion channel 4 |
| 1511 | 14034 | AI232321 | n, o | | ESTs, Highly similar to CGI-150 protein [*Homo sapiens*] [*H. sapiens*] |
| 1512 | 11873 | AI232326 | j, k, p, q, y, z | | ESTs |
| 1513 | 15246 | AI232332 | cc, dd | | ESTs |
| 1514 | 6509 | AI232361 | ll | | ESTs |
| 1515 | 4891 | AI232402 | hh | | ESTs |
| 1516 | 3143 | AI232408 | ll | | ESTs |
| 1517 | 11157 | AI232494 | w, x | | ESTs |
| 1518 | 13645 | AI232694 | hh | | ESTs, Weakly similar to S24C__HUMAN Protein transport protein Sec24C (SEC24-related protein C) [*H. sapiens*] |
| 1519 | 7285 | AI232731 | gg | | ESTs, Weakly similar to *E.coli* YCAC like [*Caenorhabditis elegans*] [*C. elegans*] |
| 1520 | 3100 | AI232741 | hh | | ESTs, Highly similar to CG51__HUMAN Protein CGI-51 [*H. sapiens*] |

TABLE 1-continued

| SEQ ID | GLGC ID | GenBank Accession No. | Model Code | Known Gene Name | Unigene Sequence Cluster Title |
|---|---|---|---|---|---|
| 1521 | 7147 | AI232948 | hh | | ESTs, Weakly similar to T27038 hypothetical protein Y49E10.2 - *Caenorhabditis elegans* [*C. elegans*] |
| 1522 | 14088 | AI232982 | ee, ff | | ESTs |
| 1523 | 4855 | AI233024 | jj, kk | | ESTs |
| 1524 | 3823 | AI233147 | y, z | | ESTs, Weakly similar to HE47_RAT Probable ATP-dependent RNA helicase p47 [*R.norvegicus*] |
| 1525 | 11561 | AI233182 | b | | ESTs |
| 1526 | 21948 | AI233191 | hh | | ESTs, Weakly similar to YQO9_CAEEL Hypothetical 141.2 kDa protein EEED8.9 in chromosome II [*C. elegans*] |
| 1527 | 15107 | AI233220 | h, l | | ESTs, Highly similar to RS18_HUMAN 40S ribosomal protein S18 (KE-3) (KE3) [*R.norvegicus*] |
| 1528 | 5228 | AI233311 | h, l, n, o | | ESTs, Highly similar to cytokine receptor-like factor 1; cytokine receptor like molecule 3 [*Mus musculus*] [*M. musculus*] |
| 1529 | 23296 | AI233316 | hh | | ESTs, Weakly similar to ribosomal protein S23 [*Rattus norvegicus*] [*R.norvegicus*] |
| 1530 | 4475 | AI233374 | n, o | | ESTs |
| 1531 | 14095 | AI233468 | jj, kk | | ESTs |
| 1532 | 4670 | AI233714 | w, x | | ESTs |
| 1533 | 14871 | AI233743 | hh | | ESTs |
| 1534 | 2822 | AI233763 | hh | | ESTs |
| 1535 | 15085 | AI233829 | cc, dd, hh | P11 protein | P11 protein |
| 1536 | 15685 | AI233870 | hh | | ESTs, Weakly similar to PAB1_MOUSE Polyadenylate-binding protein 1 (Poly(A)-binding protein 1) (PABP 1) (PABP1) [*M. musculus*] |
| 1537 | 2146 | AI233965 | r | | ESTs |
| 1538 | 3213 | AI234095 | hh | | ESTs |
| 1539 | 6532 | AI234105 | j, k, p, q | | ESTs |
| 1540 | 14494 | AI234222 | a, ee, ff, jj, kk | | ESTs |
| 1541 | 12583 | AI234251 | hh | | ESTs |
| 1542 | 2765 | AI234283 | n, o, hh | | ESTs |
| 1543 | 14202 | AI234326 | cc, dd | | EST |
| 1544 | 17664 | AI234496 | ii | | ESTs |
| 1545 | 6387 | AI234664 | cc, dd | | ESTs |
| 1546 | 23964 | AI234748 | a, kk | | ESTs |
| 1547 | 22152 | AI234822 | j, k | DEXRAS1 (Dexras1) | DEXRAS1 (Dexras1) |
| 1548 | 14700 | AI234852 | jj, kk | | ESTs |
| 1549 | 18444 | AI234915 | ii | growth and transformation-dependent protein | growth and transformation-dependent protein |
| 1550 | 13293 | AI235032 | hh | | ESTs, Weakly similar to ELV4_RAT ELAV like protein 4 (Paraneoplastic encephalomyelitis antigen HuD) (Hu-antigen D) [*R.norvegicus*] |
| 1551 | 14718 | AI235210 | d | | ESTs |
| 1552 | 11246 | AI235222 | jj, kk | | ESTs |
| 1553 | 15004 | AI235224 | a, l, n, o, x, z, kk | tissue inhibitor of metalloproteinase 1 | tissue inhibitor of metalloproteinase 1 |
| 1554 | 6632 | AI235277 | a, y, z | | ESTs |
| 1555 | 11644 | AI235282 | n, o | HMm:low density lipoprotein receptor-related protein 1 | ESTs, Highly similar to S25111 alpha-2-macroglobulin receptor precursor - mouse [*M. musculus*] |
| 1556 | 14722 | AI235284 | gg | | ESTs, Weakly similar to MIC2_HUMAN T-cell surface glycoprotein E2 precursor (E2 antigen) (CD99) (MIC2 protein) (12E7) [*H. sapiens*] |
| 1557 | 1896 | AI235313 | h, l | | ESTs |
| 1558 | 14094 | AI235377 | y, z | | ESTs, Moderately similar to synaptic nuclei expressed gene 2 [*Homo sapiens*] [*H. sapiens*] |
| 1559 | 8440 | AI235611 | b | ZAP 36/annexin IV | ZAP 36/annexin IV |
| 1560 | 3650 | AI235738 | r | | ESTs, Weakly similar to T42751 sulfonylurea receptor 2 - rat [*R.norvegicus*] |
| 1561 | 14642 | AI235874 | h, l | | ESTs, Weakly similar to MGP1_MOUSE Microfibril-associated glycoprotein precursor (MAGP) (MAGP-1) [*M. musculus*] |

TABLE 1-continued

| SEQ ID | GLGC ID | GenBank Accession No. | Model Code | Known Gene Name | Unigene Sequence Cluster Title |
|---|---|---|---|---|---|
| 1562 | 2687 | AI235877 | s, t | | ESTs, Highly similar to 2019405A upstream regulator element-binding protein [*Rattus norvegicus*] [*R.norvegicus*] |
| 1563 | 4770 | AI235915 | d, ll | | ESTs |
| 1564 | 22717 | AI235948 | g | | ESTs, Highly similar to NIDO__RAT NIDOGEN (ENTACTIN) [*R.norvegicus*] |
| 1565 | 14776 | AI235950 | w, x, jj, kk | | ESTs |
| 1566 | 14861 | AI236045 | c | | ESTs |
| 1567 | 14869 | AI236089 | aa, bb | | ESTs, Weakly similar to T13380 ribokinase homolog - fruit fly (*Drosophila melanogaster*) [*D.melanogaster*] |
| 1568 | 23230 | AI236146 | t | | ESTs |
| 1569 | 14594 | AI236152 | b, d, u, v | | ESTs |
| 1570 | 18513 | AI236175 | c | | ESTs, Moderately similar to I54411 MHC RT1-B A-alpha chain - rat (fragment) [*R.norvegicus*] |
| 1571 | 14884 | AI236212 | ll | | ESTs |
| 1572 | 5007 | AI236229 | s, t, aa, bb | | ESTs |
| 1573 | 22212 | AI236294 | kk | | ESTs, Highly similar to IF6__MOUSE Eukaryotic translation initiation factor 6 (eIF-6) (B4 integrin interactor) (CAB) (p27(BBP)) [*M. musculus*] |
| 1574 | 18610 | AI236307 | l, m | | ESTs |
| 1575 | 15051 | AI236332 | j, k, p, q, y, z, ee, ff | | ESTs, Highly similar to S43429 diamine N-acetyltransferase (EC 2.3.1.57) - mouse [*M. musculus*] |
| 1576 | 4911 | AI236405 | cc, dd | | ESTs, Highly similar to RIKEN cDNA 1700029H06 [*Mus musculus*] [*M. musculus*] |
| 1577 | 19075 | AI236473 | p, q | | ESTs |
| 1578 | 14901 | AI236481 | ii | | ESTs |
| 1579 | 9546 | AI236520 | n, o | | ESTs |
| 1580 | 17950 | AI236590 | kk | | ESTs |
| 1581 | 18259 | AI236601 | p, q, ee, ff | | ESTs |
| 1582 | 11445 | AI236613 | r | | ESTs |
| 1583 | 22939 | AI236669 | y, z, jj, kk | HMm:REV3-like, catalytic subunit of DNA polymerase zeta RAD54 | ESTs, Highly similar to DPOZ__MOUSE DNA polymerase zeta catalytic subunit (Seizure related protein 4) [*M. musculus*] like (*S. cerevisiae*) |
| 1584 | 22443 | AI236761 | ee, ff | | ESTs |
| 1585 | 11404 | AI237002 | hh | spermidine synthase | spermidine synthase |
| 1586 | 12098 | AI237075 | t | | ESTs |
| 1587 | 18151 | AI237212 | f, g, hh | HHs:hepatitis B virus x interacting protein | ESTs, Highly similar to hepatitis B virus x-interacting protein; HBx-interacting protein; hepatitis B virus x-interacting protein (9.6 kD) [*Homo sapiens*] [*H. sapiens*] |
| 1588 | 3368 | AI237331 | c | | ESTs, Weakly similar to YCE3__HUMAN Hypothetical protein CGI-143 [*H. sapiens*] |
| 1589 | 21653 | AI237535 | a, j, k, p, q, y, z | LPS-induced TNF-alpha factor | LPS-induced TNF-alpha factor |
| 1590 | 23288 | AI237581 | u, v | | ESTs |
| 1591 | 11208 | AI237586 | kk | | ESTs, Moderately similar to JC1241 beta-interferon-induced protein - rat [*R.norvegicus*] |
| 1592 | 11375 | AI237594 | u, v | | ESTs, Weakly similar to G01614 zinc finger protein 127 - human [*H. sapiens*] |
| 1593 | 18854 | AI237636 | f, g, l, m | | ESTs, Weakly similar to CNE6__MOUSE Copine VI (Neuronal-copine) (N-copine) [*M. musculus*] |
| 1594 | 3615 | AI237645 | t | transferrin receptor | transferrin receptor |
| 1595 | 8759 | AI237646 | p, q, ee, ff | | ESTs |
| 1596 | 14720 | AI237648 | gg | | ESTs |
| 1597 | 14840 | AI237698 | kk | | ESTs |
| 1598 | 14842 | AI237724 | u, v | | ESTs |
| 1599 | 9501 | AI638949 | c, f, g, v | | ESTs, Moderately similar to chromosome 20 open reading frame 116 [*Homo sapiens*] [*H. sapiens*] |
| 1600 | 16340 | AI638955 | hh | | ESTs, Highly similar to fox-1 homolog (C. elegans) [*Mus musculus*] [*M. musculus*] |
| 1601 | 25854 | AI639001 | r | | ESTs |
| 1602 | 17214 | AI639008 | b, h, l | | ESTs |
| 1603 | 23781 | AI639012 | a, h, l, n, o | | ESTs, Weakly similar to hypothetical protein MGC2601 [*Homo sapiens*] [*H. sapiens*] |

TABLE 1-continued

| SEQ ID | GLGC ID | GenBank Accession No. | Model Code | Known Gene Name | Unigene Sequence Cluster Title |
|---|---|---|---|---|---|
| 1604 | 17108 | AI639017 | ll | | ESTs, Weakly similar to T17453 ERG-associated protein ESET - mouse [*M. musculus*] |
| 1605 | 4035 | AI639023 | cc, dd | | ESTs |
| 1606 | 15450 | AI639035 | cc, dd | | ESTs |
| 1607 | 10071 | AI639058 | a, q, y, z, ee, ff, ll | | ESTs, Highly similar to Nedd4 WW binding# protein 4; Nedd4 WW-binding protein 4 [*Mus musculus*] [*M. musculus*] |
| 1608 | 17383 | AI639060 | h, l, w, x | | ESTs |
| 1609 | 25883 | AI639076 | j | | |
| 1610 | 16514 | AI639093 | hh | | ESTs |
| 1611 | 22555 | AI639103 | n, o | | ESTs |
| 1612 | 12400 | AI639107 | n, o | | ESTs |
| 1613 | 13882 | AI639120 | b | | ESTs |
| 1614 | 25895 | AI639128 | jj, kk | | ESTs |
| 1615 | 25899 | AI639136 | n, o | | |
| 1616 | 5065 | AI639139 | ll | | ESTs |
| 1617 | 18482 | AI639151 | gg | | ESTs, Highly similar to pinin [*Mus musculus*] [*M. musculus*] |
| 1618 | 20073 | AI639152 | b, c, u, v | | |
| 1619 | 15379 | AI639162 | a, jj, kk, ll | | ESTs |
| 1620 | 25907 | AI639167 | d | | ESTs |
| 1621 | 5159 | AI639185 | c, u, v | | ESTs |
| 1622 | 19795 | AI639197 | u, v | | EST |
| 1623 | 19749 | AI639203 | s, t | | ESTs |
| 1624 | 25918 | AI639204 | hh | | |
| 1625 | 20021 | AI639214 | l, m | | EST |
| 1626 | 20614 | AI639246 | h, l, j, k | | ESTs |
| 1627 | 19962 | AI639248 | aa | | |
| 1628 | 17083 | AI639255 | e, gg | | ESTs |
| 1629 | 17215 | AI639268 | h, l, n, o, jj, kk | | ESTs, Weakly similar to T17307 hypothetical protein DKFZp566O084.1 - human [*H. sapiens*] |
| 1630 | 16016 | AI639308 | ii | | ESTs |
| 1631 | 20461 | AI639350 | d, q, y, z, kk | | ESTs |
| 1632 | 25964 | AI639352 | s, t | | |
| 1633 | 18295 | AI639381 | ee, ff | | ESTs |
| 1634 | 19152 | AI639387 | cc, dd | | ESTs, Highly similar to RT06__MOUSE Mitochondrial 28S ribosomal protein S6 (MRP-S6) [*M. musculus*] |
| 1635 | 20647 | AI639402 | ii | | ESTs |
| 1636 | 5014 | AI639410 | cc, dd | | ESTs |
| 1637 | 10097 | AI639425 | k, kk | | ESTs |
| 1638 | 25997 | AI639452 | e | | |
| 1639 | 20032 | AI639466 | n, o | | EST |
| 1640 | 22763 | AI639474 | e, gg | | ESTs |
| 1641 | 20082 | AI639488 | d | HMm:transformed mouse 3T3 cell double minute 2 | ESTs, Highly similar to A42772 mdm2 protein - rat (fragments) [*R.norvegicus*] |
| 1642 | 5998 | AI639501 | ll | | ESTs |
| 1643 | 20056 | AI639504 | w, x, ii | | ESTs, Weakly similar to T13607 hypothetical protein 87B1.3 - fruit fly (*Drosophila melanogaster*) [*D.melanogaster*] |
| 1644 | 19864 | AI639510 | d | | ESTs |
| 1645 | 20083 | AI639523 | s, t, hh | | EST, Weakly similar to SPCA__HUMAN Spectrin alpha chain, erythrocyte (Erythroid alpha-spectrin) [*H. sapiens*] |
| 1646 | 23219 | AJ000347 | n, o | 3'(2'),5'-bisphosphate nucleotidase | 3'(2'),5'-bisphosphate nucleotidase |
| 1647 | 25235 | AJ001290 | b, l, m | solute carrier family 5 (inositol transporters), member 3 | |
| 1648 | 7602 | AJ001929 | f, aa | reticulocalbin | reticulocalbin |
| 1649 | 20127 | AJ011116 | j, k, n, o | Endothelial nitric oxide synthase 3 | Endothelial nitric oxide synthase 3 |
| 1650 | 2401 | AJ011607 | u | | ESTs, Highly similar to C46642 DNA primase (EC 2.7.7.-) 54K chain - mouse [*M. musculus*] |
| 1651 | 20519 | C06598 | aa, bb | | ESTs, Weakly similar to FK506 binding protein 2 (13 kDa) [*Rattus norvegicus*] [*R.norvegicus*] |
| 1652 | 18686 | D00729 | g, hh | dodecenoyl-Coenzyme A delta isomerase (3,2 trans-enoyl-Coenyme A isomerase) | Rat mRNA for delta3, delta2-enoyl-CoA isomerase, dodecenoyl-Coenzyme A delta isomerase (3,2 trans-enoyl-Coenyme A isomerase) |

TABLE 1-continued

| SEQ ID | GLGC ID | GenBank Accession No. | Model Code | Known Gene Name | Unigene Sequence Cluster Title |
|---|---|---|---|---|---|
| 1653 | 5049 | D10655 | g, w, cc, dd, jj, kk | dihydrolipoamide acetyltransferase | dihydrolipoamide acetyltransferase |
| 1653 | 5050 | D10655 | f, g, cc, dd | dihydrolipoamide acetyltransferase | dihydrolipoamide acetyltransferase |
| 1654 | 19053 | D12770 | aa, bb | solute carrier family 25 (mitochondrial adenine nucleotide translocator) member 4 | solute carrier family 25 (mitochondrial adenine nucleotide translocator) member 4 |
| 1655 | 18018 | D12771 | f, g | Solute carrier family 25, member 5 (adenine nucleotid translocator 2, fibroblast isoform (ATP-ADP carrier protein)) | Solute carrier family 25, member 5 (adenine nucleotid translocator 2, fibroblast isoform (ATP-ADP carrier protein)) |
| 1656 | 25257 | D13623 | s, t | | |
| 1656 | 15281 | D13623 | a, d | | ESTs |
| 1657 | 25041 | D14014 | f | Cyclin D1 | Cyclin D1 |
| 1658 | 17264 | D25233 | d | Retinoblastoma 1 (including osteosarcoma) | Retinoblastoma 1 (including osteosarcoma) |
| 1659 | 16610 | D28557 | c, f, u, v | cold shock domain protein A | cold shock domain protein A |
| 1660 | 25276 | D28966 | s | | |
| 1661 | 25278 | D30734 | gg | RAS p21 protein activator 2 | |
| 1662 | 9029 | D30804 | hh | proteasome (prosome, macropain) subunit, alpha type 7 | ESTs, Highly similar to S60038 multicatalytic endopeptidase complex (EC 3.4.99.46) alpha chain RC6-I - rat [*R.norvegicus*] |
| 1663 | 1884 | D50695 | s, t | proteasome (prosome, macropain) 26S subunit, ATPase, 4 | proteasome (prosome, macropain) 26S subunit, ATPase, 4 |
| 1664 | 21147 | D63772 | j, k, p | Solute carrier family 1 A1 (brain glutamate transporter) | Solute carrier family 1 A1 (brain glutamate transporter) |
| 1665 | 1356 | D83538 | u, v | phosphatidylinositol 4-kinase | phosphatidylinositol 4-kinase |
| 1666 | 25306 | D84485 | u, v | | |
| 1667 | 22762 | D89730 | bb | | ESTs, Highly similar to JC5621 epidermal growth factor-like protein, T16 precursor - rat [*R.norvegicus*] |
| 1668 | 20984 | D90109 | ll | fatty acid Coenzyme A ligase, long chain 2 | fatty acid Coenzyme A ligase, long chain 2 |
| 1669 | 25801 | E12286 | w, x | | |
| 1670 | 20456 | H31144 | j, k | | ESTs, Moderately similar to 1914275A non-receptor Tyr kinase [*Homo sapiens*] [*H. sapiens*] |
| 1671 | 12360 | H31456 | cc, dd | | ESTs |
| 1672 | 6499 | H31625 | d | | ESTs |
| 1673 | 13083 | H31665 | t | | ESTs |
| 1674 | 19278 | H31802 | jj, kk | | EST, Moderately similar to S12207 hypothetical protein (B2 element) - mouse [*M. musculus*] |
| 1675 | 4362 | H31842 | l, m | | ESTs |
| 1676 | 26039 | H31982 | b | | ESTs |
| 1677 | 6980 | H33001 | e, y, z, jj, kk | | ESTs |
| 1678 | 24033 | H33101 | r | | ESTs |
| 1679 | 16524 | H33219 | e, hh | | ESTs |
| 1680 | 10185 | H33426 | a, h, jj, kk, ll | | ESTs |
| 1681 | 4405 | H33472 | c | | EST |
| 1682 | 4407 | H33528 | h, l, p, q, y, z | | ESTs |
| 1683 | 4418 | H33656 | c | | ESTs |
| 1684 | 16714 | H33660 | d | | ESTs |
| 1685 | 15374 | H34186 | j, k | | ESTs, Highly similar to IF39_HUMAN Eukaryotic translation initiation factor 3 subunit 9 (eIF-3 eta) (eIF3 p1 16) (eIF3 p110) [*H. sapiens*] |
| 1686 | 17159 | J00797 | w, x, aa, bb, hh, ll | alpha-tubulin | alpha-tubulin |
| 9 | 16130 | J01435 | bb | *Rattus norvegicus* mitochondrial genome. 9/22Length = 16, 3 | unknown Glu-Pro dipeptide repeat protein |
| 9 | 25319 | J01435 | bb | *Rattus norvegicus* mitochondrial genome. 9/22Length = 16, 3 | |

TABLE 1-continued

| SEQ ID | GLGC ID | GenBank Accession No. | Model Code | Known Gene Name | Unigene Sequence Cluster Title |
|---|---|---|---|---|---|
| 9 | 25050 | J01435 | bb | *Rattus norvegicus* mitochondrial genome. 9/22Length = 16, 3 | |
| 10 | 25051 | J01436 | bb | *Rattus norvegicus* mitochondrial genome. 9/22Length = 16, 3 | |
| 1687 | 16260 | J01878 | u, v | | Rat brain-specific identifier sequence RNA, clone p1b224 |
| 1688 | 17285 | J02827 | c | Branched chain alpha-ketoacid dehydrogenase subunit E1 alpha | Branched chain alpha-ketoacid dehydrogenase subunit E1 alpha |
| 1689 | 17136 | J04035 | f, aa, bb | Tropoelastin | Tropoelastin |
| 1690 | 20549 | K01701 | b | Oxytocin/neurophysin | Oxytocin/neurophysin |
| 1691 | 14968 | K02815 | c | butyrophilin-like 2 (MHC class II associated) | butyrophilin-like 2 (MHC class II associated) |
| 1692 | 23486 | K02816 | cc, dd | pR-ET2 encoded oncodevelopmental protein | pR-ET2 encoded oncodevelopmental protein |
| 1693 | 381 | L00124 | b, l, m | Elastase 2, pancreatic | Elastase 2, pancreatic |
| 1694 | 17508 | L08814 | ii | Structure specific recognition protein 1 | Structure specific recognition protein 1 |
| 1695 | 25354 | L13025 | g | | |
| 1696 | 25359 | L13202 | n, o | forkhead box D3 | |
| 1697 | 25371 | L17077 | e | | |
| 1698 | 6963 | L18889 | e | calnexin | |
| 1699 | 24520 | L20869 | e | | *Rattus norvegicus* pancreatitis associated protein III (PAPIII0) mRNA, complete cds |
| 1700 | 25816 | L23863 | n, o | POU domain, class 2, transcription factor 3 | POU domain, class 2, transcription factor 3 |
| 1701 | 12058 | L25387 | w | phosphofructokinase, platelet | ESTs, Highly similar to A53047 6-phosphofructokinase (EC 2.7.1.11) - rat [*R.norvegicus*] |
| 1701 | 25377 | L25387 | hh | phosphofructokinase, platelet | |
| 1702 | 13682 | L38482 | e | HHs:cell division cycle 34 | ESTs, Moderately similar to I54552 hypothetical serine proteinase - rat [*R.norvegicus*] |
| 1703 | 11955 | L48209 | hh | cytochrome c oxidase, subunit VIIIa | cytochrome c oxidase, subunit VIIIa |
| 1704 | 17086 | M13011 | l, m, ll | | |
| 1705 | 20625 | M13100 | p | | |
| 1705 | 20628 | M13100 | hh | | |
| 1705 | 20630 | M13100 | f, g | | |
| 1705 | 18480 | M13100 | hh | | ESTs |
| 1706 | 25399 | M13101 | f | | |
| 1707 | 1466 | M14050 | e | Heat shock 70 kD protein 5 | ESTs, Heat shock 70 kD protein 5 |
| 1708 | 20714 | M14972 | s, t | Cytochrome P450, subfamily IVB, polypeptide 1 | Cytochrome P450, subfamily IVB, polypeptide 1 |
| 1709 | 19255 | M15562 | c | | Rat (diabetic BB) MHC class II alpha chain RT1.D alpha (u) |
| 1709 | 19256 | M15562 | c | | Rat (diabetic BB) MHC class II alpha chain RT1.D alpha (u) |
| 1710 | 25411 | M18529 | gg | | |
| 1711 | 16427 | M21354 | f, g | procollagen, type III, alpha 1 | procollagen, type III, alpha 1 |
| 1712 | 15049 | M24542 | aa, bb | HHs:ubiquinol-cytochrome c reductase, Rieske iron-sulfur polypeptide 1 | ESTs, Highly similar to A32296 ubiquinol--cytochrome-c reductase (EC 1.10.2.2) Rieske iron-sulfur protein precursor - rat (fragment) [*R.norvegicus*] |
| 1713 | 15571 | M27207 | g | procollagen, type I, alpha 1 | procollagen, type I, alpha 1 |
| 1714 | 25438 | M32757 | l, m | | |
| 1715 | 15580 | M33648 | y, z | | Rat mitochondrial 3-hydroxy-3-methylglutaryl-CoA synthase mRNA, complete cds |
| 1716 | 17211 | M34331 | cc, dd | | *Rattus norvegicus* mRNA for ribosomal protein L35 |
| 1716 | 26030 | M34331 | g | | *Rattus norvegicus* mRNA for ribosomal protein L35 |
| 11 | 25439 | M35826 | bb | *Rattus norvegicus* mitochondrial genome. 9/22Length = 16, 3 | |

TABLE 1-continued

| SEQ ID | GLGC ID | GenBank Accession No. | Model Code | Known Gene Name | Unigene Sequence Cluster Title |
|---|---|---|---|---|---|
| 1717 | 9223 | M36151 | c | | Rat mRNA for MHC class II antigen RT1.B-1 beta-chain, *Rattus norvegicus* MHC class II antigen RT1.B beta chain mRNA, partial cds |
| 1718 | 21400 | M36410 | ee, ff, gg | sepiapterin reductase | sepiapterin reductase |
| 1719 | 17145 | M38566 | gg | Serine protease inhibitor | Serine protease inhibitor |
| 1720 | 1586 | M57728 | c | | Rat general mitochondrial matrix processing protease (MPP) mRNA, 3' end |
| 1721 | 24844 | M58040 | u, v | transferrin receptor | transferrin receptor |
| 1722 | 24662 | M59786 | l, m, jj, kk | Ca channel, voltage-dependent, L type, alpha 1c subunit | Ca channel, voltage-dependent, L type, alpha 1c subunit |
| 1723 | 457 | M60666 | aa | Tropomyosin 1 (alpha) | Tropomyosin 1 (alpha) |
| 1724 | 17130 | M62992 | l, m | | |
| 1725 | 10743 | M64780 | r, jj, kk | Agrin | Agrin |
| 1725 | 10744 | M64780 | f | Agrin | Agrin |
| 1726 | 5733 | M81855 | d | ATP-binding cassette, sub family B (MDR/TAP), member 1 (P-glycoprotein/multidrug resistance 1) | ATP-binding cassette, sub-family B (MDR/TAP), member 1 (P-glycoprotein/multidrug resistance 1) |
| 1727 | 21882 | M83740 | l, m | dimerization cofactor of hepatocyte nuclear factor-1-alpha | |
| 1728 | 3762 | M86341 | s, t | ADP-ribosylarginine hydrolase | ADP-ribosylarginine hydrolase |
| 1729 | 13489 | M91599 | cc, dd | Fibroblast growth factor receptor 4 | ESTs, Highly similar to JC1450 fibroblast growth factor receptor 4 - rat [*R.norvegicus*] |
| 1730 | 25470 | M95791 | e, aa, bb | | |
| 1731 | 17991 | M96626 | cc, dd, gg | ATPase, Ca++ transporting, plasma membrane 3 | ATPase, Ca++ transporting, plasma membrane 3 |
| 1732 | 23698 | NM_012489 | l | *Rattus norvegicus* acetyl-CoA acyltransferase, 3-oxo acyl-CoAthiolase A (Acaa), mRNA. 11/22Length = 1619 | Acetyl-CoA acyltransferase, 3-oxo acyl-CoA thiolase A1, peroxisomal |
| 1733 | 15511 | NM_012498 | ii | *Rattus norvegicus* Aldehyde reductase 1 (low Km aldose reductase) (5.8 kb PstI fragment, probably the functional gene) (Aldr1), mRNA. 11/22Length = 1339 | Aldehyde reductase 1 (low Km aldose reductase) (5.8 kb PstI fragment, probably the functional gene) |
| 1734 | 583 | NM_012505 | h, l | *Rattus norvegicus* ATPase, Na+K+ transporting, alpha 2(Atp1a2), mRNA. 11/22Length = 519 | ATPase, Na+K+ transporting, alpha 2 polypeptide |
| 1735 | 1745 | NM_012513 | p, q, ll | *Rattus norvegicus* Brain derived neurothrophic factor (Bdnf), mRNA. 4/22Length = 185 | Brain derived neurothrophic factor |
| 1736 | 20518 | NM_012518 | n, o, r | *Rattus norvegicus* Calmodulin III (Calm3), mRNA. 11/2Length = 691 | Calmodulin III |
| 1737 | 25365 | NM_012519 | u, v, ll | *Rattus norvegicus* Ca++/calmodulin-dependent protein kinase 2delta subunit (Camk2d), mRNA. 11/22Length = 5637 | Ca++/calmodulin-dependent protein kinase II, delta subunit |
| 1737 | 2735 | NM_012519 | r | *Rattus norvegicus* Ca++/calmodulin-dependent protein kinase 2delta subunit (Camk2d), mRNA. 11/22Length = 5637 | Ca++/calmodulin-dependent protein kinase II, delta subunit |
| 1737 | 2736 | NM_012519 | j, k | *Rattus norvegicus* Ca++/calmodulin-dependent protein kinase 2delta subunit (Camk2d), | Ca++/calmodulin-dependent protein kinase II, delta subunit |

TABLE 1-continued

| SEQ ID | GLGC ID | GenBank Accession No. | Model Code | Known Gene Name | Unigene Sequence Cluster Title |
|---|---|---|---|---|---|
| | | | | mRNA. 11/22Length = 5637 | |
| 1738 | 15741 | NM_012520 | ll | *Rattus norvegicus* Catalase (Cat), mRNA. 11/22Length= 2495 | Catalase |
| 1739 | 4467 | NM_012529 | f, g | *Rattus norvegicus* creatine kinase, brain (Ckb), mRNA. 11/22Length = 1146 | Creatine kinase, brain |
| 1739 | 4468 | NM_012529 | g | *Rattus norvegicus* creatine kinase, brain (Ckb), mRNA. 11/22Length = 1146 | Creatine kinase, brain |
| 1740 | 11115 | NM_012531 | f, g | *Rattus norvegicus* Catecholamine-O-methyltransferase (Comt), mRNA. 11/2Length = 1531 | Catecholamine-O-methyltransferase |
| 1740 | 11116 | NM_012531 | f, g | *Rattus norvegicus* Catecholamine-O-methyltransferase (Comt), mRNA. 11/2Length = 1531 | Catecholamine-O-methyltransferase |
| 1741 | 16520 | NM_012532 | c | *Rattus norvegicus* Ceruloplasmin (ferroxidase) (Cp), mRNA. 11/22Length = 37 | Ceruloplasmin (ferroxidase) |
| 1742 | 20357 | NM_012534 | cc, dd | *Rattus norvegicus* Crystallin, alpha polypeptide A (Cryaa), mRNA. 3/22Length = 156 | Crystallin, alpha polypeptide A |
| 1743 | 20704 | NM_012541 | aa, bb | *Rattus norvegicus* cytochrome P45, 1a2 (Cyp1a2), mRNA. 11/22Length = 1542 | Cytochrome P450, subfamily I (aromatic compound-inducible), member A2 (Q42, form d) |
| 1744 | 1762 | NM_012543 | f | *Rattus norvegicus* D site albumin promoter binding protein (Dbp), mRNA. 11/22Length = 1671 | D site albumin promoter binding protein |
| 1744 | 1763 | NM_012543 | hh | *Rattus norvegicus* D site albumin promoter binding protein (Dbp), mRNA. 11/22Length = 1671 | D site albumin promoter binding protein |
| 1745 | 225 | NM_012544 | aa, bb | *Rattus norvegicus* angiotensin 1 converting enzyme 1 (Ace), mRNA. 11/22Length = 4142 | Angiotensin I-converting enzyme (Dipeptidyl carboxypeptidase 1) |
| 1746 | 23868 | NM_012551 | a, h, l, p, q, y, z, ee, ff | *Rattus norvegicus* Early growth response 1 (Egr1), mRNA. 11/22Length = 3112 | Earlygrowth response 1 |
| 1746 | 23869 | NM_012551 | a, h, l, p, q, y, z | *Rattus norvegicus* Early growth response 1 (Egr1), mRNA. 11/22Length = 3112 | Early growth response 1 |
| 1746 | 23871 | NM_012551 | p, q, y, z, ii | *Rattus norvegicus* Early growth response 1 (Egr1), mRNA. 11/22Length = 3112 | Early growth response 1 |
| 1746 | 23872 | NM_012551 | p, q, y, z | *Rattus norvegicus* Early growth response 1 (Egr1), mRNA. 11/22Length = 3112 | Early growth response 1 |
| 1747 | 6477 | NM_012559 | z | *Rattus norvegicus* Fibrinogen, gamma polypeptide (Fgg), mRNA. 11/2Length = 1358 | Fibrinogen, gamma polypeptide |
| 1747 | 6478 | NM_012559 | y, z | *Rattus norvegicus* Fibrinogen, gamma polypeptide (Fgg), mRNA. 11/2Length = 1358 | Fibrinogen, gamma polypeptide |

TABLE 1-continued

| SEQ ID | GLGC ID | GenBank Accession No. | Model Code | Known Gene Name | Unigene Sequence Cluster Title |
|---|---|---|---|---|---|
| 1748 | 619 | NM_012565 | l, m, n, o | *Rattus norvegicus* Glucokinase (Gck), mRNA. 11/22Length = 2326 | Glucokinase |
| 1749 | 482 | NM_012567 | s, t | *Rattus norvegicus* Gap junction protein, alpha 1, 43 kD(connexin 43) (Gja1), mRNA. 11/2Length = 2768 | Gap junction protein, alpha 1, 43 kD (connexin 43) |
| 1750 | 16025 | NM_012578 | p, q | *Rattus norvegicus* Histone H1- (H1f), mRNA. 11/2Length = 1779 | Histone H1-0 |
| 1750 | 16026 | NM_012578 | p, q, s, t, ee, ff | *Rattus norvegicus* Histone H1- (H1f), mRNA. 11/2Length = 1779 | Histone H1-0 |
| 1751 | 16080 | NM_012580 | p, q, y, z, kk | *Rattus norvegicus* Heme oxygenase (Hmox1), mRNA. 1/22Length = 87 | Heme oxygenase |
| 1752 | 1708 | NM_012581 | ii | *Rattus norvegicus* Homeo box A2 (Hoxa2), mRNA. 1/22Length = 1576 | homeoboxA2 |
| 1752 | 1709 | NM_012581 | l, m | *Rattus norvegicus* Homeo box A2 (Hoxa2), mRNA. 1/22Length = 1576 | homeoboxA2 |
| 1753 | 20313 | NM_012585 | b, u, v | *Rattus norvegicus* 5-hydroxytryptamine (serotonin) receptor 1A (Htr1a), mRNA. 11/22Length = 1269 | 5-Hydroxytryptamine (serotonin) receptor 1A |
| 1754 | 15098 | NM_012588 | bb | *Rattus norvegicus* insulin-like growth factor binding protein3 (Igfbp3), mRNA. 11/22Length = 2352 | Insulin-like growth factor-binding protein (IGF-BP3) |
| 1755 | 24716 | NM_012589 | j, k, p, q | *Rattus norvegicus* Interleukin 6 (interferon, beta 2) (Il6), mRNA. 11/22Length = 146 | Interleukin 6 (interferon, beta 2) |
| 1756 | 4450 | NM_012592 | c | *Rattus norvegicus* Isovaleryl Coenzyme A dehydrogenase (Ivd), mRNA. 11/22Length = 214 | Isovaleryl Coenzyme A dehydrogenase |
| 1757 | 7125 | NM_012595 | aa, bb | *Rattus norvegicus* Lactate dehydrogenease B (Ldhb), mRNA. 11/2Length = 1217 | Lactate dehydrogenase B |
| 1758 | 18386 | NM_012598 | w, x | *Rattus norvegicus* Lipoprotein lipase (Lpl), mRNA. 11/22Length = 3617 | ESTs, Highly similar to JH0790 lipoprotein lipase (EC 3.1.1.34) precursor - rat [*R.norvegicus*], Lipoprotein lipase |
| 1758 | 18387 | NM_012598 | w, x | *Rattus norvegicus* Lipoprotein lipase (Lpl), mRNA. 11/22Length = 3617 | Lipoprotein lipase |
| 1759 | 2628 | NM_012603 | a, p, q, y, z ee, ff, kk | *Rattus norvegicus* v-myc avian myelocytomatosis viral oncogene homolog (Myc), mRNA. 11/22Length = 2168 | Avian myelocytomatosis viral (v-myc) oncogene homolog |
| 1759 | 2629 | NM_012603 | a, j, k, p, q, y, z, ee, ff, kk | *Rattus norvegicus* v-myc avian myelocytomatosis viral oncogene homolog (Myc), mRNA. 11/22Length = 2168 | Avian myelocytomatosis viral (v-myc) oncogene homolog |
| 1760 | 25450 | NM_012609 | n, o | *Rattus norvegicus* Neurofibromatosis type 1 (Nf1), mRNA. 11/2Length = 9132 | |
| 1761 | 1298 | NM_012610 | d | *Rattus norvegicus* Nerve growth factor receptor, fast (Ngfr), mRNA. 11/2Length = 3259 | Nerve growth factor receptor, fast |

TABLE 1-continued

| SEQ ID | GLGC ID | GenBank Accession No. | Model Code | Known Gene Name | Unigene Sequence Cluster Title |
|---|---|---|---|---|---|
| 1761 | 1299 | NM_012610 | cc, dd | *Rattus norvegicus* Nerve growth factor receptor, fast (Ngfr), mRNA. 11/22Length = 3259 | Nerve growth factor receptor, fast |
| 1762 | 638 | NM_012613 | aa, bb | *Rattus norvegicus* natriuretic peptide receptor 1 (Npr1), mRNA. 11/22Length = 468 | Natriuretic peptide receptor A/Guanylate cyclase A |
| 1763 | 24506 | NM_012614 | c | *Rattus norvegicus* Neuropeptide Y (Npy), mRNA. 11/22Length = 539 | Neuropeptide Y |
| 1764 | 20589 | NM_012618 | h, l, n, o, w, x | *Rattus norvegicus* S1 calcium-binding protein A4 (S1a4), mRNA. 1/22Length = 487 | S100 calcium-binding protein A4 |
| 1765 | 15540 | NM_012620 | a, kk | *Rattus norvegicus* serine (or cysteine) proteinase inhibitor, member 1 (Pai1), mRNA. 11/22Length = 353 | serine (or cysteine) proteinase inhibitor, clade E (nexin, plasminogen activator inhibitor type 1), member 1 |
| 1766 | 25133 | NM_012628 | gg | *Rattus norvegicus* Protein kinase C, type I (gamma type) (Prkcg), mRNA. 11/2Length = 3113 | |
| 1767 | 1841 | NM_012637 | d, jj, kk | *Rattus norvegicus* protein tyrosine phosphatase, non-receptor type 1 (Ptpn1), mRNA. 11/22Length = 4127 | protein tyrosine phosphatase, non-receptor type 1 |
| 1767 | 1844 | NM_012637 | p, q, y, z | *Rattus norvegicus* protein tyrosine phosphatase, non-receptor type 1 (Ptpn1), mRNA. 11/22Length = 4127 | ESTs, protein tyrosine phosphatase, non-receptor type 1 |
| 1768 | 14924 | NM_012645 | cc, dd | *Rattus norvegicus* RT1 class lb gene (RT1Aw2), mRNA. 11/22Length = 154 | ESTs, Weakly similar to A60716 somatotropin intron-related protein RDE.25 - rat (fragment) [*R.norvegicus*], RT1 class lb gene |
| 1769 | 9423 | NM_012649 | j, k, y, z | *Rattus norvegicus* syndecan 4 (Sdc4), mRNA. 11/22Length = 2462 | Ryudocan/syndecan 4 |
| 1770 | 16217 | NM_012656 | c, aa, bb | *Rattus norvegicus* Secreted acidic cystein-rich glycoprotein (osteonectin) (Sparc), mRNA. 11/2Length = 225 | Secreted acidic cystein-rich glycoprotein (osteonectin) |
| 1770 | 16218 | NM_012656 | n, o | *Rattus norvegicus* Secreted acidic cystein-rich glycoprotein (osteonectin) (Sparc), mRNA. 11/2Length = 225 | Secreted acidic cystein-rich glycoprotein (osteonectin) |
| 1770 | 16219 | NM_012656 | r, gg | *Rattus norvegicus* Secreted acidic cystein-rich glycoprotein (osteonectin) (Sparc), mRNA. 11/2Length = 225 | Secreted acidic cystein-rich glycoprotein (osteonectin) |
| 1770 | 16220 | NM_012656 | h, l, aa, bb | *Rattus norvegicus* Secreted acidic cystein-rich glycoprotein (osteonectin) (Sparc), mRNA. 11/2Length = 225 | Secreted acidic cystein-rich glycoprotein (osteonectin) |
| 1770 | 16221 | NM_012656 | d | *Rattus norvegicus* Secreted acidic cystein-rich glycoprotein (osteonectin) (Sparc), mRNA. 11/2Length = 225 | Secreted acidic cystein-rich glycoprotein (osteonectin) |
| 1771 | 21087 | NM_012661 | cc, dd | *Rattus norvegicus* steroid sulfatase (Sts), mRNA. 11/22Length = 2472 | Steroid sulfatase |

TABLE 1-continued

| SEQ ID | GLGC ID | GenBank Accession No. | Model Code | Known Gene Name | Unigene Sequence Cluster Title |
|---|---|---|---|---|---|
| 1772 | 16197 | NM_012663 | j, k | *Rattus norvegicus* vesicle associated membrane protein 2 (Vamp2), mRNA. 1/22Length = 271 | Vesicle-associated membrane protein (synaptobrevin 2) |
| 1773 | 24854 | NM_012676 | aa, bb | *Rattus norvegicus* troponin T2 (Tnnt2), mRNA. 11/22Length = 196 | Troponin T, cardiac |
| 1774 | 1514 | NM_012678 | bb | *Rattus norvegicus* Tropomycin 4 (Tpm4), mRNA. 11/22Length = 9 | Tropomyosin 4 |
| 1775 | 425 | NM_012698 | hh | *Rattus norvegicus* Dystrophin (Dmd), mRNA. 11/22Length = 124 | Dystrophin |
| 1776 | 501 | NM_012704 | ii | *Rattus norvegicus* prostaglandin E receptor 3 (subtype EP3)(Ptger3), mRNA. 1/22Length = 1253 | Rat kidney prostaglandin EP3 receptor |
| 1776 | 503 | NM_012704 | n, o | *Rattus norvegicus* prostaglandin E receptor 3 (subtype EP3)(Ptger3), mRNA. 1/22Length = 1253 | Rat kidney prostaglandin EP3 receptor |
| 1777 | 4003 | NM_012708 | e | *Rattus norvegicus* proteosome (prosome, macropain) subunit, beta type 9 (large multifunctional protease 2) (Psmb9), mRNA. 11/22Length = 88 | Low molecular mass polypeptide 2 |
| 1778 | 322 | NM_012715 | d, gg | *Rattus norvegicus* adrenomedullin (Adm), mRNA. 11/22Length = 1395 | Adrenomedullin |
| 1779 | 20888 | NM_012716 | c, e | *Rattus norvegicus* Solute carrier 16 (monocarboxylic acid transporter), member 1 (Slc16a1), mRNA. 11/2Length = 332 | Solute carrier 16 (monocarboxylic acid transporter), member 1 |
| 1779 | 20889 | NM_012716 | e, aa, bb | *Rattus norvegicus* Solute carrier 16 (monocarboxylic acid transporter), member 1 (Slc16a1), mRNA. 11/2Length = 332 | Solute carrier 16 (monocarboxylic acid transporter), member 1 |
| 1780 | 1632 | NM_012717 | u, v | *Rattus norvegicus* Calcitonin receptor-like receptor (Calcri), mRNA. 11/22Length = 295 | Calcitonin receptor-like receptor |
| 1781 | 25563 | NM_012732 | f, g | *Rattus norvegicus* lipase A, lysosomal acid (Lipa), mRNA. 1/22Length = 3144 | Cholesterol esterase (pancreatic) |
| 1781 | 16613 | NM_012732 | g | *Rattus norvegicus* lipase A, lysosomal acid (Lipa), mRNA. 11/2Length = 3144 | Cholesterol esterase (pancreatic) |
| 1782 | 23806 | NM_012733 | j, k | *Rattus norvegicus* retinol-binding protein 1 (Rbp1), mRNA. 11/22Length = 695 | Retinol-binding protein 1 |
| 1783 | 25264 | NM_012735 | y, z, gg | *Rattus norvegicus* Hexokinase 2 (Hk2), mRNA. 11/22Length = 3635 | |
| 1784 | 25650 | NM_012736 | d | *Rattus norvegicus* Glycerol-3-phosphate dehydrogenase 2(mitochondrial) (Gpd2), mRNA. 11/2Length = 24 | Glycerol-3-phosophate dehydrogenase 2 (mitochondrial) |
| 1785 | 1478 | NM_012744 | n, o | *Rattus norvegicus* Pyruvate carboxylase (Pc), mRNA. 11/2Length = 3945 | Pyruvate carboxylase |
| 1786 | 343 | NM_012747 | n, o | *Rattus norvegicus* signal transducer and activator | Signal transducer and activator of transcription 3 |

TABLE 1-continued

| SEQ ID | GLGC ID | GenBank Accession No. | Model Code | Known Gene Name | Unigene Sequence Cluster Title |
|---|---|---|---|---|---|
| | | | | of transcription 3 (Stat3), mRNA. 11/22Length = 2924 | |
| 1787 | 8829 | NM_012749 | j, k, hh, kk | *Rattus norvegicus* Nucleolin (Ncl), mRNA. 11/22Length = 2142 | Nucleolin |
| 1788 | 3600 | NM_012751 | a | *Rattus norvegicus* Glucose transporter 4, insuline-responsive (Glut4), mRNA. 11/22Length = 256 | solute carrier family 2 (facilitated glucose transporter), member 4 |
| 1788 | 3601 | NM_012751 | t | *Rattus norvegicus* Glucose transporter 4, insuline-responsive (Glut4), mRNA. 11/22Length = 256 | solute carrier family 2 (facilitated glucose transporter), member 4 |
| 1789 | 13731 | NM_012755 | r | *Rattus norvegicus* Fyn proto-oncogene (Fyn), mRNA. 9/22Length = 1844 | Fyn proto-oncogene |
| 1790 | 15174 | NM_012756 | m | *Rattus norvegicus* insulin-like growth factor 2 receptor (Igf2r), mRNA. 11/22Length = 881 | Insulin-like growth factor 2 receptor |
| 1791 | 18066 | NM_012762 | aa, bb | *Rattus norvegicus* caspase 1 (Casp1), mRNA. 1 ll22Length = 129 | Interleukin 1beta converting enzyme |
| 1791 | 18068 | NM_012762 | e | *Rattus norvegicus* caspase 1 (Casp1), mRNA. 11/22Length = 129 | Interleukin 1beta converting enzyme |
| 1792 | 17257 | NM_012766 | e, aa, bb, ee, ff | *Rattus norvegicus* Cyclin D3 (Ccnd3), mRNA. 11/22Length = 1843 | Cyclin D3 |
| 1792 | 17261 | NM_012766 | l, m | *Rattus norvegicus* Cyclin D3 (Ccnd3), mRNA. 11/22Length = 1843 | Cyclin D3 |
| 1793 | 5758 | NM_012778 | p, q, s, t | *Rattus norvegicus* aquaporin 1 (Aqp1), mRNA. 11/22Length = 2623 | Aquaporin 1 (aquaporin channel forming integral protein 28 (CHIP)) |
| 1794 | 104 | NM_012779 | ii | *Rattus norvegicus* aquaporin 5 (Aqp5), mRNA. 11/22Length = 1426 | Aquaporin 5 |
| 1795 | 449 | NM_012786 | hh | *Rattus norvegicus* Cytochrom c oxidase subunit VIII-H (heart/muscle) (Cox8h), mRNA. 11/22Length = 33 | Cytochrome c oxidase subunit VIII-H (heart/muscle) |
| 1795 | 450 | NM_012786 | f, hh | *Rattus norvegicus* Cytochrom c oxidase subunit VIII-H (heart/muscle) (Cox8h), mRNA. 11/22Length = 33 | Cytochrome c oxidase subunit VIII-H (heart/muscle) |
| 1796 | 1952 | NM_012788 | gg | *Rattus norvegicus* *Drosophila* discs-large tumor suppressorhomologue (synapse associated protein) (Dlg1), mRNA. 11/22Length = 3256 | *Drosophila* discs-large tumor suppressor homologue (synapse associated protein) |
| 1797 | 24113 | NM_012791 | e | *Rattus norvegicus* Dual Specificity Yak1-related kinase (Dyrk), mRNA. 11/22Length = 284 | dual-specificity tyrosine-(Y)-phosphorylation regulated kinase 1a |
| 1797 | 18135 | NM_012791 | e, gg, ll | *Rattus norvegicus* Dual Specificity Yak1-related kinase (Dyrk), mRNA. 11/22Length = 284 | ESTs, dual-specificity tyrosine-(Y)-phosphorylation regulated kinase 1a |

TABLE 1-continued

| SEQ ID | GLGC ID | GenBank Accession No. | Model Code | Known Gene Name | Unigene Sequence Cluster Title |
|---|---|---|---|---|---|
| 1798 | 16947 | NM_012793 | b, u, v, jj, kk | *Rattus norvegicus* Guanidinoacetate methyltransferase (Gamt), mRNA. 11/22Length = 924 | Guanidinoacetate methyltransferase |
| 1799 | 961 | NM_012796 | g | *Rattus norvegicus* glutathione 5-transferase, theta 2 (Gstt2), mRNA. 11/22Length = 1258 | glutathione S-transferase, theta 2 |
| 1800 | 10248 | NM_012797 | b, j, s, t, u, jj, kk | *Rattus norvegicus* Inhibitor of DNA binding 1, helix-loop-helix protein (splice variation) (Id1), mRNA. 1/22Length = 1124 | Inhibitor of DNA binding 1, helix-loop-helix protein (splice variation) |
| 1801 | 20246 | NM_012807 | l, m, s | *Rattus norvegicus* Smoothened (Smoh), mRNA. 1/22Length = 2382 | Smoothened |
| 1802 | 15032 | NM_012816 | j, k, jj, kk | *Rattus norvegicus* alpha-methylacyl-CoA racemase (Amacr), mRNA. 11/22Length = 154 | alpha-methylacyl-CoA racemase |
| 1803 | 21350 | NM_012823 | ii | *Rattus norvegicus* Annexin III (Lipocortin III) (Anx3), mRNA. 11/22Length = 1454 | Annexin A3 |
| 1804 | 2853 | NM_012838 | n, o | *Rattus norvegicus* Cystatin beta (Cstb), mRNA. 11/2Length = 59 | Cystatin beta |
| 1805 | 338 | NM_012843 | r | *Rattus norvegicus* Epithelial membrane protein 1 (Emp1), mRNA. 11/22Length = 981 | Epithelial membrane protein 1 |
| 1806 | 17541 | NM_012844 | c, d | *Rattus norvegicus* Epoxide hydrolase 1 (microsomal xenobiotic hydrolase) (Ephx1), mRNA. 1/22Length = 1242 | Epoxide hydrolase 1 (microsomal xenobiotic hydrolase) |
| 1807 | 1249 | NM_012850 | u, v | *Rattus norvegicus* Growth hormone - releasing receptor (Ghrhr), mRNA. 11/2Length = 1629 | Growth hormone- releasing receptor |
| 1808 | 18770 | NM_012857 | hh | *Rattus norvegicus* Lysosomal associated membrane protein 1(12 kDa) (Lamp1), mRNA. 11/2Length = 26 | Lysosomal associated membrane protein 1 (120 kDa) |
| 1809 | 13151 | NM_012862 | n, o, ll | *Rattus norvegicus* Matrix Gla protein (Mgp), mRNA. 11/22Length = 521 | Matrix Gla protein |
| 1810 | 4338 | NM_012866 | u, v | *Rattus norvegicus* nuclear transcription factor-Y gamma (Nfyc), mRNA. 11/22Length = 123 | CCAAT binding factor of CBF-C/NFY-C |
| 1811 | 24617 | NM_012870 | ii | *Rattus norvegicus* Osteoprotegerin (Opg), mRNA. 11/22Length = 2432 | tumor necrosis factor receptor superfamily, member 11b (osteoprotegerin) |
| 1812 | 20945 | NM_012875 | cc, dd | *Rattus norvegicus* Ribosomal protein L39 (Rpl39), mRNA. 11/22Length = 324 | Ribosomal protein L39 |
| 1813 | 17305 | NM_012876 | g, hh | *Rattus norvegicus* Ribosomal protein S29 (Rps29), mRNA. 11/22Length = 318 | Ribosomal protein S29 |
| 1813 | 17306 | NM_012876 | f | *Rattus norvegicus* Ribosomal protein S29 (Rps29), mRNA. 11/2Length = 318 | Ribosomal protein S29 |

TABLE 1-continued

| SEQ ID | GLGC ID | GenBank Accession No. | Model Code | Known Gene Name | Unigene Sequence Cluster Title |
|---|---|---|---|---|---|
| 1814 | 23651 | NM_012881 | h, l, n, o, w, x | Rattus norvegicus secreted phosphoprotein 1 (Spp1), mRNA. 11/22Length = 1457 | Sialoprotein (osteopontin) |
| 1815 | 16871 | NM_012887 | y, ll | Rattus norvegicus Thymopoietin (lamina associated polypeptide2) (Tmpo), mRNA. 11/2Length = 358 | Thymopoietin (lamina associated polypeptide 2) |
| 1816 | 16708 | NM_012895 | u, v | Rattus norvegicus Adenosin kinase (Adk), mRNA. 11/22Length = 1123 | Adenosin kinase |
| 1817 | 187 | NM_012903 | r | Rattus norvegicus Acid nuclear phosphoprotein 32 (leucine rich) (Anp32), mRNA. 11/2Length = 117 | Acid nuclear phosphoprotein 32 (leucine rich) |
| 1818 | 7196 | NM_012904 | a, ll | Rattus norvegicus Annexin 1 (p35) (Lipocortin 1) (Anx1), mRNA. 11/2Length = 142 | Annexin 1 (p35) (Lipocortin 1) |
| 1819 | 1834 | NM_012905 | d | Rattus norvegicus Aortic preferentially expressed gene 1 (Apeg1), mRNA. 11/22Length = 138 | Aortic preferentially expressed gene 1 |
| 1820 | 16581 | NM_012911 | gg | Rattus norvegicus Arrestin, beta 2 (Arrb2), mRNA. 11/22Length = 1758 | Arrestin, beta 2 |
| 1821 | 24431 | NM_012912 | a, p, q, y, z, ee ff | Rattus norvegicus Activating transcription factor 3 (Atf3), mRNA. 11/22Length = 1893 | Activating transcription factor 3 |
| 1822 | 24783 | NM_012914 | kk | Rattus norvegicus ATPase, Ca++ transporting, ubiquitous(Atp2a3), mRNA. 11/22Length = 4472 | ATPase, Ca++ transporting, ubiquitous |
| 1823 | 6108 | NM_012915 | c | Rattus norvegicus ATPase inhibitor (rat mitochondrial IF1 protein) (Atpi), mRNA. 11/2Length = 833 | ATPase inhibitor (rat mitochondrial F1 protein) |
| 1824 | 1765 | NM_012919 | u, v | Rattus norvegicus Calcium channel subunit alpha 2 delta(dihydropyridine-sensitive L-type) (Cacna2d1), mRNA. 1/22Length = 384 | calcium channel, voltage-dependent, alpha2/delta subunit 1 |
| 1825 | 20757 | NM_012923 | cc, dd | Rattus norvegicus Cyclin G1 (Ccng1), mRNA. 11/22Length = 3169 | Cyclin G1 |
| 1826 | 1625 | NM_012924 | gg | Rattus norvegicus Cell surface glycoprotein CD44 (hyaluronatebinding protein) (Cd44), mRNA. 4/22Length = 438 | Cell surface glycoprotein CD44 (hyaluronate binding protein) |
| 1827 | 1977 | NM_012930 | a, w, x, cc, dd | Rattus norvegicus Carnitine palmitoyltransferase 2 (Cpt2), mRNA. 11/22Length = 2296 | Carnitine palmitoyltransferase 2 |
| 1828 | 18694 | NM_012931 | j, k, gg | Rattus norvegicus v-crk-associated tyrosine kinase substrate (Crkas), mRNA. 11/22Length = 3335 | v-crk-associated tyrosine kinase substrate |
| 1828 | 18695 | NM_012931 | j, k, y, z | Rattus norvegicus v-crk-associated tyrosine kinase substrate (Crkas), mRNA. 11/22Length = 3335 | v-crk-associated tyrosine kinase substrate |

TABLE 1-continued

| SEQ ID | GLGC ID | GenBank Accession No. | Model Code | Known Gene Name | Unigene Sequence Cluster Title |
|---|---|---|---|---|---|
| 1829 | 13723 | NM_012935 | aa, bb | *Rattus norvegicus* Crystallin, alpha polypeptide 2 (Cryab), mRNA. 11/21Length = 528 | Crystallin, alpha polypeptide 2, ESTs, ESTs, Weakly similar to T46637 transcription factor 1, neural - rat [*R.norvegicus*] |
| 1830 | 487 | NM_012937 | n | *Rattus norvegicus* crystallin, beta B2 (Crybb2), mRNA. 11/22Length = 735 | *R.norvegicus* CRYBB2 gene (crystallin, beta B2) |
| 1831 | 190 | NM_012940 | j, k | *Rattus norvegicus* Cytochrome P45 1b1 (Cyp1b1), mRNA. 11/2Length = 4964 | Cytochrome P450 1b1 |
| 1832 | 20928 | NM_012941 | l, m | *Rattus norvegicus* Cytochrom P45 Lanosterol 14 alpha-demethylase (Cyp51), mRNA. 11/22Length = 226 | Cytochrom P450 Lanosterol 14 alpha-demethylase |
| 1833 | 223 | NM_012945 | a, p, q, ee, ff | *Rattus norvegicus* Diphtheria toxin receptor (heparin binding epidermal growth factor - like growth factor) (Dtr), mRNA. 11/2Length = 155 | Diphtheria toxin receptor (heparin binding epidermal growth factor - like growth factor) |
| 1834 | 5033 | NM_012966 | s, t | *Rattus norvegicus* Heat shock 1 kD protein 1 (chaperonin 1) (Hspe1), mRNA. 11/2Length = 68 | Heat shock 10 kD protein 1 (chaperonin 10) |
| 1834 | 5034 | NM_012966 | ee, ff | *Rattus norvegicus* Heat shock 1 kD protein 1 (chaperonin 1) (Hspe1), mRNA. 11/2Length = 68 | Heat shock 10 kD protein 1 (chaperonin 10) |
| 1835 | 2555 | NM_012967 | a, y, z, kk | *Rattus norvegicus* Intercellular adhesion molecule 1 (Icam1), mRNA. 11/2Length = 262 | intercellular adhesion molecule 1 |
| 1836 | 22434 | NM_012974 | l, m | *Rattus norvegicus* Laminin chain beta 2 (Lamb2), mRNA. 11/2Length = 5581 | Laminin chain beta 2 |
| 1836 | 22435 | NM_012974 | c | *Rattus norvegicus* Laminin chain beta 2 (Lamb2), mRNA. 11/2Length = 5581 | Laminin chain beta 2 |
| 1837 | 956 | NM_012976 | c, v | *Rattus norvegicus* Lectin, galactose binding, soluble 5(Galectin-5) (Lgals5), mRNA. 11/2Length = 872 | Lectin, galactose binding, soluble 9 (Galectin-9) |
| 1838 | 957 | NM_012977 | ii | *Rattus norvegicus* Lectin, galactose binding, soluble 9(Galectin-9) (Lgals9), mRNA. 11/2Length = 1545 | Lectin, galactose binding, soluble 9 (Galectin-9) |
| 1838 | 958 | NM_012977 | kk | *Rattus norvegicus* Lectin, galactose binding, soluble 9(Galectin-9) (Lgals9), mRNA. 11/2Length = 1545 | Lectin, galactose binding, soluble 9 (Galectin-9) |
| 1839 | 571 | NM_012982 | cc, dd | *Rattus norvegicus* Msh (*Drosophila*) homeo box homolog (Msx2), mRNA. 11/22Length = 42 | Msh (*Drosophila*) homeo box homolog |
| 1840 | 764 | NM_012988 | ee, ff | *Rattus norvegicus* Nuclear Factor IA (Nfia), mRNA. 11/2Length = 3368 | Nuclear Factor 1A |
| 1841 | 17394 | NM_012992 | hh, kk | *Rattus norvegicus* Nucleoplasmin-related protein (Nuclearprotein B23 (Npm1), mRNA. 11/2Length = 1232 | Nucleoplasmin-related protein (Nuclear protein B23 |
| 1842 | 19393 | NM_012998 | h, l | *Rattus norvegicus* Protein disulfide isomerase (Prolyl4- | Protein disulfide isomerase (Prolyl 4-hydroxylase, beta polypeptide) |

TABLE 1-continued

| SEQ ID | GLGC ID | GenBank Accession No. | Model Code | Known Gene Name | Unigene Sequence Cluster Title |
|---|---|---|---|---|---|
| | | | | hydroxylase, beta polypeptide) (P4hb), mRNA. 11/2Length = 246 | |
| 1843 | 24263 | NM_012999 | f | *Rattus norvegicus* Subtilisin - like endoprotease (Pace4), mRNA. 1/21Length = 4153 | Subtilisin - like endoprotease |
| 1843 | 24264 | NM_012999 | g | *Rattus norvegicus* Subtilisin - like endoprotease (Pace4), mRNA. 1/21Length = 4153 | Subtilisin - like endoprotease |
| 1844 | 24718 | NM_013003 | ii | *Rattus norvegicus* phosphatidylethanolamine N-methyltransferase(Pemt), mRNA. 11/22Length = 893 | Phosphatidylethanolamine N-methyltransferase |
| 1845 | 1467 | NM_013010 | ii | *Rattus norvegicus* Protein kinase, AMP-activated, gamma 1non-catalytic subunit (Prkga1), mRNA. 11/22Length = 1328 | Protein kinase, AMP-activated, gamma |
| 1846 | 25279 | NM_013011 | p, q | *Rattus norvegicus* Tyrosine 3-monooxygenase/tryptophan 5-monooxygenase activation protein, zeta polypeptide (Ywhaz), mRNA. 11/22Length = 1687 | Tyrosine 3-monooxygenase/tryptophan 5-monooxygenase activation protein, zeta polypeptide |
| 1846 | 3404 | NM_013011 | p, q | *Rattus norvegicus* Tyrosine 3-monooxygenase/tryptophan 5-monooxygenase activation protein, zeta polypeptide (Ywhaz), mRNA. 11/22Length = 1687 | Tyrosine 3-monooxygenase/tryptophan 5-monooxygenase activation protein, zeta polypeptide |
| 1847 | 23545 | NM_013013 | l, m | *Rattus norvegicus* Prosaposin (sulfated glycoprotein, sphingolipid hydrolase activator) (Psap), mRNA. 11/2Length = 2175 | Prosaposin (sulfated glycoprotein, sphingolipid hydrolase activator) |
| 1848 | 20178 | NM_013014 | w, x | *Rattus norvegicus* Persephin (Pspn), mRNA. 11/22Length = 471 | Persephin |
| 1849 | 20229 | NM_013018 | kk | *Rattus norvegicus* Ras-related small GTP binding protein 3A (Rab3a), mRNA. 11/2Length = 743 | Ras-related small GTP binding protein 3A |
| 1850 | 1338 | NM_013022 | r | *Rattus norvegicus* RhoA - binding serine/threonine kinase alpha (ROK - alpha) (Rock2), mRNA. 11/22Length = 447 | RhoA - binding serine/threonine kinase alpha (ROK - alpha) |
| 1851 | 17894 | NM_013027 | gg | *Rattus norvegicus* Selenoprotein W muscle 1 (Sepw1), mRNA. 7/21Length = 664 | Selenoprotein W muscle 1 |
| 1852 | 17174 | NM_013030 | l, m | *Rattus norvegicus* Solute carrier family 34 (sodium phosphate), member 1 (Slc34a1), mRNA. 11/22Length = 244 | *R.norvegicus ASI mRNA for mammalian* equivalent of bacterial large ribosomal subunit protein L22 |
| 1852 | 18076 | NM_013030 | cc, dd | *Rattus norvegicus* Solute carrier family 34 (sodium phosphate), member 1 (Slc34a1), mRNA. 11/22Length = 244 | Solute carrier family 17 (sodium/hydrogen exchanger), member 2 |
| 1853 | 733 | NM_013040 | j, k | *Rattus norvegicus* ATP-binding cassette, sub- | ATP-binding cassette, sub-family C (CFTR/MRP), member 9 |

TABLE 1-continued

| SEQ ID | GLGC ID | GenBank Accession No. | Model Code | Known Gene Name | Unigene Sequence Cluster Title |
|---|---|---|---|---|---|
| | | | | family C (CFTR/MRP), member 9 (Abcc9), mRNA. 4/22Length = 6628 | |
| 1854 | 17401 | NM_013043 | a, p, q, z, ee, ff, kk | *Rattus norvegicus* Transforming growth factor beta stimulated clone 22 (Tgfb1i4), mRNA. 11/2Length = 1666 | Transforming growth factor beta stimulated clone 22 |
| 1855 | 11113 | NM_013046 | l, k, p, q, u, v, g g | *Rattus norvegicus* Tryrotropin releasing hormone (Trh), mRNA. 11/22Length = 768 | Thyrotropin releasing hormone |
| 1855 | 11114 | NM_013046 | k, n, o, y, z, kk | *Rattus norvegicus* Tryrotropin releasing hormone (Trh), mRNA. 11/22Length = 768 | Thyrotropin releasing hormone |
| 1856 | 24874 | NM_013057 | r | *Rattus norvegicus* Coagulation factor III (thromboplastin, tissuefactor) (F3), mRNA. 11/2Length = 1683 | Coagulation factor III (thromboplastin, tissue factor) |
| 1857 | 15253 | NM_013058 | n, o, s, t | *Rattus norvegicus* Inhibitor of DNA binding 3, dominant negative helix-loop-helix protein (Id3), mRNA. 11/22Length = 568 | Inhibitor of DNA binding 3, dominant negative helix-loop-helix protein |
| 1858 | 14997 | NM_013059 | e, ee, ff | *Rattus norvegicus* alkaline phosphatase, tissue-nonspecific(Alpl), mRNA. 11/22Length = 2415 | Tissue-nonspecific ALP alkaline phosphatase |
| 1859 | 21287 | NM_013065 | l, m | *Rattus norvegicus* Protein phosphatase 1, catalytic subunit, beta isoform (Ppp1cb), mRNA. 11/22Length = 276 | Protein phosphatase 1, catalytic subunit, beta isoform |
| 1860 | 16924 | NM_013069 | c, cc, dd | *Rattus norvegicus* CD74 antigen (invariant polpypeptide of majorhistocompatibility class II antigen-associated) (Cd74), mRNA. 11/2Length = 115 | CD74 antigen (invariant polpypeptide of major histocompatibility class II antigen-associated) |
| 1860 | 16925 | NM_013069 | c, n, o | *Rattus norvegicus* CD74 antigen (invariant polpypeptide of majorhistocompatibility class II antigen-associated) (Cd74), mRNA. 11/2Length = 115 | CD74 antigen (invariant polpypeptide of major histocompatibility class II antigen-associated) |
| 1860 | 16926 | NM_013069 | c | *Rattus norvegicus* CD74 antigen (invariant polpypeptide of majorhistocompatibility class II antigen-associated) (Cd74), mRNA. 11/2Length = 115 | CD74 antigen (invariant polpypeptide of major histocompatibility class II antigen-associated) |
| 1860 | 25676 | NM_013069 | c, m | *Rattus norvegicus* CD74 antigen (invariant polpypeptide of majorhistocompatibility class II antigen-associated) (Cd74), mRNA. 11/2Length = 115 | |
| 1861 | 17181 | NM_013073 | gg | *Rattus norvegicus* Protein-L-isoaspartate (D-aspartate) O-methyltransferase (Pcmt1), mRNA. 11/22Length = 1658 | Protein-L-isoaspartate (D-aspartate) O-methyltransferase |
| 1861 | 21830 | NM_013073 | aa, bb | *Rattus norvegicus* Protein-L-isoaspartate (D- | Protein-L-isoaspartate (D-aspartate) O-methyltransferase |

TABLE 1-continued

| SEQ ID | GLGC ID | GenBank Accession No. | Model Code | Known Gene Name | Unigene Sequence Cluster Title |
|---|---|---|---|---|---|
| | | | | aspartate) O-methyltransferase (Pcmt1), mRNA. 11/22Length = 1658 | |
| 1862 | 13283 | NM_013078 | b | *Rattus norvegicus* Ornithine carbamoyltransferase (Otc), mRNA. 11/2Length = 1519 | Ornithine carbamoyltransferase |
| 1863 | 1529 | NM_013082 | hh | *Rattus norvegicus* syndecan 2 (Sdc2), mRNA. 11/22Length = 2153 | Ryudocan/syndecan2 |
| 1864 | 20242 | NM_013084 | gg | *Rattus norvegicus* Acyl-Coenzyme A dehydrogenase, short-branched chain (Acadsb), mRNA. 11/2Length = 1322 | Acyl-Coenzyme A dehydrogenase, short-branched chain |
| 1865 | 20878 | NM_013085 | b | *Rattus norvegicus* Urinary plasminogen activator, urokinase(Plau), mRNA. 11/2Length = 1454 | Urinary plasminogen activator, urokinase |
| 1866 | 357 | NM_013086 | a, j, k, p, q, y, z, ee, ff | *Rattus norvegicus* CAMP responsive element modulator (Crem), mRNA. 11/2Length = 67 | CAMP responsive element modulator |
| 1867 | 8899 | NM_013087 | d, f | *Rattus norvegicus* CD81 antigen (target of antiproliferativeantibody 1) (Cd81), mRNA. 11/2Length= 133 | CD81 antigen (target of antiproliferative antibody 1) |
| 1868 | 1521 | NM_013091 | a, s, t, ee, ff, jj, kk | *Rattus norvegicus* Tumor necrosis factor receptor (Tnfr1), mRNA. 11/22Length = 213 | Tumor necrosis factor receptor superfamily, member 1a |
| 1869 | 1684 | NM_013096 | b, c, v | *Rattus norvegicus* Hemoglobin, alpha 1 (Hba1), mRNA. 11/2Length = 556 | Hemoglobin, alpha 1 |
| 1869 | 1685 | NM_013096 | b, c, v | *Rattus norvegicus* Hemoglobin, alpha 1 (Hba1), mRNA. 11/2Length = 556 | Hemoglobin, alpha 1 |
| 1869 | 1688 | NM_013096 | c | *Rattus norvegicus* Hemoglobin, alpha 1 (Hba1), mRNA. 11/2Length = 556 | Hemoglobin, alpha 1 |
| 1869 | 1689 | NM_013096 | b, c, v | *Rattus norvegicus* Hemoglobin, alpha 1 (Hba1), mRNA. 11/2Length = 556 | Hemoglobin, alpha 1 |
| 1869 | 26150 | NM_013096 | c, v | *Rattus norvegicus* Hemoglobin, alpha 1 (Hba1), mRNA. 11/2Length = 556 | |
| 1870 | 19949 | NM_013106 | l, m | *Rattus norvegicus* Guanine nucleotide binding, protein, alpha inhibiting polypeptide 3 (Gnai3), mRNA. 11/2Length = 372 | Guanine nucleotide binding, protein, alpha inhibiting polypeptide 3 |
| 1871 | 23709 | NM_013113 | f, g | *Rattus norvegicus* ATPase Na+/K+ transporting beta 1polypeptide (Atp1b1), mRNA. 11/2Length = 2528 | ATPase Na+/K+ transporting beta 1 polypeptide |
| 1871 | 23710 | NM_013113 | hh | *Rattus norvegicus* ATPase Na+/K+ transporting beta 1polypeptide (Atp1b1), mRNA. 11/2Length = 2528 | ATPase Na+/K+ transporting beta 1 polypeptide |

TABLE 1-continued

| SEQ ID | GLGC ID | GenBank Accession No. | Model Code | Known Gene Name | Unigene Sequence Cluster Title |
|---|---|---|---|---|---|
| 1872 | 38 | NM_013114 | aa, bb | *Rattus norvegicus* Selectin, platelet (Selp), mRNA. 11/22Length = 3185 | Selectin, platelet |
| 1873 | 7854 | NM_013115 | h, l | *Rattus norvegicus* Prostaglandin F receptor (Ptgfr), mRNA. 11/22Length = 3 | Prostaglandin F receptor |
| 1874 | 2005 | NM_013127 | e, bb | *Rattus norvegicus* CD38 antigen (ADP-ribosyl cyclase/cyclicADP-ribose hydrolase) (Cd38), mRNA. 11/2Length = 2248 | CD38 antigen (ADP-ribosyl cyclase/ cyclic ADP-ribose hydrolase) |
| 1875 | 21840 | NM_013128 | w, ll | *Rattus norvegicus* Carboxypeptidase E (Cpe), mRNA. 11/22Length = 292 | Carboxypeptidase E |
| 1876 | 16649 | NM_013132 | c, gg | *Rattus norvegicus* Annexin V (Anx5), mRNA. 11/22Length = 1417 | Annexin V |
| 1877 | 5837 | NM_013143 | cc, dd | *Rattus norvegicus* Meprin 1 alpha (Mep1a), mRNA. 11/22Length = 2928 | Meprin 1 alpha |
| 1878 | 786 | NM_013148 | n, o | *Rattus norvegicus* 5-hydroxytryptamine (serotonin) receptor 5A (Htr5a), mRNA. 11/22Length = 1954 | 5-hydroxytryptamine (serotonin) receptor 5A |
| 1879 | 46 | NM_013151 | p, q | *Rattus norvegicus* Plasminogen activator, tissue (Plat), mRNA. 11/22Length = 2445 | Plasminogen activator, tissue |
| 1880 | 21682 | NM_013154 | j, k, p, q, y, z, gg, kk | *Rattus norvegicus* CCAAT/enhancerbinding, protein (C/EBP) delta (Cebpd), mRNA. 11/2Length = 12 | CCAAT/enhancerbinding, protein (C/EBP) delta |
| 1880 | 21683 | NM_013154 | e, j, k, p, q, y, z, kk | *Rattus norvegicus* CCAAT/enhancerbinding, protein (C/EBP) delta (Cebpd), mRNA. 11/2Length = 12 | CCAAT/enhancerbinding, protein (C/EBP) delta |
| 1881 | 24867 | NM_013155 | kk | *Rattus norvegicus* Very low density lipoprotein receptor (Vldlr), mRNA. 11/22Length = 2952 | Very low density lipoprotein receptor |
| 1882 | 3430 | NM_013156 | c, l, m, t, kk | *Rattus norvegicus* Cathepsin L (Ctsl), mRNA. 11/22Length = 1386 | Cathepsin L |
| 1882 | 3431 | NM_013156 | c, kk | *Rattus norvegicus* Cathepsin L (Ctsl), mRNA. 11/22Length = 1386 | Cathepsin L |
| 1882 | 25567 | NM_013156 | j, k, t, kk | *Rattus norvegicus* Cathepsin L (Ctsl), mRNA. 11/22Length = 1386 | |
| 1883 | 1310 | NM_013159 | ll | *Rattus norvegicus* Insulin degrading enzyme (Ide), mRNA. 11/22Length = 4276 | Insulin degrading enzyme |
| 1884 | 3465 | NM_013160 | h, l | *Rattus norvegicus* Max interacting protein 1 (Mxi1), mRNA. 11/2Length = 922 | ESTs, Moderately similar to MXI1_RAT MAX interacting protein 1 (MXI1 protein) [*R.norvegicus*] |
| 1885 | 200 | NM_013161 | b, l, m | *Rattus norvegicus* Pancreatic lipase (Pnlip), mRNA. 11/22Length = 1492 | Pancreatic lipase |

TABLE 1-continued

| SEQ ID | GLGC ID | GenBank Accession No. | Model Code | Known Gene Name | Unigene Sequence Cluster Title |
|---|---|---|---|---|---|
| 1886 | 2012 | NM_013173 | r | *Rattus norvegicus* solute carrier family 11 member 2 (Slc11a2), mRNA. 1/22Length = 449 | Solute carrier family 11 member 2 (natural resistance-associated macrophage protein 2) |
| 1887 | 21722 | NM_013174 | jj, kk | *Rattus norvegicus* transforming growth factor, beta 3 (Tgfb3), mRNA. 11/22Length = 2633 | Transforming growth factor, beta 3 |
| 1887 | 21723 | NM_013174 | p, q | *Rattus norvegicus* transforming growth factor, beta 3 (Tgfb3), mRNA. 11/22Length = 2633 | Transforming growth factor, beta 3 |
| 1888 | 22306 | NM_013179 | aa, bb | *Rattus norvegicus* Hypocretin (orexin) neuropeptide precursor(Hcrt), mRNA. 11/2Length = 585 | Hypocretin (orexin) neuropeptide precursor |
| 1889 | 1314 | NM_013181 | f | *Rattus norvegicus* Protein kinase, cAMP dependent, regulatory, type 1 (Prkar1a), mRNA. 11/2Length = 1433 | Protein kinase, cAMP dependent, regulatory, type 1 |
| 1890 | 1258 | NM_013185 | hh | *Rattus norvegicus* Hemopoietic cell tyrosine kinase (Hck), mRNA. 11/2Length = 1911 | Hemopoietic cell tyrosine kinase |
| 1891 | 1714 | NM_013187 | a, kk | *Rattus norvegicus* Phospholipase C, gamma 1 (Plcg1), mRNA. 11/22Length = 516 | Phospholipase C, gamma 1 |
| 1892 | 1970 | NM_013194 | gg | *Rattus norvegicus* Myosin, heavy polypeptide 9, non-muscle(Myh9), mRNA. 11/22Length = 66 | Myosin, heavy polypeptide 9, non-muscle |
| 1893 | 20754 | NM_013195 | b | *Rattus norvegicus* Interleukin 2 receptor, beta chain (Il2rb), mRNA. 11/22Length = 2598 | Interleukin 2 receptor, beta chain |
| 1894 | 16448 | NM_013197 | b, c, v | *Rattus norvegicus* Aminolevulinate synthase 2, delta (Alas2), mRNA. 11/2Length = 1899 | Aminolevulinate synthase 2, delta |
| 1895 | 1693 | NM_013199 | gg | *Rattus norvegicus* Dynamin 2 (Dnm2), mRNA. 11/22Length = 3463 | Dynamin 2 |
| 1896 | 20855 | NM_013200 | a, w, x, hh | *Rattus norvegicus* Carnitine palmitoyltransferase 1, muscle (Cpt1b), mRNA. 11/22Length = 2826 | Carnitine palmitoyltransferase 1 beta, muscle isoform |
| 1896 | 20856 | NM_013200 | a, w, x, aa, hh, ll | *Rattus norvegicus* Carnitine palmitoyltransferase 1, muscle (Cpt1b), mRNA. 11/22Length = 2826 | Carnitine palmitoyltransferase 1 beta, muscle isoform |
| 1897 | 20864 | NM_013215 | b, l, m | *Rattus norvegicus* aflatoxin B1 aldehyde reductase (Afar), mRNA. 11/22Length = 1272 | aflatoxin B1 aldehyde reductase |
| 1898 | 23362 | NM_013216 | e | *Rattus norvegicus* Ras homolog enriched in brain (Rheb), mRNA. 11/2Length = 188 | Ras homolog enriched in brain |
| 1899 | 20728 | NM_013217 | cc, dd, ee, ff | *Rattus norvegicus* afadin (AF-6), mRNA. 11/2Length = 5957 | afadin |
| 1899 | 20729 | NM_013217 | jj, kk | *Rattus norvegicus* afadin (AF-6), mRNA. 11/2Length = 5957 | afadin |

TABLE 1-continued

| SEQ ID | GLGC ID | GenBank Accession No. | Model Code | Known Gene Name | Unigene Sequence Cluster Title |
|---|---|---|---|---|---|
| 1899 | 20731 | NM_013217 | gg | *Rattus norvegicus* afadin (AF-6), mRNA. 11/2Length = 5957 | afadin |
| 1899 | 20732 | NM_013217 | b, u, v | *Rattus norvegicus* afadin (AF-6), mRNA. 11/2Length = 5957 | afadin |
| 1900 | 18313 | NM_013220 | a, kk | *Rattus norvegicus* ankyrin-like repeat protein (Alrp), mRNA. 11/22Length = 1749 | cardiac ankyrin repeat protein |
| 1901 | 1495 | NM_013221 | y, z, aa, bb | *Rattus norvegicus* HMG-box containing protein 1 (Hbp1), mRNA. 11/22Length = 2642 | HMG-box containing protein 1 |
| 1902 | 1396 | NM_013222 | d | *Rattus norvegicus* growth factor, erv1-like (Gfer), mRNA. 11/22Length = 1226 | augmenter of liver regeneration |
| 1903 | 815 | NM_013224 | g, h, l, w, x | *Rattus norvegicus* ribosomal protein S26 (Rps26), mRNA. 11/22Length = 435 | ribosomal protein S26 |
| 1904 | 18305 | NM_013226 | f, h, l, w, x | *Rattus norvegicus* ribosomal protein L32 (Rpl32), mRNA. 11/22Length = 465 | |
| 1905 | 17972 | NM_016989 | l, m | *Rattus norvegicus* adenylate cyclase activating polypeptide 1 (Adcyap1), mRNA. 11/22Length = 2681 | adenylate cyclase activating polypeptide 1 |
| 1906 | 64 | NM_016991 | jj, kk | *Rattus norvegicus* adrenergic, alpha 1B, receptor (Adra1b), mRNA. 11/22Length = 218 | Adrenergic, alpha 1B-, receptor |
| 1907 | 24868 | NM_016992 | n, o | *Rattus norvegicus* arginine vasopressin (Avp), mRNA. 11/22Length = 62 | Arginine vasopressin (Diabetes insipidus) |
| 1907 | 24869 | NM_016992 | n, o | *Rattus norvegicus* arginine vasopressin (Avp), mRNA. 11/22Length = 62 | Arginine vasopressin (Diabetes insipidus) |
| 1908 | 24354 | NM_016998 | c | *Rattus norvegicus* Carboxypeptidase A1 (pancreatic) (Cpa1), mRNA. 11/2Length = 131 | Carboxypeptidase A1 (pancreatic) |
| 1909 | 20921 | NM_016999 | s, t | *Rattus norvegicus* Cytochrome P45, subfamily IVB, polypeptide1 (Cyp4b1), mRNA. 1/22Length = 192 | Cytochrome P450, subfamily IVB, polypeptide 1 |
| 1910 | 8417 | NM_017008 | aa | *Rattus norvegicus* Glyceraldehyde-3-phosphate dehydrogenase(Gapd), mRNA. 11/22Length = 1233 | Glyceraldehyde-3-phosphate dehydrogenase |
| 1911 | 24676 | NM_017010 | aa, bb | *Rattus norvegicus* Glutamate receptor, ionotropic, N-methyl D-aspartate 1 (Grin1), mRNA. 3/21Length = 4213 | Glutamate receptor, ionotropic, N-methyl D-aspartate 1 |
| 1912 | 21013 | NM_017014 | b | *Rattus norvegicus* Glutathione-S-transferase, mu type 2 (Yb2) (Gstm2), mRNA. 11/2Length = 155 | Glutathione-S-transferase, mu type 2 (Yb2) |

TABLE 1-continued

| SEQ ID | GLGC ID | GenBank Accession No. | Model Code | Known Gene Name | Unigene Sequence Cluster Title |
|---|---|---|---|---|---|
| 1913 | 17815 | NM_017015 | w, x | *Rattus norvegicus* Glucuronidase, beta (Gusb), mRNA. 11/22Length = 2472 | Glucuronidase, beta |
| 1914 | 6598 | NM_017020 | j, k | *Rattus norvegicus* Interleukin 6 receptor (Il6r), mRNA. 11/22Length = 4614 | Interleukin 6 receptor |
| 1915 | 17807 | NM_017025 | h, l | *Rattus norvegicus* Lactate dehydrogenase A (Ldha), mRNA. 11/22Length= 169 | Lactate dehydrogenase A |
| 1916 | 14247 | NM_017031 | h, l | *Rattus norvegicus* Phosphodiesterase 4B, cAMP-specific (dunce (*Drosophila*)-homolog phosphodiesterase E4) (Pde4b), mRNA. 4/22Length = 3133 | Phosphodiesterase 4B, cAMP-specific (dunce (*Drosophila*)-homolog phosphodiesterase E4) |
| 1917 | 4500 | NM_017037 | ii | *Rattus norvegicus* peripheral myelin protein 22 (Pmp22), mRNA. 11/22Length = 1816 | Peripheral myelin protein |
| 1918 | 3203 | NM_017039 | c | *Rattus norvegicus* Protein phosphatase 2 (formerly 2A), catalytic subunit, alpha isoform (Ppp2ca), mRNA. 11/22Length = 184 | Protein phosphatase 2 (formerly 2A), catalytic subunit, alpha isoform |
| 1919 | 24597 | NM_017040 | b, l, m, u, v | *Rattus norvegicus* Protein phosphatase 2 (formerly 2A), catalytic subunit, beta isoform (Ppp2cb), mRNA. 11/22Length = 1843 | Protein phosphatase 2 (formerly 2A), catalytic subunit, beta isoform |
| 1920 | 24697 | NM_017048 | u, v, ii | *Rattus norvegicus* Solute carrier family 4, member 2, anionexchange protein 2 (Slc4a2), mRNA. 11/2Length = 457 | Solute carrier family 4, member 2, anion exchange protein 2 |
| 1921 | 24695 | NM_017049 | c | *Rattus norvegicus* Solute carrier family 4, member 3, anionexchange protein 3 (Slc4a3), mRNA. 11/2Length = 3877 | Solute carrier family 4, member 3, anion exchange protein 3 |
| 1922 | 20875 | NM_017050 | hh | *Rattus norvegicus* Superoxide dismutase 1, soluble (Sod1), mRNA. 12/21Length = 65 | Superoxide dismutase 1, soluble |
| 1922 | 20876 | NM_017050 | r | *Rattus norvegicus* Superoxide dismutase 1, soluble (Sod1), mRNA. 12/21Length = 65 | Superoxide dismutase 1, soluble |
| 1923 | 1876 | NM_017052 | w, x | *Rattus norvegicus* Sorbitol dehydrogenase (Sord), mRNA. 11/22Length = 1358 | Sorbitol dehydrogenase |
| 1924 | 910 | NM_017059 | d | *Rattus norvegicus* bcl2-associated X protein (Bax), mRNA. 11/22Length = 579 | Bcl2-associated X protein |
| 1924 | 911 | NM_017059 | d | *Rattus norvegicus* bcl2-associated X protein (Bax), mRNA. 11/22Length = 579 | Bcl2-associated X protein |
| 1924 | 912 | NM_017059 | d, l, m | *Rattus norvegicus* bcl2-associated X protein (Bax), mRNA. 11/22Length = 579 | Bcl2-associated X protein |
| 1925 | 19549 | NM_017060 | h, l | *Rattus norvegicus* Hras-revertant gene 17 (Hrev17), mRNA. 1/22Length = 966 | ESTs |

TABLE 1-continued

| SEQ ID | GLGC ID | GenBank Accession No. | Model Code | Known Gene Name | Unigene Sequence Cluster Title |
|---|---|---|---|---|---|
| 1926 | 1942 | NM_017061 | f, ll | *Rattus norvegicus* lysyl oxidase (Lox), mRNA. 11/22Length = 4557 | Lysyl oxidase |
| 1926 | 1943 | NM_017061 | s, t | *Rattus norvegicus* lysyl oxidase (Lox), mRNA. 11/22Length = 4557 | Lysyl oxidase |
| 1927 | 1427 | NM_017063 | hh | *Rattus norvegicus* Importin beta (Impnb), mRNA. 11/2Length = 2991 | Importin beta |
| 1928 | 6653 | NM_017068 | d | *Rattus norvegicus* Lysosomal-associated membrane protein 2 (Lamp2), mRNA. 11/2Length = 1548 | Lysosomal-associated membrane protein 2 |
| 1928 | 6654 | NM_017068 | b, v | *Rattus norvegicus* Lysosomal-associated membrane protein 2 (Lamp2), mRNA. 11/2Length = 1548 | Lysosomal-associated membrane protein 2 |
| 1929 | 11152 | NM_017073 | c, s, t, kk | *Rattus norvegicus* Glutamine synthetase (glutamate-ammonialigase) (Glul), mRNA. 11/2Length = 2793 | Glutamine synthetase (glutamate-ammonia ligase) |
| 1929 | 11153 | NM_017073 | y, kk | *Rattus norvegicus* Glutamine synthetase (glutamate-ammonialigase) (Glul), mRNA. 11/2Length = 2793 | Glutamine synthetase (glutamate-ammonia ligase) |
| 1930 | 18956 | NM_017075 | aa | *Rattus norvegicus* Acetyl-Co A acetyltransferase 1, mitochondrial (Acat1), mRNA. 11/2Length = 1715 | Acetyl-Co A acetyltransferase 1, mitochondrial |
| 1930 | 18957 | NM_017075 | r, s, t, ll | *Rattus norvegicus* Acetyl-Co A acetyltransferase 1, mitochondrial (Acat1), mRNA. 11/2Length = 1715 | Acetyl-Co A acetyltransferase 1, mitochondrial |
| 1931 | 923 | NM_017076 | a, p, q, y, z, ee, ff | *Rattus norvegicus* Tumor-associated glycoprotein pE4 (Tage4), mRNA. 11/2Length = 2171 | Tumor-associated glycoprotein pE4 |
| 1932 | 1523 | NM_017079 | h, l, n, o, w, x | *Rattus norvegicus* CD1D antigen (Cd1d), mRNA. 11/2Length= 1835 | CD1D antigen |
| 1933 | 22552 | NM_017087 | n, o | *Rattus norvegicus* biglycan (Bgn), mRNA. 11/22Length = 2446 | Small proteoglycan I (biglycan), bone (BSPG1) (bone/cartilage proteclycan 1 precursor) |
| 1934 | 1383 | NM_017088 | ll | *Rattus norvegicus* GDP-dissociation inhibitor 1 (Gdi1), mRNA. 11/2Length = = 139 | GDP-dissociation inhibitor 1 |
| 1935 | 23665 | NM_017092 | u, v | *Rattus norvegicus* Bruton agammaglobulinemia tyrosine kinase (Tyro3), mRNA. 12/2Length = 3726 | Bruton agammaglobulinemia tyrosine kinase |
| 1936 | 10886 | NM_017094 | ii | *Rattus norvegicus* growth hormone receptor (Ghr), mRNA. 11/22Length = 295 | Growth hormone receptor |
| 1936 | 10887 | NM_017094 | jj, kk | *Rattus norvegicus* growth hormone receptor (Ghr), mRNA. 11/22Length = 295 | Growth hormone receptor |
| 1936 | 10888 | NM_017094 | e, r, hh | *Rattus norvegicus* growth hormone receptor (Ghr), mRNA. 11/22Length = 295 | Growth hormone receptor |
| 1937 | 2150 | NM_017097 | a, ll | *Rattus norvegicus* Cathepsin C (dipeptidyl | Cathepsin C (dipeptidyl peptidase I) |

TABLE 1-continued

| SEQ ID | GLGC ID | GenBank Accession No. | Model Code | Known Gene Name | Unigene Sequence Cluster Title |
|---|---|---|---|---|---|
| | | | | peptidase I) (Ctsc), mRNA. 11/2Length = 185 | |
| 1938 | 15517 | NM_017099 | c | *Rattus norvegicus* potassium inwardly-rectifying channel, subfamily J, member 8 (Kcnj8), mRNA. 11/22Length = 158 | Inwardly rectifying potassium channel gene, subfamily J-8 (ATP sensitive) |
| 1939 | 4391 | NM_017101 | s, t | *Rattus norvegicus* Peptidylprolyl isomerase A (cyclophilin A)(Ppia), mRNA. 11/22Length = 743 | Peptidylprolyl isomerase A (cyclophilin A) |
| 1940 | 15776 | NM_017108 | u, v | *Rattus norvegicus* potassium voltage-gated channel, subfamily H (eag-related), member 3 (Kcnh3), mRNA. 11/22Length = 3715 | potassium voltage-gated channel, subfamily H (eag-related), member 3 |
| 1941 | 20745 | NM_017113 | f, g | *Rattus norvegicus* granulin (Grn), mRNA. 11/22Length = 2113 | granulin |
| 1941 | 20746 | NM_017113 | j, cc, dd, gg | *Rattus norvegicus* granulin (Grn), mRNA. 11/22Length = 2113 | granulin |
| 1942 | 1375 | NM_017122 | n, o | *Rattus norvegicus* hippocalcin (Hpca), mRNA. 11/22Length = 1561 | hippocalcin |
| 1943 | 1435 | NM_017125 | kk | *Rattus norvegicus* CD63 antigen (Cd63), mRNA. 11/22Length = 86 | Cd63 antigen |
| 1944 | 21662 | NM_017126 | a, ee, ff | *Rattus norvegicus* ferredoxin 1 (Fdx1), mRNA. 11/22Length = 838 | ferredoxin 1 |
| 1944 | 21663 | NM_017126 | a, h, l, p, q, y, z, ee, ff | *Rattus norvegicus* ferredoxin 1 (Fdx1), mRNA. 11/22Length = 838 | ferredoxin 1 |
| 1945 | 24522 | NM_017130 | u, v | *Rattus norvegicus* neuraminidase 2 (Neu2), mRNA. 11/22Length = 166 | neuraminidase 2 |
| 1946 | 167 | NM_017131 | b, e, u, v, ll | *Rattus norvegicus* calsequestrin 2 (Casq2), mRNA. 11/22Length = 1681 | calsequestrin 2 |
| 1947 | 20916 | NM_017132 | d | *Rattus norvegicus* reticulocalbin 2 (Rcn2), mRNA. 11/22Length = 219 | reticulocalbin 2 |
| 1948 | 16681 | NM_017136 | ii | *Rattus norvegicus* squalene epoxidase (Sqle), mRNA. 11/22Length = 2199 | squalene epoxidase |
| 1949 | 24885 | NM_017138 | h, l, w, x | *Rattus norvegicus* laminin receptor 1 (67kD, ribosomal protein SA) (Lamr1), mRNA. 11/22Length = 118 | laminin receptor 1 |
| 1949 | 24886 | NM_017138 | h, l, w, x | *Rattus norvegicus* laminin receptor 1 (67 kD, ribosomal protein SA) (Lamr1), mRNA. 11/22Length = 118 | laminin receptor 1 |
| 1950 | 492 | NM_017140 | l, m, n, aa | *Rattus norvegicus* dopamine receptor D3 (Drd3), mRNA. 11/22Length = 1481 | dopamine receptor 3 |
| 1951 | 24106 | NM_017141 | s, t, bb | *Rattus norvegicus* DNA polymerase beta (Polb), mRNA. 11/22Length = 3298 | DNA polymerase beta |

TABLE 1-continued

| SEQ ID | GLGC ID | GenBank Accession No. | Model Code | Known Gene Name | Unigene Sequence Cluster Title |
|---|---|---|---|---|---|
| 1951 | 24107 | NM_017141 | ll | *Rattus norvegicus* DNA polymerase beta (Po1b), mRNA. 11/22Length = 3298 | DNA polymerase beta |
| 1952 | 15364 | NM_017147 | ii | *Rattus norvegicus* cofilin 1 (Cfl1), mRNA. 11/22Length = 139 | cofilin 1, non-muscle |
| 1952 | 15365 | NM_017147 | aa, bb, ll | *Rattus norvegicus* cofilin 1 (Cfl1), mRNA. 11/22Length = 139 | cofilin 1, non-muscle |
| 1953 | 13392 | NM_017148 | e | *Rattus norvegicus* cysteine rich protein 1 (Csrp1), mRNA. 1/22Length = 143 | cysteine rich protein 1 |
| 1954 | 17287 | NM_017149 | ii | *Rattus norvegicus* mesenchyme homeo box 2 (Meox2), mRNA. 11/22Length = 2244 | mesenchyme homeobox 2 |
| 1955 | 16953 | NM_017151 | g | *Rattus norvegicus* ribosomal protein S15 (Rps15), mRNA. 11/22Length = 487 | ribosomal protein S15 |
| 1955 | 16954 | NM_017151 | gg | *Rattus norvegicus* ribosomal protein S15 (Rps15), mRNA. 11/22Length = 487 | ribosomal protein S15 |
| 1955 | 16955 | NM_017151 | l, m, s, t | *Rattus norvegicus* ribosomal protein S15 (Rps15), mRNA. 11/22Length = 487 | ribosomal protein S15 |
| 1956 | 21975 | NM_017154 | d, e, j, k, n, o, y, z, kk | *Rattus norvegicus* xanthine dehydrogenase (Xdh), mRNA. 11/22Length = 4198 | xanthine dehydrogenase |
| 1957 | 17104 | NM_017160 | h, l | *Rattus norvegicus* ribosomal protein S6 (Rps6), mRNA. 11/22Length = 81 | ribosomal protein S6 |
| 1957 | 17105 | NM_017160 | h, l | *Rattus norvegicus* ribosomal protein S6 (Rps6), mRNA. 11/22Length = 81 | ribosomal protein S6 |
| 1957 | 17106 | NM_017160 | n, o | *Rattus norvegicus* ribosomal protein S6 (Rps6), mRNA. 11/22Length = 81 | ribosomal protein S6 |
| 1958 | 17686 | NM_017165 | hh | *Rattus norvegicus* glutathione peroxidase 4 (Gpx4), mRNA. 11/22Length = 872 | glutathione peroxidase 4 |
| 1959 | 20702 | NM_017166 | j, k, y, z | *Rattus norvegicus* stathmin 1 (Stmn1), mRNA. 11/22Length = 154 | Leukemia-associated cytosolic phosphoprotein stathmin |
| 1960 | 20919 | NM_017172 | a | *Rattus norvegicus* zinc finger protein 36, C3H type-like 1 (Zfp36l1), mRNA. 5/22Length = 2741 | zinc finger protein 36, C3H type-like 1 |
| 1961 | 17301 | NM_017173 | c, f, g, j, k, y, z | *Rattus norvegicus* serine (or cysteine) proteinaseinhibitor, clade H, member 1 (Serpinh1), mRNA. 11/22Length = 263 | serine proteinase inhibitor, clade H (heat shock protein 47), member 1 |
| 1962 | 9378 | NM_017174 | jj, kk | *Rattus norvegicus* phospholipase A2, group 5 (Pla2g5), mRNA. 11/22Length = 183 | phospholipase A2, group V |
| 1963 | 19031 | NM_017180 | p, q | *Rattus norvegicus* T-cell death associated gene (Tdag), mRNA. 11/22Length = 1353 | T-cell death associated gene |

TABLE 1-continued

| SEQ ID | GLGC ID | GenBank Accession No. | Model Code | Known Gene Name | Unigene Sequence Cluster Title |
|---|---|---|---|---|---|
| 1964 | 1488 | NM_017182 | h | *Rattus norvegicus* H2A histone family, member Y (H2afy), mRNA. 1/22Length= 157 | H2A histone family, member Y |
| 1965 | 5676 | NM_017188 | ee, ff | *Rattus norvegicus* UNC-119 homolog (*C. elegans*) (Uncl19), mRNA. 11/22Length = 1264 | UNC-119 homolog (*C. elegans*) |
| 1966 | 9124 | NM_017199 | h, l, hh | *Rattus norvegicus* signal sequence receptor 4 (Ssr4), mRNA. 11/22Length = 757 | signal sequence receptor, delta |
| 1967 | 20779 | NM_017201 | b, l, m | *Rattus norvegicus* 5-adenosylhomocysteine hydrolase (Ahcy), mRNA. 11/22Length = 229 | S-adenosylhomocysteine hydrolase |
| 1968 | 14694 | NM_017202 | aa | *Rattus norvegicus* cytochrome c oxidase, subunit 4a (Cox4a), mRNA. 11/22Length = 696 | cytochrome c oxidase, subunit IVa |
| 1969 | 24859 | NM_017206 | h, l | *Rattus norvegicus* solute carrier family 6, member 6 (Slc6a6), mRNA. 11/22Length = 2489 | Solute carrier 6, member 6 (taurine transporter) |
| 1970 | 13938 | NM_017212 | jj, kk | *Rattus norvegicus* microtubule-associated protein tau (Mapt), mRNA. 11/22Length = 524 | microtubule-associated protein tau |
| 1970 | 13940 | NM_017212 | a | *Rattus norvegicus* microtubule-associated protein tau (Mapt), mRNA. 11/22Length = 524 | microtubule-associated protein tau |
| 1971 | 1527 | NM_017220 | ee, ff | *Rattus norvegicus* 6-pyruvoyl-tetrahydropterin synthase (Pts), mRNA. 11/22Length = 1176 | 6-pyruvoyl-tetrahydropterin synthase |
| 1971 | 20632 | NM_017220 | aa, bb | *Rattus norvegicus* 6-pyruvoyl-tetrahydropterin synthase (Pts), mRNA. 11/22Length= 1176 | ESTs |
| 1971 | 19928 | NM_017220 | l, m | *Rattus norvegicus* 6-pyruvoyl-tetrahydropterin synthase (Pts), mRNA. 11/22Length= 1176 | ESTs |
| 1972 | 11989 | NM_017222 | hh | *Rattus norvegicus* solute carrier family 1, member 2 (Slc1a2), mRNA. 11/22Length = 4269 | ESTs |
| 1972 | 18967 | NM_017222 | r | *Rattus norvegicus* solute carrier family 1, member 2 (Slc1a2), mRNA. 11/22Length = 4269 | ESTs |
| 1973 | 1510 | NM_017224 | ll | *Rattus norvegicus* solute carrier family 22 (organic anion transporter), member 6 (Slc22a6), mRNA. 1/22Length = 2227 | solute carrier family 22 (organic anion transporter), member 6 |
| 1974 | 15108 | NM_017226 | u, v | *Rattus norvegicus* peptidyl arginine deiminase, type 2 (Pdi2), mRNA. 11/22Length = 457 | ESTs, Highly similar to RS18_HUMAN 40S ribosomal protein S18 (KE-3) (KE3) [*R.norvegicus*], peptidyl arginine deiminase, type II |
| 1974 | 18148 | NM_017226 | n, o | *Rattus norvegicus* peptidyl arginine deiminase, type 2 (Pdi2), mRNA. 11/22Length = 457 | peptidyl arginine deiminase, type II |
| 1975 | 24598 | NM_017231 | hh | *Rattus norvegicus* phosphatidylinositol transfer protein (Pitpn), mRNA. 11/22Length = 1638 | phosphatidylinositol transfer protein |

TABLE 1-continued

| SEQ ID | GLGC ID | GenBank Accession No. | Model Code | Known Gene Name | Unigene Sequence Cluster Title |
|---|---|---|---|---|---|
| 1976 | 20193 | NM_017232 | p, q | *Rattus norvegicus* prostaglandin-endoperoxide synthase 2 (Ptgs2), mRNA. 11/22Length = 444 | prostaglandin-endoperoxide synthase 2 |
| 1977 | 15598 | NM_017236 | ii | *Rattus norvegicus* phosphatidylethanolamine binding protein (Pbp), mRNA. 11/22Length = 175 | phosphatidylethanolamine binding protein |
| 1978 | 1498 | NM_017239 | d | *Rattus norvegicus* myosin heavy chain, polypeptide 6 (Myh6), mRNA. 11/22Length = 593 | myosin heavy chain, polypeptide 6, cardiac muscle, alpha |
| 1978 | 1497 | NM_017239 | d | *Rattus norvegicus* myosin heavy chain, polypeptide 6 (Myh6), mRNA. 11/22Length = 593 | myosin heavy chain, polypeptide 6, cardiac muscle, alpha |
| 1979 | 20482 | NM_017240 | c, g | *Rattus norvegicus* myosin heavy chain, polypeptide 7 (Myh7), mRNA. 11/22Length = 5925 | myosin heavy chain, cardiac muscle, fetal |
| 1979 | 20483 | NM_017240 | d | *Rattus norvegicus* myosin heavy chain, polypeptide 7 (Myh7), mRNA. 11/22Length = 5925 | myosin heavy chain, cardiac muscle, fetal |
| 1979 | 20484 | NM_017240 | e | *Rattus norvegicus* myosin heavy chain, polypeptide 7 (Myh7), mRNA. 11/22Length = 5925 | myosin heavy chain, cardiac muscle, fetal |
| 1979 | 3780 | NM_017240 | c, g | *Rattus norvegicus* myosin heavy chain, polypeptide 7 (Myh7), mRNA. 11/22Length = 5925 | EST |
| 1980 | 17561 | NM_017245 | l, m | *Rattus norvegicus* eukaryotic translation elongation factor 2(Eef2), mRNA. 11/22Length = 2626 | eukaryotic translation elongation factor 2 |
| 1980 | 17563 | NM_017245 | h, l | *Rattus norvegicus* eukaryotic translation elongation factor 2(Eef2), mRNA. 11/22Length = 2626 | eukaryotic translation elongation factor 2 |
| 1981 | 17501 | NM_017248 | l, m | *Rattus norvegicus* heterogeneous nuclear ribonucleoprotein A1(Hnrpa1), mRNA. 11/22Length= 1696 | heterogeneous nuclear ribonucleoprotein A1 |
| 1981 | 17502 | NM_017248 | l, m | *Rattus norvegicus* heterogeneous nuclear ribonucleoprotein A1(Hnrpa1), mRNA. 11/22Length = 1696 | heterogeneous nuclear ribonucleoprotein A1 |
| 1982 | 16601 | NM_017252 | s, t | *Rattus norvegicus* POU domain, class 3, transcription factor 4(Pou3f4), mRNA. 11/22Length= 125 | POU domain, class 3, transcription factor 4 |
| 1983 | 1496 | NM_017255 | aa, bb | *Rattus norvegicus* purinergic receptor P2Y, G-protein coupled 2 (P2ry2), mRNA. 11/22Length = 211 | purinergic receptor P2Y, G-protein coupled2 |
| 1984 | 19 | NM_017258 | p, q | *Rattus norvegicus* B-cell translocation gene 1 (Btg1), mRNA. 11/22Length = 1464 | B-cell translocation gene 1, anti-proliferative |

TABLE 1-continued

| SEQ ID | GLGC ID | GenBank Accession No. | Model Code | Known Gene Name | Unigene Sequence Cluster Title |
|---|---|---|---|---|---|
| 1985 | 15300 | NM_017259 | p, q, kk | *Rattus norvegicus* B-cell translocation gene 2 (Btg2), mRNA. 11/22Length = 2519 | Early induced gene, B-cell translocation gene 2 |
| 1985 | 15301 | NM_017259 | j, k, p, q, y, z, gg | *Rattus norvegicus* B-cell translocation gene 2 (Btg2), mRNA. 11/22Length = 2519 | Early induced gene, B-cell translocation gene 2 |
| 1985 | 15299 | NM_017259 | y, z | *Rattus norvegicus* B-cell translocation gene 2 (Btg 2), mRNA. 11/22Length = 2519 | Early induced gene, B-cell translocation gene2 |
| 1986 | 7593 | NM_017260 | w, x | *Rattus norvegicus* arachidonate 5-lipoxygenase activating protein (Alox5ap), mRNA. 11/22Length = 54 | Arachidonate 5-lipoxygenase activating protein |
| 1986 | 7594 | NM_017260 | w, x, ii | *Rattus norvegicus* arachidonate 5-lipoxygenase activating protein (Alox5ap), mRNA. 11/22Length = 54 | Arachidonate 5-lipoxygenase activating protein |
| 1987 | 20600 | NM_017268 | ii | *Rattus norvegicus* 3-hydroxy-3-methylglutaryl-Coenzyme Asynthase 1 (Hmgcs1), mRNA. 11/22Length = 3275 | 3-hydroxy-3-methylglutaryl-Coenzyme A synthase 1 |
| 1987 | 20601 | NM_017268 | r | *Rattus norvegicus* 3-hydroxy-3-methylglutaryl-Coenzyme Asynthase 1 (Hmgcs1), mRNA. 11/22Length = 3275 | 3-hydroxy-3-methylglutaryl-Coenzyme A synthase 1 |
| 1988 | 20913 | NM_017272 | n, o | *Rattus norvegicus* aldehyde dehydrogenase family 1, subfamily A4 (Aldh1a4), mRNA. 11/22Length = 224 | aldehyde dehydrogenase family 1, subfamily A4 |
| 1989 | 20281 | NM_017274 | gg | *Rattus norvegicus* glycerol-3-phosphate acyltransferase, mitochondrial (Gpam), mRNA. 11/22Length = 2646 | glycerol-3-phosphate acyltransferase, mitochondrial |
| 1990 | 17959 | NM_017277 | s, t | *Rattus norvegicus* adaptor protein complex AP-1, beta 1 subunit (Ap1b1), mRNA. 11/22Length = 3679 | Adaptor protein complex AP-1, beta 1 subunit |
| 1991 | 15142 | NM_017278 | l, m | *Rattus norvegicus* proteasome (prosome, macropain) subunit, alpha type 1 (Psma1), mRNA. 11/22Length = 1174 | proteasome (prosome, macropain) subunit, alpha type 1 |
| 1992 | 15538 | NM_017283 | r | *Rattus norvegicus* proteasome (prosome, macropain) subunit, alpha type 6 (Psma6), mRNA. 11/22Length = 932 | proteasome (prosome, macropain) subunit, alpha type 6 |
| 1993 | 20579 | NM_017288 | aa, bb | *Rattus norvegicus* sodium channel, voltage-gated, type 1, beta polypeptide (Scn1b), mRNA. 11/22Length = 149 | sodium channel, voltage-gated, type I, beta polypeptide |
| 1994 | 12347 | NM_017290 | ll | *Rattus norvegicus* ATPase, Ca++ transporting, cardiac *muscle, slow twitch 2* (Atp2a2), mRNA. 11/22Length = 5648 | ATPase, Ca++ transporting, cardiac muscle, slow twitch 2 |

TABLE 1-continued

| SEQ ID | GLGC ID | GenBank Accession No. | Model Code | Known Gene Name | Unigene Sequence Cluster Title |
|---|---|---|---|---|---|
| 1994 | 12349 | NM_017290 | aa | *Rattus norvegicus* ATPase, Ca++ transporting, cardiac muscle, slow twitch 2 (Atp2a2), mRNA. 11/22Length = 5648 | ATPase, Ca++ transporting, cardiac muscle, slow twitch 2 |
| 1995 | 82 | NM_017297 | ii | *Rattus norvegicus* potassium inwardly-rectifying channel, subfamily J, member 5 (Kcnj5), mRNA. 1/22Length = 3156 | potassium inwardly-rectifying channel, subfamily J, member 5 |
| 1996 | 23825 | NM_017299 | cc, dd | *Rattus norvegicus* solute carrier family 19, member 1 (Slc19a1), mRNA. 11/22Length = 242 | solute carrier family 19 (sodium/hydrogen exchanger), member 1 |
| 1997 | 1028 | NM_017304 | ii | *Rattus norvegicus* potassium voltage gated channel, shakerrelated subfamily, beta member 2 (Kcnab2), mRNA. 11/22Length = 17 | potassium voltage gated channel, shaker related subfamily, beta member 2 |
| 1998 | 14004 | NM_017305 | aa, bb | *Rattus norvegicus* Glutamate-cysteine ligase (gamma-glutamylcysteine synthetase), regulatory (Glclr), mRNA. 11/22Length= 1382 | glutamate-cysteine ligase, modifier subunit |
| 1999 | 18687 | NM_017306 | hh | *Rattus norvegicus* dodecenoyl-coenzyme A delta isomerase (Dci), mRNA. 11/22Length = 987 | Rat mRNA for delta3, delta2-enoyl-CoA isomerase, dodecenoyl-Coenzyme A delta isomerase (3,2 trans-enoyl-Coenyme A isomerase) |
| 2000 | 16844 | NM_017311 | n, o | *Rattus norvegicus* ATP synthase, H+ transporting, mitochondrial F complex, subunit c, isoform 1 (Atp5g1), mRNA. 11/22Length = 561 | ATP synthase, H+ transporting, mitochondrial FO complex, subunit c (subunit 9), isoform 1 |
| 2001 | 1904 | NM_017315 | u, v | *Rattus norvegicus* sodium-coupled ascorbic acid transporter 1 (SVCT1), mRNA. 11/2Length = 2472 | Rat VL30 element mRNA |
| 2002 | 1894 | NM_017320 | b, l, m, kk | *Rattus norvegicus* cathepsin S (Ctss), mRNA. 8/22Length = 133 | cathepsin S |
| 2003 | 24533 | NM_017328 | n, o | *Rattus norvegicus* phosphoglycerate mutase 2 (Pgam2), mRNA. 11/22Length = 798 | Phosphoglycerate mutase 2 |
| 2004 | 24248 | NM_017332 | e, gg | *Rattus norvegicus* fatty acid synthase (Fasn), mRNA. 11/22Length = 9136 | fatty acid synthase |
| 2005 | 355 | NM_017334 | a, j, k, p, q, y, z, ee, ff | *Rattus norvegicus* CAMP responsive element modulator (Crem), mRNA. 1/22Length = 436 | CAMP responsive element modulator |
| 2005 | 356 | NM_017334 | a, j, k, p, q, kk | *Rattus norvegicus* CAMP responsive element modulator (Crem), mRNA. 1/22Length = 436 | CAMP responsive element modulator |
| 2006 | 16382 | NM_017343 | cc, dd | *Rattus norvegicus* myosin regulatory light chain (MRLCB), mRNA. 6/21Length = 1139 | myosin regulatory light chain |
| 2006 | 20848 | NM_017343 | bb, hh, jj, kk | *Rattus norvegicus* myosin regulatory light chain (MRLCB), mRNA. 6/21Length = 1139 | Rat mRNA for myosin regulatory light chain (RLC) |

TABLE 1-continued

| SEQ ID | GLGC ID | GenBank Accession No. | Model Code | Known Gene Name | Unigene Sequence Cluster Title |
|---|---|---|---|---|---|
| 2006 | 20849 | NM_017343 | gg | *Rattus norvegicus* myosin regulatory light chain (MRLCB), mRNA. 6/21Length = 1139 | Rat mRNA for myosin regulatory light chain (RLC) |
| 2007 | 17782 | NM_017344 | e | *Rattus norvegicus* glycogen synthase kinase 3 alpha (Gsk3a), mRNA. 11/22Length = 2155 | glycogen synthase kinase 3 alpha |
| 2008 | 15037 | NM_017347 | e, r | *Rattus norvegicus* mitogen activated protein kinase 3 (Mapk3), mRNA. 11/22Length = 1238 | mitogen activated protein kinase 3 |
| 2009 | 468 | NM_017348 | w, x | *Rattus norvegicus* choline transporter (CHOT1), mRNA. 11/2Length = 3972 | choline transporter |
| 2010 | 24428 | NM_017356 | ll | *Rattus norvegicus* neural visinin-like Ca2+-binding protein type3 (NVP-3), mRNA. 11/2Length = 115 | neural visinin-like Ca2+-binding protein type 3 |
| 2011 | 17202 | NM_017357 | gg | *Rattus norvegicus* neural visinin-like Ca2+-binding protein type2 (NVP-2), mRNA. 11/2Length = 663 | neural visinin-like Ca2+-binding protein type2 |
| 2012 | 20417 | NM_017359 | h, l, hh | *Rattus norvegicus* ras-related protein rab1 (Rab1), mRNA. 11/2Length = 991 | ras-related protein rab10 |
| 2013 | 20232 | NM_017364 | u, v | *Rattus norvegicus* Pancreas zinc finger protein, see alsoD1Bda1\2 (Znf146), mRNA. 5/22Length = 1578 | Pancreas zinc finger protein, see also D1Bda10\2 |
| 2014 | 1581 | NM_017365 | l, p, q, s, t | *Rattus norvegicus* PDZ and LIM domain 1 (Pdlim1), mRNA. 11/22Length = 1392 | PDZ and LIM domain 1 (elfin) |
| 2015 | 20536 | NM_019122 | b, l, m, u, v | *Rattus norvegicus* Synaptotagmin 3 (Syt3), mRNA. 11/22Length = 296 | Synaptotagmin 3 |
| 2016 | 20778 | NM_019124 | ll | *Rattus norvegicus* rabaptin 5 (LOC5419), mRNA. 11/22Length = 3465 | rabaptin 5 |
| 2017 | 20318 | NM_019127 | n, o | *Rattus norvegicus* interferon, beta 1, fibroblast (Ifnb1), mRNA. 11/22Length = 555 | Interferon, beta 1, fibroblast |
| 2018 | 455 | NM_019131 | b, u, v | *Rattus norvegicus* tropomyosin 1, alpha (Tpm1), mRNA. 11/22Length = 14 | Tropomyosin 1 (alpha) |
| 2018 | 461 | NM_019131 | b, l, m | *Rattus norvegicus* tropomyosin 1, alpha (Tpm1), mRNA. 11/22Length = 14 | Tropomyosin 1 (alpha) |
| 2019 | 15975 | NM_019132 | ii | *Rattus norvegicus* Guanine nucleotide-binding protein G-s, alphasubunit, Genbank no U51565 (Gnas), mRNA. 11/22Length = 1738 | Guanine nucleotide-binding protein G-s, alpha subunit |
| 2020 | 16227 | NM_019137 | l, m | *Rattus norvegicus* early growth response 4 (Egr4), mRNA. 11/22Length = 2145 | Zinc-finger transcription factor NGFI-C (early response gene) |
| 2021 | 14973 | NM_019140 | aa | *Rattus norvegicus* protein tyrosine phosphatase, receptor type, D (Ptprd), mRNA. 11/22Length = 6469 | Protein tyrosine phosphatase, receptor type, D |

TABLE 1-continued

| SEQ ID | GLGC ID | GenBank Accession No. | Model Code | Known Gene Name | Unigene Sequence Cluster Title |
|---|---|---|---|---|---|
| 2022 | 5618 | NM_019143 | s, t | *Rattus norvegicus* Fibronectin 1 (Fn1), mRNA. 11/22Length = 8329 | Fibronectin 1 |
| 2022 | 5622 | NM_019143 | n, o | *Rattus norvegicus* Fibronectin 1 (Fn1), mRNA. 11/22Length = 8329 | Fibronectin 1 |
| 2023 | 278 | NM_019150 | aa, bb | *Rattus norvegicus* urocortin (Ucn), mRNA. 11/22Length = 579 | urocortin |
| 2024 | 20863 | NM_019152 | cc, dd | *Rattus norvegicus* calpain 1 (Capn1), mRNA. 11/22Length = 2917 | calpain 1 |
| 2025 | 6451 | NM_019153 | f, g | *Rattus norvegicus* fibulin 5 (Fbln5), mRNA. 11/22Length = 234 | fibulin 5 |
| 2026 | 24362 | NM_019156 | jj, kk | *Rattus norvegicus* vitronectin (Vtn), mRNA. 11/22Length = 1588 | vitronectin |
| 2027 | 20440 | NM_019166 | b, l, m | *Rattus norvegicus* synaptogyrin 1 (Syngr1), mRNA. 11/22Length = 879 | synaptogyrin 1 |
| 2028 | 7486 | NM_019169 | n, o | *Rattus norvegicus* synuclein, alpha (Snca), mRNA. 11/22Length = 118 | synuclein, alpha |
| 2029 | 17063 | NM_019170 | f, g | *Rattus norvegicus* carbonyl reductase 1 (Cbr1), mRNA. 11/22Length = 118 | carbonyl reductase 1 |
| 2029 | 17064 | NM_019170 | f, g | *Rattus norvegicus* carbonyl reductase 1 (Cbr1), mRNA. 11/22Length = 118 | carbonyl reductase 1 |
| 2029 | 17066 | NM_019170 | g | *Rattus norvegicus* carbonyl reductase 1 (Cbr1), mRNA. 11/22Length = 118 | carbonyl reductase 1 |
| 2030 | 1174 | NM_019184 | c | *Rattus norvegicus* Cytochrome P45, subfamily IIC (mephenytoin 4-hydroxylase) (Cyp2c), mRNA. 11/22Length = 1856 | Cytochrome P450, subfamily IIC (mephenytoin 4-hydroxylase) |
| 2031 | 23481 | NM_019185 | aa, bb | *Rattus norvegicus* GATA-binding protein 6 (Gata6), mRNA. 3/21Length = 1844 | GATA-binding protein 6 |
| 2032 | 24019 | NM_019186 | j, k | *Rattus norvegicus* ADP-ribosylation-like 4 (Arl4), mRNA. 11/22Length = 167 | ADP-ribosylation-like4 |
| 2033 | 15244 | NM_019191 | ll | *Rattus norvegicus* MAD homolog 2 (*Drosophila*) (Madh2), mRNA. 11/22Length = 2113 | MAD homolog 2 (*Drosophila*) |
| 2034 | 21421 | NM_019196 | ll | *Rattus norvegicus* multiple PDZ domain protein (Mpdz), mRNA. 11/22Length = 7516 | multiple PDZ domain protein |
| 2035 | 18572 | NM_019201 | n, o | *Rattus norvegicus* C-terminal binding protein 1 (Ctbp1), mRNA. 11/22Length = 243 | C-terminal binding protein 1 |
| 2035 | 18573 | NM_019201 | f, g | *Rattus norvegicus* C-terminal binding protein 1 (Ctbp1), mRNA. 11/22Length = 243 | C-terminal binding protein 1 |

TABLE 1-continued

| SEQ ID | GLGC ID | GenBank Accession No. | Model Code | Known Gene Name | Unigene Sequence Cluster Title |
|---|---|---|---|---|---|
| 2036 | 21508 | NM_019208 | ii | *Rattus norvegicus* multiple endocrine neoplasia 1 (Men1), mRNA. 11/22Length = 367 | multiple endocrine neoplasia 1 |
| 2037 | 18569 | NM_019212 | f, w, x, hh | *Rattus norvegicus* actin alpha 1 (Acta1), mRNA. 1/22Length = 1134 | actin, alpha 1, skeletal muscle |
| 2038 | 2632 | NM_019213 | cc, dd | *Rattus norvegicus* jumping translocation breakpoint (Jtb), mRNA. 11/22Length = 897 | jumping translocation breakpoint |
| 2039 | 2079 | NM_019220 | c | *Rattus norvegicus* amino-terminal enhancer of split (Aes), mRNA. 1/22Length = 1356 | amino-terminal enhancer of split |
| 2040 | 15347 | NM_019222 | ll | *Rattus norvegicus* coronin, actin-binding protein, 1B(Coro1b), mRNA. 11/22Length = 18 | coronin, actin binding protein 1B |
| 2041 | 20938 | NM_019223 | hh | *Rattus norvegicus* NADH dehydrogenase Fe—S protein 6 (Ndufs6), mRNA. 11/22Length = 351 | NADH dehydrogenase Fe—S protein 6 |
| 2042 | 20433 | NM_019232 | p, q, kk | *Rattus norvegicus* serum/glucocorticoid regulated kinase (Sgk), mRNA. 11/22Length = 2435 | serum/glucocorticoid regulated kinase |
| 2043 | 15503 | NM_019237 | n, o | *Rattus norvegicus* procollagen C-proteinase enhancer protein(Pcolce), mRNA. 11/22Length = 1547 | procollagen C-proteinase enhancer protein |
| 2044 | 17908 | NM_019242 | a, p, q, y, z, bb, ee, ff | *Rattus norvegicus* interferon-related developmental regulator 1 (Ifrd1), mRNA. 5/22Length = 1736 | interferon-related developmental regulator 1 |
| 2045 | 21108 | NM_019243 | f | *Rattus norvegicus* prostaglandin F2 receptor negativeregulator (Ptgfrn), mRNA. 11/22Length = 5825 | prostaglandin F2 receptor negative regulator |
| 2046 | 11218 | NM_019247 | b, u, v | *Rattus norvegicus* paired-like homeodomain transcription factor 3 (Pitx3), mRNA. 11/22Length = 1253 | paired-like homeodomain transcription factor 3 |
| 2047 | 24849 | NM_019248 | aa, bb | *Rattus norvegicus* neural receptor protein-tyrosine kinase (Ntrk3), mRNA. 11/22Length = 2682 | neurotrophic tyrosine kinase, receptor, type 3 |
| 2048 | 18761 | NM_019250 | aa | *Rattus norvegicus* ral guanine nucleotide dissociationstimulator (Ralgds), mRNA. 11/22Length = 3665 | ral guanine nucleotide dissociation stimulator |
| 2049 | 23419 | NM_019257 | t | *Rattus norvegicus* splicing factor, arginine/serine-rich 5 (Sfrs5), mRNA. 11/22Length = 2781 | splicing factor, arginine/serine-rich 5 (SRp40, HRS) |
| 2050 | 21443 | NM_019262 | kk, ll | *Rattus norvegicus* complement component 1, q subcomponent, betapolypeptide (C1qb), mRNA. 11/22Length = 1136 | complement component 1, q subcomponent, beta polypeptide |
| 2050 | 21444 | NM_019262 | jj, kk | *Rattus norvegicus* complement component 1, q subcomponent, betapolypeptide (C1qb), mRNA. 11/22Length = 1136 | complement component 1, q subcomponent, beta polypeptide |

TABLE 1-continued

| SEQ ID | GLGC ID | GenBank Accession No. | Model Code | Known Gene Name | Unigene Sequence Cluster Title |
|---|---|---|---|---|---|
| 2051 | 1143 | NM_019280 | w, x | *Rattus norvegicus* gap junction membrane channel protein alpha 5(Gja5), mRNA. 11/22Length = 3115 | gap junction membrane channel protein alpha 5 (connexin 40) |
| 2052 | 20734 | NM_019283 | j, k, t, u, v, jj, kk | *Rattus norvegicus* solute carrier family 3, member 2 (Slc3a2), mRNA. 11/22Length = 194 | solute carrier family 3 (activators of dibasic and neutral amino acid transport), member 2 |
| 2052 | 20735 | NM_019283 | j, k, t, y, z, kk | *Rattus norvegicus* solute carrier family 3, member 2 (Slc3a2), mRNA. 11/22Length = 194 | solute carrier family 3 (activators of dibasic and neutral amino acid transport), member 2 |
| 2053 | 8200 | NM_019285 | ll | *Rattus norvegicus* adenylyl cyclase 4 (Adcy4), mRNA. 11/22Length = 3357 | Adenylyl cyclase 4 |
| 2054 | 10015 | NM_019289 | n, o, jj, kk, ll | *Rattus norvegicus* Actin-related protein complex 1b (Arp1lb), mRNA. 11/2Length = 143 | Actin-related protein complex 1b |
| 2054 | 10016 | NM_019289 | a, o, jj, kk, ll | *Rattus norvegicus* Actin-related protein complex lb (Arpclb), mRNA. 11/2Length = 143 | Actin-related protein complex 1b |
| 2055 | 23679 | NM_019290 | p, q | *Rattus norvegicus* B-cell translocation gene 3 (Btg3), mRNA.11/22Length = 1259 | B-cell translocation gene 3 |
| 2056 | 15056 | NM_019291 | b, c | *Rattus norvegicus* carbonic anhydrase 2 (Ca2), mRNA. 11/22Length= 1459 | carbonic anhydrase 2 |
| 2057 | 17507 | NM_019299 | f, g | *Rattus norvegicus* clathrin, heavy polypeptide (Hc) (Cltc), mRNA. 11/22Length = 671 | clathrin, heavy polypeptide (Hc) |
| 2058 | 24674 | NM_019328 | j, k | *Rattus norvegicus* nuclear receptor subfamily 4, group A, member 2 (Nr4a2), mRNA. 11/22Length = 22 | nuclear receptor subfamily 4, group A, member 2 |
| 2059 | 16330 | NM_019331 | h, l, ll | *Rattus norvegicus* Proprotein convertase subtilisin/kexin type 3 (paired basic amino acid cleaving enzyme, furin, membrane associated receptor protein) (Pcsk3), mRNA. 1/22Length = 4259 | Paired basic amino acid cleaving enzyme (furin) |
| 2060 | 1238 | NM_019333 | gg | *Rattus norvegicus* phosphofructo-2-kinase/fructose-2,6-biphosphatase 4 (Pfkfb4), mRNA. 11/22Length = 1739 | 6-phosphofructo-2-kinaselfructose-2 6-biphosphatase 4 |
| 2061 | 52 | NM_019335 | d | *Rattus norvegicus* Protein kinase, interferon-inducible doublestranded RNA dependent (Prkr), mRNA. 11/2Length = 388 | Protein kinase, interferon-inducible double stranded RNA dependent |
| 2062 | 2088 | NM_019341 | aa, bb | *Rattus norvegicus* regulator of G-protein signaling 5 (Rgs5), mRNA. 11/22Length = 546 | regulator of G-protein signaling 5 |
| 2063 | 22675 | NM_019358 | a, n, o, kk | *Rattus norvegicus* glycoprotein 38 (Gp38), mRNA. 11/22Length = 1854 | glycoprotein 38 |

TABLE 1-continued

| SEQ ID | GLGC ID | GenBank Accession No. | Model Code | Known Gene Name | Unigene Sequence Cluster Title |
|---|---|---|---|---|---|
| 2064 | 23491 | NM_019359 | r | *Rattus norvegicus* calponin 3, acidic (Cnn3), mRNA. 5/22Length = 1932 | calponin 3, acidic |
| 2065 | 23225 | NM_019360 | c | *Rattus norvegicus* cytochrome oxidase subunit VIc (Cox6c), mRNA. 11/2Length = 418 | cytochrome oxidase subunit VIc |
| 2066 | 18819 | NM_019367 | l, m | *Rattus norvegicus* palmitoyl-protein thioesterase 2 (Ppt2), mRNA. 11/22Length = 166 | palmitoyl-protein thioesterase 2 |
| 2066 | 18820 | NM_019367 | s, t | *Rattus norvegicus* palmitoyl-protein thioesterase 2 (Ppt2), mRNA. 11/22Length = 166 | palmitoyl-protein thioesterase 2 |
| 2067 | 1323 | NM_019371 | c, aa, bb, ii | *Rattus norvegicus* EGL nine homolog 3 (*C. elegans*) (Egln3), mRNA. 11/22Length = 2825 | EGL nine homolog 3 (*C. elegans*) |
| 2067 | 1324 | NM_019371 | f, g, aa, bb, kk | *Rattus norvegicus* EGL nine homolog 3 (*C. elegans*) (Egln3), mRNA. 11/22Length = 2825 | EGL nine homolog 3 (*C. elegans*) |
| 2068 | 20298 | NM_019374 | l, m | *Rattus norvegicus* prodynorphin (Pdyn), mRNA. 11/22Length = 747 | prodynorphin |
| 2069 | 18032 | NM_019380 | b, l, m | *Rattus norvegicus* stromal cell derived factor receptor 1 (Sdfr1), mRNA. 11/22Length = 2369 | stromal cell derived factor receptor 1 |
| 2070 | 2453 | NM_019385 | j, k | *Rattus norvegicus* golgi peripheral membrane protein p65 (GRASP65), mRNA. 11/2Length = 2493 | golgi peripheral membrane protein p65 |
| 2071 | 16 | NM_019386 | cc, dd, kk | *Rattus norvegicus* tissue-type transglutaminase (Tgm2), mRNA. 11/22Length = 3393 | tissue-type transglutaminase |
| 2072 | 904 | NM_019620 | p | *Rattus norvegicus* Kruppel associated box (KRAB) zinc finger 1(Kzf1), mRNA. 11/2Length= 194 | Kruppel associated box (KRAB) zinc finger 1 |
| 2073 | 574 | NM_019905 | a, h, l, z, aa, kk, ll | *Rattus norvegicus* calpactin I heavy chain (Anxa2), mRNA. 11/22Length = 1395 | calpactin I heavy chain, hydroxyacid oxidase 3 (medium-chain), unknown Glu-Pro dipeptide repeat protein |
| 2074 | 15911 | NM_019907 | cc, dd | *Rattus norvegicus* postsynaptic protein Cript (Cript), mRNA. 11/22Length = 1435 | postsynaptic protein Cript |
| 2075 | 18713 | NM_020075 | p, q, s, t | *Rattus norvegicus* eukaryotic initiation factor 5 (eIF-5)(Eif5), mRNA. 11/2Length = 354 | eukaryotic initiation factor 5 (eIF-5) |
| 2075 | 18715 | NM_020075 | ee, ff | *Rattus norvegicus* eukaryotic initiation factor 5 (eIF-5)(Eif5), mRNA. 11/2Length = 354 | eukaryotic initiation factor 5 (eIF-5) |
| 2076 | 13486 | NM_020306 | aa, bb | *Rattus norvegicus* a disintegrin and metalloproteinase domain 17 (Adam17), mRNA. 11/22Length = 4128 | a disintegrin and metalloproteinase domain 17 |
| 2077 | 20816 | NM_021261 | c | *Rattus norvegicus* thymosin, beta 1 (Tmsb1), mRNA. 1/22Length = 539 | thymosin, beta 10 |

TABLE 1-continued

| SEQ ID | GLGC ID | GenBank Accession No. | Model Code | Known Gene Name | Unigene Sequence Cluster Title |
|---|---|---|---|---|---|
| 2078 | 15335 | NM_021264 | w | *Rattus norvegicus* ribosomal protein L35a (Rpl35a), mRNA. 11/22Length = 348 | ribosomal protein L35a |
| 2079 | 18729 | NM_021578 | r | *Rattus norvegicus* transforming growth factor, beta 1 (Tgfb1), mRNA. 11/22Length = 1585 | transforming growth factor, beta-1 |
| 2080 | 18946 | NM_021584 | s, t | *Rattus norvegicus* activity and neurotransmitter-induced early gene protein 4 (ania-4) (Ania4), mRNA. 11/22Length = 4831 | activity and neurotransmitter-induced early gene protein 4 (ania-4) |
| 2081 | 25445 | NM_021654 | r | *Rattus norvegicus* gap junction membrane channel protein alpha 4(Gja4), mRNA. 11/22Length = 12 | Gap junction membrane channel, protein alpha 4 (connexin 37) |
| 2082 | 23424 | NM_021680 | j, k | *Rattus norvegicus* neurexophilin 4 (Nxph4), mRNA. 11/22Length = 1265 | ESTs, Highly similar to SYA_HUMAN Alanyl-tRNA synthetase (Alanine--tRNA ligase) (AlaRS) [*H. sapiens*] |
| 2083 | 19661 | NM_021686 | n | *Rattus norvegicus* membrane-associated guanylatekinase-interacting protein (LOC59322), mRNA. 3/21Length = 2691 | membrane-associated guanylate kinase-interacting protein |
| 2084 | 19667 | NM_021690 | ii | *Rattus norvegicus* cAMP-regulated guanine nucleotide exchangefactor I (cAMP-GEFI) (Epac), mRNA. 11/2Length = 3373 | cAMP-regulated guanine nucleotide exchange factor I (cAMP-GEFI) |
| 2085 | 22916 | NM_021740 | ii | *Rattus norvegicus* prothymosin alpha (Ptma), mRNA. 11/22Length = 1182 | prothymosin alpha |
| 2086 | 19710 | NM_021744 | a, j, k, q, hh, kk | *Rattus norvegicus* CD14 antigen (Cd14), mRNA. 11/22Length = 1591 | CD14 antigen |
| 2087 | 20035 | NM_021754 | a, y, z | *Rattus norvegicus* Nopp14 associated protein (Nap65), mRNA 11/2Length = 198 | Nopp140 associated protein |
| 2088 | 17936 | NM_021766 | d, r, gg | *Rattus norvegicus* progesterone receptor membrane component 1(Pgrmc1), mRNA. 11/22Length = 1885 | progesterone receptor membrane component 1 |
| 2089 | 22351 | NM_021835 | ee, ff | *Rattus norvegicus* Avian sarcoma virus 17 (v-jun) oncogene homolog (Jun), mRNA. 4/22Length = 2573 | Avian sarcoma virus 17 (v-jun) oncogene homolog |
| 2090 | 20161 | NM_021836 | j, k, p, q, r | *Rattus norvegicus* jun B proto-oncogene (Junb), mRNA. 11/22Length = 135 | jun B proto-oncogene |
| 2091 | 20177 | NM_021867 | d, jj, kk | *Rattus norvegicus* fibroblast growth factor 16 (Fgf16), mRNA. 11/22Length = 624 | Fibroblast growth factor 16 |
| 2092 | 243 | NM_021989 | h, l, n, o, ll | *Rattus norvegicus* tissue inhibitor of metalloproteinase 2 (Timp2), mRNA. 11/22Length = 19 | ESTs, tissue inhibitor of metalloproteinase 2 |
| 2093 | 17100 | NM_022179 | h, l, w, x, dd | *Rattus norvegicus* Hexokinase 3 (Hk3), mRNA. 12/2Length = 3692 | Hexokinase 3 |

TABLE 1-continued

| SEQ ID | GLGC ID | GenBank Accession No. | Model Code | Known Gene Name | Unigene Sequence Cluster Title |
|---|---|---|---|---|---|
| 2094 | 23780 | NM_022183 | jj, kk | *Rattus norvegicus* topoisomerase (DNA) 2 alpha (Top2a), mRNA. 11/22Length = 652 | topoisomerase (DNA) II alpha |
| 2095 | 20204 | NM_022196 | ee, ff, kk | *Rattus norvegicus* leukemia inhibitory factor (Lif), mRNA. 11/22Length = 69 | leukemia inhibitory factor |
| 2096 | 20225 | NM_022198 | b, l, m | *Rattus norvegicus* putative chloride channel (similar to MmClcn4-2) (LOC6586), mRNA. 12/2Length = 2244 | putative chloride channel (similar to Mm Clcn4-2) |
| 2097 | 20249 | NM_022205 | ll | *Rattus norvegicus* Chemokine receptor (LCR1) (Cxcr4), mRNA. 5/22Length = 15 | Chemokine receptor (LCR1) |
| 2098 | 20450 | NM_022239 | b, l, m, u, v | *Rattus norvegicus* neuromedin (Nmu), mRNA. 11/22Length = 832 | neuromedin U |
| 2099 | 762 | NM_022245 | h, l | *Rattus norvegicus* cytochrome b5 (Cyb5), mRNA. 12/2Length = 751 | cytochrome b5 |
| 2100 | 6263 | NM_022251 | jj, kk | *Rattus norvegicus* aminopeptidase A (Enpep), mRNA. 12/2Length = 475 | aminopeptidase A |
| 2101 | 6585 | NM_022266 | q, kk | *Rattus norvegicus* connective tissue growth factor (Ctgf), mRNA. 11/22Length = 2345 | connective tissue growth factor |
| 2102 | 13758 | NM_022289 | ll | *Rattus norvegicus* sorting nexin 16 (Snx16), mRNA. 12/2Length = 1773 | ESTs |
| 2103 | 23511 | NM_022294 | n, o | *Rattus norvegicus* ETL protein (Etl), mRNA. 12/2Length = 4274 | ETL protein |
| 2104 | 19423 | NM_022297 | u, v | *Rattus norvegicus* dimethylarginine dimethylaminohydrolase 1 (Ddah1), mRNA. 5/22Length = 38 | dimethylarginine dimethylaminohydrolase 1 |
| 2105 | 17158 | NM_022298 | f, s, t | *Rattus norvegicus* alpha-tubulin (Tuba1), mRNA. 12/2Length = 1617 | alpha-tubulin |
| 2105 | 17160 | NM_022298 | b, l, m, aa | *Rattus norvegicus* alpha-tubulin (Tuba1), mRNA. 12/2Length = 1617 | alpha-tubulin |
| 2105 | 17161 | NM_022298 | a, z, kk | *Rattus norvegicus* alpha-tubulin (Tuba1), mRNA. 12/2Length = 1617 | alpha-tubulin |
| 2106 | 18246 | NM_022300 | hh | *Rattus norvegicus* brain acidic membrane protein (Basp1), mRNA. 12/2Length = 124 | brain acidic membrane protein |
| 2107 | 11454 | NM_022381 | d, l, m, n, o, s, t | *Rattus norvegicus* Proliferating cell nuclear antigen (Pcna), mRNA. 11/22Length = 116 | Proliferating cell nuclear antigen |
| 2107 | 11455 | NM_022381 | s | *Rattus norvegicus* Proliferating cell nuclear antigen (Pcna), mRNA. 11/22Length = 116 | Proliferating cell nuclear antigen |
| 2108 | 695 | NM_022388 | u, v | *Rattus norvegicus* FXYD domain-containing ion transport regulator 4 (Fxyd4), mRNA. 11/22Length = 1362 | corticosteroid-induced protein |
| 2109 | 13480 | NM_022390 | l | *Rattus norvegicus* quinoid dihydropteridine reductase (Qdpr), mRNA. 11/22Length = 137 | quinoid dihydropteridine reductase |

TABLE 1-continued

| SEQ ID | GLGC ID | GenBank Accession No. | Model Code | Known Gene Name | Unigene Sequence Cluster Title |
|---|---|---|---|---|---|
| 2110 | 22412 | NM_022392 | p, q | *Rattus norvegicus* growth response protein (CL-6)(LOC64194), mRNA. 12/2Length = 241 | growth response protein (GL-6) |
| 2111 | 22499 | NM_022393 | a, p, q, cc, dd, ee, ff, jj, kk | *Rattus norvegicus* macrophage galactose N-acetyl-galactosamine specific lectin (Mgl), mRNA. 1/22Length = 1358 | macrophage galactose N-acetyl-galactosamine specific lectin |
| 2112 | 23061 | NM_022394 | s, t | *Rattus norvegicus* scaffold attachment factor B (Safb), mRNA. 11/22Length = 3113 | scaffold attachment factor B |
| 2113 | 18221 | NM_022395 | cc, dd | *Rattus norvegicus* mitochondrial processing peptidase beta (Pmpcb), mRNA. 12/2Length = 157 | ESTs, Weakly similar to mitochondrial processing peptidase beta [*Rattus norvegicus*] [*R.norvegicus*], mitochondrial processing peptidase beta |
| 2114 | 23705 | NM_022396 | e, j, k, ii | *Rattus norvegicus* guanine nucleotide binding protein gamma subunit 11 (Gng11), mRNA. 12/2Length = 557 | guanine nucleotide binding protein gamma subunit 11 |
| 2115 | 23300 | NM_022398 | jj, kk | *Rattus norvegicus* 2-oxoglutarate carrier (LOC6421), mRNA. 12/2Length = 946 | 2-oxoglutarate carrier |
| 2116 | 24536 | NM_022399 | h, l, n, o | *Rattus norvegicus* calreticulin (Calr), mRNA. 11/22Length = 1882 | calreticulin |
| 2117 | 24643 | NM_022400 | b, u, v | *Rattus norvegicus* branched chain aminotransferase 2, mitochondrial (Bcat2), mRNA. 11/22Length = 1548 | branched chain aminotransferase 2, mitochondrial |
| 2118 | 20915 | NM_022407 | kk | *Rattus norvegicus* Aldehyde dehydrogenase 1, subfamily A1 (Aldh1a1), mRNA. 1/21Length = 212 | Aldehyde dehydrogenase 1, subfamily A1 |
| 2119 | 8211 | NM_022500 | jj, kk | *Rattus norvegicus* ferritin light chain 1 (Ftl1), mRNA. 11/22Length = 552 | ferritin light chain 1 |
| 2119 | 8212 | NM_022500 | h, l, kk, ll | *Rattus norvegicus* ferritin light chain 1 (Ftl1), mRNA. 11/22Length = 552 | ferritin light chain 1 |
| 2120 | 4259 | NM_022504 | f, g | *Rattus norvegicus* ribosomal protein L36 (Rpl36), mRNA. 11/22Length = 364 | ribosomal protein L36 |
| 2121 | 8586 | NM_022505 | gg | *Rattus norvegicus* Rhesus blood group (Rh), mRNA. 11/22Length = 1269 | Rhesus blood group |
| 2121 | 8587 | NM_022505 | b, u, v | *Rattus norvegicus* Rhesus blood group (Rh), mRNA. 11/22Length = 1269 | Rhesus blood group |
| 2122 | 1867 | NM_022510 | c, kk | *Rattus norvegicus* ribosomal protein L4 (Rpl4), mRNA. 11/22Length = 1387 | ribosomal protein L4 |
| 2123 | 2109 | NM_022511 | n, o, w, x | *Rattus norvegicus* profilin (Pfn1), mRNA. 12/2Length = 689 | profilin |
| 2124 | 3027 | NM_022514 | w, x | *Rattus norvegicus* ribosomal protein L27 (Rpl27), mRNA. 11/22Length = 463 | ribosomal protein L27 |
| 2125 | 2696 | NM_022515 | cc, dd | *Rattus norvegicus* ribosomal protein L24 | ribosomal protein L24 |

TABLE 1-continued

| SEQ ID | GLGC ID | GenBank Accession No. | Model Code | Known Gene Name | Unigene Sequence Cluster Title |
|---|---|---|---|---|---|
| 2125 | 2697 | NM_022515 | f, g, gg | *Rattus norvegicus* ribosomal protein L24 (Rpl24), mRNA. 11/22Length = 541 | ribosomal protein L24 |
| 2126 | 3900 | NM_022516 | s, t | *Rattus norvegicus* polypyrimidine tract binding protein (Ptb), mRNA. 11/22Length = 2723 | polypyrimidine tract binding protein |
| 2126 | 3904 | NM_022516 | aa, bb, ll | *Rattus norvegicus* polypyrimidine tract binding protein (Ptb), mRNA. 11/22Length = 2723 | polypyrimidine tract binding protein |
| 2126 | 162 | NM_022516 | e, u, v | *Rattus norvegicus* polypyrimidine tract binding protein (Ptb), mRNA. 11/22Length = 2723 | malate dehydrogenase mitochondrial |
| 2127 | 4145 | NM_022518 | jj, kk | *Rattus norvegicus* ADP-ribosylation factor 1 (Arf1), mRNA. 11/22Length = 9 | ADP-ribosylation factor 1 |
| 2127 | 4151 | NM_022518 | b, l, m | *Rattus norvegicus* ADP-ribosylation factor 1 (Arf1), mRNA. 11/22Length = 9 | ADP-ribosylation factor 1 |
| 2128 | 4242 | NM_022521 | b, l, m | *Rattus norvegicus* ornithine aminotransferase (Oat), mRNA. 11/22Length = 1938 | ornithine aminotransferase |
| 2129 | 4412 | NM_022523 | l, m | *Rattus norvegicus* CD151 antigen (Cd151), mRNA. 11/22Length = 1668 | CD151 antigen |
| 2130 | 4601 | NM_022524 | l, m | *Rattus norvegicus* sushi-repeat-containing protein (Srpx), mRNA. 11/22Length = 1827 | sushi-repeat-containing protein, X chromosome |
| 2131 | 4615 | NM_022525 | cc, dd | *Rattus norvegicus* plasma glutathione peroxidase precursor(Gpxp), mRNA. 12/2Length = 134 | plasma glutathione peroxidase precursor |
| 2132 | 6100 | NM_022531 | n, o | *Rattus norvegicus* desmin (Des), mRNA. 11/22Length = 2169 | desmin |
| 2133 | 6577 | NM_022532 | u, v | *Rattus norvegicus* A-raf (Araf1), mRNA. 6/21Length = 2288 | A-raf |
| 2134 | 7505 | NM_022534 | ii | *Rattus norvegicus* transcobalamin II precursor (Tcn2p), mRNA. 11/22Length = 188 | transcobalamin II precursor |
| 2135 | 8097 | NM_022536 | h, l | *Rattus norvegicus* cyclophilin B (Ppib), mRNA. 12/2Length = 84 | cyclophilin B |
| 2135 | 8098 | NM_022536 | ii | *Rattus norvegicus* cyclophilin B (Ppib), mRNA. 12/2Length = 84 | cyclophilin B |
| 2136 | 8596 | NM_022538 | ll | *Rattus norvegicus* phosphatidate phosphohydrolase type 2a(Ppap2a), mRNA. 5/22Length = 871 | phosphatidate phosphohydrolase type 2a |
| 2136 | 8597 | NM_022538 | aa, bb, kk, ll | *Rattus norvegicus* phosphatidate phosphohydrolase type 2a(Ppap2a), mRNA. 5/22Length = 871 | phosphatidate phosphohydrolase type 2a |
| 2137 | 9240 | NM_022540 | j, k, w, x | *Rattus norvegicus* peroxiredoxin 3 (Prdx3), | peroxiredoxin 3 |

TABLE 1-continued

| SEQ ID | GLGC ID | GenBank Accession No. | Model Code | Known Gene Name | Unigene Sequence Cluster Title |
|---|---|---|---|---|---|
| 2138 | 9541 | NM_022542 | e, r | *Rattus norvegicus* rhoB gene (Arhb), mRNA. 11/22Length = 1433 12/2Length = 2183 | rhoB gene |
| 2139 | 12422 | NM_022546 | n, o | *Rattus norvegicus* Death-associated like kinase (Dapkl), mRNA. 12/2Length = 1514 | Death-associated like kinase |
| 2140 | 21076 | NM_022584 | e, w, x | *Rattus norvegicus* thioredoxin reductase 2 (Txnrd2), mRNA. 11/22Length = 1999 | thioredoxin reductase 2 |
| 2141 | 21062 | NM_022585 | gg | *Rattus norvegicus* ornithine decarboxylase antizyme inhibitor(Oazi), mRNA. 11/22Length = 4269 | ornithine decarboxylase antizyme inhibitor |
| 2141 | 21063 | NM_022585 | f, y, z | *Rattus norvegicus* ornithine decarboxylase antizyme inhibitor(Oazi), mRNA. 11/22Length = 4269 | ornithine decarboxylase antizyme inhibitor |
| 2142 | 20762 | NM_022588 | r, s, t | *Rattus norvegicus* metastasis associated 1 (Mta1), mRNA. 1/21Length = 2741 | metastasis associated 1 |
| 2143 | 20925 | NM_022594 | g, hh | *Rattus norvegicus* enoyl coenzyme A hydratase 1 (Ech1), mRNA. 11/22Length = 197 | Peroxisomal enoyl hydratase-like protein |
| 2144 | 20959 | NM_022598 | d, r | *Rattus norvegicus* cellular nucleic acid binding protein (Cnbp), mRNA. 11/22Length = 164 | cellular nucleic acid binding protein |
| 2144 | 20960 | NM_022598 | c, e, r | *Rattus norvegicus* cellular nucleic acid binding protein (Cnbp), mRNA. 11/22Length = 164 | cellular nucleic acid binding protein |
| 2145 | 21115 | NM_022602 | j, k | *Rattus norvegicus* serine threonine kinase pim3 (Pim3), mRNA. 1/21Length = 2133 | serine threonine kinase pim3 |
| 2146 | 21206 | NM_022606 | c | *Rattus norvegicus* protein phosphatase 2C (AF95927), mRNA. 1/21Length = 1318 | protein phosphatase 2C |
| 2147 | 17661 | NM_022674 | d, gg | *Rattus norvegicus* H2A histone family, member Z (H2afz), mRNA. 11/22Length = 811 | H2A histone family, member Z |
| 2148 | 24564 | NM_022676 | f | *Rattus norvegicus* protein phosphatase 1, regulatory (inhibitor) subunit 1A (Ppp1r1a), mRNA. 11/22Length = 619 | protein phosphatase 1, regulatory (inhibitor) subunit 1A |
| 2149 | 20506 | NM_022686 | d | *Rattus norvegicus* germinal histone H4 gene (Hist4), mRNA. 1/21Length = 377 | germinal histone H4 gene |
| 2149 | 6121 | NM_022686 | d, r | *Rattus norvegicus* germinal histone H4 gene (Hist4), mRNA. 1/21Length = 377 | ESTs, Highly similar to I48404 histone H4 (55AA) (1 is 3rd base in codon) - mouse (fragment) [*M. musculus*] |
| 2150 | 20509 | NM_022689 | b, r, u, v | *Rattus norvegicus* synaptosomal-associated protein, 23 kD(Snap23), mRNA. 1/21Length = 633 | synaptosomal-associated protein, 23 kD |
| 2151 | 17586 | NM_022694 | w, x | *Rattus norvegicus* p15 coactivator (U83883), mRNA. 8/21Length = 3166 | p105 coactivator |

TABLE 1-continued

| SEQ ID | GLGC ID | GenBank Accession No. | Model Code | Known Gene Name | Unigene Sequence Cluster Title |
|---|---|---|---|---|---|
| 2152 | 17729 | NM_022697 | f, g, w, x, cc, dd | *Rattus norvegicus* ribosomal protein L28 (Rpl28), mRNA. 11/22Length = 466 | ribosomal protein L28 |
| 2153 | 17757 | NM_022698 | cc, dd | *Rattus norvegicus* bcl-2 associated death agonist (Bad), mRNA. 1/21Length = 115 | bcl-2 associated death agonist |
| 2154 | 17808 | NM_022699 | cc, dd | *Rattus norvegicus* ribosomal protein L3 (Rpl3), mRNA. 11/22Length = 392 | ribosomal protein L30 |
| 2155 | 24346 | NM_022701 | gg | *Rattus norvegicus* flotillin 1 (Flot1), mRNA. 11/22Length = 2157 | flotillin 1 |
| 2156 | 58 | NM_022715 | u, v | *Rattus norvegicus* major vault protein (Mvp), mRNA. 11/22Length = 2756 | major vault protein |
| 2157 | 194 | NM_022861 | cc, dd | *Rattus norvegicus* Munc13-1 (Unc13h1), mRNA. 1/21Length = 6683 | Munc13-1 |
| 2158 | 202 | NM_022863 | h, l | *Rattus norvegicus* iron-regulatory protein 2 (Ireb2), mRNA. 1/21Length = 377 | iron-regulatory protein 2 |
| 2159 | 23606 | NM_022867 | w, x | *Rattus norvegicus* microtubule-associated proteins 1A/1B lightchain 3 (MPL3), mRNA. 1/21Length = 861 | microtubule-associated proteins 1A/1B light chain 3 |
| 2159 | 23608 | NM_022867 | r | *Rattus norvegicus* microtubule-associated proteins 1A/1B lightchain 3 (MPL3), mRNA. 1/21Length = 861 | microtubule-associated proteins 1A/1B light chain 3 |
| 2160 | 24283 | NM_022869 | s, t | *Rattus norvegicus* nucleolar phosphoprotein p13 (Nopp14), mRNA. 1/21Length = 369 | nucleolar phosphoprotein p130 |
| 2161 | 6891 | NM_022934 | ee, ff | *Rattus norvegicus* DnaJ-like protein (Hsj2), mRNA. 11/22Length = 161 | DnaJ-like protein |
| 2162 | 2006 | NM_022936 | aa | *Rattus norvegicus* cytosolic epoxide hydrolase (Ephx2), mRNA. 1/21Length = 1992 | cytosolic epoxide hydrolase |
| 2162 | 2008 | NM_022936 | w, x, aa, bb | *Rattus norvegicus* cytosolic epoxide hydrolase (Ephx2), mRNA. 1/21Length = 1992 | cytosolic epoxide hydrolase |
| 2163 | 15697 | NM_022939 | ll | *Rattus norvegicus* syntaxin 12 (Stx12), mRNA. 11/22Length = 819 | syntaxin 12 |
| 2164 | 18098 | NM_022947 | l | *Rattus norvegicus* suppressor of K+ transport defect 3 (Skd3), mRNA. 11/22Length = 2138 | suppressor of K+ transport defect 3 |
| 2165 | 18104 | NM_022948 | hh | *Rattus norvegicus* tricarboxylate carrier-like protein(Loc6542), mRNA. 1/21Length = 2699 | tricarboxylate carrier-like protein |
| 2166 | 18107 | NM_022949 | f, g | *Rattus norvegicus* ribosomal protein L14 (Rpl14), mRNA. 11/22Length = 715 | ribosomal protein L14 |
| 2167 | 15727 | NM_022953 | u, v | *Rattus norvegicus* slit homolog 1 (*Drosophila*) (Slit1), mRNA. 11/22Length 495 | Slit1 |

TABLE 1-continued

| SEQ ID | GLGC ID | GenBank Accession No. | Model Code | Known Gene Name | Unigene Sequence Cluster Title |
|---|---|---|---|---|---|
| 2168 | 3337 | NM_022961 | a, y, z | *Rattus norvegicus* vacuolar protein sorting protein 33a(Vps33a), mRNA. 1/21Length = 3269 | ESTs |
| 2169 | 9286 | NM_023027 | l, m | *Rattus norvegicus* tRNA selenocysteine associated protein(Secp43), mRNA. 11/22Length = 864 | tRNA selenocysteine associated protein |
| 2170 | 23215 | NM_023102 | b, l, m | *Rattus norvegicus* casein kinase 1 gamma 2 isoform (Csnk1g2), mRNA. 2/21Length = 1572 | casein kinase 1 gamma 2 isoform |
| 2171 | 8269 | NM_023103 | b, l, m | *Rattus norvegicus* alpha(1)-inhibitor 3, variant I (Mug1), mRNA. 2/21Length = 462 | alpha(1)-inhibitor 3, variant I |
| 2172 | 21238 | NM_024125 | p, q | *Rattus norvegicus* CCAAT/enhancer binding protein (C/EBP), beta (Cebpb), mRNA. 11/22Length= 148 | Liver activating protein (LAP, also NF-IL6, nuclear factor-IL6, previously designated TCF5) |
| 2172 | 21239 | NM_024125 | p, q, r, bb, ee, ff, kk | *Rattus norvegicus* CCAAT/enhancer binding protein (C/EBP), beta (Cebpb), mRNA. 11/22Length = 148 | Liver activating protein (LAP, also NF-IL6, nuclear factor-IL6, previously designated TCF5) |
| 2173 | 352 | NM_024127 | p, q | *Rattus norvegicus* growth arrest and DNA-damage-inducible 45 alpha (Gadd45a), mRNA. 11/22Length = 711 | DNA-damage-inducible transcript 1 |
| 2173 | 353 | NM_024127 | q, ee, ff, gg | *Rattus norvegicus* growth arrest and DNA-damage-inducible 45 alpha (Gadd45a), mRNA. 11/22Length = 711 | DNA-damage-inducible transcript 1 |
| 2173 | 354 | NM_024127 | p, q, ee, ff | *Rattus norvegicus* growth arrest and DNA-damage-inducible 45 alpha (Gadd45a), mRNA. 11/22Length = 711 | DNA-damage-inducible transcript 1 |
| 2174 | 17226 | NM_024131 | b, c, u, v | *Rattus norvegicus* D-dopachrome tautomerase (Ddt), mRNA. 11/22Length = 628 | D-dopachrome tautomerase |
| 2174 | 17227 | NM_024131 | c | *Rattus norvegicus* D-dopachrome tautomerase (Ddt), mRNA. 11/22Length = 628 | D-dopachrome tautomerase |
| 2175 | 1879 | NM_024138 | l, m | *Rattus norvegicus* guanine nucleotide binding protein, gamma 7(Gng7), mRNA. 11/22Length = 2897 | guanine nucleotide binding protein (G protein), gamma 7 subunit |
| 2176 | 24623 | NM_024146 | ll | *Rattus norvegicus* Fibroblast growth factor receptor 1 (Fgfr1), mRNA. 5/22Length = 2469 | Fibroblast growth factor receptor 1 |
| 2177 | 20801 | NM_024148 | d, s, t | *Rattus norvegicus* apurinic/apyrimidinic endonuclease 1 (Apex), mRNA. 5/22Length = 1213 | apurinic/apyrimidinic endonuclease 1 |
| 2178 | 1742 | NM_024150 | p, q, y, ee, ff | *Rattus norvegicus* ADP-ribosylation factor 2 (Arf2), mRNA. 11/22Length = 17 | ADP-ribosylation factor 2 |
| 2179 | 17517 | NM_024151 | f | *Rattus norvegicus* ADP-ribosylation factor 4 (Arf4), mRNA. 11/22Length = 168 | ADP-ribosylation factor 4 |

TABLE 1-continued

| SEQ ID | GLGC ID | GenBank Accession No. | Model Code | Known Gene Name | Unigene Sequence Cluster Title |
|---|---|---|---|---|---|
| 2180 | 21696 | NM_024152 | y, z | *Rattus norvegicus* ADP-ribosylation factor 6 (Arf6), mRNA. 11/22Length = 995 | ADP-ribosylatlon factor 6 |
| 2181 | 561 | NM_024156 | jj, kk | *Rattus norvegicus* annexin VI (Anxa6), mRNA. 11/22Length = 2739 | annexin VI |
| 2181 | 562 | NM_024156 | r | *Rattus norvegicus* annexin VI (Anxa6), mRNA. 11/22Length = 2739 | annexin VI |
| 2182 | 4504 | NM_024159 | d | *Rattus norvegicus* disabled homolog 2, mitogen-responsivephosphoprotein (*Drosophila*) (Dab2), mRNA. 5/22Length = 317 | disabled homolog 2, mitogen-responsive phosphoprotein (*Drosophila*) |
| 2183 | 20770 | NM_024160 | n, o | *Rattus norvegicus* cytochrome b558 alpha-subunit (Cyba), mRNA. 2/21Length = 79 | cytochrome b558 alpha-subunit |
| 2184 | 16476 | NM_024162 | aa | *Rattus norvegicus* fatty acid binding protein 3 (Fabp3), mRNA. 11/22Length = 666 | Fatty acid binding protein 3, muscle and heart |
| 2185 | 17764 | NM_024351 | e, p, r, ee, ff | *Rattus norvegicus* Heat shock cognate protein 7 (Hsc7), mRNA. 11/22Length = 273 | heat shock 70 kD protein 8 |
| 2185 | 17765 | NM_024351 | e, p, q, r, ee, ff | *Rattus norvegicus* Heat shock cognate protein 7 (Hsc7), mRNA. 11/22Length = 273 | heat shock 70 kD protein 8 |
| 2186 | 20933 | NM_024353 | h, l | *Rattus norvegicus* Phospholipase C, beta4 (Plcb4). mRNA. 1/22Length = 5297 | Phospholipase C, beta4 |
| 2187 | 15349 | NM_024356 | a, y, z | *Rattus norvegicus* GTP cyclohydrolase 1 (Gch), mRNA. 11/22Length = 116 | GTP cyclohydrolase 1 |
| 2187 | 15353 | NM_024356 | j, k, y, z, ii | *Rattus norvegicus* GTP cyclohydrolase 1 (Gch), mRNA. 11/22Length = 116 | GTP cyclohydrolase 1 |
| 2188 | 1146 | NM_024359 | y, z | *Rattus norvegicus* hypoxia inducible factor 1, alpha subunit (Hif1a), mRNA. 11/22Length = 3718 | hypoxia inducible factor 1, alpha subunit |
| 2189 | 767 | NM_024365 | b, c | *Rattus norvegicus* 5-hydroxytryptamine (serotonin) receptor 6(Htr6), mRNA. 11/22Length = 1929 | 5-hydroxytryptamine (serotonin) receptor 6 |
| 2190 | 15622 | NM_024369 | f, g | *Rattus norvegicus* follistatin-related protein (Frp), mRNA. 11/22Length = 137 | follistatin-related protein precursor |
| 2190 | 15623 | NM_024369 | r | *Rattus norvegicus* follistatin-related protein (Frp), mRNA. 11/22Length = 137 | follistatin-related protein precursor |
| 2191 | 23488 | NM_024375 | n, o | *Rattus norvegicus* prepro bone inducing protein (Gdf1), mRNA. 3/21Length = 2411 | prepro bone inducing protein |
| 2192 | 11628 | NM_024383 | b | *Rattus norvegicus* hairy and enhancer of split 5 (*Drosophila*)(Hes5), mRNA. 11/22Length = 592 | hairy and enhancer of split 5 (*Drosophila*) |
| 2193 | 2811 | NM_024386 | cc, dd | *Rattus norvegicus* 3-hydroxy-3-methylglutaryl | 3-hydroxy-3-methylglutaryl CoA lyase |

TABLE 1-continued

| SEQ ID | GLGC ID | GenBank Accession No. | Model Code | Known Gene Name | Unigene Sequence Cluster Title |
|---|---|---|---|---|---|
| 2193 | 2812 | NM_024386 | w, x, cc, dd | CoA lyase (Hmgcl), mRNA. 3/21 Length = 139 Rattus norvegicus 3-hydroxy-3-methylglutaryl CoA lyase (Hmgcl), mRNA. 3/21 Length = 139 | 3-hydroxy-3-methylglutaryl CoA lyase |
| 2193 | 2813 | NM_024386 | b | Rattus norvegicus 3-hydroxy-3-methylglutaryl CoA lyase (Hmgcl), mRNA. 3/21 Length = 139 | 3-hydroxy-3-methylglutaryl CoA lyase |
| 2194 | 21 | NM_024388 | w, x | Rattus norvegicus immediate early gene transcription factor NGFI-B (Nr4a1), mRNA. 3/21 Length = 2488 | immediate early gene transcription factor NGFI-B |
| 2194 | 22 | NM_024388 | w, x | Rattus norvegicus immediate early gene transcription factor NGFI-B (Nr4a1), mRNA. 3/21 Length = 2488 | immediate early gene transcription factor NGFI-B |
| 2195 | 25070 | NM_024392 | r, ii | Rattus norvegicus peroxisomal multifunctional enzyme type II (Hsd17b4), mRNA. 3/21 Length = 2535 | peroxisomal multifunctional enzyme type II |
| 2196 | 22626 | NM_024400 | kk | Rattus norvegicus a disintegrin and metalloproteinase with thrombospondin motifs 1 (ADAMTS-1) (Adamts1), mRNA. 1/22 Length = 4878 | a disintegrin and metalloproteinase with thrombospondin motifs 1 (ADAMTS-1) |
| 2197 | 13633 | NM_024403 | e, p, q, y, z | Rattus norvegicus activating transcription factor ATF-4 (Atf4), mRNA. 3/21 Length = 1173 | activating transcription factor ATF-4 |
| 2197 | 13634 | NM_024403 | a, j, k, p, q, y, z | Rattus norvegicus activating transcription factor ATF-4 (Atf4), mRNA. 3/21 Length = 1173 | activating transcription factor ATF-4 |
| 2198 | 938 | NM_024486 | u, v | Rattus norvegicus activin type I receptor (Acvr1), mRNA. 3/21 Length = 178 | activin type I receptor |
| 2199 | 862 | NM_024487 | hh | Rattus norvegicus GrpE-like 1, mitochondrial (Grpel1), mRNA. 5/22 Length = 961 | GrpE-like 1, mitochondrial |
| 2200 | 17917 | NM_024488 | b, v | Rattus norvegicus CDK5 activator-binding protein C53 (C53), mRNA. 3/21 Length = 1865 | CDK5 activator-binding protein C53 |
| 2201 | 348 | NM_030586 | u, v | Rattus norvegicus cytochrome b5, outer mitochondrial membrane isoform (omb5), mRNA. 3/21 Length = 845 | cytochrome b5, outer mitochondrial membrane isoform |
| 2201 | 349 | NM_030586 | ll | Rattus norvegicus cytochrome b5, outer mitochondrial membrane isoform (omb5), mRNA. 3/21 Length = 845 | cytochrome b5, outer mitochondrial membrane isoform |
| 2202 | 1852 | NM_030826 | aa, gg | Rattus norvegicus Glutathione peroxidase 1 (Gpx1), mRNA. 11/22 Length = 1539 | ESTs, Glutathione peroxidase 1 |
| 2203 | 21746 | NM_030828 | c | Rattus norvegicus glypican 1 (Gpc1), mRNA. 11/22 Length = 359 | glypican 1 |
| 2204 | 18023 | NM_030846 | b | Rattus norvegicus growth factor receptor bound | growth factor receptor bound protein 2 |

TABLE 1-continued

| SEQ ID | GLGC ID | GenBank Accession No. | Model Code | Known Gene Name | Unigene Sequence Cluster Title |
|---|---|---|---|---|---|
| | | | | protein 2(Grb2), mRNA. 11/22Length = 299 | |
| 2205 | 21509 | NM_030847 | h, l, n, o | Rattus norvegicus epithelial membrane protein 3 (Emp3), mRNA. 11/22Length = 737 | epithelial membrane protein 3 |
| 2206 | 16292 | NM_030860 | cc, dd | Rattus norvegicus myocyte enhancer factor 2D (Mef2d), mRNA. 11/22Length = 1557 | myocyte enhancer factor 2D |
| 2207 | 1048 | NM_030863 | s, t, hh | Rattus norvegicus moesin (Msn), mRNA. 11/22Length = 299 | moesin |
| 2208 | 1928 | NM_030872 | s, t | Rattus norvegicus pyruvate dehydrogenase kinase 2 (Pdk2), mRNA. 11/22Length = 227 | pyruvate dehydrogenase kinase 2 subunit p45 (PDK2) |
| 2208 | 1929 | NM_030872 | hh | Rattus norvegicus pyruvate dehydrogenase kinase 2 (Pdk2), mRNA. 11/22Length = 227 | pyruvate dehydrogenase kinase 2 subunit p45 (PDK2) |
| 2209 | 21801 | NM_030987 | cc, dd, ii | Rattus norvegicus Guanine nucleotide-binding protein beta 1(Gnb1), mRNA. 4/22Length = 2837 | Guanine nucleotide-binding protein beta 1 |
| 2209 | 21805 | NM_030987 | cc, dd | Rattus norvegicus Guanine nucleotide-binding protein beta 1(Gnb1), mRNA. 4/22Length = 2837 | Guanine nucleotide-binding protein beta 1 |
| 2210 | 8815 | NM_030991 | aa, bb | Rattus norvegicus synaptosomal-associated protein (Snap25), mRNA. 11/22Length = 21 | ESTs, Highly similar to LAS1_MOUSE LIM AND SH3 DOMAIN PROTEIN 1 (LASP-1) (MLN 50) [M. musculus] |
| 2211 | 1991 | NM_030995 | h, l | Rattus norvegicus Microtubule-associated protein 1a (Map1a), mRNA. 4/21Length = 1, 12 | Microtubule-associated protein 1a |
| 2212 | 21166 | NM_031005 | a, n, o | Rattus norvegicus actinin, alpha 1 (Actn1), mRNA. 5/22Length = 2956 | actinin, alpha 1 |
| 2213 | 25517 | NM_031010 | c, v | Rattus norvegicus arachidonate 12-lipoxygenase (Alox12), mRNA. 11/22Length = 248 | arachidonate 12-lipoxygenase |
| 2213 | 1845 | NM_031010 | c, v | Rattus norvegicus arachidonate 12-lipoxygenase (Alox12), mRNA. 11/22Length = 248 | arachidonate 12-lipoxygenase |
| 2214 | 15682 | NM_031011 | n, o | Rattus norvegicus S-Adenosylmethionine decarboxylase 1A (Amd1a), mRNA. 11/22Length = 312 | S-Adenosylmethionine decarboxylase 1 |
| 2214 | 15683 | NM_031011 | cc, dd, gg | Rattus norvegicus S-Adenosylmethionine decarboxylase 1A (Amd1a), mRNA. 11/22Length = 312 | S-Adenosylmethionine decarboxylase 1 |
| 2215 | 1540 | NM_031012 | n | Rattus norvegicus alanyl (membrane) aminopeptidase (Anpep), mRNA. 1/22Length = 332 | alanyl (membrane) aminopeptidase |
| 2216 | 1024 | NM_031016 | s, u, v | Rattus norvegicus muscarinic receptor m2 (Chrm2), mRNA. 4/21Length = 2483 | muscarinic receptor m2 |
| 2216 | 1025 | NM_031016 | u, v | Rattus norvegicus muscarinic receptor m2 (Chrm2), mRNA. 4/21Length = 2483 | muscarinic receptor m2 |

TABLE 1-continued

| SEQ ID | GLGC ID | GenBank Accession No. | Model Code | Known Gene Name | Unigene Sequence Cluster Title |
|---|---|---|---|---|---|
| 2217 | 485 | NM_031017 | l, m | *Rattus norvegicus* cAMP response element binding protein 1 (Creb1), mRNA. 3/22Length = 1125 | cAMP response element binding protein 1 |
| 2218 | 1719 | NM_031024 | jj, kk | *Rattus norvegicus* drebrin 1 (Dbn1), mRNA. 11/22Length = 2697 | drebrin 1 |
| 2219 | 16210 | NM_031026 | l, m | *Rattus norvegicus* LIC-2 dynein light intermediate chain 53/55(Dncli2), mRNA. 4/21Length = 43 | LIC-2 dynein light intermediate chain 53/55 |
| 2220 | 690 | NM_031034 | w, x | *Rattus norvegicus* guanine nucleotide binding protein, alpha 12 (Gna12), mRNA. 11/22Length = 1423 | guanine nucleotide binding protein (G protein) alpha 12 |
| 2221 | 15886 | NM_031035 | r, bb, ll | *Rattus norvegicus* GTP-binding protein (G-alpha-i2) (Gnai2), mRNA. 4/21Length = 1748 | GTP-binding protein (G-alpha-12) |
| 2222 | 17727 | NM_031043 | c | *Rattus norvegicus* glycogenin (Gyg), mRNA. 11/22Length= 1624 | glycogenin |
| 2223 | 18188 | NM_031046 | gg | *Rattus norvegicus* inositol 1,4,5-triphosphate receptor type 2 (Itpr2), mRNA. 11/22Length = 1, 78 | inositol triphosphate receptor type 2 |
| 2224 | 1731 | NM_031047 | jj, kk | *Rattus norvegicus* unction plakoglobin (Jup), mRNA. 4/21Length = 3177 | unction plakoglobin |
| 2225 | 15957 | NM_031050 | c, ii | *Rattus norvegicus* lumican (Lum), mRNA. 11/22Length = 174 | lumican |
| 2226 | 21182 | NM_031054 | l, m | *Rattus norvegicus* matrix metalloproteinase 2 (72 KDa type IVcollagenase) (Mmp2), mRNA. 5/22Length = 3231 | *Rattus norvegicus* gelatinase A mRNA, complete cds |
| 2227 | 11849 | NM_031065 | h, l, n, o | *Rattus norvegicus* ribosomal protein L1a (Rpl1a), mRNA. 11/22Length = 71 | ribosomal protein L10a |
| 2228 | 25600 | NM_031077 | b, l, m | *Rattus norvegicus* PCTAIRE-1 protein kinase, alternatively spliced (Pctk1), mRNA. 1/22Length = 3111 | PCTAIRE-1 protein kinase, alternatively spliced |
| 2228 | 6349 | NM_031077 | ee, ff | *Rattus norvegicus* PCTAIRE-1 protein kinase, alternatively spliced (Pctk1), mRNA. 1/22Length = 3111 | PCTAIRE-1 protein kinase, alternatively spliced |
| 2229 | 79 | NM_031079 | y, z, ee, ff | *Rattus norvegicus* cyclic GMP stimulated phosphodiesterase (Pde2a), mRNA. 4/21Length = 398 | cyclic GMP stimulated phosphodiesterase |
| 2230 | 4684 | NM_031083 | b, l, m | *Rattus norvegicus* phosphatidylinositol 4-kinase (Pik4cb), mRNA. 11/22Length = 325 | phosphatidylinositol 4-kinase |
| 2231 | 18307 | NM_031091 | w, x | *Rattus norvegicus* Rab3B protein (Rab3b), mRNA. 4/21Length = 66 | Rab3B protein |
| 2231 | 18308 | NM_031091 | w, x | *Rattus norvegicus* Rab3B protein (Rab3b), mRNA. 4/21Length = 66 | Rab3B protein |
| 2232 | 15201 | NM_031093 | h, l, w | *Rattus norvegicus* (Rala), mRNA. 11/22Length = 952 | |
| 2232 | 15202 | NM_031093 | f, w, x, cc, dd | *Rattus norvegicus* (Rala), mRNA. 11/22Length = 952 | |

TABLE 1-continued

| SEQ ID | GLGC ID | GenBank Accession No. | Model Code | Known Gene Name | Unigene Sequence Cluster Title |
|---|---|---|---|---|---|
| 2232 | 15203 | NM_031093 | aa, bb | *Rattus norvegicus* (Rala), mRNA. 11/22Length = 952 | |
| 2233 | 1376 | NM_031094 | ii | *Rattus norvegicus* Retinoblastoma-related gene (Rb2), mRNA. 11/22Length = 4861 | Retinoblastoma-related gene |
| 2234 | 1295 | NM_031097 | j, k, r | *Rattus norvegicus* aminopeptidase B (Rnpep), mRNA. 4/21Length = 228 | aminopeptidase B |
| 2235 | 12638 | NM_031099 | e | *Rattus norvegicus* ribosomal protein L5 (Rpl5), mRNA. 11/22Length = 169 | ribosomal protein L5 |
| 2235 | 12639 | NM_031099 | g | *Rattus norvegicus* ribosomal protein L5 (Rpl5), mRNA. 11/22Length = 169 | ribosomal protein L5 |
| 2236 | 20812 | NM_031100 | g, h, l | *Rattus norvegicus* ribosomal protein L1 (Rpl1), mRNA. 11/22Length = 769 | ribosomal protein L10 |
| 2237 | 23854 | NM_031101 | f, w, x, ll | *Rattus norvegicus* ribosomal protein L13 (Rpl13), mRNA. 11/22Length = 722 | ribosomal protein L13 |
| 2238 | 20462 | NM_031102 | h, l | *Rattus norvegicus* ribosomal protein L18 (Rpl18), mRNA. 11/22Length = 67 | ribosomal protein L18 |
| 2239 | 16938 | NM_031103 | g | *Rattus norvegicus* ribosomal protein L19 (Rpl19), mRNA. 11/22Length = 73 | ribosomal protein L19 |
| 2240 | 22205 | NM_031105 | b | *Rattus norvegicus* large subunit ribosomal protein L36a(Rpl36a), mRNA. 4/21Length = 444 | large subunit ribosomal protein L36a |
| 2241 | 20807 | NM_031106 | f, g | *Rattus norvegicus* ribosomal protein L37 (Rpl37), mRNA. 11/22Length = 366 | ribosomal protein L37 |
| 2242 | 16847 | NM_031109 | h, l, x | *Rattus norvegicus* ribosomal protein S1 (Rps1), mRNA. 11/22Length = 61 | ribosomal protein S10 |
| 2243 | 10878 | NM_031110 | g, j, k | *Rattus norvegicus* ribosomal protein S11 (Rps11), mRNA. 11/22Length = 534 | ribosomal protein S21 |
| 2244 | 19162 | NM_031111 | h, l | *Rattus norvegicus* ribosomal protein S21 (Rps21), mRNA. 11/22Length = 359 | ribosomal protein S21 |
| 2245 | 25458 | NM_031112 | h, l | *Rattus norvegicus* ribosomal protein S24 (Rps24), mRNA. 11/22Length = 466 | |
| 2246 | 20839 | NM_031113 | w, x | *Rattus norvegicus* ribosomal protein S27a (Rps27a), mRNA. 4/21Length = 552 | ribosomal protein S27a |
| 2247 | 19040 | NM_031114 | a, c, h, l, y, ee, ff | *Rattus norvegicus* S-1 related protein, clone 42C (S1A1), mRNA. 2/22Length = 573 | S-100 related protein, clone 420 |
| 2248 | 23568 | NM_031122 | e | *Rattus norvegicus* suppression of tumorigenicity 13 (coloncarcinoma) Hsp7-interacting protein (St13), mRNA. 4/21Length = 1694 | suppression of tumorigenicity 13 (colon carcinoma) Hsp70-interacting protein |

TABLE 1-continued

| SEQ ID | GLGC ID | GenBank Accession No. | Model Code | Known Gene Name | Unigene Sequence Cluster Title |
|---|---|---|---|---|---|
| 2248 | 23569 | NM_031122 | r | *Rattus norvegicus* suppression of tumorigenicity 13 (coloncarcinoma) Hsp7-interacting protein (St13), mRNA. 4/21Length = 1694 | suppression of tumorigenicity 13 (colon carcinoma) Hsp70-interacting protein |
| 2249 | 882 | NM_031123 | d | *Rattus norvegicus* stanniocalcin 1 (Stc1), mRNA. 11/22Length = 14 | stanniocalcin 1 |
| 2250 | 1265 | NM_031124 | u, v | *Rattus norvegicus* syntaxin 3 (Stx3a), mRNA. 11/22Length = 154 | syntaxin 3 |
| 2251 | 14970 | NM_031127 | a, h, l, n, o | *Rattus norvegicus* sulfite oxidase (Suox), mRNA. 11/22Length= 1777 | sulfite oxidase |
| 2252 | 6525 | NM_031129 | gg | *Rattus norvegicus* transcription elongation factor B (SIII) polypeptide 2 (18 kD, elongin B) (TCEB2), mRNA. 4/21Length = 357 | transcription elongation factor B (SIII) polypeptide 2 (18 kD, elongin B) |
| 2253 | 13929 | NM_031131 | n, o, hh | *Rattus norvegicus* transforming growth factor, beta 2 (Tgfb2), mRNA. 11/22Length = 288 | TGF beta 2 protein |
| 2254 | 1816 | NM_031134 | l, m | *Rattus norvegicus* thyroid hormone receptor alpha (Thra), mRNA. 11/22Length = 246 | thyroid hormone receptor alpha |
| 2255 | 13358 | NM_031135 | d | *Rattus norvegicus* TGFB inducible early growth response (Tieg), mRNA. 11/22Length = 3115 | TGFB inducible early growth response |
| 2255 | 13359 | NM_031135 | s, t | *Rattus norvegicus* TGFB inducible early growth response (Tieg), mRNA. 11/22Length = 3115 | TGFB inducible early growth response |
| 2256 | 15052 | NM_031136 | c, w, x, aa, bb | *Rattus norvegicus* thymosin beta-4 (Tmsb4x), mRNA. 4/21Length = 686 | thymosin beta-4 |
| 2256 | 19359 | NM_031136 | h, l | *Rattus norvegicus* thymosin beta-4 (Tmsb4x), mRNA. 4/21Length = 686 | EST |
| 2257 | 15485 | NM_031137 | l, m | *Rattus norvegicus* tripeptidylpeptidase II (Tpp2), mRNA. 4/21Length = 4566 | tripeptidylpeptidase II |
| 2257 | 15486 | NM_031137 | w, x | *Rattus norvegicus* tripeptidylpeptidase II (Tpp2), mRNA. 4/21Length = 4566 | tripeptidylpeptidase II |
| 2258 | 17379 | NM_031138 | r, w, x | *Rattus norvegicus* ubiquitin conjugating enzyme (LOC81816), mRNA. 4/21Length = 1737 | ubiquitin conjugating enzyme |
| 2259 | 15185 | NM_031140 | n, bb, ll | *Rattus norvegicus* vimentin (Vim), mRNA. 11/22Length = 1796 | vimentin |
| 2260 | 1638 | NM_031143 | d, e, ii, kk | *Rattus norvegicus* diacylglycerol kinase zeta (Dgkz), mRNA. 11/22Length = 356 | diacylglycerol kinase zeta |
| 2261 | 21623 | NM_031144 | c | *Rattus norvegicus* cytoplasmic beta-actin (Actx), mRNA. 4/21Length = 1128 | |

TABLE 1-continued

| SEQ ID | GLGC ID | GenBank Accession No. | Model Code | Known Gene Name | Unigene Sequence Cluster Title |
|---|---|---|---|---|---|
| 2262 | 23097 | NM_031145 | n, o, cc, dd | *Rattus norvegicus* calcium- and integrin-binding protein(Sip2-28), mRNA. 4/21Length = 822 | calcium- and integrin-binding protein |
| 2263 | 1291 | NM_031149 | c, r | *Rattus norvegicus* for proteasomal ATPase (SUG1) (L0081827), mRNA. 4/21Length = 1288 | for proteasomal ATPase (SUG1) |
| 2264 | 239 | NM_031152 | e | *Rattus norvegicus* RAB11a, member RAS oncogene family(Rab11a), mRNA. 11/22Length = 895 | RAB11a, member RAS oncogene family |
| 2265 | 20862 | NM_031154 | w, x | *Rattus norvegicus* glutathione S-transferase, mu type 3 (Yb3) (Gstm3), mRNA. 4/21Length = 128 | glutathione S-transferase, mu type 3 (Yb3) |
| 2266 | 15273 | NM_031237 | aa, bb | *Rattus norvegicus* ubiquitin-conjugating enzyme E2D 3(homologous to yeast UBC⅘) (Ube2d3), mRNA. 4/21Length = 1531 | ubiquitin-conjugating enzyme E2D 3 (homologous to yeast UBC⅘) |
| 2266 | 15277 | NM_031237 | a | *Rattus norvegicus* ubiquitin-conjugating enzyme E2D 3(homologous to yeast UBC⅘) (Ube2d3), mRNA. 4/21Length = 1531 | ubiquitin-conjugating enzyme E2D 3 (homologous to yeast UBC⅘) |
| 2267 | 18596 | NM_031325 | u, v | *Rattus norvegicus* UDP-glucose dehydrogeanse (Ugdh), mRNA. 4/21Length = 2318 | UDP-glucose dehydrogeanse |
| 2267 | 18597 | NM_031325 | a, j, k, p, q, y, z, ee, ff | *Rattus norvegicus* UDP-glucose dehydrogeanse (Ugdh), mRNA. 4/21Length = 2318 | UDP-glucose dehydrogeanse |
| 2268 | 11258 | NM_031327 | y, z, ee, ff, gg | *Rattus norvegicus* cysteine rich protein 61 (Cyr61), mRNA. 11/22Length = 1871 | cysteine rich protein 61 |
| 2269 | 4235 | NM_031330 | b, d, f, g, l, m | *Rattus norvegicus* heterogeneous nuclear ribonucleoprotein A/B(Hnrpab), mRNA. 11/22Length = 361 | heterogeneous nuclear ribonucleoprotein A/B |
| 2270 | 18539 | NM_031353 | f, g | *Rattus norvegicus* voltage-dependent anion channel 1 (Vdac1), mRNA. 11/22Length = 1818 | voltage-dependent anion channel 1 |
| 2271 | 16777 | NM_031354 | hh | *Rattus norvegicus* voltage-dependent anion channel 2 (Vdac2), mRNA. 11/22Length = 1715 | voltage-dependent anion channel 2 |
| 2272 | 20087 | NM_031357 | cc, dd | *Rattus norvegicus* ceroid-lipofuscinosis, neuronal 2 (Cln2), mRNA. 11/22Length = 2485 | ESTs |
| 2273 | 18654 | NM_031358 | a, d, r, y, z, ee, ff, kk | *Rattus norvegicus* potassium inwardly rectifying channel, subfamily J, member 11 (Kcnj11), mRNA. 11/22Length = 335 | potassium inwardly-rectifying channel, subfamily J, member 11 |
| 2273 | 18655 | NM_031358 | d, l, m, jj, kk | *Rattus norvegicus* potassium inwardly rectifying channel, subfamily J, member 11 (Kcnj11), | potassium inwardly-rectifying channel, subfamily J, member 11 |

TABLE 1-continued

| SEQ ID | GLGC ID | GenBank Accession No. | Model Code | Known Gene Name | Unigene Sequence Cluster Title |
|---|---|---|---|---|---|
| 2274 | 25525 | NM_031509 | b, r | Rattus norvegicus Glutathione-S-transferase, alpha type (Ya) (Gsta1), mRNA. 11/22Length = 335 | Glutathione-S-transferase, alpha type (Ya) |
| 2274 | 634 | NM_031509 | d, r | Rattus norvegicus Glutathione-S-transferase, alpha type (Ya) (Gsta1), mRNA. 5/21Length= 1178 | Glutathione-S-transferase, alpha type (Ya) |
| 2274 | 635 | NM_031509 | d, r | Rattus norvegicus Glutathione-S-transferase, alpha type (Ya) (Gsta1), mRNA. 5/21Length = 1178 | Glutathione-S-transferase, alpha type (Ya) |
| 2275 | 17427 | NM_031510 | b, u, v | Rattus norvegicus Isocitrate dehydrogenase 1, soluble (Idh1), mRNA. 5/21Length = 1719 | Isocitrate dehydrogenase 1, soluble |
| 2276 | 12580 | NM_031514 | a, h, l, j, k, y, z | Rattus norvegicus Janus kinase 2 (a protein tyrosine kinase)(Jak2), mRNA. 5/21Length = 3731 | Janus kinase 2 (a protein tyrosine kinase) |
| 2276 | 12581 | NM_031514 | y, z, hh | Rattus norvegicus Janus kinase 2 (a protein tyrosine kinase)(Jak2), mRNA. 5/21Length = 3731 | Janus kinase 2 (a protein tyrosine kinase) |
| 2277 | 20448 | NM_031530 | a, d, z, ee, ff, jj, kk | Rattus norvegicus small inducible cytokine A2 (Scya2), mRNA. 11/22Length = 78 | Small inducible gene JE |
| 2277 | 20449 | NM_031530 | a, z, ee, ff, kk | Rattus norvegicus small inducible cytokine A2 (Scya2), mRNA. 11/22Length = 78 | Small inducible gene JE |
| 2278 | 3292 | NM_031531 | a, j, k | Rattus norvegicus Serine protease inhibitor (Spin2c), mRNA. 11/22Length = 261 | Serine protease inhibitor |
| 2279 | 1005 | NM_031537 | l, m | Rattus norvegicus Solute carrier family 11 member 1 (Slc11a1), mRNA. 11/22Length = 167 | Solute carrier family 11 member 1 (natural resistance-associated macrophage protein 1), see also D9Arb3 |
| 2280 | 16049 | NM_031541 | n, o | Rattus norvegicus CD36 antigen (collagen type I receptor, thrombospondin receptor)-like 1 (Cd36l1), mRNA. 1/22Length = 2497 | CD36 antigen (collagen type I receptor, thrombospondin receptor)-like 1 (scavanger receptor class B type 1) |
| 2281 | 4010 | NM_031543 | u, v | Rattus norvegicus Cytochrome P45, subfamily 2e1 (ethanol-inducible) (Cyp2e1), mRNA. 11/22Length = 1624 | Cytochrome P450, subfamily 2e1 (ethanol inducible) |
| 2281 | 4011 | NM_031543 | v | Rattus norvegicus Cytochrome P45, subfamily 2e1 (ethanol-inducible) (Cyp2e1), mRNA. 11/22Length = 1624 | Cytochrome P450, subfamily 2e1 (ethanol inducible) |
| 2282 | 18389 | NM_031545 | a, d, y, ee, ff | Rattus norvegicus natriuretic peptide precursor type B (Nppb), mRNA. 11/22Length = 628 | Brain natriuretic factor |
| 2283 | 1822 | NM_031553 | ii | Rattus norvegicus nuclear transcription factor - Y beta (Nfyb), mRNA. 11/22Length = 734 | CCAAT binding transcription factor of CBF-B/NFY-B |

TABLE 1-continued

| SEQ ID | GLGC ID | GenBank Accession No. | Model Code | Known Gene Name | Unigene Sequence Cluster Title |
|---|---|---|---|---|---|
| 2284 | 25795 | NM_031556 | jj, kk | *Rattus norvegicus* Caveolin, caveolae protein, 22 kDa (Cav), mRNA. 11/22Length = 537 | Caveolin, caveolae protein, 22 kDa |
| 2285 | 692 | NM_031557 | s, t, ll | *Rattus norvegicus* Prostaglandin I2 (prostacyclin) synthase (Ptgis), mRNA. 11/22Length = 1618 | Prostaglandin I2 (prostacyclin) synthase |
| 2286 | 18315 | NM_031561 | e, u | *Rattus norvegicus* cd36 antigen (Cd36), mRNA. 11/22Length = 2436 | CD36 antigen (collagen type I receptor, thrombospondin receptor) |
| 2286 | 18316 | NM_031561 | e | *Rattus norvegicus* cd36 antigen (Cd36), mRNA. 11/22Length = 2436 | CD36 antigen (collagen type I receptor, thrombospondin receptor) |
| 2286 | 18317 | NM_031561 | r, aa, bb, ii | *Rattus norvegicus* cd36 antigen (Cd36), mRNA. 11/22Length = 2436 | CD36 antigen (collagen type I receptor, thrombospondin receptor) |
| 2286 | 18319 | NM_031561 | w, x | *Rattus norvegicus* cd36 antigen (Cd36), mRNA. 11/22Length = 2436 | CD36 antigen (collagen type I receptor, thrombospondin receptor) |
| 2287 | 9620 | NM_031570 | w, x, cc, dd | *Rattus norvegicus* ribosomal protein S7 (Rps7), mRNA. 11/22Length = 65 | ribosomal protein S7 |
| 2288 | 546 | NM_031573 | h, ii | *Rattus norvegicus* Phosphorylase kinase, gamma 1 (Phkg1), mRNA. 11/21Length = 1388 | Phosphorylase kinase, gamma 1 |
| 2289 | 1918 | NM_031576 | gg | *Rattus norvegicus* P45 (cytochrome) oxidoreductase (Por), mRNA. 11/22Length = 2441 | P450 (cytochrome) oxidoreductase |
| 2289 | 1920 | NM_031576 | s | *Rattus norvegicus* P45 (cytochrome) oxidoreductase (Por), mRNA. 11/22Length = 2441 | P450 (cytochrome) oxidoreductase |
| 2289 | 1921 | NM_031576 | j, k, s, t | *Rattus norvegicus* P45 (cytochrome) oxidoreductase (Por), mRNA. 11/22Length = 2441 | P450 (cytochrome) oxidoreductase |
| 2290 | 942 | NM_031577 | u | *Rattus norvegicus* growth hormone releasing hormone (Ghrh), mRNA. 11/22Length = 616 | growth hormone releasing hormone |
| 2290 | 25793 | NM_031577 | ii | *Rattus norvegicus* growth hormone releasing hormone (Ghrh), mRNA. 11/22Length = 616 | |
| 2291 | 21715 | NM_031578 | aa | *Rattus norvegicus* testis specific protein kinase 1 (Tesk1), mRNA. 11/22Length = 3581 | testis specific protein kinase 1 |
| 2292 | 24219 | NM_031579 | d, p, q, y, z, kk | *Rattus norvegicus* protein tyrosine phosphatase 4a1 (Ptp4a1), mRNA. 11/22Length = 2638 | protein tyrosine phosphatase 4a1 |
| 2293 | 5496 | NM_031589 | a, ee, ff | *Rattus norvegicus* glucose-6-phosphatase, transport protein 1 (G6pt1), mRNA. 11/22Length= 193 | glucose-6-phosphatase, transport protein 1 |
| 2293 | 5497 | NM_031589 | ii | *Rattus norvegicus* glucose-6-phosphatase, transport protein 1 (G6pt1), mRNA. 11/22Length = 193 | glucose-6-phosphatase, transport protein 1 |
| 2294 | 14542 | NM_031596 | r | *Rattus norvegicus* squamous cell carcinoma antigen recognized by T- | squamous cell carcinoma antigen recognized by T-cells |

TABLE 1-continued

| SEQ ID | GLGC ID | GenBank Accession No. | Model Code | Known Gene Name | Unigene Sequence Cluster Title |
|---|---|---|---|---|---|
| 2294 | 14543 | NM_031596 | b, u, v | cells 1 (Sart1), mRNA. 11/22Length = 2532 *Rattus norvegicus* squamous cell carcinoma antigen recognized by T-cells 1 (Sart1), mRNA. 11/22Length = 2532 | squamous cell carcinoma antigen recognized byT-cells |
| 2295 | 19341 | NM_031603 | h, l | *Rattus norvegicus* tyrosine 3-monooxygenase/tryptophan 5-monooxygenase activation protein, epsilon polypeptide (Ywhae), mRNA. 11/22Length = 1771 | tyrosine 3-monooxygenase/tryptophan 5-monooxygenase activatioprotein, epsilon polypeptide |
| 2296 | 20840 | NM_031604 | cc, dd | *Rattus norvegicus* ATPase, H+ transporting, lysosomal noncatalytic accessory protein 1a (Atp6n1a), mRNA. 11/22Length = 3876 | ATPase, H+ transporting, lysosomal (vacuolar proton pump) noncatalytic accessory protein 1(110/160 kDa) |
| 2297 | 11296 | NM_031606 | f | *Rattus norvegicus* phosphatase and tensin homolog (Pten), mRNA. 11/22Length = 1212 | phosphatase and tensin homolog (mutated in multiple advanced cancers 1) |
| 2298 | 19022 | NM_031609 | s, t, jj, kk | *Rattus norvegicus* neuroblastoma, suppression of tumorigenicity1 (Nbl1), mRNA. 11/22Length = 1788 | Neuroblastoma, suppression of tumorigenicity 1 (DNA segment human D1S1733E) D1S1733E) |
| 2299 | 24234 | NM_031614 | r, y, z, jj, kk | *Rattus norvegicus* thioredoxin reductase 1 (Txnrd1), mRNA. 11/22Length = 336 | thioredoxin reductase 1 |
| 2299 | 24235 | NM_031614 | y, z, kk | *Rattus norvegicus* thioredoxin reductase 1 (Txnrd1), mRNA. 11/22Length = 336 | thioredoxin reductase 1 |
| 2300 | 14957 | NM_031622 | f | *Rattus norvegicus* mitogen-activated protein kinase 6 (Mapk6), mRNA. 11/22Length = 3662 | mitogen-activated protein kinase 6 |
| 2301 | 15767 | NM_031623 | aa, bb, jj, kk, ll | *Rattus norvegicus* growth factor receptor bound protein 14 (Grb14), mRNA. 11/22Length = 195 | growth factor receptor bound protein 14 |
| 2302 | 21772 | NM_031624 | y, z | *Rattus norvegicus* immunoglobulin binding protein 1 (Igbp1), mRNA. 11/22Length= 1239 | immunoglobulin (CD79A) binding protein 1 |
| 2303 | 567 | NM_031628 | p, q | *Rattus norvegicus* nuclear receptor subfamily 4, group A, member 3 (Nr4a3), mRNA. 11/22Length = 44 | nuclear receptor subfamily 4, group A, member 3 |
| 2304 | 1727 | NM_031642 | jj, kk | *Rattus norvegicus* core promoter element binding protein (Copeb), mRNA. 11/22Length = 1356 | core promoter element binding protein |
| 2305 | 16062 | NM_031646 | n, o | *Rattus norvegicus* receptor (calcitonin) activity modifying protein 2 (Ramp2), mRNA. 11/22Length = 751 | receptor (calcitonin) activity modifying protein 2 |
| 2306 | 17448 | NM_031668 | h, l | *Rattus norvegicus* MYB binding protein 1a (Mybbp1a), mRNA. 11/22Length = 3834 | MYB binding protein (P160) 1a |
| 2307 | 5358 | NM_031675 | r | *Rattus norvegicus* actinin alpha 4 (Actn4), mRNA. 11/22Length = 2996 | Actinin, alpha 4 |

TABLE 1-continued

| SEQ ID | GLGC ID | GenBank Accession No. | Model Code | Known Gene Name | Unigene Sequence Cluster Title |
|---|---|---|---|---|---|
| 2308 | 19909 | NM_031676 | ii | *Rattus norvegicus* transgelin 3 (Tagln3), mRNA. 1/22Length = 12 | EST |
| 2309 | 18403 | NM_031677 | d, jj, kk | *Rattus norvegicus* four and a half LIM domains 2 (Fhl2), mRNA. 11/22Length = 84 | four and a half LIM domains 2 |
| 2310 | 15041 | NM_031678 | jj, kk | *Rattus norvegicus* period homolog 2 (Per2), mRNA. 11/22Length = 5761 | period homolog 2 (*Drosophila*) |
| 2311 | 20743 | NM_031684 | a, x, z, kk | *Rattus norvegicus* solute carrier family 29, member 1 (Slc29a1), mRNA. 11/22Length = 1766 | solute carrier family 29 (nucleoside transporters), member 1 |
| 2312 | 8844 | NM_031690 | b | *Rattus norvegicus* crystallin, beta B3 (Crybb3), mRNA. 11/22Length = 747 | crystallin, beta B3 |
| 2313 | 16663 | NM_031695 | s | *Rattus norvegicus* sialyltransferase 5 (Siat5), mRNA. 11/22Length = 2725 | sialyltransferase 5 |
| 2314 | 21575 | NM_031698 | w, x | *Rattus norvegicus* ribophorin 2 (Rpn2), mRNA. 1/22Length = 2234 | ribophorin II |
| 2315 | 16204 | NM_031706 | f, g, jj, kk | *Rattus norvegicus* ribosomal protein S8 (Rps8), mRNA. 11/22Length = 696 | ribosomal protein S8 |
| 2315 | 16205 | NM_031706 | jj, kk | *Rattus norvegicus* ribosomal protein S8 (Rps8), mRNA. 11/22Length = 696 | ribosomal protein S8 |
| 2316 | 18054 | NM_031707 | f, g, n, o | *Rattus norvegicus* homer, neuronal immediate early gene, 1(Homer1), mRNA. 11/22Length = 45 | RuvB-like protein 1 |
| 2316 | 18057 | NM_031707 | r | *Rattus norvegicus* homer, neuronal immediate early gene, 1(Homer1), mRNA. 11/22Length = 45 | RuvB-like protein 1 |
| 2316 | 18059 | NM_031707 | p, q, ee, ff | *Rattus norvegicus* homer, neuronal immediate early gene, 1(Homer1), mRNA. 11/22Length = 45 | RuvB-like protein 1 |
| 2317 | 24081 | NM_031708 | e | *Rattus norvegicus* adhesion regulating molecule 1 (Adrm1), mRNA. 11/22Length = 1444 | glycoprotein 110 |
| 2318 | 16918 | NM_031709 | g, h, l, w, x | *Rattus norvegicus* ribosomal protein S12 (Rps12), mRNA. 11/22Length = 499 | ribosomal protein S12 |
| 2319 | 20210 | NM_031710 | u, v | *Rattus norvegicus* olfactory receptor 41 (Olfr41), mRNA. 11/22Length = 984 | olfactory receptor 41 |
| 2320 | 1340 | NM_031715 | jj, kk | *Rattus norvegicus* phosphofructokinase, *muscle (Pfkm)*, mRNA. 11/22Length = 2757 | phosphofructokinase, muscle |
| 2321 | 19048 | NM_031719 | jj, kk | *Rattus norvegicus* chloride channel, nucleotide-sensitive, 1A(Clns1a), mRNA. 11/22Length = 1399 | chloride channel, nucleotide-sensitive, 1A |
| 2322 | 15507 | NM_031735 | u | *Rattus norvegicus* serine/threonine kinase 3 (Stk3), mRNA. 11/22Length = 261 | serine/threonine kinase 3 (Ste20, yeast homolog) STK3 |
| 2323 | 20724 | NM_031753 | d | *Rattus norvegicus* activated leukocyte cell | activated leukocyte cell adhesion molecule |

TABLE 1-continued

| SEQ ID | GLGC ID | GenBank Accession No. | Model Code | Known Gene Name | Unigene Sequence Cluster Title |
|---|---|---|---|---|---|
| 2324 | 16003 | NM_031757 | c | adhesion molecule (Alcam), mRNA. 11/22Length = 2866 *Rattus norvegicus* matrix metalloproteinase 24 (membrane-inserted) (Mmp24), mRNA. 11/22Length = 4245 | matrix metalloproteinase 24 (membrane-inserted) |
| 2325 | 14184 | NM_031776 | kk | *Rattus norvegicus* guanine deaminase (Gda), mRNA. 11/22Length = 1568 | guanine deaminase |
| 2325 | 14185 | NM_031776 | kk | *Rattus norvegicus* guanine deaminase (Gda), mRNA. 11/22Length = 1568 | guanine deaminase |
| 2326 | 4325 | NM_031784 | d | *Rattus norvegicus* potassium channel regulatory protein KChAP (83614), mRNA. 12/21Length = 2927 | potassium channel regulatory protein KChAP |
| 2327 | 16178 | NM_031785 | f | *Rattus norvegicus* ATPase, H+ transporting, lysosomal(vacuolar proton pump), subunit 1 (Atp6s1), mRNA. 5/21Length = 289 | ATPase, H+ transporting, lysosomal (vacuolar proton pump), subunit 1 |
| 2328 | 1169 | NM_031789 | d | *Rattus norvegicus* NF-E2-related factor 2 (Nfe2l2), mRNA. 5/21Length = 237 | NF-E2-related factor 2 |
| 2328 | 1170 | NM_031789 | d, l, m, jj, kk | *Rattus norvegicus* NF-E2-related factor 2 (Nfe2l2), mRNA. 5/21Length = 237 | NF-E2-related factor 2 |
| 2329 | 1182 | NM_031790 | b, l, m | *Rattus norvegicus* citron (Cit), mRNA. 11/22Length = 5952 | postsynaptic density protein (citron) |
| 2330 | 15864 | NM_031797 | r | *Rattus norvegicus* kangai 1 (Kai1), mRNA. 11/22Length = 174 | ESTs, Kangai 1 (suppression of tumorigenicity 6, prostate; CD82 antigen (R2 leukocyte antigen, antigen detected by monoclonal and antibody IA4)) |
| 2331 | 2114 | NM_031798 | aa, bb | *Rattus norvegicus* solute carrier family 12, member 2 (Slc12a2), mRNA. 11/22Length = 642 | solute carrier family 12, member 2 |
| 2332 | 16155 | NM_031810 | ii | *Rattus norvegicus* defensin beta 1 (Defb1), mRNA. 5/22Length = 416 | defensin beta 1 |
| 2333 | 15840 | NM_031817 | h, l | *Rattus norvegicus* osteomodulin (osteoadherin) (Omd), mRNA. 5/21Length = 1536 | osteomodulin (osteoadherin) |
| 2334 | 2655 | NM_031821 | d | *Rattus norvegicus* serum-inducible kinase (Snk), mRNA. 11/22Length = 2781 | serum-inducible kinase |
| 2335 | 22321 | NM_031832 | a, h, l, n, o, x, kk | *Rattus norvegicus* lectin, galactose binding, soluble 3(Lgals3), mRNA. 5/22Length = 948 | lectin, galactose binding, soluble 3 |
| 2336 | 4748 | NM_031834 | s, t, aa, bb | *Rattus norvegicus* sulfotransferase family 1A, phenol-preferring, member 1 (Sult1a1), mRNA. 1/22Length = 1227 | sulfotransferase family 1A, phenol-preferring, member 1 |
| 2336 | 4749 | NM_031834 | t, bb | *Rattus norvegicus* sulfotransferase family 1A, phenol-preferring, member 1 (Sult1a1), mRNA. 1/22Length = 1227 | Aryl sulfotransferase cytosolic, 1A, phenol-preferring, member 3, sulfotransferase family 1A, phenol-preferring, member 1 |
| 2337 | 8384 | NM_031836 | gg, ll | *Rattus norvegicus* vascular endothelial growth factor | vascular endothelial growth factor |

TABLE 1-continued

| SEQ ID | GLGC ID | GenBank Accession No. | Model Code | Known Gene Name | Unigene Sequence Cluster Title |
|---|---|---|---|---|---|
| 2337 | 8385 | NM_031836 | s, t, gg | Rattus norvegicus vascular endothelial growth factor (Vegf), mRNA. 11/22Length = 645 Rattus norvegicus vascular endothelial growth factor (Vegf), mRNA. 11/22Length = 645 | vascular endothelial growth factor |
| 2337 | 8386 | NM_031836 | ll | Rattus norvegicus vascular endothelial growth factor (Vegf), mRNA. 11/22Length = 645 | vascular endothelial growth factor |
| 2338 | 10269 | NM_031838 | h, l, w, x | Rattus norvegicus ribosomal protein S2 (Rps2), mRNA. 11/22Length = 817 | ribosomal protein S2 |
| 2339 | 15077 | NM_031841 | ii | Rattus norvegicus stearoyl-Coenzyme A desaturase 2 (Scd2), mRNA. 5/22Length = 555 | Rat DNA polymerase alpha mRNA, 3' end, stearoyl-Coenzyme A desaturase 2 |
| 2340 | 19190 | NM_031969 | h, l | Rattus norvegicus Calmodulin 1 (phosphorylase kinase, delta) (Calm1), mRNA. 11/22Length = 3513 | Calmodulin 1 (phosphorylase kinase, delta) |
| 2340 | 19191 | NM_031969 | h, l | Rattus norvegicus Calmodulin 1 (phosphorylase kinase, delta) (Calm1), mRNA. 11/22Length = 3513 | Calmodulin 1 (phosphorylase kinase, delta) |
| 2340 | 19195 | NM_031969 | h, l, ll | Rattus norvegicus Calmodulin 1 (phosphorylase kinase, delta) (Calm1), mRNA. 11/22Length = 3513 | Calmodulin 1 (phosphorylase kinase, delta) |
| 2340 | 25802 | NM_031969 | h, i, aa, bb, ll | Rattus norvegicus Calmodulin 1 (phosphorylase kinase, delta) (Calm1), mRNA. 11/22Length = 3513 | Calmodulin 1 (phosphorylase kinase, delta) |
| 2341 | 17734 | NM_031970 | a, o, q, ee, ff, kk | Rattus norvegicus Heat shock 27 kDa protein (Hsp27), mRNA. 11/22Length = 787 | ESTs, Moderately similar to hypothetical protein MGC10974 [Homo sapiens] [H. sapiens], heat shock 27 kD protein 1 |
| 2341 | 17735 | NM_031970 | a, z, ee, ff, kk | Rattus norvegicus Heat shock 27 kDa protein (Hsp27), mRNA. 11/22Length = 787 | ESTs, Moderately similar to hypothetical protein MGC10974 [Homo sapiens] [H. sapiens], heat shock 27 kD protein 1 |
| 2341 | 17736 | NM_031970 | a, l, o, q, ee, ff, kk | Rattus norvegicus Heat shock 27 kDa protein (Hsp27), mRNA. 11/22Length = 787 | ESTs, Moderately similar to hypothetical protein MGC10974 [Homo sapiens] [H. sapiens], heat shock 27 kD protein 1 |
| 2342 | 1475 | NM_031971 | a, p, q, ee, ff | Rattus norvegicus Heat shock protein 7-1 (Hspa1a), mRNA. 5/21Length = 2455 | ESTs, Highly similar to S10A_RAT S-100 protein, alpha chain [R.norvegicus], Heat shock protein 70-1 |
| 2342 | 8661 | NM_031971 | e, ee, ff, gg | Rattus norvegicus Heat shock protein 7-1 (Hspa1a), mRNA. 5/21Length = 2455 | Heat shock protein 70-1 |
| 2342 | 8662 | NM_031971 | ee, ff, gg | Rattus norvegicus Heat shock protein 7-1 (Hspa1a), mRNA. 5/21Length = 2455 | Heat shock protein 70-1 |
| 2342 | 8663 | NM_031971 | ee, ff, gg | Rattus norvegicus Heat shock protein 7-1 (Hspa1a), mRNA. 5/21Length = 2455 | Heat shock protein 70-1 |
| 2343 | 24644 | NM_031972 | cc, dd | Rattus norvegicus Aldehyde dehydrogenase family 3, subfamily A1 (Aldh3a1), mRNA. 11/22Length = 1725 | Aldehyde dehydrogenase class 3 |

TABLE 1-continued

| SEQ ID | GLGC ID | GenBank Accession No. | Model Code | Known Gene Name | Unigene Sequence Cluster Title |
|---|---|---|---|---|---|
| 2344 | 17075 | NM_031974 | gg | *Rattus norvegicus* clathrin, light polypeptide (Lca) (Clta), mRNA. 11/22Length = 1124 | clathrin light chain |
| 2345 | 17556 | NM_031975 | j, k | *Rattus norvegicus* parathymosin (Ptms), mRNA. 11/22Length = 936 | parathymosin |
| 2346 | 17601 | NM_031976 | a, jj, kk | *Rattus norvegicus* protein kinase, AMP-activated, beta 1non-catalytic subunit (Prkab1), mRNA. 11/22Length = 1978 | 5'-AMP-activated protein kinase, beta subunit |
| 2347 | 18499 | NM_031984 | aa, bb | *Rattus norvegicus* calbindin 1 (Calb1), mRNA. 11/22Length = 228 | cerebellar Ca-binding protein, spot 35 protein |
| 2347 | 18500 | NM_031984 | bb | *Rattus norvegicus* calbindin 1 (Calb1), mRNA. 11/22Length = 228 | cerebellar Ca-binding protein, spot 35 protein |
| 2348 | 18898 | NM_031985 | ii | *Rattus norvegicus* S6 kinase (Rps6kb1), mRNA. 5/21Length = 2287 | S6 kinase |
| 2348 | 18899 | NM_031985 | gg | *Rattus norvegicus* S6 kinase (Rps6kb1), mRNA. 5/21Length = 2287 | S6 kinase |
| 2349 | 19768 | NM_031986 | f, g, cc, dd | *Rattus norvegicus* syntenin (Sdcbp), mRNA. 5/21Length = 277 | syntenin |
| 2350 | 20554 | NM_031987 | b, l, m, aa, cc dd | *Rattus norvegicus* carnitine O-octanoyltransferase (Crot), mRNA. 11/22Length = 2681 | carnitine O-octanoyltransferase |
| 2350 | 20555 | NM_031987 | j, k | *Rattus norvegicus* carnitine O-octanoyltransferase (Crot), mRNA. 11/22Length = 2681 | carnitine O-octanoyltransferase |
| 2351 | 21807 | NM_032067 | gg | *Rattus norvegicus* RalA binding protein 1 (Ralbp1), mRNA. 5/21Length = 3622 | RalA binding protein 1 |
| 2351 | 21809 | NM_032067 | ll | *Rattus norvegicus* RalA binding protein 1 (Ralbp1), mRNA. 5/21Length = 3622 | RalA binding protein 1 |
| 2352 | 1171 | NM_032071 | y, z | *Rattus norvegicus* synaptojanin 2 (Synj2), mRNA. 11/22Length = 533 | synaptojanin II |
| 2353 | 12299 | NM_032416 | c | *Rattus norvegicus* aldehyde dehydrogenase 2 (Aldh2), mRNA. 11/22Length = 1889 | aldehyde dehydrogenase 2, mitochondrial |
| 2354 | 21102 | NM_033021 | ll | *Rattus norvegicus* vesicle associated protein (VAP1), mRNA. 7/21Length = 4422 | vesicle associated protein |
| 2354 | 21103 | NM_033021 | s | *Rattus norvegicus* vesicle associated protein (VAP1), mRNA. 7/21Length = 4422 | vesicle associated protein |
| 2354 | 21104 | NM_033021 | s, t | *Rattus norvegicus* vesicle associated protein (VAP1), mRNA. 7/21Length = 4422 | vesicle associated protein |
| 2355 | 25529 | NM_033096 | n, o | *Rattus norvegicus* Protein phosphatase type 1B (formely 2C), Mg-dependent, beta isoform | Protein phosphatase type 1B (formely 2C), Mg-dependent, beta isoform |

TABLE 1-continued

| SEQ ID | GLGC ID | GenBank Accession No. | Model Code | Known Gene Name | Unigene Sequence Cluster Title |
|---|---|---|---|---|---|
| | | | | (Ppm1b), mRNA. 7/21Length = 3257 | |
| 2355 | 25569 | NM_033096 | r | Rattus norvegicus Protein phosphatase type 1B (formely 2C), Mg-dependent, beta isoform (Ppm1b), mRNA. 7/21Length = 3257 | Protein phosphatase type 1B (formely 2C), Mg-dependent, beta isoform |
| 2355 | 19148 | NM_033096 | h, l | Rattus norvegicus Protein phosphatase type 1B (formely 2C), Mg-dependent, beta isoform (Ppm1b), mRNA. 17/21Length = 3257 | Protein phosphatase type 1B (formely 2C), Mg-dependent, beta isoform |
| 2356 | 25468 | NM_033234 | b, c, v | Rattus norvegicus Hemoglobin, beta (Hbb), mRNA. 12/21Length = 62 | Hemoglobin, beta |
| 2356 | 17829 | NM_033234 | c | Rattus norvegicus Hemoglobin, beta (Hbb), mRNA. 12/21Length = 62 | Hemoglobin, beta |
| 2356 | 17832 | NM_033234 | b, c, v | Rattus norvegicus Hemoglobin, beta (Hbb), mRNA. 12/21Length = 62 | Hemoglobin, beta |
| 2356 | 25469 | NM_033234 | b, c, v | Rattus norvegicus Hemoglobin, beta (Hbb), mRNA. 12/21Length = 62 | |
| 2357 | 2577 | NM_033236 | r | Rattus norvegicus Proteasome (prosome, macropain) 26S subunit, ATPase (Psmc2), mRNA. 8/21Length = 143 | Proteasome (prosome, macropain) 26S subunit, ATPase |
| 2358 | 23715 | NM_033237 | j, k, y, z, jj, kk | Rattus norvegicus galanin (Gal), mRNA. 11/22Length = 699 | galanin |
| 2359 | 12364 | NM_033351 | e, y, z, ee, ff | Rattus norvegicus Fc receptor, IgG, alpha chain transporter (Fcgrt), mRNA. 11/22Length = 1552 | Fc fragment immunoglobulin G receptor |
| 2359 | 12365 | NM_033351 | e | Rattus norvegicus Fc receptor, IgG, alpha chain transporter (Fcgrt), mRNA. 11/22Length = 1552 | Fc fragment immunoglobulin G receptor |
| 2360 | 11714 | NM_033352 | kk | Rattus norvegicus ATP-binding cassette, sub-family D (ALD), member 2 (Abcd2), mRNA. 11/22Length = 5531 | ESTs |
| 2361 | 23895 | NM_033485 | aa | Rattus norvegicus PRKC, apoptosis, WT1, regulator (Pawr), mRNA. 11/22Length = 2122 | Prostate apoptosis response protein 4 |
| 2362 | 24420 | NM_033539 | jj, kk, ll | Rattus norvegicus eukaryotic translation elongation factor 1alpha 2 (Eef1a2), mRNA. 11/22Length = 144 | eukaryotic translation elongation factor 1 alpha 1 |
| 2362 | 24419 | NM_033539 | jj, kk | Rattus norvegicus eukaryotic translation elongation factor 1alpha 2 (Eef1a2), mRNA. 11/22Length= 144 | eukaryotic translation elongation factor 1 alpha 1 |
| 2363 | 25072 | NM_052807 | j, k | Rattus norvegicus Insulin-like growth factor 1 receptor (Igf1r), mRNA. 1/21Length = 4696 | Insulin-like growth factor 1 receptor |
| 2364 | 15867 | NM_053289 | a, h, l, w, x | Rattus norvegicus Pancreatitis-associated protein 1 (Pap1), mRNA. 11/21Length = 781 | ESTs, Weakly similar to R02D3.2.p [Caenorhabditis elegans] [C. elegans], Pancreatitis-associated protein 1 |

TABLE 1-continued

| SEQ ID | GLGC ID | GenBank Accession No. | Model Code | Known Gene Name | Unigene Sequence Cluster Title |
|---|---|---|---|---|---|
| 2365 | 1311 | NM_053291 | e | *Rattus norvegicus* Phosphoglycerate kinase 1 (Pgk), mRNA. 11/22Length= 1675 | phosphoglycerate kinase 1 |
| 2366 | 1596 | NM_053294 | r | *Rattus norvegicus* Adenosine A2a-receptor (Adora2a), mRNA. 4/22Length = 2373 | Adenosine A2a-receptor |
| 2367 | 20235 | NM_053302 | cc, dd | *Rattus norvegicus* adrenomedullin receptor (Admr), mRNA. 11/22Length = 1197 | ESTs, Weakly similar to dual-specificity phosphatase [*Mus musculus*] [*M. musculus*] |
| 2368 | 15748 | NM_053309 | ii | *Rattus norvegicus* homer, neuronal immediate early gene, 2(Homer2), mRNA. 11/22Length = 1994 | homer, neuronal immediate early gene, 2 |
| 2369 | 7207 | NM_053326 | hh | *Rattus norvegicus* enigma homolog (Enh), mRNA. 11/21Length = 1896 | enigma homolog |
| 2370 | 1063 | NM_053328 | e | *Rattus norvegicus* basic helix-loop-helix domain containing, class B2 (Bhlhb2), mRNA. 11/22Length = 2388 | basic helix-loop-helix domain containing, class B2 |
| 2371 | 14927 | NM_053330 | e | *Rattus norvegicus* ribosomal protein L21 (Rpl21), mRNA. 11/22Length = 554 | ribosomal protein L21 |
| 2371 | 14929 | NM_053330 | h, l | *Rattus norvegicus* ribosomal protein L21 (Rpl21), mRNA. 11/22Length = 554 | ribosomal protein L21 |
| 2372 | 2674 | NM_053333 | gg | *Rattus norvegicus* resistin like alpha (Retnla), mRNA. 11/22Length = 54 | resistin like alpha |
| 2373 | 1609 | NM_053338 | j, p, q, y, z | *Rattus norvegicus* Ras-related associated with diabetes (Rrad), mRNA. 11/22Length = 1421 | Ras-related associated with diabetes |
| 2374 | 18949 | NM_053345 | ii | *Rattus norvegicus* general transcription factor IIa, 2 (12 kDsubunit) (Gtf2a2), mRNA. 11/21Length = 33 | general transcription factor IIa, 2 (12 kD subunit) |
| 2375 | 9352 | NM_053347 | u, v | *Rattus norvegicus* nuclear distribution gene E homolog(*Aspergillus*) (Nude), mRNA. 11/22Length = 2153 | nuclear distribution gene E homolog (*Aspergillus*) |
| 2376 | 6154 | NM_053356 | f, g | *Rattus norvegicus* procollagen, type I, alpha 2 (Col1a2), mRNA. 11/22Length = 4474 | procollagen, type I, alpha 2 |
| 2376 | 6155 | NM_053356 | g | *Rattus norvegicus* procollagen, type I, alpha 2 (Col1a2), mRNA. 11/22Length = 4474 | procollagen, type I, alpha 2 |
| 2376 | 6156 | NM_053356 | g | *Rattus norvegicus* procollagen, type I, alpha 2 (Col1a2), mRNA. 11/22Length = 4474 | procollagen, type I, alpha 2 |
| 2376 | 6157 | NM_053356 | f, g | *Rattus norvegicus* procollagen, type I, alpha 2 (Col1a2), mRNA. 11/22Length = 4474 | procollagen, type I, alpha 2 |
| 2376 | 25184 | NM_053356 | f | *Rattus norvegicus* procollagen, type I, alpha 2 (Col1a2), mRNA. 11/22Length = 4474 | |
| 2377 | 19512 | NM_053365 | ii | *Rattus norvegicus* fatty acid binding protein 4 (Fabp4), mRNA. 11/22Length = 6 | adipocyte lipid-binding protein |

TABLE 1-continued

| SEQ ID | GLGC ID | GenBank Accession No. | Model Code | Known Gene Name | Unigene Sequence Cluster Title |
|---|---|---|---|---|---|
| 2378 | 622 | NM_053369 | a, j, k | *Rattus norvegicus* transcription factor 4 (Tcf4), mRNA. 1/22Length = 259 | transcription factor 4 |
| 2378 | 623 | NM_053369 | r, hh | *Rattus norvegicus* transcription factor 4 (Tcf4), mRNA. 1/22Length = 259 | transcription factor 4 |
| 2379 | 16017 | NM_053401 | o, aa | *Rattus norvegicus* nerve growth factor receptor (TNFRSF16) associated protein 1 (Ngfrap1), mRNA. 11/22Length = 519 | brain expressed X-linked 3 |
| 2379 | 16018 | NM_053401 | b, c | *Rattus norvegicus* nerve growth factor receptor (TNFRSF16) associated protein 1 (Ngfrap1), mRNA. 11/22Length = 519 | brain expressed X-linked 3 |
| 2380 | 14621 | NM_053437 | e, hh | *Rattus norvegicus* diacylglycerol O-acyltransferase 1 (Dgat1), mRNA. 11/22Length = 1751 | diacylglycerol acyltransferase |
| 2381 | 6712 | NM_053448 | cc, dd | *Rattus norvegicus* histone deacetylase 3 (Hdac3), mRNA. 11/22Length = 1799 | histone deacetylase 3 |
| 2382 | 4622 | NM_053463 | i, m | *Rattus norvegicus* nucleobindin (Nucb), mRNA. 11/22Length = 233 | nucleobindin |
| 2383 | 21866 | NM_053472 | u, v | *Rattus norvegicus* cytochrome c oxidase, subunit 4b (Cox4b), mRNA. 11/22Length = 74 | cytochrome c oxidase, subunit IVb |
| 2384 | 21498 | NM_053474 | gg | *Rattus norvegicus* spinophilin (LOC84686), mRNA. 11/21Length = 455 | spinophilin |
| 2385 | 15556 | NM_053483 | kk | *Rattus norvegicus* karyopherin (importin) alpha 2 (Kpna2), mRNA. 11/22Length = 1886 | karyopherin (importin) alpha 2 |
| 2386 | 16394 | NM_053485 | h, l, w, x | *Rattus norvegicus* calcium binding protein A6 (calcyclin)(S1a6), mRNA. 11/21Length = 291 | calcium binding protein A6 (calcyclin) |
| 2387 | 14904 | NM_053492 | s, t | *Rattus norvegicus* transporter-like protein (Ctl1), mRNA. 11/21Length = 2849 | transporter-like protein |
| 2388 | 16135 | NM_053516 | aa, bb | *Rattus norvegicus* unknown Glu-Pro dipeptide repeat protein(LOC85383), mRNA. 11/21Length = 1876 | unknown Glu-Pro dipeptide repeat protein |
| 2389 | 18826 | NM_053523 | bb | *Rattus norvegicus* homocysteine-inducible, endoplasmic reticulum stress-inducible, ubiquitin-like domain member 1 (Herpud1), mRNA. 11/21Length = 1857 | homocysteine-inducible, endoplasmic reticulum stress-inducible, ubiquitin-like domain member 1 |
| 2390 | 14380 | NM_053536 | e, y, z | *Rattus norvegicus* Kruppel-like factor 15 (Klf15), mRNA. 11/22Length = 2458 | Kruppel-like factor 15 (kidney) |
| 2391 | 31 | NM_053537 | b | *Rattus norvegicus* solute carrier family 22 (organic anion transporter), | solute carrier family 22 (organic anion transporter), member 7 |

TABLE 1-continued

| SEQ ID | GLGC ID | GenBank Accession No. | Model Code | Known Gene Name | Unigene Sequence Cluster Title |
|---|---|---|---|---|---|
| 2392 | 15829 | NM_053551 | e, n, o, p, q, r, aa, bb | member 7 (Slc22a7), mRNA. 1/22Length = 191 *Rattus norvegicus* pyruvate dehydrogenate kinase 4 (Pdk4), mRNA. 11/22Length = 1435 | pyruvate dehydrogenase kinase, isoenzyme 4 |
| 2393 | 17298 | NM_053553 | cc, dd | *Rattus norvegicus* synaptogyrin 2 (Syngr2), mRNA. 11/21Length = 118 | synaptogyrin 2 |
| 2394 | 11843 | NM_053555 | n, o, s | *Rattus norvegicus* vesicle associated membrane protein 5 (Vamp5), mRNA. 11/21Length = 39 | vesicle-associated membrane protein 5 |
| 2395 | 4327 | NM_053563 | a, n, o, y, z, jj, kk | *Rattus norvegicus* nuclear RNA helicase, DECD variant of DEADbox family (Ddxl), mRNA. 11/21Length = 1511 | nuclear RNA helicase, DECD variant of DEAD box family |
| 2396 | 15708 | NM_053565 | p, q, y, z | *Rattus norvegicus* cytokine inducible SH2-containing protein 3 (Cish3), mRNA. 11/21Length = 863 | cytokine inducible SH2-containing protein 3 |
| 2397 | 21940 | NM_053568 | f | *Rattus norvegicus* phosphate cytidylyltransferase 2, ethanolamine (Pcyt2), mRNA. 11/21Length = 1846 | phosphate cytidylyltransferase 2, ethanolamine |
| 2398 | 19252 | NM_053576 | a | *Rattus norvegicus* peroxiredoxin 5 (Prdx5), mRNA. 1/22Length = 1414 | peroxiredoxin 5 |
| 2399 | 653 | NM_053580 | aa, bb | *Rattus norvegicus* fatty acid transport protein (Slc27a1), mRNA. 11/21Length = 398 | fatty acid transport protein |
| 2400 | 3049 | NM_053582 | j, k, t, kk | *Rattus norvegicus* glucocorticoid-inducible protein (gis5), mRNA. 11/21Length = 1869 | glucocorticoid-inducible protein |
| 2400 | 3050 | NM_053582 | j, k, t, kk | *Rattus norvegicus* glucocorticoid-inducible protein (gis5), mRNA. 11/21Length = 1869 | glucocorticoid-inducible protein |
| 2401 | 24875 | NM_053583 | ii, jj, kk | *Rattus norvegicus* Olf-1/EBF associated Zn finger protein Roaz(Roaz), mRNA. 11/21Length = 4665 | Olf-1/EBF associated Zn finger protein Roaz |
| 2402 | 21170 | NM_053585 | s, t | *Rattus norvegicus* MAP-kinase activating death domain (Madd), mRNA. 11/21Length = 5249 | MAP-kinase activating death domain |
| 2403 | 21445 | NM_053587 | a, e, y, z, ee, ff | *Rattus norvegicus* S1 calcium-binding protein A9(calgranulin B) (S1a9), mRNA. 11/21Length = 494 | S100 calcium-binding protein A9 (calgranulin B) |
| 2404 | 20896 | NM_053592 | h, l | *Rattus norvegicus* Deoxyuridinetriphosphatase (dUTPase) (Dut), mRNA. 5/22Length = 952 | Deoxyuridinetriphosphatase (dUTPase) |
| 2405 | 20902 | NM_053593 | r | *Rattus norvegicus* cyclin-dependent kinase 4 (Cdk4), mRNA. 11/21Length = 1232 | cyclin-dependent kinase 4 |
| 2406 | 21709 | NM_053596 | j, k, y, ll | *Rattus norvegicus* Endothelin-converting enzyme 1 (Ece1), mRNA. 5/22Length = 4469 | Endothelin-converting enzyme 1 |

TABLE 1-continued

| SEQ ID | GLGC ID | GenBank Accession No. | Model Code | Known Gene Name | Unigene Sequence Cluster Title |
|---|---|---|---|---|---|
| 2407 | 2103 | NM_053597 | g | *Rattus norvegicus* ribosomal protein S27 (Rps27), mRNA. 11/22Length = 336 | ribosomal protein S27 |
| 2408 | 11794 | NM_053606 | ii | *Rattus norvegicus* Matrix metalloproteinase 23 (Mmp23), mRNA. 11/21Length = 1444 | Matrix metalloproteinase 23 |
| 2409 | 20243 | NM_053615 | aa, bb | *Rattus norvegicus* casein kinase 1, alpha 1 (Csnk1a1), mRNA. 11/21Length = 978 | casein kinase 1, alpha 1 |
| 2410 | 13005 | NM_053623 | j, k, y, z | *Rattus norvegicus* fatty acid Coenzyme A ligase, long chain 4 (Facl4), mRNA. 11/22Length = 4862 | fatty acid-Coenzyme A ligase, long chain 4 |
| 2411 | 1228 | NM_053625 | j, k | *Rattus norvegicus* G elongation factor (EF-G), mRNA. 11/21Length = 2619 | G elongation factor |
| 2412 | 15777 | NM_053630 | b, u, v | *Rattus norvegicus* potassium voltage-gated channel, subfamily H (eag-related), member 4 (Kcnh4), mRNA. 11/21Length = 3736 growth response 2 (Egr2), mRNA. 11/21Length = 2976 | potassium voltage-gated channel, subfamily H (eag-related), member 4 |
| 2414 | 18644 | NM_053648 | bb | *Rattus norvegicus* beta-carotene 15, 15-dioxygenase (Bcdo), mRNA. 11/22Length = 227 | beta-carotene 15, 15'-dioxygenase |
| 2415 | 1118 | NM_053655 | u | *Rattus norvegicus* dynamin 1-like (Dnml1), mRNA. 11/22Length = 3845 | dynamin 1-like |
| 2416 | 1316 | NM_053656 | s, t, ii | *Rattus norvegicus* purinergic receptor P2X, ligand-gated ion channel, 2 (P2rx2), mRNA. 1/22Length = 1831 | purinergic receptor P2X, ligand-gated ion channel, 2 |
| 2417 | 3454 | NM_053662 | p, q | *Rattus norvegicus* cyclin L (Ccnl), mRNA. 11/21Length = 292 | cyclin L |
| 2417 | 3455 | NM_053662 | p, q, gg | *Rattus norvegicus* cyclin L (Ccnl), mRNA. 11/21Length = 292 | cyclin L |
| 2418 | 2063 | NM_053682 | e | *Rattus norvegicus* YME1 (*S.cerevisiae*)-like 1 (Ymel1), mRNA. 11/21Length = 2727 | YME1 (*S.cerevisiae*)-like 1 |
| 2419 | 16122 | NM_053698 | p, q, ee, ff | *Rattus norvegicus* Cbp/p3-interacting transactivator, withGlu/Asp-rich carboxy-terminal domain, 2 (Cited2), mRNA. 11/21Length = 1155 | Cbp/p300-interacting transactivator, with Glu/Asp-rich carboxy-terminal domain, 2 |
| 2419 | 16123 | NM_053698 | d, p, q, jj, kk | *Rattus norvegicus* Cbp/p3-interacting transactivator, withGlu/Asp-rich carboxy-terminal domain, 2 (Cited2), mRNA. 11/21Length = 1155 | Cbp/p300-interacting transactivator, with Glu/Asp-rich carboxy-terminal domain, 2 |
| 2420 | 6684 | NM_053703 | kk | *Rattus norvegicus* mitogen-activated protein kinase kinase 6(Map2k6), mRNA. 11/22Length = 169 | mitogen-activated protein kinase kinase 6 |

TABLE 1-continued

| SEQ ID | GLGC ID | GenBank Accession No. | Model Code | Known Gene Name | Unigene Sequence Cluster Title |
|---|---|---|---|---|---|
| 2421 | 13622 | NM_053713 | aa, bb, ll | *Rattus norvegicus* Kruppel-like factor 4 (gut) (Klf4), mRNA. 11/22Length = 2393 | Kruppel-like factor 4 (gut) |
| 2421 | 22411 | NM_053713 | d, t | *Rattus norvegicus* Kruppel-like factor 4 (gut) (Klf4), mRNA. 11/22Length = 2393 | Kruppel-like factor 4 (gut) |
| 2421 | 25379 | NM_053713 | t, ll | *Rattus norvegicus* Kruppel-like factor 4 (gut) (Klf4), mRNA. 11/22Length = 393 | Kruppel-like factor 4 (gut) |
| 2422 | 15269 | NM_053739 | d, f, g | *Rattus norvegicus* beclin 1 (coiled-coil, myosin-like BCL2-interacting protein) (Becn1), mRNA. 11/21Length = 198 | beclin 1 (coiled-coil, myosin-like BCL2-interacting protein) |
| 2423 | 13369 | NM_053742 | n, o | *Rattus norvegicus* phosphotidylinositol transfer protein, beta(Pitpnb), mRNA. 11/22Length = 268 | phosphotidylinositol transfer protein, beta |
| 2424 | 10510 | NM_053743 | u, v | *Rattus norvegicus* cell division cycle 37 homolog (*S. cerevisiae*) (Cdc37), mRNA. 11/22Length = 164 | CDC37 (cell division cycle 37, *S. cerevisiae*, homolog) |
| 2425 | 18175 | NM_053752 | aa, bb | *Rattus norvegicus* succinate-CoA ligase, GDP-forming, alphasubunit (Suclg1), mRNA. 11/21Length = 1684 | succinate-CoA ligase, GDP-forming, alpha subunit |
| 2426 | 7927 | NM_053765 | d | *Rattus norvegicus* UDP-N-acetylglucosamine-2-epimerase/N-acetylmannosamine kinase (Uae1), mRNA. 11/22Length = 258 | UDP-N-acetylglucosamine-2-epimerase/N acetylmannosamine kinase |
| 2427 | 15996 | NM_053769 | cc, dd | *Rattus norvegicus* protein tyrosine phosphatase, non-receptortype 16 (Ptpn16), mRNA. 11/22Length = 198 | protein tyrosine phosphatase, non-receptor type 16 |
| 2428 | 14015 | NM_053770 | hh | *Rattus norvegicus* Arg/Abl-interacting protein ArgBP2(Argbp2), mRNA. 11/21Length = 6331 | Arg/Abl-interacting protein ArgBP2 |
| 2428 | 14017 | NM_053770 | hh | *Rattus norvegicus* Arg/Abl-interacting protein ArgBP2(Argbp2), mRNA. 11/21Length = 6331 | Arg/Abl-interacting protein ArgBP2 |
| 2429 | 1016 | NM_053772 | r, gg | *Rattus norvegicus* protein kinase inhibitor, alpha (Pkia), mRNA. 11/21Length = 1183 | protein kinase inhibitor, alpha |
| 2430 | 9059 | NM_053783 | j, k, kk | *Rattus norvegicus* interferon gamma receptor (Ifngr), mRNA. 11/21Length = 186 | interferon gamma receptor |
| 2431 | 11606 | NM_053795 | gg | *Rattus norvegicus* kinase D-interacting substance of 22 kDa (Kidins22), mRNA. 3/22Length = 714 | kinase D-interacting substance of 220 kDa |
| 2432 | 25594 | NM_053799 | jj, kk, ll | *Rattus norvegicus* aspartyl-tRNA synthetase (Dars), mRNA. 11/21Length = 2143 | aspartyl-tRNA synthetase |
| 2433 | 15615 | NM_053800 | h, l | *Rattus norvegicus* thioredoxin (Txn), mRNA. 11/22Length = 33 | thioredoxin |

TABLE 1-continued

| SEQ ID | GLGC ID | GenBank Accession No. | Model Code | Known Gene Name | Unigene Sequence Cluster Title |
|---|---|---|---|---|---|
| 2434 | 25262 | NM_053814 | b, u, v, cc, dd | *Rattus norvegicus* Rho interacting protein 3 (Rhoip3), mRNA. 11/21Length = 3286 | Rho interacting protein 3 |
| 2435 | 15002 | NM_053819 | a, l, k, n, o, x, z, hh, kk | *Rattus norvegicus* tissue inhibitor of metalloproteinase 1 (Timp1), mRNA. 11/21Length = 74 | tissue inhibitor of metalloproteinase 1 |
| 2435 | 15003 | NM_053819 | a, l, k, n, o, x, z, hh, kk | *Rattus norvegicus* tissue inhibitor of metalloproteinase 1 (Timp1), mRNA. 11/21Length = 74 | tissue inhibitor of metalloproteinase 1 |
| 2436 | 20421 | NM_053821 | f, ii | *Rattus norvegicus* v-ral simian leukemia viral oncogene homologB (ras related) (Ralb), mRNA. 11/21Length = 274 | v-ral simian leukemia viral oncogene homolog B (ras related) |
| 2437 | 16173 | NM_053822 | e, y, z, ee, ff | *Rattus norvegicus* S1 calcium-binding protein A8(calgranulin A) (Sla8), mRNA. 11/21Length = 361 | S100 calcium-binding protein A8 (calgranulin A) |
| 2438 | 17154 | NM_053835 | b, gg | *Rattus norvegicus* clathrin, light polypeptide (Lcb) (Cltb), mRNA. 11/22Length = 982 | clathrin, light polypeptide (Lcb) |
| 2438 | 17155 | NM_053835 | g | *Rattus norvegicus* clathrin, light polypeptide (Lcb) (Cltb), mRNA. 11/22Length = 982 | clathrin, light polypeptide (Lcb) |
| 2438 | 18065 | NM_053835 | c | *Rattus norvegicus* clathrin, light polypeptide (Lcb) (Cltb), mRNA. 11/22Length = 982 | clathrin, light polypeptide (Lcb) |
| 2439 | 16099 | NM_053837 | f, r, cc, dd | *Rattus norvegicus* adaptor-related protein complex 2, mu 1 subunit (Ap2m1), mRNA. 11/21Length = 1816 | adaptor-related protein complex 2, mu 1 subunit |
| 2440 | 20868 | NM_053843 | kk | *Rattus norvegicus* Fc receptor, IgG, low affinity III (Fcgr3), mRNA. 11/22Length = 1318 | Fc receptor, IgG, low affinity III |
| 2440 | 20869 | NM_053843 | w, x, kk | *Rattus norvegicus* Fc receptor, IgG, low affinity III (Fcgr3), mRNA. 11/22Length = 1318 | Fc receptor, IgG, low affinity III |
| 2441 | 1780 | NM_053846 | u, v | *Rattus norvegicus* neurexin 2 (Nrxn2), mRNA. 11/21Length = 6436 | neurexin 2 |
| 2442 | 1011 | NM_053851 | e | *Rattus norvegicus* calcium channel, voltage-dependent, beta 2subunit (Cacnb2), mRNA. 11/22Length= 3927 | calcium channel, voltage-dependent, beta 2 subunit |
| 2443 | 16361 | NM_053853 | cc, dd | *Rattus norvegicus* N-acetyltransferase 1 (arylamineN-acetyltransferase) (Nat1), mRNA. 11/22Length = 2533 | N-acetyltransferase 1 (arylamine N-acetyltransferase) |
| 2444 | 1570 | NM_053857 | s, t | *Rattus norvegicus* eukaryotic translation initiation factor4E binding protein 1 (Eif4ebp1), mRNA. 11/22Length = 843 | eukaryotic translation initiation factor 4E binding protein 1 |
| 2444 | 1571 | NM_053857 | e, f, kk | *Rattus norvegicus* eukaryotic translation initiation factor4E binding protein 1 (Eif4eb1l), | eukaryotic translation initiation factor 4E binding protein 1 |

TABLE 1-continued

| SEQ ID | GLGC ID | GenBank Accession No. | Model Code | Known Gene Name | Unigene Sequence Cluster Title |
|---|---|---|---|---|---|
| | | | | mRNA. 11/22Length = 843 | |
| 2445 | 18357 | NM_053864 | n, o | *Rattus norvegicus* valosin containing protein (Vcp), mRNA. 11/22Length = 287 | valosin-containing protein |
| 2446 | 11405 | NM_053866 | f | *Rattus norvegicus* phospholipase A2, activating protein (Plaa), mRNA. 11/21Length = 2451 | phospholipase A2, activating protein |
| 2447 | 1352 | NM_053880 | aa | *Rattus norvegicus* dynein, cytoplasmic, intermediate polypeptide 2 (Dnci2), mRNA. 11/21Length = 2538 | dynein, cytoplasmic, intermediate polypeptide 2 |
| 2448 | 20939 | NM_053884 | gg | *Rattus norvegicus* ATPase, vacuolar, 14 kD (Atp6s14), mRNA. 11/21Length = 667 | ATPase, vacuolar, 14 kD |
| 2449 | 385 | NM_053885 | b, o, u, v, ee, ff, kkk | *Rattus norvegicus* arginine-glutamic acid dipeptide (RE) repeats(Rere), mRNA. 11/21Length = 6659 | arginine-glutamic acid dipeptide (RE) repeats |
| 2450 | 753 | NM_053897 | ee, ff, gg | *Rattus norvegicus* Proteinase-activated receptor-2, G protein-coupled receptor 11 (F2rl1), mRNA. 5/22Length = 1428 | Proteinase-activated receptor-2, G protein-coupled receptor 11 |
| 2451 | 15706 | NM_053921 | ll | *Rattus norvegicus* peroxisomal biogenesis factor 12 (Pex12), mRNA. 11/21Length = 2347 | peroxisomal biogenesis factor 12 |
| 2452 | 1426 | NM_053950 | aa | *Rattus norvegicus* eukaryotic translation initiation factor 2B (Eif2b), mRNA. 11/21Length = 1634 | eukaryotic translation initiation factor 2B |
| 2453 | 531 | NM_053951 | gg | *Rattus norvegicus* MCF.2 cell line derived transforming sequence-like (Mcf2l), mRNA. 11/21Length = 4354 | MCF.2 cell line derived transforming sequence-like |
| 2454 | 16552 | NM_053961 | h, l, n, o | *Rattus norvegicus* endoplasmic retuclum protein 29 (Erp29), mRNA. 11/21Length = 4529 | endoplasmic retuclum protein 29 |
| 2454 | 16553 | NM_053961 | h, l | *Rattus norvegicus* endoplasmic retuclum protein 29 (Erp29), mRNA. 11/21Length = 4529 | endoplasmic retuclum protein 29 |
| 2455 | 16654 | NM_053963 | n, o | *Rattus norvegicus* matrix metalloproteinase 12 (Mmp12), mRNA. 11/21Length = 1632 | matrix metalloproteinase 12 |
| 2456 | 16546 | NM_053965 | hh | *Rattus norvegicus* solute carrier family 25(carnitine/acylcarnitine translocase), member 2 (Slc25a2), mRNA. 11/21Length = 1231 | solute carrier family 25 (carnitine/acylcarnitine translocase), member 20 |
| 2456 | 16547 | NM_053965 | hh | *Rattus norvegicus* solute carrier family 25(carnitine/acylcarnitine translocase), member 2 (Slc25a2), mRNA. 11/21Length = 1231 | solute carrier family 25 (carnitine/acylcarnitine translocase), member 20 |
| 2457 | 6357 | NM_053969 | d | *Rattus norvegicus* G protein pathway | G protein pathway suppressor 1 |

TABLE 1-continued

| SEQ ID | GLGC ID | GenBank Accession No. | Model Code | Known Gene Name | Unigene Sequence Cluster Title |
|---|---|---|---|---|---|
| 2458 | 15135 | NM_053971 | h, l, n, o, w, x | suppressor 1 (Gps1), mRNA. 11/21Length = 1794<br>*Rattus norvegicus* ribosomal protein L6 (Rpl6), mRNA. 11/21Length = 963 | ribosomal protein L6 |
| 2458 | 15136 | NM_053971 | h, l, w, ii | *Rattus norvegicus* ribosomal protein L6 (Rpl6), mRNA. 11/21Length = 963 | ribosomal protein L6 |
| 2458 | 22183 | NM_053971 | h, l | *Rattus norvegicus* ribosomal protein L6 (Rpl6), mRNA. 11/21Length = 963 | EST |
| 2459 | 15343 | NM_053973 | aa | *Rattus norvegicus* Ras-related GTP-binding protein ragA (Raga), mRNA. 11/21Length = 161 | Ras-related GTP-binding protein ragA |
| 2460 | 18798 | NM_053978 | h, l, n, o | *Rattus norvegicus* RAB28, member RAS oncogene family (Rab28), mRNA. 11/21Length = 1483 | RAB28, member RAS oncogene family |
| 2461 | 15468 | NM_053982 | j, w, x, jj, kk | *Rattus norvegicus* ribosomal protein S15a (Rps15a), mRNA. 11/21Length = 449 | ribosomal protein S15a |
| 2462 | 15642 | NM_053985 | d | *Rattus norvegicus* H3 histone, family 3B (H3f3b), mRNA. 11/21Length = 117 | H3 histone, family 3B |
| 2462 | 15645 | NM_053985 | d | *Rattus norvegicus* H3 histone, family 3B (H3f3b), mRNA. 11/21Length = 117 | H3 histone, family 3B |
| 2463 | 17653 | NM_053986 | cc, dd | *Rattus norvegicus* myosin Ib (Myo1b), mRNA. 11/22Length = 367 | myosin 1B |
| 2464 | 18025 | NM_053989 | w, x | *Rattus norvegicus* progestin induced protein (dds), mRNA. 11/21Length = 318 | progestin induced protein |
| 2465 | 17739 | NM_053995 | g | *Rattus norvegicus* 3-hydroxybutyrate dehydrogenase (heart, mitochondrial) (Bdh), mRNA. 11/21Length = 142 | 3-hydroxybutyrate dehydrogenase (heart, mitochondrial) |
| 2466 | 16962 | NM_053999 | u, v | *Rattus norvegicus* protein phosphatase 2 (formerly 2A), regulatory subunit B (PR 52), alpha isoform (Ppp2r2a), mRNA. 11/21Length = 2142 | protein phosphatase 2 (formerly 2A), regulatory subunit B (PR 52), alpha isoform |
| 2467 | 25249 | NM_054001 | n, o | *Rattus norvegicus* CD36 antigen (collagen type I receptor, thrombospondin receptor)-like 2 (Cd36l2), mRNA. 11/21Length = 1938 | |
| 2468 | 16566 | NM_054004 | hh | *Rattus norvegicus* TBP-interacting protein 12A (Tip12A), mRNA. 11/21Length = 4383 | TBP-interacting protein 120A |
| 2469 | 1108 | NM_054005 | b, l, m | *Rattus norvegicus* integral membrane-associated protein 1(Itmap1), mRNA. 11/21Length = 2282 | integral membrane-associated protein 1 |
| 2470 | 17431 | NM_054006 | cc, dd | *Rattus norvegicus* unr protein (unr), mRNA. 11/21Length = 3755 | unr protein |

TABLE 1-continued

| SEQ ID | GLGC ID | GenBank Accession No. | Model Code | Known Gene Name | Unigene Sequence Cluster Title |
|---|---|---|---|---|---|
| 2471 | 17326 | NM_054008 | s, t | *Rattus norvegicus* Rgc32 protein (Rgc32), mRNA. 11/21Length = 889 | Rgc32 protein |
| 2471 | 17330 | NM_054008 | aa, bb | *Rattus norvegicus* Rgc32 protein (Rgc32), mRNA. 11/21Length = 889 | Rgc32 protein |
| 2472 | 23250 | NM_057097 | f, g | *Rattus norvegicus* vesicle associated membrane protein 3 (Vamp3), mRNA. 11/22Length = 1742 | vesicle-associated membrane protein 3 |
| 2473 | 25290 | NM_057100 | d, u, v | *Rattus norvegicus* growth arrest specific 6 (Gas6), mRNA. 11/22Length = 2573 | growth arrest specific 6 |
| 2474 | 17709 | NM_057101 | u, v | *Rattus norvegicus* Cytochrome P45, subfamily XXI (steroid 21-hydroxylase) (Cyp21), mRNA. 1/22Length = 1964 | Tenascin X |
| 2475 | 19658 | NM_057103 | gg | *Rattus norvegicus* A kinase (PRKA) anchor protein (gravin) 12(Akap12), mRNA. 11/22Length = 5236 | A kinase (PRKA) anchor protein (gravin) 12 |
| 2476 | 9528 | NM_057104 | r | *Rattus norvegicus* ectonucleotide pyrophosphatase/phospho-diesterase 2 (Enpp2), mRNA. 11/22Length = 3216 | ectonucleotide pyrophosphatase/phosphodiesterase 2 |
| 2477 | 15125 | NM_057105 | jj, kk, ll | *Rattus norvegicus* UDP glycosyltransferase 1 family, polypeptide A6 (Ugt1a6), mRNA. 1/22Length = 1593 | UDP glycosyltransferase 1 family, polyprptide A6, UDP glycosyltransferase 1 family, polypeptide A7 polypeptide A6, |
| 2478 | 15391 | NM_057114 | d | *Rattus norvegicus* peroxiredoxin 1 (Prdx1), mRNA. 11/21Length = 882 | peroxiredoxin 1 |
| 2479 | 23310 | NN_057119 | e | *Rattus norvegicus* splicing factor, arginine/serine-rich(transformer 2 *Drosophila* homolog) 1 (Sfrs1), mRNA. 11/21Length = 1978 | splicing factor, arginine/serine-rich (transformer 2 *Drosophila* homolog) 10 |
| 2479 | 23310 | NM_057119 | e, s, t | *Rattus norvegicus* splicing factor, arginine/serine-rich(transformer 2 *Drosophila* homolog) 1 (Sfrs1), mRNA. 11/21Length = 1978 | splicing factor, arginine/serine-rich (transformer 2 *Drosophila* homolog) 10 |
| 2480 | 727 | NM_057123 | s, t | *Rattus norvegicus* protease (prosome, macropain) 26S subunit, ATPase 1 (Psmc1), mRNA. 11/21Length = 1556 | protease (prosome, macropain) 26S subunit, ATRase 1 subunit, |
| 2481 | 919 | NM_057125 | l, m | *Rattus norvegicus* peroxisomal biogenesis factor 6 (Pex6), mRNA. 11/21Length = 3169 | peroxisomal biogenesis factor 6 |
| 2482 | 2413 | NM_057141 | b, g, n, o, u, v | *Rattus norvegicus* heterogeneous nuclear ribonucleoprotein K (Hnrpk), mRNA. 11/22Length = 2563 | heterogeneous nuclear ribonucleoprotein K |
| 2482 | 2416 | NM_057141 | t | *Rattus norvegicus* heterogeneous nuclear ribonucleoprotein K | heterogeneous nuclear ribonucleoprotein K |

TABLE 1-continued

| SEQ ID | GLGC ID | GenBank Accession No. | Model Code | Known Gene Name | Unigene Sequence Cluster Title |
|---|---|---|---|---|---|
| 2483 | 1892 | NM_057144 | a, o, x, ee, ff, kk | (Hnrpk), mRNA. 11/22Length = 2563 *Rattus norvegicus* cysteine-rich protein 3 (Csrp3), mRNA. 11/22Length = 853 | cysteine-rich protein 3 |
| 2484 | 19481 | NM_057153 | a, y, z, ee, ff | *Rattus norvegicus* oxidation resistance 1 (Oxr1), mRNA. 11/21Length = 1896 | oxidation resistance 1 |
| 2485 | 15460 | NM_057191 | d, ee, ff | *Rattus norvegicus* sarcomeric muscle protein (Sarcosin), rnRNA. 11/21Length = 2316 | sarcomeric muscle protein |
| 2485 | 15461 | NM_057191 | ee, ff | *Rattus norvegicus* sarcomeric muscle protein (Sarcosin), mRNA. 11/21Length = 2316 | sarcomeric muscle protein |
| 2486 | 15408 | NM_057197 | f, g, l, m | *Rattus norvegicus* 2,4-dienoyl CoA reductase 1, mitochondrial (Decr1), mRNA. 11/22Length = 119 | 2,4-dienoyl CoA reductase 1, mitochondrial |
| 2486 | 15409 | NM_057197 | f, g | *Rattus norvegicus* 2,4-dienoyl CoA reductase 1, mitochondrial (Decr1), mRNA. 11/22Length = 119 | 2,4-dienoyl CoA reductase 1, mitochondrial |
| 2487 | 18122 | NM_057208 | h, l | *Rattus norvegicus* tropomyosin 3, gamma (Tpm3), mRNA. 11/21Length = 111 | tropomyosin 3, gamma |
| 2488 | 1743 | NM_057210 | hh | *Rattus norvegicus* synaptic vesicle glycoprotein 2 a (Sv2a), mRNA. 11/21Length = 3844 | synaptic vesicle glycoprotein 2 a |
| 2489 | 8641 | NM_057211 | bb | *Rattus norvegicus* Kruppel-like factor 9 (Klf9), mRNA. 11/22Length = 2721 | Kruppel-like factor 9 |
| 2490 | 11632 | NM_057212 | b | *Rattus norvegicus* brain specific binding protein (LOC17582), mRNA. 11/22Length = 999 | brain specific binding protein |
| 2491 | 15707 | NM_058208 | d | *Rattus norvegicus* cytokine inducible SH2-containing protein 2 (Cish2), mRNA. 11/22Length = 918 | cytokine inducible SH2-containing protein 2 |
| 2492 | 10498 | NM_078617 | c, g, w, x | *Rattus norvegicus* ribosomal protein S23 (Rps23), mRNA. 11/22Length = 432 | ribosomal protein S23 |
| 2493 | 8820 | NM_080399 | j, k, ee, ff, jj, kk | *Rattus norvegicus* Smhs1 protein (Smhs1), mRNA. 12/21Length = 117 | Smhs1 protein |
| 2494 | 2541 | NM_080479 | aa, bb | *Rattus norvegicus* melanoma antigen, family D, 2 (Maged2), mRNA. 12/21Length = 1993 | melanoma antigen, family D, 2 |
| 2495 | 17958 | NM_080583 | gg | *Rattus norvegicus* adaptor-related protein complex 2, beta 1 subunit (Ap2b1), mRNA. 11/22Length = 5413 | adaptor-related protein complex 2, beta 1 subunit |
| 2495 | 17960 | NM_080583 | r | *Rattus norvegicus* adaptor-related protein complex 2, beta 1 subunit (Ap2b1), mRNA. 11/22Length = 5413 | adaptor-related protein complex 2, beta 1 subunit |
| 2496 | 506 | NM_080586 | ii | *Rattus norvegicus* gamma-aminobutyric acid (GABA) A receptor, gamma 1 | gamma-aminobutyric acid (GABA) A receptor, gamma 1 |

TABLE 1-continued

| SEQ ID | GLGC ID | GenBank Accession No. | Model Code | Known Gene Name | Unigene Sequence Cluster Title |
|---|---|---|---|---|---|
| | | | | (Gabrg1), mRNA. 1/22Length = 1739 | |
| 2497 | 17662 | NM_080697 | cc, dd | *Rattus norvegicus* dynein light chain-2 (Dlc2), mRNA. 1/22Length = 51 | dynein light chain-2 |
| 2498 | 23551 | NM_080698 | ii | *Rattus norvegicus* fibromodulin (Fmod), mRNA. 11/22Length = 296 | fibromodulin |
| 2499 | 363 | NM_080780 | d, e, p, q, ee, ff | *Rattus norvegicus* purinergic receptor P2X, ligand-gated ion channel, 5 (P2rx5), mRNA. 1/22Length = 1558 | purinergic receptor P2X, ligand-gated ion channel, 5 |
| 2500 | 23033 | NM_080888 | r | *Rattus norvegicus* BCL2/adenovirus E1B 19 kDa-interactingprotein 3-like (Bnip3I), mRNA. 1/22Length = 3219 | BCL2/adenovirus E1B 19 kDa-interacting protein 3-like |
| 2501 | 9952 | NM_080902 | cc, dd | *Rattus norvegicus* hypoxia induced gene 1 (Hig1), mRNA. 1/22Length = 355 | hypoxia induced gene 1 |
| 2502 | 4739 | NM_130400 | aa, bb | *Rattus norvegicus* Dihydrofolate reductase 1 (active) (Dhfr1), mRNA. 1/22Length = 761 | Dihydrofolate reductase 1 (active) |
| 2503 | 9633 | NM_130403 | jj, kk | *Rattus norvegicus* protein phosphatase 1, regulatory(inhibitor) subunit 14a (Ppp1r14a), mRNA. 1/22Length = 559 | protein phosphatase 1, regulatory (inhibitor) subunit 14a |
| 2504 | 21695 | NM_130411 | c | *Rattus norvegicus* coronin, actin binding protein 1A (Corol1a), mRNA. 1/22Length = 1386 | coronin, actin binding protein 1A |
| 2505 | 11709 | NM_130431 | s | *Rattus norvegicus* heat shock 27 kD protein 2 (Hspb2), mRNA. 11/22Length = 549 | heat shock 27 kD protein 2 |
| 2506 | 14959 | NM_130734 | w, x | *Rattus norvegicus* guanine nucleotide binding protein, betapolypeptide 2-like 1 (Gnb2l1), mRNA. 11/22Length = 189 | guanine nucleotide binding protein (G protein), beta polypeptide 2-like 1 |
| 2507 | 1809 | NM_130741 | l, k | *Rattus norvegicus* lipocalin 2 (Lcn2), mRNA. 11/22Length = 876 | lipocalin 2 |
| 2508 | 1502 | NM_130746 | aa | *Rattus norvegicus* solute carrier family 5, member 6 (Slc5a6), mRNA. 11/22Length = 391 | solute carrier family 5 (sodium-dependent vitamin transporter), member 6 |
| 2508 | 1503 | NM_130746 | d | *Rattus norvegicus* solute carrier family 5, member 6 (Slc5a6), mRNA. 11/22Length = 391 | solute carrier family 5 (sodium-dependent vitamin transporter), member 6 |
| 2509 | 20738 | NM_131907 | c | *Rattus norvegicus* ATPase, Ca++-sequestering (Atp2c1), mRNA. 11/22Length = 4645 | ATPase, Ca++-sequestering |
| 2510 | 17564 | NM_133283 | hh | *Rattus norvegicus* mitogen activated protein kinase kinase 2(Map2k2), mRNA. 11/22Length = 1376 | mitogen activated protein kinase kinase 2 |
| 2511 | 25730 | NM_133290 | j, k, p, q | *Rattus norvegicus* zinc finger protein 36 (Zfp36), mRNA. 11/22Length = 963 | zinc finger protein 36 |
| 2512 | 20879 | NM_133295 | hh | *Rattus norvegicus* carboxylesterase 3 | carboxylesterase 3 |

TABLE 1-continued

| SEQ ID | GLGC ID | GenBank Accession No. | Model Code | Known Gene Name | Unigene Sequence Cluster Title |
|---|---|---|---|---|---|
| | | | | (Ces3), mRNA. 11/22Length = 1935 | |
| 2513 | 19456 | NM_133298 | h, l, w, x | *Rattus norvegicus* glycoprotein (transmembrane) nmb (Gpnmb), mRNA. 2/22Length = 232 | glycoprotein (transmembrane) nmb |
| 2513 | 4048 | NM_133298 | h, l, n, o, w, x | *Rattus norvegicus* glycoprotein (transmembrane) nmb (Gpnmb), mRNA. 2/22Length = 232 | glycoprotein (transmembrane) nmb |
| 2513 | 4049 | NM_133298 | c, h, l, n, o, w, x | *Rattus norvegicus* glycoprotein (transmembrane) nmb (Gpnmb), mRNA. 2/22Length = 232 | glycoprotein (transmembrane) nmb |
| 2514 | 1061 | NM_133303 | p, q, hh | *Rattus norvegicus* basic helix-loop-helix domain containing, class B3 (Bhlhb3), mRNA. 11/22Length = 311 | basic helix-loop-helix domain containing, class B, 3 |
| 2515 | 4318 | NM_133306 | p, q | *Rattus norvegicus* oxidised low density lipoprotein(lectin-like) receptor 1 (Qlr1), mRNA. 11/22Length = 375 | oxidised low density lipoprotein (lectin-like) receptor 1 |
| 2516 | 657 | NM_133380 | j, k, y, z | *Rattus norvegicus* Interleukin 4 receptor (Il4r), mRNA. 3/22Length = 3576 | Interleukin 4 receptor |
| 2517 | 7700 | NM_133386 | ee, ff | *Rattus norvegicus* sphingosine kinase 1 (Sphk1), mRNA. 11/22Length = 2648 | sphingosine kinase 1 |
| 2518 | 16713 | NM_133409 | b | *Rattus norvegicus* integrin-linked kinase (Ilk), mRNA. 3/22Length = 1359 | integrin-linked kinase |
| 2519 | 19326 | NM_133419 | u, v, jj, kk | *Rattus norvegicus* dyskeratosis congenita 1, dyskerin (Dkc1), mRNA. 3/22Length = 183 | dyskeratosis congenita 1, dyskerin |
| 2520 | 10660 | NM_133423 | e, cc, dd | *Rattus norvegicus* splicing factor YT521-B (YT521), mRNA. 3/22Length = 2968 | splicing factor YT521-B |
| 2521 | 24775 | NM_133511 | c | *Rattus norvegicus* adenylate cyclase activating polypeptide 1 receptor (Adcyap1r1), mRNA. 11/22Length = 2681 | adenylate cyclase activating polypeptide 1 receptor 1 |
| 2522 | 25543 | NM_133524 | s | *Rattus norvegicus* transcription factor E2a (Tcfe2a), mRNA. 3/22Length = 216 | |
| 2523 | 20890 | NM_133526 | ii | *Rattus norvegicus* transmembrane 4 superfamily member 3(Tm4sf3), mRNA. 3/22Length = 1182 | transmembrane 4 superfamily member 3 |
| 2524 | 2788 | NM_133528 | s, t | *Rattus norvegicus* preimplantation protein 3 (Prei3), mRNA. 3/22Length = 2513 | preimplantation protein 3 |
| 2525 | 1791 | NM_133541 | ll | *Rattus norvegicus* general transcription factor III C 1(Gtf3c1). mRNA. 3/22Length = 6878 | general transcription factor III C 1 |
| 2526 | 1824 | NM_133545 | j, k, r | *Rattus norvegicus* protein tyrosine phosphatase 2E (Ptp2E), mRNA. 3/22Length = 5543 | protein tyrosine phosphatase 2E |

TABLE 1-continued

| SEQ ID | GLGC ID | GenBank Accession No. | Model Code | Known Gene Name | Unigene Sequence Cluster Title |
|---|---|---|---|---|---|
| 2527 | 11483 | NM_133546 | j, k, p, q, kk | Rattus norvegicus myeloid differentiation primary responsegene 116 (Myd116), mRNA. 3/22Length = 2225 | myeloid differentiation primary response gene 116 |
| 2527 | 18043 | NM_133546 | s, t, ll | Rattus norvegicus myeloid differentiation primary responsegene 116 (Myd116), mRNA. 3/22Length = 2225 | myeloid differentiation primary response gene 116 |
| 2528 | 244 | NM_133551 | a, j, k, y, z, ee, ff, kk | Rattus norvegicus phospholipase A2, group IVA (cytosolic, calcium-dependent) (Pla2g4a), mRNA. 1/22Length = 2858 | EST, Weakly similar to FGD1_MOUSE Putative Rho/Rac guanine nucleotide exchange factor (Rho/Rac GEF) (Faciogenital dysplasia protein homolog) [*M. musculus*], phospholipase A2, group IVA (cytosolic, calcium-dependent) |
| 2529 | 25369 | NM_133559 | l, m | Rattus norvegicus proprotein convertase subtilisin/kexin type 4 (Pcsk4), mRNA. 11/22Length = 2458 | proprotein convertase subtilisin/kexin type 4 |
| 2530 | 1827 | NM_133572 | r, u, v | Rattus norvegicus cell division cycle 25B (Cdc25b), mRNA. 3/22Length = 284 | cell division cycle 25B |
| 2530 | 1830 | NM_133572 | v | Rattus norvegicus cell division cycle 25B (Cdc25b), mRNA. 3/22Length = 284 | cell division cycle 25B |
| 2530 | 1831 | NM_133572 | v | Rattus norvegicus cell division cycle 25B (Cdc25b), mRNA. 3/22Length = 284 | cell division cycle 25B |
| 2531 | 24609 | NM_133585 | cc, dd | Rattus norvegicus RN protein (LOC171116), mRNA. 3/22Length 1619 | RN protein |
| 2532 | 1271 | NM_133593 | a, ee, ff, jj, kk | Rattus norvegicus adaptor-related protein complex AP-3, mu 1 subunit (Ap3m1), mRNA. 4/22Length = 2146 | adaptor-related protein complex AP-3, mu 1 subunit |
| 2533 | 1728 | NM_133618 | w, x | Rattus norvegicus hydroxyacyl-Coenzyme A dehydrogenase/3-ketoacyl-Coenzyme A thiolase/enoyl-Coenzyme A hydratase (trifunctional protein), beta subunit (Hadhb), mRNA. 3/22Length = 1928 | hydroxyacyl-Coenzyme A dehydrogenase/3-ketoacyl-Coenzyme A thiolase/enoyl-Coenzyme A hydratase (trifunctional protein), beta subunit |
| 2534 | 14995 | NM_133624 | d | Rattus norvegicus guanylate binding protein 2, interferon-inducible (Gbp2), mRNA. 3/22Length = 2396 | guanylate binding protein 2, interferon-inducible |
| 2535 | 1463 | NM_134334 | u, v, gg | Rattus norvegicus cathepsin D (Ctsd), mRNA. 11/22Length = 1934 | cathepsin D |
| 2536 | 16456 | NM_134346 | ii | Rattus norvegicus RAPi B, member of RAS oncogene family (Rapi b), mRNA. 3/22Length = 1874 | RAP1B, member of RAS oncogene family |
| 2537 | 517 | NM_134350 | s | Rattus norvegicus myxovirus (influenza virus) resistance 3 (Mx3), mRNA. 3/22Length = 2443 | myxovirus (influenza virus) resistance 3 |
| 2538 | 17337 | NM_134351 | j, k | Rattus norvegicus methionine adenosyltransferase II, alpha (Mat2a), mRNA. 3/22Length = 1337 | ESTs |

TABLE 1-continued

| SEQ ID | GLGC ID | GenBank Accession No. | Model Code | Known Gene Name | Unigene Sequence Cluster Title |
|---|---|---|---|---|---|
| 2539 | 606 | NM_134352 | a, y, z | *Rattus norvegicus* Plasminogen activator, urokinase receptor (Plaur), mRNA. 5/22Length = 1277 | Plasminogen activator, urokinase receptor |
| 2540 | 19840 | NM_134353 | ll | *Rattus norvegicus* poly(A) binding protein, cytoplasmic 1 (Pabpcl), mRNA. 3/22Length = 219 | poly(A) binding protein, cytoplasmic 1 |
| 2541 | 8692 | NM_134387 | hh | *Rattus norvegicus* diacetyl/L-xylulose reductase (glb), mRNA. 3/22Length = 879 | diacetyl/L-xylulose reductase |
| 2542 | 1530 | NM_134397 | a, e, jj, kk | *Rattus norvegicus* LLS protein (LIS), mRNA. 3/22Length 3765 | LL5 protein |
| 2543 | 7164 | NM_134406 | jj, kk | *Rattus norvegicus* cytosolic sorting protein PACS-1 (Pacsl), mRNA. 3/22Length = 4198 | cytosolic sorting protein PACS-1 |
| 2544 | 25237 | NM_134452 | r | *Rattus norvegicus* collagen, type V, alpha 1 (ColSa 1), mRNA. 11/22Length = 5551 | collagen, type V, alpha 1 |
| 2545 | 19077 | NM_134455 | aa, bb | *Rattus norvegicus* chemokine (C-X3-C motif) ligand 1 (Cx3cll), mRNA. 1/22Length = 344 | small inducible cytokine subfamily D, 1 |
| 2546 | 19894 | NM_138518 | t, ll | *Rattus norvegicus* late gestation lung protein 1 (Lgll), mRNA. 4/22Length = 352 | late gestation lung protein 1 |
| 2547 | 4422 | NM_138531 | gg | *Rattus norvegicus* associated molecule with the SH3 domain ofSTAM (Amsh), mRNA. 11/22Length= 1544 | associated molecule with the SH3 domain of STAM |
| 2548 | 5283 | NM_138535 | gg | *Rattus norvegicus* glutamate receptor interacting protein 2 (Grip2), mRNA. 4/22Length = 5433 | glutamate receptor interacting protein 2 |
| 2549 | 25479 | NM_138549 | jj, kk | *Rattus norvegicus* synaptic glycoprotein (S02), mRNA. 4I22Length = 1178 | synaptic glycoprotein SG2 SC2 |
| 2550 | 15189 | NM_138826 | j, k, y, z, ee, ff, kk | *Rattus norvegicus* Metallothionein (Mtla), mRNA. 11/22Length = 389 | Metallothionein |
| 2550 | 15190 | NM_138826 | j, k, y, z, ii | *Rattus norvegicus* Metallothionein (Mtla), mRNA. 11/22Length = 389 | Metallothionein |
| 2551 | 16248 | NM_138827 | y, z | *Rattus norvegicus* solute carrier family 2, member 1 (Slc2al), mRNA. 1/22Length = 2571 | Solute carrier family 2 a 1 (facilitated glucose transporter) brain |
| 2551 | 16249 | NM_138827 | j, k | *Rattus norvegicus* solute carrier family 2, member I (Slc2al), mRNA. 1/22Length = 2571 | Solute carrier family 2 a 1 (facilitated glucose transporter) brain |
| 2552 | 16400 | NM_138828 | cc, dd | *Rattus norvegicus* apolipoprotein F (Apoe), mRNA. 11/22Length = 936 | Apolipoprotein E, |
| 2552 | 16401 | NM_138828 | gg | *Rattus norvegicus* apolipoprotein F (Apoe), mRNA. 11/22Length = 936 | |
| 2553 | 23166 | NM_138839 | y, z, ee, ff, kk | *Rattus norvegicus* vacuole Membrane Protein 1 (Vmpl), mRNA. 11/22Length = 183 | Vacuole Membrane Protein 1 |

TABLE 1-continued

| SEQ ID | GLGC ID | GenBank Accession No. | Model Code | Known Gene Name | Unigene Sequence Cluster Title |
|---|---|---|---|---|---|
| 2554 | 9796 | NM_138847 | j, k | *Rattus norvegicus Saccharomyces cerevisiae* Nip7p homolog(pEachy), mRNA. 4/22Length = 1175 | *Saccharomyces cerevisiae* Nip7p homolog |
| 2555 | 8468 | NM_138861 | b | *Rattus norvegicus* prolactin-like protein K (Prlpk), mRNA. 11/22Length = 865 | prolactin-like protein K |
| 2556 | 17530 | NM_138877 | n, o, ii | *Rattus norvegicus* Diaphorase (NADH) (cytochrome b-5 reductase)(Dia1), mRNA. 4/22Length = 1893 | Diaphorase (NADH) (cytochrome b-5 reductase) |
| 2556 | 17532 | NM_138877 | j, k | *Rattus norvegicus* Diaphorase (NADH) (cytochrome b-5 reductase)(Dia1), mRNA. 4/22Length= 1893 | Diaphorase (NADH) (cytochrome b-5 reductase) |
| 2556 | 25039 | NM_138877 | ee, ff | *Rattus norvegicus* Diaphorase (NADH) (cytochrome b-S reductase)(Dia1), mRNA. 4/22Length = 1893 | Diaphorase (NADH) (cytochrome b-5 reductase) |
| 2557 | 4594 | NM_138881 | c | *Rattus norvegicus* Best5 protein (Best5), mRNA. 4/22Length = 3628 | Best5 protein |
| 2558 | 945 | NM_138882 | j, k, s, t | *Rattus norvegicus* phosphatidylserine-specific phospholipaseAl (Pspla 1), mRNA. 11/22Length = 1743 | phosphatidylserine-specific phospholipase A1 |
| 2559 | 7395 | NM_138883 | r | *Rattus norvegicus* ATP synthase, H+ transporting, mitochondrial Fl complex, 0 subunit (oligomycin sensitivity conferring protein) (Atp5o), mRNA. 4/22Length = 77 | ATP synthase, H+ transporting, mitochondrial F1 complex, 0 subunit (oligomycin sensitivity conferring protein) |
| 2560 | 3015 | NM_138895 | aa, bb | *Rattus norvegicus* polyubiquitin (Loci 92255), mRNA. 4/22Length = 1115 | polyubiquitin |
| 2561 | 1168 | NM_138898 | e, n | *Rattus norvegicus* phospholipase B (Loci 92259), mRNA. 4/22Length = 459 | phospholipase B |
| 2562 | 18867 | NM_138900 | b, c | *Rattus norvegicus* complement component 1, s subcomponent (Cl s), mRNA. 11/22Length = 298 | complement component 1, s subcomponent |
| 2563 | 11840 | NM_138911 | e | *Rattus norvegicus* stress-induced-phosphoprotein 1 (Hsp7/Hsp9-organizing protein) (Stipi), mRNA. 4/22Length = 1632 | stress-induced-phosphoprOtein 1 (Hsp70/Hsp90-organizing protein) |
| 2564 | 15380 | NM_139083 | u, v, cc, dd | *Rattus norvegicus* ribosomal protein L41 (Rpl4l), mRNA. 11/22Length = 357 | ribosomal protein L41 |
| 2565 | 734 | NM_139094 | gg | *Rattus norvegicus* CTD-binding SR-like protein rA8 (L0C245926), mRNA. 5/22Length = 4794 | CTD-binding SR-like protein rA8 |
| 2566 | 17203 | NM_139099 | g, hh | *Rattus norvegicus* ATP synthase, H+ transporting, mitochondrial Fl complex, epsilon subunit (Atp5e), mRNA. 5/22Length = 44 | ATP synthase, H+transporting, mitochondrial F1 complex, epsilon subunit |
| 2566 | 17204 | NM_139099 | g | *Rattus norvegicus* ATP synthase, H+ transporting, | ATP synthase, H+transporting, mitochondrial Fl complex, epsilon subunit |

TABLE 1-continued

| SEQ ID | GLGC ID | GenBank Accession No. | Model Code | Known Gene Name | Unigene Sequence Cluster Title |
|---|---|---|---|---|---|
| 2567 | 17854 | NM_139103 | ii | mitochondrial Fl complex, epsilon subunit (Atp5e), mRNA. 5/22Length = 44 *Rattus norvegicus* CD48 antigen (0d48), mRNA. 5/22Length = 1422 | CD48 antigen |
| 2568 | 17868 | NM_139104 | r, s, t | *Rattus norvegicus* Estrogen-regulated protein 0BL2, 2.4 kD (L0C245963), mRNA. 5/22Length = 1888 | ESTs, Weakly similar to T09065 hypothetical protein - mouse [*M musculus*], Estrogen-regulated protein CBL20, 20.4kD |
| 2569 | 18108 | NM_139105 | a, n, o, ll | *Rattus norvegicus* ribonucleaselangiogenin inhibitor (Rnhl), mRNA. 11/22Length = 1664 | ribonuclease/angiogenin inhibitor |
| 2570 | 14463 | NM_139110 | ii | *Rattus norvegicus* G protein-coupled hepta-helical receptor Ig-Hepta (Ig-Hepta), mRNA. 5/22Length = 4951 | G protein-coupled hepta-helical receptor Ig-Hepta |
| 2571 | 22595 | NM_139253 | cc, dd | *Rattus norvegicus* stem cell derived neuronal survival protein precursor (Sdnsf), mRNA. 5/22Length = 1771 | stem cell derived neuronal survival protein precursor |
| 2572 | 1803 | NM_139256 | c | *Rattus norvegicus* mannosidase, alpha, class 20, member 1(Man2cl), mRNA. 5/22Length = 336 | mannosidase, alpha, class 20, member 1 |
| 2573 | 9775 | NM_139334 | c | *Rattus norvegicus* brain-enriched protein Besh3 (Besh3), mRNA. 11/22Length = | brain-enriched SH3-domain protein Besh3 SH3-domain |
| 2574 | 12450 | NM_139337 | c, hh | *Rattus norvegicus* LRP16 protein (Lrpl6), mRNA. 11/22Length = 13 | *Rattus norvegicus* LRP16-like protein mRNA, complete cds |
| 2575 | 21818 | NM_139342 | bb | *Rattus norvegicus* homocysteine respondent protein HCYP2 (Hcyp2), mRNA. 11/22Length = 215 | *Rattus norvegicus* homocysteine respondent protein HCYP2 mRNA, complete cds |
| 2576 | 12804 | NM_144740 | l, m | *Rattus norvegicus* Rho GTPase activating protein 4 (Arhgap4), mRNA. 11/22Length = 325 | ESTs, Moderately similar to RHG4 HUMAN Rho-GTPase-activating protein 4 (Rho-GAP hematopoietic protein C1) (P115) [*H. sapiens*] |
| 2577 | 13712 | NM_144744 | ii | *Rattus norvegicus* adipocyte complement related protein of 3kDa (Acrp3), mRNA. 11/22Length = 767 | ESTs, Weakly similar to 1917150A collagen:SUBUNIT = alpha1:ISOTYPEV=VIII [*Rattus norvegicus* [*R.norvegicus*] |
| 2578 | 23756 | NM_145084 | gg | *Rattus norvegicus* hypothetical protein RMT-7 (Rmt7), mRNA. 11/22Length = 1855 | *Rattus norvegicus* hypothetical protein RMT-7 mRNA, complete cds |
| 2579 | 15761 | NM_145091 | cc, dd, jj, kk | *Rattus norvegicus* pyruvate dehydrogenase phosphatase isoenzyme2 (Pdp2), mRNA. 11/22Length = 175 | *Rattus norvegicus* pyruvate dehydrogenase phosphatase isoenzyme 2 mRNA, complete cds |
| 2580 | 1948 | NM_145092 | b, l, m | *Rattus norvegicus* lamina-associated polypeptide 10 (Lapic), mRNA. 11/22Length = 231 | *Rattus norvegicus* lamina-associated polypeptide 10 (LAPiC) mRNA, complete cds |
| 2581 | 6731 | NM_145096 | hh | *Rattus norvegicus* zinc finger, DHHC domain containing 2(Zdhhc2), mRNA. 11/22Length = 1487 | *Rattus norvegicus* small rec (srec) mRNA, complete cds |
| 2582 | 6988 | NM_145677 | j, k | *Rattus norvegicus* peroxisomal Ca-dependent solute carrier-like protein (Pcscl), | ESTs |

TABLE 1-continued

| SEQ ID | GLGC ID | GenBank Accession No. | Model Code | Known Gene Name | Unigene Sequence Cluster Title |
|---|---|---|---|---|---|
| | | | | mRNA. 11/22Length = 315 | |
| 2583 | 305 | NM_145773 | u, v | *Rattus norvegicus* Max dimerization protein 3 (Mad3), mRNA. 11/22Length = 989 | *Rattus norvegicus* Myx mRNA, complete cds |
| 2584 | 15640 | NM_145775 | h, l, j, k, r | *Rattus norvegicus* nuclear receptor subfamily 1, group D, member 1 (Nr1d1), mRNA. 11/22Length = 2297 | Rat Rev-ErbA-alpha protein mRNA, complete cds |
| 2584 | 15641 | NM_145775 | h, l | *Rattus norvegicus* nuclear receptor subfamily 1, group D, member 1 (Nr1d1), mRNA. 11/22Length = 2297 | Rat Rev-ErbA-alpha protein mRNA, complete cds |
| 2585 | 22972 | NM_145778 | e | *Rattus norvegicus* tubulin, gamma 1 (Tubg1), mRNA. 11/22Length = 142 | *Rattus norvegicus* mRNA for tubulin, complete cds |
| 2586 | 20106 | NM_145784 | ii | *Rattus norvegicus* G protein-coupled receptor 37-like 1 (Gpr37l1), mRNA. 11/22Length = 2451 | ESTs |
| 2586 | 20515 | NM_145784 | ll | *Rattus norvegicus* G protein-coupled receptor 37-like 1 (Gpr37l1), mRNA. 11/22Length = 2451 | ESTs |
| 2586 | 19976 | NM_145784 | ij, kk | *Rattus norvegicus* G protein-coupled receptor 37-like 1 (Gpr37l1), mRNA. 1 ll22Length = 2451 | ESTs |
| 2586 | 20046 | NM_145784 | w, x | *Rattus norvegicus* G protein-coupled receptor 37-like 1 (Gpr37l1), mRNA. 11/22Length = 2451 | ESTs |
| 2587 | 20740 | NM_145878 | d, j, k, t, bb, gg, kk, ll | *Rattus norvegicus* fatty acid binding protein 5, epidermal (Fabp5), mRNA. 11/22Length = 664 | *Rattus norvegicus* Sprague-Dawley lipid-binding protein mRNA, complete cds |
| 2588 | 5095 | NM_147140 | u, v | *Rattus norvegicus* PLRR-4 polymorphic leucine-rich repeat protein (Plrr4), mRNA. 11/22Length = 2275 | *Rattus norvegicus* clone PLRR-4 polymorphic leucine-rich repeat protein mRNA, complete cds |
| 2589 | 25435 | NM_147208 | s, t | *Rattus norvegicus* ischemia related factor vof 21 (L0C259228), mRNA. 11/22Length = 4885 | |
| 2590 | 90 | NM_147210 | h, l | *Rattus norvegicus* nuclear receptor subfamily 1, group D, member 2 (Nr1d2), mRNA. 11/22Length = 1996 | *Rattus norvegicus* nuclear receptor Rev-ErbA-beta mRNA, partial cds |
| 2591 | 1760 | NM_147211 | d, kk | *Rattus norvegicus* SH3 domain binding protein CR16 (CR16), mRNA. 11/22Length 4359 | *Rattus norvegicus* SH3 domain binding protein (CR16) mRNA, complete cds |
| 2592 | 10544 | NM_152935 | s, t, u, v | *Rattus norvegicus* outer mitochondrial membrane receptor rTOM2 (L0C26661), mRNA. 11/22Length = 976 | *Rattus norvegicus* outer mitochondrial membrane receptor rTOM20 mRNA, complete cds |
| 2593 | 12700 | NM_152936 | h, l | *Rattus norvegicus* pancreatic secretory trypsin inhibitor type II | Rat pancreatic secretory trypsin inhibitor type II (PSTI-ll) mRNA, complete cds |

TABLE 1-continued

| SEQ ID | GLGC ID | GenBank Accession No. | Model Code | Known Gene Name | Unigene Sequence Cluster Title |
|---|---|---|---|---|---|
| | | | | (PSTI-ll) (L0C26662), mRNA. 11/22Length = 379 | |
| 2594 | 15711 | NM_153629 | p | *Rattus norvegicus* heat shock 7 kDa protein 4 (Hspa4), mRNA. 1/22Length = 4521 | *Rattus norvegicus* ischemia responsive 94 kDa protein (irp94) mRNA, complete cds |
| 2595 | 4834 | NM_153821 | h, l | *Rattus norvegicus* paired mesoderm homeobox 1 (Pmx1), mRNA. 1/22Length = 1375 | ESTs, ESTs, Highly similar to S37300 glycogen phosphorylase (EC 2.4.1.1), brain - rat [*R.norvegicus*] |
| 2596 | 19888 | S56464 | cc, dd | | ESTs |
| 2597 | 15693 | S56679 | aa, bb | glutamate receptor, onotropic, AMPA1 (alpha 1) | glutamate receptor, ionotropic, AMPA1 (alpha 1) |
| 2598 | 25495 | S59892 | b, l, m | | |
| 2599 | 25496 | S59893 | b, l, m | | |
| 2600 | 8210 | S61960 | jj, kk | ferritin light chain 1 | ferritin light chain 1 |
| 2601 | 3244 | S63519 | a, c, r, w, x | | ESTs |
| 2602 | 951 | S69206 | ii | mast cell protease 1 | mast cell protease 1 |
| 2603 | 18647 | S69316 | d, e | | ESTs, Weakly similar to HS9B RAT Heat shock protein HSP 90-beta (HSP 84) [*R.norvegicus*] |
| 2604 | 25066 | S75280 | r | | |
| 2605 | 25538 | S76466 | gg | | |
| 2606 | 24469 | S77858 | ll | | ESTs, Highly similar to MLES RAT Myosin light chain alkali, smooth-muscle isoform (MLC3SM) [*R.norvegicus*] |
| 2607 | 21583 | S77900 | bb, kk | | ESTs, Highly similar to A37100 myosin regulatory light chain A, smooth muscle - rat [*R.norvegicus*] |
| 2608 | 17626 | S78556 | gg | | ESTs, Highly similar to 156581 dnaK-type molecular chaperone grp75 precursor - rat [*R.norvegicus*] |
| 2608 | 25547 | S78556 | n, cc, dd, ll | | |
| 2609 | 25550 | S79213 | d | protein phosphatase 1, regulatory (inhibitor) subunit2 | |
| 2610 | 25556 | S79939 | hh | | |
| 2611 | 25571 | S98336 | u, v | | |
| 2612 | 25075 | U01347 | l, m | | |
| 2613 | 25572 | U02534 | b | | |
| 2614 | 15462 | U06230 | f, g | protein S | protein S |
| 2615 | 16675 | U17565 | r, ii | mini chromosome maintenance deficient 6 (*S. cerevisiae*) | mini chromosome maintenance deficient 6 (*S. cerevisiae*) |
| 2616 | 25589 | U21718 | d, hh | | |
| 2617 | 22196 | U21719 | d | ESTs | |
| 2618 | 25590 | U21720 | hh | | |
| 2619 | 298 | U25282 | b, l, m | | |
| 2620 | 25593 | U26310 | gg | tensin | |
| 2621 | 399 | U31668 | p, q | E2F transcription factor 5 | E2F transcription factor 5 |
| 2622 | 20224 | U47014 | b, u, v | proprotein convertase subtilisin/kexin type 5 | proprotein convertase subtilisin/kexin type 5 |
| 262 | 314554 | U48828 | ll | | *R.norvegicus* H1SHR mRNA, *Rattus norvegicus* retroviral-like ovarian specific transcript 30-1 mRNA |
| 2624 | 21654 | U53184 | a, e, j, k, q, y, z, kk | LPS-induced TNF-alpha factor | LPS-induced TNF-alpha factor |
| 2625 | 1283 | U61729 | cc, dd, ll | | *Rattus norvegicus* proline rich protein mRNA, complete cds |
| 2626 | 25618 | U64705 | r | | |
| 2626 | 25619 | U64705 | r | | |
| 2627 | 20386 | U68562 | cc, dd | heat shock protein 60 (liver) | heat shock protein 60 (liver) |
| 2628 | 25629 | U70270 | n, o | | |
| 2629 | 1715 | U72660 | a, jj, kk | Ninjurin | Ninjurin |
| 2630 | 2153 | U75404 | u, v | A kinase (PRKA) anchor protein (gravin) 12 | A kinase (PRKA) anchor protein (gravin) 12 |
| 2631 | 25632 | U75405 | g | | |
| 2632 | 25638 | U75923 | gg | isoleucine-tRNA synthetase | |
| 2633 | 17296 | U76206 | jj, kk | G protein-coupled receptor VTR 15-20 | G protein-coupled receptor VTR 15-20 |

TABLE 1-continued

| SEQ ID | GLGC ID | GenBank Accession No. | Model Code | Known Gene Name | Unigene Sequence Cluster Title |
|---|---|---|---|---|---|
| 2634 | 25643 | U77829 | cc, dd | growth arrest specific 5 | |
| 2634 | 4477 | U77829 | d | growth arrest specific 5 | ESTs |
| 2635 | 25647 | U83119 | g, gg | | |
| 2636 | 983 | U89745 | u, ii | unknown protein | |
| 2637 | 23282 | U90725 | hh | lipoprotein-binding protein | lipoprotein-binding protein |
| 2638 | 25659 | U95157 | b, l, m | ryanodine receptor type II | |
| 2639 | 20818 | X02904 | ii | glutathione 5-transferase, pi 2 | glutathione 5-transferase, pi 2 |
| 2640 | 20169 | X03347 | p, q | | |
| 2641 | 10181 | X06769 | p, q | FBJ murine osteosarcoma viral (v-fos) oncogene homolog | FBJ murine osteosarcoma viral (v-fos) oncogene homolog |
| 2642 | 14966 | X07551 | c, w, x, cc, dd | | |
| 2643 | 25671 | X07686 | g | | |
| 2644 | 2464 | X13411 | u, v | Eph receptor B2 (ELK-related protein tyrosine kinase) | Eph receptor B2 (ELK-related protein tyrosine kinase) |
| 2645 | 20810 | X14181 | f, g, w, x | | ESTs, Highly similar to R5RT18 ribosomal protein Ll8a, cytosolic [validated] - rat [*R.norvegicus*] |
| 2646 | 18541 | X14671 | g | | ESTs, Highly similar to RL26 RAT 60S RIBOSOMAL PROTEIN L26 [*R.norvegicus*] |
| 12 | 21152 | X14848 | bb | *Rattus norvegicus* mitochondrial genome. 9/22Length = 16, 3 | golgi SNAP receptor complex member 1 |
| 2647 | 19244 | X15013 | f, g, w, x | | ESTs, Highly similar to RL7A HUMAN 60S ribosomal protein L7a (Surfeit locus protein 3) (PLA-X polypeptide) [*R.norvegicus*] |
| 2647 | 25679 | X15013 | f, g, aa | | |
| 2648 | 15626 | X17665 | w, x | ribosomal protein S16 | ESTs, Highly similar to R3RT16 ribosomal protein S16, cytosolic [validated]- rat [*R.norvegicus*] |
| 2649 | 10819 | X51536 | gg | ribosomal protein S3 | ESTs, Highly similar to RS3_MOUSE 40S ribosomal protein S3 [*R.norvegicus*] |
| 2649 | 25686 | X51536 | w, x, hh | ribosomal protein S3 | |
| 2650 | 18250 | X51706 | w, x | ribosomal protein L9 | ESTs, Highly similar to RL9_RAT 60S RIBOSOMAL PROTEIN L9 [*R.norvegicus*] |
| 2651 | 20872 | X51707 | l, w, x | ribosomal protein S19 | ESTs, Highly similar to R3RT19 ribosomal protein S19, cytosolic [validated] - rat [*R.norvegicus*] |
| 2652 | 16715 | X53054 | cc, dd, ii | | Rat mRNA for RT1.D beta chain |
| 2652 | 16716 | X53054 | c | | Rat mRNA for RT1.D beta chain |
| 2653 | 20421 | X53378 | h | ribosomal protein 513 | ribosomal protein 513 |
| 2654 | 18606 | X53504 | g, w, x | | ESTs, Highly similar to RL12 RAT 60S RIBOSOMAL PROTEIN L12 [*R.norvegicus*] |
| 2654 | 25691 | X53504 | g | | |
| 2655 | 25692 | X53581 | hh | | |
| 2655 | 20617 | X53581 | g | | |
| 2656 | 1037 | X57523 | d | Transporter 1, ABC (ATP binding cassette) | Transporter 1, ABC (ATP binding cassette) |
| 2657 | 15106 | X57529 | h, l, aa | | ESTs, Highly similar to RS18_HUMAN 40S ribosomal protein 518 (KE-3) (KE3) [*R.norvegicus*] |
| 2658 | 18611 | X58200 | g | ribosomal protein L29 | ribosomal protein L29 |
| 2658 | 5667 | X58200 | h, l, w, x | ribosomal protein L23 | |
| 2659 | 25702 | X58465 | g, w, x | Ribosomal protein S5 | Ribosomal protein S5 |
| 2659 | 10109 | X58465 | g, w, x | Ribosomal protein S5 | Ribosomal protein SS |
| 2660 | 25705 | X59375 | b, d, l, kk | | |
| 2661 | 25710 | X59864 | ll | | |
| 2662 | 17176 | X60212 | f | | *R.norvegicus ASI mRNA for* mammalian equivalent of bacterial large ribosomal subunit protein L22 |
| 2663 | 25711 | X60468 | s, t | amyloid beta (A4) precursor protein-binding, family B, member 1 | amyloid beta (A4) precursor protein-binding, family B, member 1 |
| 2664 | 25716 | X61295 | c, g, hh | | |
| 2665 | 21657 | X61381 | d, j, k, m, y, z, kk | | *Rattus norvegicus* interferon-inducible protein variant 10 mRNA, complete cds |
| 2666 | 15875 | X62145 | h, r | ribosomal protein L8 | ESTs, Highly similar to RL8_HUMAN 60S [*R.norvegicus*] |

TABLE 1-continued

| SEQ ID | GLGC ID | GenBank Accession No. | Model Code | Known Gene Name | Unigene Sequence Cluster Title |
|---|---|---|---|---|---|
| 2667 | 13646 | X62166 | n, o, w, x, kk, ll | | ESTs, Highly similar to RL3_RAT 60S RIBOSOMAL PROTEIN L3 (L4) [*R.norvegicus*] |
| 2668 | 15387 | X62482 | w, x | | ESTs, Highly similar to R3RT2S ribosomal protein 525, cytosolic [validated] - rat [*R.norvegicus*] |
| 2669 | 16780 | X62660 | c, f, g | HMm:glutathione S-transferase, alpha 4 | ESTs, Highly similar to S23433 glutathione transferase (EC 2.5.1.18)8-rat [*R.norvegicus*] |
| 2670 | 25090 | X63594 | j, k | Inhibitor of nuclear factor of kappa light chain gene enhancer in B-cells, alpha | |
| 2671 | 20844 | X65228 | f, g, cc, dd | | ESTs, Highly similar to R3RT3A ribosomal protein L23a, cytosolic [validated]- rat [*R.norvegicus*] |
| 2672 | 436 | X67877 | c, s, t, gg | | *R.norvegicus* mRNA for cytosolic resiniferatoxin-binding protein |
| 2673 | 602 | X68101 | ee, ff | | *R.norvegicus* trg mRNA |
| 2674 | 16426 | X70369 | c, g, bb | procollagen, type III, alpha 1 | procollagen, type III, alpha 1 |
| 2675 | 25737 | X70667 | l, m | | |
| 2676 | 16725 | X73371 | e, jj, kk | melanocortin 3 receptor | *R.norvegius* mRNA for Fc gamma receptor |
| 2677 | 24232 | X75207 | aa, bb | Cyclin D1 | Cyclin D1 |
| 2678 | 16272 | X76456 | u, v | | |
| 2679 | 25741 | X76489 | s, t | CD9 antigen (p24) | |
| 2680 | 25094 | X77117 | bb | | |
| 2681 | 25743 | X80130 | aa, bb | | |
| 2682 | 18621 | X82669 | ii | RT1 class lb gene | RT1 class lb gene |
| 2683 | 25752 | X89694 | b, l, m | | |
| 2684 | 25761 | X89702 | j, k | | |
| 2685 | 25765 | X89706 | b, c, u, v | | |
| 2686 | 18031 | X94551 | f, r | laminin, gamma 1 | laminin, gamma 1 |
| 2687 | 12978 | X96437 | a, j, k, p, q, y, z, ee, ff | ESTs, Highly similar to | S33363 gly96 protein - mouse [*M. musculus*] |
| 2687 | 25770 | X96437 | b, c, u, v, y | | |
| 2688 | 19279 | Y00350 | a, aa, bb, jj, kk | uroporphyrinogen decarboxylase | uroporphyrinogen decarboxylase |
| 2689 | 17146 | Y07534 | aa | Serine protease inhibitor | Serine protease inhibitor |
| 2690 | 25777 | Y08355 | l, m | oxidative stress induced | oxidative stress induced |
| 2691 | 18352 | Z12298 | aa, bb | decorin | decorin |
| 2692 | 25790 | Z21935 | b, u, v | mitogen activated protein kinase 4 | |
| 2693 | 19694 | Z48444 | cc, dd | A disintegrin and metalloprotease domain (ADAM) 10 | A disintegrin and metalloprotease domain (ADAM) 10 |
| 2694 | 17481 | Z49761 | w, x | | *R.norvegicus* mRNA for RT1.Ma |
| 2695 | 8664 | Z75029 | y, z, ee, ff | | ESTs, Moderately similar to 117342 hypothetical protein DKFZp586K1 924.1 - human (fragment) [*H. sapiens*], *R.norvegicus* hsp70.2 mRNA for heat shock protein 70 |
| 2696 | 15569 | Z78279 | c, g, bb | procollagen, type I, alpha 1 | procollagen, type I, alpha 1 |
| 2696 | 15570 | Z78279 | c, f, g, j, k | procollagen, type I, alpha 1 | procollagen, type I, alpha 1 |

TABLE 2

| SEQ ID | GLGC ID | GenBank Accession No. | Model Code | Pathways |
|---|---|---|---|---|
| 1649 | 20127 | AJ011116 | j, k, n, o | Actions of Nitric Oxide in the Heart, Arginine and proline metabolism, Hypoxia-Inducible Factor in the Cardiovascular System |
| 2037 | 18569 | NM_019212 | f, w, x, hh | Actions of Nitric Oxide in the Heart, Integrin Signaling Pathway |
| 2284 | 25795 | NM_031556 | jj, kk | Actions of Nitric Oxide in the Heart, Integrin Signaling Pathway |
| 2019 | 15975 | NM_019132 | ii | Activation of Csk by cAMP-dependent Protein Kinase Inhibits Signaling through the T Cell Receptor, Activation of cAMP-dependent protein kinase, PKA, Attenuation of GPCR Signaling, CCR3 signaling in Eosinophils, ChREBP regulation |

TABLE 2-continued

| SEQ ID | GLGC ID | GenBank Accession No. | Model Code | Pathways |
|---|---|---|---|---|
| 1835 | 2555 | NM_012967 | a, y, z, kk | by carbohydrates and cAMP, Erk1/Erk2 Mapk Signaling pathway, Phospholipase C-epsilon pathway, Signaling Pathway from G-Protein Families, Transcription factor CREB and its extracellular signals<br>Adhesion Molecules on Lymphocyte, B Lymphocyte Cell Surface Molecules, CTL mediated immune response against target cells, Cells and Molecules involved in local acute inflammatory response, Monocyte and its Surface Molecules, Neutrophil and its Surface Molecules, T Cytotoxic Cell Surface Molecules, T Helper Cell Surface Molecules |
| 1356 | 14989 | AI177366 | f, g, l, m, kk | Adhesion Molecules on Lymphocyte, Cells and Molecules involved in local acute inflammatory response, Erk and PI-3 Kinase Are Necessary for Collagen Binding in Corneal Epithelia, Erk1/Erk2 Mapk Signaling pathway, Integrin Signaling Pathway, Monocyte and its Surface Molecules, PTEN dependent cell cycle arrest and apoptosis, Ras-Independent pathway in NK cell-mediated cytotoxicity |
| 1826 | 1625 | NM_012924 | gg | Adhesion Molecules on Lymphocyte, Monocyte and its Surface Molecules, Neutrophil and Its Surface Molecules |
| 2670 | 25090 | X63594 | j, k | AKT Signaling Pathway, ATM Signaling Pathway, Acetylation and Deacetylation of RelA in The Nucleus, Activation of PKC through G protein coupled receptor, CD40L Signaling Pathway, Double Stranded RNA Induced Gene Expression, Erythropoietin mediated neuroprotection through NF-kB, HIV-I Nef: negative effector of Fas and TNF, Induction of apoptosis through DR3 and DR4/5 Death Receptors, Influence of Ras and Rho proteins on G1 to S Transition, NF-kB Signaling Pathway, Neuropeptides VIP and PACAP inhibit the apoptosis of activated T cells, Signal transduction through IL1R, T Cell Receptor Signaling Pathway, TNF/Stress Related Signaling, TNFR2 Signaling Pathway, The 41BB-dependent immune response, Toll-Like Receptor Pathway, interact6-1 |
| 1918 | 3203 | NM_017039 | c | AKT Signaling Pathway, ChREBP regulation by carbohydrates and cAMP, Erk1/Erk2 Mapk Signaling pathway, Inactivation of Gsk3 by AKT causes accumulation of b-catenin in Alveolar Macrophages, Regulation of ck1/cdk5 by type 1 glutamate receptors, Skeletal muscle hypertrophy is regulated via AKT/mTOR pathway, WNT Signaling Pathway, mTOR Signaling Pathway |
| 815 | 17524 | AI010568 | jj, kk | AKT Signaling Pathway, Growth Hormone Signaling Pathway, Regulation of eIF4e and p70 S6 Kinase |
| 1936 | 10886 | NM_017094 | ii | AKT Signaling Pathway, Growth Hormone Signaling Pathway, Regulation of eIF4e and p70 S6 Kinase |
| 1936 | 10887 | NM_017094 | jj, kk | AKT Signaling Pathway, Growth Hormone Signaling Pathway, Regulation of eIF4e and p70 S6 Kinase |
| 1936 | 10888 | NM_017094 | e, r, hh | AKT Signaling Pathway, Growth Hormone Signaling Pathway, Regulation of eIF4e and p70 S6 Kinase |
| 2082 | 23424 | NM_021680 | j, k | Alanine and aspartate metabolism, Aminoacyl-tRNA biosynthesis |
| 1785 | 1478 | NM_012744 | n, o | Alanine and aspartate metabolism, Citrate cycle (TCA cycle), Pyruvate metabolism |
| 2028 | 7486 | NM_019169 | n, o | Alpha-synuclein and Parkin-mediated proteolysis in Parkinson's disease, Role of Parkin in Ubiquitin-Proteasomal Pathway |
| 143 | 16756 | AA818089 | ll | Aminoacyl-tRNA biosynthesis, Glycine, serine and threonine metabolism |
| 450 | 12031 | AA893860 | y, z | Aminoacyl-tRNA biosynthesis, Glycine, serine and threonine metabolism |
| 1376 | 6502 | AI178283 | r | Aminoacyl-tRNA biosynthesis, Phenylalanine, tyrosine and tryptophan biosynthesis |
| 2426 | 7927 | NM_053765 | d | Aminosugars metabolism |
| 1748 | 619 | NM_012565 | l, m, n, o | Aminosugars metabolism, Erythromycin biosynthesis, Fructose and mannose metabolism, Galactose metabolism, Glycolysis/Gluconeogenesis, Starch and sucrose metabolism |
| 2093 | 17100 | NM_022179 | h, l, w, x, dd | Aminosugars metabolism, Erythromycin biosynthesis, Fructose and mannose metabolism, Galactose metabolism, Glycolysis/Gluconeogenesis, Starch and sucrose metabolism |
| 1771 | 21087 | NM_012661 | cc, dd | Androgen and estrogen metabolism |
| 2195 | 25070 | NM_024392 | r, ii | Androgen and estrogen metabolism |
| 2477 | 15125 | NM_057105 | jj, kk, ll | Androgen and estrogen metabolism, Pentose and glucuronate interconversions, Porphyrin and chlorophyll metabolism, Starch and sucrose metabolism |
| 2510 | 17564 | NM_133283 | hh | Angiotensin II mediated activation of JNK Pathway via Pyk2 dependent signaling, Anthrax Toxin Mechanism of Action, Bioactive Peptide Induced Signaling Pathway, Erk1/Erk2 Mapk Signaling pathway, Integrin Signaling Pathway, Links between |

TABLE 2-continued

| SEQ ID | GLGC ID | GenBank Accession No. | Model Code | Pathways |
|---|---|---|---|---|
| | | | | Pyk2 and Map Kinases, MAPKinase Signaling Pathway, Phosphorylation of MEK1 by cdk5/p35 down regulates the MAP kinase pathway |
| 1924 | 910 | NM_017059 | d | Apoptotic Signaling in Response to DNA Damage, Hypoxia and p53 in the Cardiovascular system, Regulation of BAD phosphorylation, Role of Mitochondria in Apoptotic Signaling, p53 Signaling Pathway |
| 1924 | 911 | NM_017059 | d | Apoptotic Signaling in Response to DNA Damage, Hypoxia and p53 in the Cardiovascular system, Regulation of BAD phosphorylation, Role of Mitochondria in Apoptotic Signaling, p53 Signaling Pathway |
| 1924 | 912 | NM_017059 | d, l, m | Apoptotic Signaling in Response to DNA Damage, Hypoxia and p53 in the Cardiovascular system, Regulation of BAD phosphorylation, Role of Mitochondria in Apoptotic Signaling, p53 Signaling Pathway |
| 602 | 22283 | AA945172 | e | Arginine and proline metabolism |
| 2214 | 15682 | NM_031011 | n, o | Arginine and proline metabolism |
| 2214 | 15683 | NM_031011 | cc, dd, gg | Arginine and proline metabolism |
| 119 | 11901 | AA801058 | d | Arginine and proline metabolism, Ascorbate and aldarate metabolism, Bile acid biosynthesis, Butanoate metabolism, Fatty acid metabolism, Glycerolipid metabolism, Glycolysis/Gluconeogenesis, Histidine metabolism, Lysine degradation, Propanoate metabolism, Pyruvate metabolism, Tryptophan metabolism, Valine, leucine and isoleucine degradation, beta-Alanine metabolism |
| 1988 | 20913 | NM_017272 | n, o | Arginine and proline metabolism, Ascorbate and aldarate metabolism, Bile acid biosynthesis, Butanoate metabolism, Fatty acid metabolism, Glycerolipid metabolism, Glycolysis/Gluconeogenesis, Histidine metabolism, Lysine degradation, Propanoate metabolism, Pyruvate metabolism, Tryptophan metabolism, Valine, leucine and isoleucine degradation, beta-Alanine metabolism |
| 2118 | 20915 | NM_022407 | kk | Arginine and proline metabolism, Ascorbate and aldarate metabolism, Bile acid biosynthesis, Butanoate metabolism, Fatty acid metabolism, Glycerolipid metabolism, Glycolysis/Gluconeogenesis, Histidine metabolism, Lysine degradation, Propanoate metabolism, Pyruvate metabolism, Tryptophan metabolism, Valine, leucine and isoleucine degradation, beta-Alanine metabolism |
| 2353 | 12299 | NM_032416 | c | Arginine and proline metabolism, Ascorbate and aldarate metabolism, Bile acid biosynthesis, Butanoate metabolism, Fatty acid metabolism, Glycerolipid metabolism, Glycolysis/Gluconeogenesis, Histidine metabolism, Lysine degradation, Propanoate metabolism, Pyruvate metabolism, Tryptophan metabolism, Valine, leucine and isoleucine degradation, beta-Alanine metabolism |
| 1296 | 19118 | AI175281 | hh | Arginine and proline metabolism, Glycine, serine and threonine metabolism, Urea cycle and metabolism of amino groups |
| 1798 | 16947 | NM_012793 | b, u, v, jj, kk | Arginine and proline metabolism, Glycine, serine and threonine metabolism, Urea cycle and metabolism of amino groups |
| 1842 | 19393 | NM_012998 | h, l | Arginine and proline metabolism, Hypoxia-Inducible Factor in the Cardiovascular System |
| 1739 | 4467 | NM_012529 | f, g | Arginine and proline metabolism, Urea cycle and metabolism of amino groups |
| 1739 | 4468 | NM_012529 | g | Arginine and proline metabolism, Urea cycle and metabolism of amino groups |
| 1862 | 13283 | NM_013078 | b | Arginine and proline metabolism, Urea cycle and metabolism of amino groups |
| 2128 | 4242 | NM_022521 | b, l, m | Arginine and proline metabolism, Urea cycle and metabolism of amino groups |
| 2089 | 22351 | NM_021835 | ee, ff | ATM Signaling Pathway, Angiotensin II mediated activation of JNK Pathway via Pyk2 dependent signaling, BCR Signaling Pathway, D4-GDI Signaling Pathway, EGF Signaling Pathway, EPO Signaling Pathway, FAS signaling pathway (CD95), Fc Epsilon Receptor I Signaling in Mast Cells, Hypoxia-Inducible Factor in the Cardiovascular System, IGF-1 Signaling Pathway, IL 2 signaling pathway, IL 6 signaling pathway, Inhibition of Cellular Proliferation by Gleevec, Insulin Signaling Pathway, Integrin Signaling Pathway, Links between Pyk2 and Map Kinases, MAPKinase Signaling Pathway, Nerve growth factor pathway (NGF), PDGF Signaling Pathway, Pertussis toxin-insensitive CCR5 Signaling in Macrophage, Repression of Pain Sensation by the Transcriptional Regulator DREAM, Signal transduction through IL1R, Signaling Pathway from G-Protein Families, T Cell Receptor Signaling Pathway, TNF/Stress |

TABLE 2-continued

| SEQ ID | GLGC ID | GenBank Accession No. | Model Code | Pathways |
|---|---|---|---|---|
| 2173 | 352 | NM_024127 | p, q | Related Signaling, TNFR1 Signaling Pathway, TPO Signaling Pathway, TSP-1 Induced Apoptosis in Microvascular Endothelial Cell, The 41BB-dependent immune response, Toll-ATM Signaling Pathway, Cell Cycle: G2/M Checkpoint, Hypoxia and p53 in the Cardiovascular system, p53 Signaling Pathway |
| 2173 | 353 | NM_024127 | q, ee, ff, gg | ATM Signaling Pathway, Cell Cycle: G2/M Checkpoint, Hypoxia and p53 in the Cardiovascular system, p53 Signaling Pathway |
| 2173 | 354 | NM_024127 | p, q, ee, ff | ATM Signaling Pathway, Cell Cycle: G2/M Checkpoint, Hypoxia and p53 in the Cardiovascular system, p53 Signaling Pathway |
| 1205 | 17914 | AI169159 | hh | ATP Synthesis, Oxidative phosphorylation |
| 1209 | 22661 | AI169265 | gg | ATP Synthesis, Oxidative phosphorylation |
| 2000 | 16844 | NM_017311 | n, o | ATP Synthesis, Oxidative phosphorylation |
| 2327 | 16178 | NM_031785 | f | ATP Synthesis, Oxidative phosphorylation |
| 2448 | 20939 | NM_053884 | gg | ATP Synthesis, Oxidative phosphorylation |
| 2566 | 17203 | NM_139099 | g, hh | ATP Synthesis, Oxidative phosphorylation |
| 2566 | 17204 | NM_139099 | g | ATP Synthesis, Oxidative phosphorylation |
| 1319 | 10182 | AI176185 | p, q, gg | BCR Signaling Pathway, EGF Signaling Pathway, EPO Signaling Pathway, Fc Epsilon Receptor I Signaling in Mast Cells, IGF-1 Signaling Pathway, IL 2 signaling pathway, IL 3 signaling pathway, IL 6 signaling pathway, IL-2 Receptor B Protein Interaction Pathway, Inhibition of Cellular Proliferation by Gleevec, Insulin Signaling Pathway, Nerve growth factor pathway (NGF), PDGF Signaling Pathway, Pertussis toxin-insensitive CCR5 Signaling in Macrophage, Repression of Pain Sensation by the Transcriptional Regulator DREAM, Signaling Pathway from G-Protein Families, T Cell Receptor Signaling Pathway, TPO Signaling Pathway, TSP-1 Induced Apoptosis in Microvascular Endothelial Cell, Toll-Like Receptor Pathway, egf, epo, igf-1, il2, il3, il6, insulin, ngf, pdgf, tpo |
| 2641 | 10181 | X06769 | p, q | BCR Signaling Pathway, EGF Signaling Pathway, EPO Signaling Pathway, Fc Epsilon Receptor I Signaling in Mast Cells, IGF-1 Signaling Pathway, IL 2 signaling pathway, IL 3 signaling pathway, IL 6 signaling pathway, IL-2 Receptor B Protein Interaction Pathway, Inhibition of Cellular Proliferation by Gleevec, Insulin Signaling Pathway, Nerve growth factor pathway (NGF), PDGF Signaling Pathway, Pertussis toxin-insensitive CCR5 Signaling in Macrophage, Repression of Pain Sensation by the Transcriptional Regulator DREAM, Signaling Pathway from G-Protein Families, T Cell Receptor Signaling Pathway, TPO Signaling Pathway, TSP-1 Induced Apoptosis in Microvascular Endothelial Cell, Toll-Like Receptor Pathway, egf, epo, igf-1, il2, il3, il6, insulin, ngf, pdgf, tpo |
| 1930 | 18956 | NM_017075 | aa | Benzoate degradation, Bile acid biosynthesis, Butanoate metabolism, Fatty acid biosynthesis (path 2), Fatty acid metabolism, Lysine degradation, Propanoate metabolism, Pyruvate metabolism, Synthesis and degradation of ketone bodies, Tryptophan metabolism |
| 1930 | 18957 | NM_017075 | r, s, t, ll | Benzoate degradation, Bile acid biosynthesis, Butanoate metabolism, Fatty acid biosynthesis (path 2), Fatty acid metabolism, Lysine degradation, Propanoate metabolism, Pyruvate metabolism, Synthesis and degradation of ketone bodies, Tryptophan metabolism |
| 1150 | 23596 | AI105435 | bb | Benzoate degradation, Fatty acid metabolism, Lysine degradation, Tryptophan metabolism |
| 1732 | 23698 | NM_012489 | l | Bile acid biosynthesis, Fatty acid biosynthesis (path 2), Fatty acid metabolism, Valine, leucine and isoleucine degradation |
| 280 | 16074 | AA874874 | p, q | Bile acid biosynthesis, Fatty acid metabolism, Glycerolipid metabolism, Glycolysis/Gluconeogenesis, Methane metabolism, Pyruvate metabolism, Tyrosine metabolism |
| 1781 | 25563 | NM_012732 | f, g | Bile acid biosynthesis, Glycerolipid metabolism |
| 1781 | 16613 | NM_012732 | g | Bile acid biosynthesis, Glycerolipid metabolism |
| 1970 | 13938 | NM_017212 | jj, kk | Bioactive Peptide Induced Signaling Pathway |
| 1970 | 13940 | NM_017212 | a | Bioactive Peptide Induced Signaling Pathway |
| 2276 | 12580 | NM_031514 | a, h, l, j, k, y, z | Bioactive Peptide Induced Signaling Pathway, EPO Signaling Pathway, Erythropoietin mediated neuroprotection through NF-kB, Growth Hormone Signaling Pathway, IFN gamma signaling pathway, IL 3 signaling pathway, IL 6 signaling pathway, IL22 Soluble Receptor Signaling Pathway, Inhibition of Cellular Proliferation by Gleevec, Stat3 Signaling Pathway, TPO Signaling Pathway, epo, ifn_gamma, il3, il6, interact6-1, pdgf, tpo |

TABLE 2-continued

| SEQ ID | GLGC ID | GenBank Accession No. | Model Code | Pathways |
|---|---|---|---|---|
| 2276 | 12581 | NM_031514 | y, z, hh | Bioactive Peptide Induced Signaling Pathway, EPO Signaling Pathway, Erythropoietin mediated neuroprotection through NF-kB, Growth Hormone Signaling Pathway, IFN gamma signaling pathway, IL 3 signaling pathway, IL 6 signaling pathway, IL22 Soluble Receptor Signaling Pathway, Inhibition of Cellular Proliferation by Gleevec, Stat3 Signaling Pathway, TPO Signaling Pathway, epo, ifn_gamma, il3, il6, interact6-1, pdgf, tpo |
| 133 | 23828 | AA817823 | ii | Blood group glycolipid biosynthesis - neolact series, Galactose metabolism, Keratan sulfate biosynthesis, N-Glycans biosynthesis |
| 412 | 11997 | AA892828 | f, h, l | Butanoate metabolism, Glycolysis/Gluconeogenesis, Pyruvate metabolism, Valine, leucine and isoleucine biosynthesis |
| 1313 | 5876 | AI176117 | hh | Butanoate metabolism, Glycolysis/Gluconeogenesis, Pyruvate metabolism, Valine, leucine and isoleucine biosynthesis |
| 2541 | 8692 | NM_134387 | hh | Butanoate metabolism, Pentose and glucuronate interconversions |
| 1987 | 20600 | NM_017268 | ii | Butanoate metabolism, SREBP and controls lipid synthesis, Synthesis and degradation of ketone bodies, Valine, leucine and isoleucine degradation |
| 1987 | 20601 | NM_017268 | r | Butanoate metabolism, SREBP and controls lipid synthesis, Synthesis and degradation of ketone bodies, Valine, leucine and isoleucine degradation |
| 2465 | 17739 | NM_053995 | g | Butanoate metabolism, Synthesis and degradation of ketone bodies |
| 2193 | 2811 | NM_024386 | cc, dd | Butanoate metabolism, Synthesis and degradation of ketone bodies, Valine, leucine and isoleucine degradation |
| 2193 | 2812 | NM_024386 | w, x, cc, dd | Butanoate metabolism, Synthesis and degradation of ketone bodies, Valine, leucine and isoleucine degradation |
| 2193 | 2813 | NM_024386 | b | Butanoate metabolism, Synthesis and degradation of ketone bodies, Valine, leucine and isoleucine degradation |
| 1587 | 18151 | AI237212 | f, g, hh | Calcium Signaling by HBx of Hepatitis B virus |
| 2126 | 162 | NM_022516 | e, u, v | Carbon fixation, Citrate cycle (TCA cycle), Glyoxylate and dicarboxylate metabolism, Pyruvate metabolism, Reductive carboxylate cycle (CO2 fixation) |
| 2365 | 1311 | NM_053291 | e | Carbon fixation, Glycolysis/Gluconeogenesis, Glycolysis Pathway |
| 873 | 20086 | AI013260 | z | Caspase Cascade in Apoptosis, FAS signaling pathway (CD95), HIV-I Nef: negative effector of Fas and TNF, Induction of apoptosis through DR3 and DR4/5 Death Receptors, TNFR1 Signaling Pathway |
| 544 | 5206 | AA925755 | ll | Catabolic Pathways for Arginine, Histidine, Glutamate, Glutamine, and Proline, D-Glutamine and D-glutamate metabolism, Glutamate metabolism, Nitrogen metabolism |
| 1850 | 1338 | NM_013022 | r | CCR3 signaling in Eosinophils |
| 1952 | 15364 | NM_017147 | ii | CCR3 signaling in Eosinophils, Rac 1 cell motility signaling pathway, Rho cell motility signaling pathway |
| 1952 | 15365 | NM_017147 | aa, bb, ll | CCR3 signaling in Eosinophils, Rac 1 cell motility signaling pathway, Rho cell motility signaling pathway |
| 2427 | 15996 | NM_053769 | cc, dd | CD40L Signaling Pathway, Phosphatidylinositol signaling system, TNFR2 Signaling Pathway |
| 1658 | 17264 | D25233 | d | Cell Cycle: G1/S Check Point, Cyclin E Destruction Pathway, Cyclins and Cell Cycle Regulation, E2F1 Destruction Pathway, FAS signaling pathway (CD95), HIV-I Nef: negative effector of Fas and TNF, Influence of Ras and Rho proteins on G1 to S Transition, Overview of telomerase RNA component gene hTerc Transcriptional Regulation, RB Tumor Suppressor/Checkpoint Signaling in response to DNA damage, Regulation of p27 Phosphorylation during Cell Cycle Progression, TNFR1 Signaling Pathway, p53 Signaling Pathway |
| 1657 | 25041 | D14014 | f | Cell Cycle: G1/S Check Point, Cyclins and Cell Cycle Regulation, Inactivation of Gsk3 by AKT causes accumulation of b-catenin in Alveolar Macrophages, Influence of Ras and Rho proteins on G1 to S Transition, WNT Signaling Pathway, p53 Signaling Pathway |
| 2677 | 24232 | X75207 | aa, bb | Cell Cycle: G1/S Check Point, Cyclins and Cell Cycle Regulation, Inactivation of Gsk3 by AKT causes accumulation of b-catenin in Alveolar Macrophages, Influence of Ras and Rho proteins on G1 to S Transition, WNT Signaling Pathway, p53 Signaling Pathway |
| 2079 | 18729 | NM_021578 | r | Cell Cycle: G1/S Check Point, Cytokines and Inflammatory Response, Erythrocyte Differentiation Pathway, Function of SLRP in Bone: An Integrated View, Selective expression of chemokine receptors during T-cell polarization, Signal |

TABLE 2-continued

| SEQ ID | GLGC ID | GenBank Accession No. | Model Code | Pathways |
|---|---|---|---|---|
| 73 | 13683 | AA799788 | e | transduction through IL1R, TGF beta signaling pathway, p38 MAPK Signaling Pathway, tgf-beta<br>Cell Cycle: G2/M Checkpoint, Cyclin E Destruction Pathway, E2F1 Destruction Pathway |
| 1702 | 13682 | L38482 | e | Cell Cycle: G2/M Checkpoint, Cyclin E Destruction Pathway, E2F1 Destruction Pathway |
| 2212 | 21166 | NM_031005 | a, n, o | Cell to Cell Adhesion Signaling, Integrin Signaling Pathway |
| 1755 | 24716 | NM_012589 | j, k, p, q | Cells and Molecules involved in local acute inflammatory response, Cytokine Network, Cytokines and Inflammatory Response, Erythrocyte Differentiation Pathway, IL 17 Signaling Pathway, IL 5 Signaling Pathway, IL 6 signaling pathway, Regulation of hematopoiesis by cytokines, Signal transduction through IL1R, il6, interact6-1 |
| 875 | 6758 | AI013394 | d, jj, kk | Chondroitin/Heparan sulfate biosynthesis |
| 2275 | 17427 | NM_031510 | b, u, v | Citrate cycle (TCA cycle), Glutathione metabolism, Reductive carboxylate cycle (CO2 fixation) |
| 2425 | 18175 | NM_053752 | aa, bb | Citrate cycle (TCA cycle), Propanoate metabolism |
| 2363 | 25072 | NM_052807 | j, k | Control of skeletal myogenesis by HDAC & calcium/calmodulin-dependent kinase (CaMK), Erk1/Erk2 Mapk Signaling pathway, IGF-1 Signaling Pathway, Multiple antiapoptotic pathways from IGF-1R signaling lead to BAD phosphphorylation, Regulation of BAD phosphorylation, Skeletal muscle hypertrophy is regulated via AKT/mTOR pathway, igf-1 |
| 1915 | 17807 | NM_017025 | h, l | Cysteine metabolism, Glycolysis/Gluconeogenesis, Hypoxia-Inducible Factor in the Cardiovascular System, Propanoate metabolism, Pyruvate metabolism |
| 1757 | 7125 | NM_012595 | aa, bb | Cysteine metabolism, Glycolysis/Gluconeogenesis, Propanoate metabolism, Pyruvate metabolism |
| 2017 | 20318 | NM_019127 | n, o | Cytokine Network, Cytokines and Inflammatory Response, Dendritic cells in regulating TH1 and TH2 Development, IFN alpha signaling pathway, Signal transduction through IL1R |
| 872 | 1332 | AI013222 | e | Cytokines and Inflammatory Response, PDGF Signaling Pathway, pdgf |
| 1910 | 8417 | NM_017008 | aa | D-Arginine and D-ornithine metabolism, Glycolysis/Gluconeogenesis, Glycolysis Pathway |
| 1583 | 22939 | AI236669 | y, z, jj, kk | DNA polymerase, Purine metabolism, Pyrimidine metabolism |
| 1951 | 24106 | NM_017141 | s, t, bb | DNA polymerase, Purine metabolism, Pyrimidine metabolism |
| 1951 | 24107 | NM_017141 | ll | DNA polymerase, Purine metabolism, Pyrimidine metabolism |
| 470 | 24329 | AA899253 | aa, bb | Effects of calcinurin in Keratinocyte Differentiation |
| 1784 | 25650 | NM_012736 | d | Electron - Transfer Reaction in Mitochondria, Glycerolipid metabolism |
| 1759 | 2628 | NM_012603 | a, p, q, y, z | Erk1/Erk2 Mapk Signaling pathway, IL-2 Receptor B Protein Interaction Pathway, Inhibition of Cellular Proliferation by Gleevec, Neuropeptides VIP and PACAP inhibit the apoptosis of activated T cells, Overview of telomerase protein component gene hTert Transcriptional Regulation, WNT Signaling Pathway, p38 MAPK Signaling Pathway |
| 1759 | 2629 | NM_012603 | a, j, k, p, q, y, z, ee, ff, kk | Erk1/Erk2 Mapk Signaling pathway, IL-2 Receptor B Protein Interaction Pathway, Inhibition of Cellular Proliferation by Gleevec, Neuropeptides VIP and PACAP inhibit the apoptosis of activated T cells, Overview of telomerase protein component gene hTert Transcriptional Regulation, WNT Signaling Pathway, p38 MAPK Signaling Pathway |
| 1761 | 1298 | NM_012610 | d | Erk1/Erk2 Mapk Signaling pathway, Nerve growth factor pathway (NGF), Phosphorylation of MEK1 by cdk5/p35 down regulates the MAP kinase pathway, ngf |
| 1761 | 1299 | NM_012610 | cc, dd | Erk1/Erk2 Mapk Signaling pathway, Nerve growth factor pathway (NGF), Phosphorylation of MEK1 by cdk5/p35 down regulates the MAP kinase pathway, ngf |
| 1911 | 24676 | NM_017010 | aa, bb | Erythropoietin mediated neuroprotection through NF-kB |
| 2188 | 1146 | NM_024359 | y, z | Erythropoietin mediated neuroprotection through NF-kB, Hypoxia and p53 in the Cardiovascular system, Hypoxia-Inducible Factor in the Cardiovascular System |
| 2004 | 24248 | NM_017332 | e, gg | Fatty acid biosynthesis (path 1) |
| 431 | 20985 | AA893242 | ll | Fatty acid metabolism |
| 431 | 20986 | AA893242 | ll | Fatty acid metabolism |
| 972 | 20983 | AI044900 | a, h, l, ee, ff, kk | Fatty acid metabolism |
| 1652 | 18686 | D00729 | g, hh | Fatty acid metabolism |
| 1668 | 20984 | D90109 | ll | Fatty acid metabolism |
| 1999 | 18687 | NM_017306 | hh | Fatty acid metabolism |
| 2410 | 13005 | NM_053623 | j, k, y, z | Fatty acid metabolism |
| 1896 | 20855 | NM_013200 | a, w, x, hh | Fatty acid metabolism, Glycerolipid metabolism |
| 1896 | 20856 | NM_013200 | a, w, x, aa, hh, ll | Fatty acid metabolism, Glycerolipid metabolism |

TABLE 2-continued

| SEQ ID | GLGC ID | GenBank Accession No. | Model Code | Pathways |
|---|---|---|---|---|
| 1827 | 1977 | NM_012930 | a, w, x, cc, dd | Fatty acid metabolism, Glycerolipid metabolism, Mitochondrial Carnitine Palmitoyltransferase (CPT) System |
| 1708 | 20714 | M14972 | s, t | Fatty acid metabolism, Tryptophan metabolism |
| 1743 | 20704 | NM_012541 | aa, bb | Fatty acid metabolism, Tryptophan metabolism |
| 1831 | 190 | NM_012940 | j, k | Fatty acid metabolism, Tryptophan metabolism |
| 1832 | 20928 | NM_012941 | l, m | Fatty acid metabolism, Tryptophan metabolism |
| 1909 | 20921 | NM_016999 | s, t | Fatty acid metabolism, Tryptophan metabolism |
| 2030 | 1174 | NM_019184 | c | Fatty acid metabolism, Tryptophan metabolism |
| 2281 | 4010 | NM_031543 | u, v | Fatty acid metabolism, Tryptophan metabolism |
| 2281 | 4011 | NM_031543 | v | Fatty acid metabolism, Tryptophan metabolism |
| 2528 | 244 | NM_133551 | a, j, k, y, z, ee, ff, kk | Fc Epsilon Receptor I Signaling in Mast Cells, Glycerolipid metabolism, Phospholipid degradation, Prostaglandin and leukotriene metabolism, p38 MAPK Signaling Pathway |
| 2398 | 19252 | NM_053576 | a | Flavonoids, stilbene and lignin biosynthesis, Methane metabolism, Phenylalanine metabolism |
| 1718 | 21400 | M36410 | ee, ff, gg | Folate biosynthesis |
| 2109 | 13480 | NM_022390 | l | Folate biosynthesis |
| 2187 | 15349 | NM_024356 | a, y, z | Folate biosynthesis |
| 2187 | 15353 | NM_024356 | j, k, y, z, ii | Folate biosynthesis |
| 1858 | 14997 | NM_013059 | e, ee, ff | Folate biosynthesis, Glycerolipid metabolism |
| 1971 | 1527 | NM_017220 | ee, ff | Folate biosynthesis, Nicotinate and nicotinamide metabolism, Purine metabolism, Pyrimidine metabolism |
| 1922 | 20875 | NM_017050 | hh | Free Radical Induced Apoptosis |
| 1922 | 20876 | NM_017050 | r | Free Radical Induced Apoptosis |
| 2202 | 1852 | NM_030826 | aa, gg | Free Radical Induced Apoptosis, Glutathione metabolism |
| 1956 | 21975 | NM_017154 | d, e, j, k, n, o, y, z, kk | Free Radical Induced Apoptosis, Purine metabolism |
| 1923 | 1876 | NM_017052 | w, x | Fructose and mannose metabolism |
| 2060 | 1238 | NM_019333 | gg | Fructose and mannose metabolism |
| 1733 | 15511 | NM_012498 | ii | Fructose and mannose metabolism, Galactose metabolism, Glycerolipid metabolism, Pentose and glucuronate interconversions, Pyruvate metabolism |
| 1701 | 12058 | L25387 | w | Fructose and mannose metabolism, Galactose metabolism, Glycolysis/Gluconeogenesis, Pentose phosphate pathway |
| 1701 | 25377 | L25387 | hh | Fructose and mannose metabolism, Galactose metabolism, Glycolysis/Gluconeogenesis, Pentose phosphate pathway |
| 2320 | 1340 | NM_031715 | jj, kk | Fructose and mannose metabolism, Galactose metabolism, Glycolysis/Gluconeogenesis, Pentose phosphate pathway |
| 2693 | 19694 | Z48444 | cc, dd | Generation of amyloid b-peptide by PS1 |
| 1998 | 14004 | NM_017305 | aa, bb | Glutamate metabolism, Glutathione metabolism |
| 1929 | 11152 | NM_017073 | c, s, t, kk | Glutamate metabolism, Nitrogen metabolism |
| 1929 | 11153 | NM_017073 | y, kk | Glutamate metabolism, Nitrogen metabolism |
| 938 | 7867 | AI043695 | t | Glutamate metabolism, Purine metabolism |
| 658 | 23927 | AA957007 | g | Glutathione metabolism |
| 1799 | 961 | NM_012796 | g | Glutathione metabolism |
| 1912 | 21013 | NM_017014 | b | Glutathione metabolism |
| 1958 | 17686 | NM_017165 | hh | Glutathione metabolism |
| 2131 | 4615 | NM_022525 | cc, dd | Glutathione metabolism |
| 2265 | 20862 | NM_031154 | w, x | Glutathione metabolism |
| 2274 | 25525 | NM_031509 | b, r | Glutathione metabolism |
| 2274 | 634 | NM_031509 | d, r | Glutathione metabolism |
| 2274 | 635 | NM_031509 | d, r | Glutathione metabolism |
| 2639 | 20818 | X02904 | ii | Glutathione metabolism |
| 2669 | 16780 | X62660 | c, f, g | Glutathione metabolism |
| 1885 | 200 | NM_013161 | b, l, m | Glycerolipid metabolism |
| 1989 | 20281 | NM_017274 | gg | Glycerolipid metabolism |
| 2380 | 14621 | NM_053437 | e, hh | Glycerolipid metabolism |
| 2260 | 1638 | NM_031143 | d, e, ii, kk | Glycerolipid metabolism, Phosphatidylinositol signaling system |
| 1962 | 9378 | NM_017174 | jj, kk | Glycerolipid metabolism, Phospholipid degradation, Prostaglandin and leukotriene metabolism |
| 1758 | 18386 | NM_012598 | w, x | Glycerolipid metabolism, Visceral Fat Deposits and the Metabolic Syndrome |
| 1758 | 18387 | NM_012598 | w, x | Glycerolipid metabolism, Visceral Fat Deposits and the Metabolic Syndrome |
| 1844 | 24718 | NM_013003 | ii | Glycine, serine and threonine metabolism |
| 1894 | 16448 | NM_013197 | b, c, v | Glycine, serine and threonine metabolism |
| 2003 | 24533 | NM_017328 | n, o | Glycolysis/Gluconeogenesis |
| 2343 | 24644 | NM_031972 | cc, dd | Glycolysis/Gluconeogenesis, Histidine metabolism, Phenylalanine metabolism, Tyrosine metabolism |
| 1913 | 17815 | NM_017015 | w, x | Glycosaminoglycan degradation, Porphyrin and chlorophyll metabolism, Starch and sucrose metabolism |
| 2073 | 574 | NM_019905 | a, h, l, z, aa, kk, ll | Glyoxylate and dicarboxylate metabolism |
| 1726 | 5733 | M81855 | d | Hypoxia and p53 in the Cardiovascular system |
| 1754 | 15098 | NM_012588 | bb | Hypoxia and p53 in the Cardiovascular system |

TABLE 2-continued

| SEQ ID | GLGC ID | GenBank Accession No. | Model Code | Pathways |
|---|---|---|---|---|
| 2309 | 18403 | NM_031677 | d, jj, kk | Hypoxia and p53 in the Cardiovascular system |
| 2409 | 20243 | NM_053615 | aa, bb | Hypoxia and p53 in the Cardiovascular system, WNT Signaling Pathway |
| 2516 | 657 | NM_133380 | j, k, y, z | IL 4 signaling pathway, Selective expression of chemokine receptors during T-cell polarization, Th1/Th2 Differentiation, il4 |
| 1914 | 6598 | NM_017020 | j, k | IL 6 signaling pathway, il6, interact6-1 |
| 2172 | 21238 | NM_024125 | p, q | IL 6 signaling pathway, il6, interact6-1 |
| 2172 | 21239 | NM_024125 | p, q, r, bb, ee, ff, kk | IL 6 signaling pathway, il6, interact6-1 |
| 1939 | 4391 | NM_017101 | s, t | IL-2 Receptor B Protein Interaction Pathway |
| 1749 | 482 | NM_012567 | s, t | Inactivation of Gsk3 by AKT causes accumulation of b-catenin in Alveolar Macrophages |
| 778 | 3278 | AI008988 | y, z | Inhibition of Cellular Proliferation by Gleevec, Integrin Signaling Pathway |
| 2092 | 243 | NM_021989 | h, l, n, o, ll | Inhibition of Matrix Metalloproteinases |
| 229 | 17236 | AA858903 | s, t, gg | Inhibition of Matrix Metalloproteinases, p53 Signaling Pathway |
| 512 | 17231 | AA924107 | ii | Inhibition of Matrix Metalloproteinases, p53 Signaling Pathway |
| 697 | 17232 | AA965161 | ll | Inhibition of Matrix Metalloproteinases, p53 Signaling Pathway |
| 1891 | 1714 | NM_013187 | a, kk | Inositol phosphate metabolism, Phosphatidylinositol signaling system |
| 2186 | 20933 | NM_024353 | h, l | Inositol phosphate metabolism, Phosphatidylinositol signaling system |
| 2352 | 1171 | NM_032071 | y, z | Inositol phosphate metabolism, Phosphatidylinositol signaling system |
| 260 | 23336 | AA859981 | ee, ff, jj, kk | Inositol phosphate metabolism, Phosphatidylinositol signaling system, Streptomycin biosynthesis |
| 2024 | 20863 | NM_019152 | cc, dd | Integrin Signaling Pathway |
| 2620 | 25593 | U26310 | gg | Integrin Signaling Pathway |
| 1983 | 1496 | NM_017255 | aa, bb | Ion Channel and Phorbal Esters Signaling Pathway |
| 1738 | 15741 | NM_012520 | ll | Methane metabolism, Tryptophan metabolism |
| 1967 | 20779 | NM_017201 | b, l, m | Methionine metabolism, Selenoamino acid metabolism |
| 2277 | 20448 | NM_031530 | a, d, z, ee, ff, jj, kk | Msp/Ron Receptor Signaling Pathway, Pertussis toxin-insensitive CCR5 Signaling in Macrophage |
| 2277 | 20449 | NM_031530 | a, z, ee, ff, kk | Msp/Ron Receptor Signaling Pathway, Pertussis toxin-insensitive CCR5 Signaling in Macrophage |
| 1318 | 6782 | AI176170 | e | mTOR Signaling Pathway |
| 1945 | 24522 | NM_017130 | u, v | N-Glycan degradation, Sphingoglycolipid metabolism |
| 2314 | 21575 | NM_031698 | w, x | N-Glycans biosynthesis |
| 1874 | 2005 | NM_013127 | e, bb | Nicotinate and nicotinamide metabolism |
| 2056 | 15056 | NM_019291 | b, c | Nitrogen metabolism |
| 2267 | 18596 | NM_031325 | u, v | Nucleotide sugars metabolism, Pentose and glucuronate interconversions, Starch and sucrose metabolism |
| 2267 | 18597 | NM_031325 | a, j, k, p, q, y, z, ee, ff | Nucleotide sugars metabolism, Pentose and glucuronate interconversions, Starch and sucrose metabolism |
| 299 | 4339 | AA875121 | jj, kk | Overview of telomerase RNA component gene hTerc Transcriptional Regulation |
| 1810 | 4338 | NM_012866 | u, v | Overview of telomerase RNA component gene hTerc Transcriptional Regulation |
| 1138 | 23574 | AI104520 | hh | Oxidative phosphorylation |
| 1712 | 15049 | M24542 | aa, bb | Oxidative phosphorylation |
| 1795 | 449 | NM_012786 | hh | Oxidative phosphorylation |
| 1795 | 450 | NM_012786 | f, hh | Oxidative phosphorylation |
| 1968 | 14694 | NM_017202 | aa | Oxidative phosphorylation |
| 2383 | 21866 | NM_053472 | u, v | Oxidative phosphorylation |
| 2041 | 20938 | NM_019223 | hh | Oxidative phosphorylation, Ubiquinone biosynthesis |
| 2107 | 11454 | NM_022381 | d, l, m, n, o, s, t | p53 Signaling Pathway |
| 2107 | 11455 | NM_022381 | s | p53 Signaling Pathway |
| 495 | 23038 | AA900881 | a, j, k, y, z | Pantothenate and CoA biosynthesis, Valine, leucine and isoleucine biosynthesis, Valine, leucine and isoleucine degradation |
| 2117 | 24643 | NM_022400 | b, u, v | Pantothenate and CoA biosynthesis, Valine, leucine and isoleucine biosynthesis, Valine, leucine and isoleucine degradation |
| 269 | 17742 | AA866302 | c | Phenylalanine metabolism, Tyrosine metabolism |
| 1468 | 14430 | AI230798 | r | Phosphatidylinositol signaling system |
| 1767 | 1841 | NM_012637 | d, jj, kk | Phosphatidylinositol signaling system |
| 1767 | 1844 | NM_012637 | p, q, y, z | Phosphatidylinositol signaling system |
| 2021 | 14973 | NM_019140 | aa | Phosphatidylinositol signaling system |
| 1906 | 64 | NM_016991 | jj, kk | Phospholipase C d1 in phospholipid associated cell signaling |
| 1746 | 23868 | NM_012551 | a, h, l, p, q, y, z, ee, ff | Phosphorylation of MEK1 by cdk5/p35 down regulates the MAP kinase pathway |
| 1746 | 23869 | NM_012551 | a, h, l, p, q, y, z | Phosphorylation of MEK1 by cdk5/p35 down regulates the MAP kinase pathway |

TABLE 2-continued

| SEQ ID | GLGC ID | GenBank Accession No. | Model Code | Pathways |
|---|---|---|---|---|
| 1746 | 23871 | NM_012551 | p, q, y, z, ii | Phosphorylation of MEK1 by cdk5/35 down regulates the MAP kinase pathway |
| 1746 | 23872 | NM_012551 | p, q, y, z | Phosphorylation of MEK1 by cdk5/p35 down regulates the MAP kinase pathway |
| 1402 | 16081 | AI179610 | a, p, q, r, y, z, gg, kk | Porphyrin and chlorophyll metabolism |
| 1741 | 16520 | NM_012532 | c | Porphyrin and chlorophyll metabolism |
| 1751 | 16080 | NM_012580 | p, q, y, z, kk | Porphyrin and chlorophyll metabolism |
| 2688 | 19279 | Y00350 | a, aa, bb, jj, kk | Porphyrin and chlorophyll metabolism |
| 1976 | 20193 | NM_017232 | p, q | Prostaglandin and leukotriene metabolism |
| 2029 | 17063 | NM_019170 | f, g | Prostaglandin and leukotriene metabolism |
| 2029 | 17064 | NM_019170 | f, g | Prostaglandin and leukotriene metabolism |
| 2029 | 17066 | NM_019170 | g | Prostaglandin and leukotriene metabolism |
| 2213 | 25517 | NM_031010 | c, v | Prostaglandin and leukotriene metabolism |
| 2213 | 1845 | NM_031010 | c, v | Prostaglandin and leukotriene metabolism |
| 2285 | 692 | NM_031557 | s, t, ll | Prostaglandin and leukotriene metabolism |
| 190 | 18673 | AA849028 | t | Proteasome |
| 1662 | 9029 | D30804 | hh | Proteasome |
| 1777 | 4003 | NM_012708 | e | Proteasome |
| 1991 | 15142 | NM_017278 | l, m | Proteasome |
| 1992 | 15538 | NM_017283 | r | Proteasome |
| 2297 | 11296 | NM_031606 | f | PTEN dependent cell cycle arrest and apoptosis, Phosphatidylinositol signaling system, Regulation of eIF4e and p70 S6 Kinase, mTOR Signaling Pathway |
| 63 | 14250 | AA799729 | j, k | Purine metabolism |
| 1450 | 23042 | AI230130 | s, t, ii | Purine metabolism |
| 1762 | 638 | NM_012613 | aa, bb | Purine metabolism |
| 1816 | 16708 | NM_012895 | u, v | Purine metabolism |
| 1916 | 14247 | NM_017031 | h, l | Purine metabolism |
| 2053 | 8200 | NM_019285 | ll | Purine metabolism |
| 2229 | 79 | NM_031079 | y, z, ee, ff | Purine metabolism |
| 2325 | 14184 | NM_031776 | kk | Purine metabolism |
| 2325 | 14185 | NM_031776 | kk | Purine metabolism |
| 2299 | 24234 | NM_031614 | r, y, z, jj, kk | Pyrimidine metabolism |
| 2299 | 24235 | NM_031614 | y, z, kk | Pyrimidine metabolism |
| 2404 | 20896 | NM_053592 | h, l | Pyrimidine metabolism |
| 2351 | 21807 | NM_032067 | gg | Rac 1 cell motility signaling pathway, Ras Signaling Pathway |
| 2351 | 21809 | NM_032067 | ll | Rac 1 cell motility signaling pathway, Ras Signaling Pathway |
| 1423 | 22845 | AI227887 | e, aa, bb | Ras Signaling Pathway, Role of PI3K subunit p85 in regulation of Actin Organization and Cell Migration, p38 MAPK Signaling Pathway |
| 630 | 22771 | AA946432 | b, l, m | Regulation of ck1/cdk5 by type 1 glutamate receptors |
| 2075 | 18713 | NM_020075 | p, q, s, t | Regulation of eIF2 |
| 2075 | 18715 | NM_020075 | ee, ff | Regulation of eIF2 |
| 2208 | 1928 | NM_030872 | s, t | Regulation of eIF4e and p70 S6 Kinase |
| 2208 | 1929 | NM_030872 | hh | Regulation of eIF4e and p70 S6 Kinase |
| 1206 | 23152 | AI169170 | r | Regulation of eIF4e and p70 S6 Kinase, mTOR Signaling Pathway |
| 1957 | 17104 | NM_017160 | h, l | Skeletal muscle hypertrophy is regulated via AKT/mTOR pathway, mTOR Signaling Pathway |
| 1957 | 17105 | NM_017160 | h, l | Skeletal muscle hypertrophy is regulated via AKT/mTOR pathway, mTOR Signaling Pathway |
| 1957 | 17106 | NM_017160 | n, o | Skeletal muscle hypertrophy is regulated via AKT/mTOR pathway, mTOR Signaling Pathway |
| 1933 | 22552 | NM_017087 | n, o | Small Leucine-rich Proteoglycan (SLRP) molecules |
| 2691 | 18352 | Z12298 | aa, bb | Small Leucine-rich Proteoglycan (SLRP) molecules |
| 1236 | 15393 | AI170663 | cc, dd | SREBP and controls lipid synthesis |
| 92 | 4832 | AA800190 | a, e, ii, kk | Starch and sucrose metabolism |
| 1232 | 11585 | AI170502 | r | Starch and sucrose metabolism |
| 2595 | 4834 | NM_153821 | h, l | Starch and sucrose metabolism |
| 1948 | 16681 | NM_017136 | ii | Sterol biosynthesis, Terpenoid biosynthesis |
| 2251 | 14970 | NM_031127 | a, h, l, n, o | Sulfur metabolism |
| 2336 | 4748 | NM_031834 | s, t, aa, bb | Sulfur metabolism |
| 2336 | 4749 | NM_031834 | t, bb | Sulfur metabolism |
| 1806 | 17541 | NM_012844 | c, d | Tetrachloroethene degradation |
| 2162 | 2006 | NM_022936 | aa | Tetrachloroethene degradation |
| 2162 | 2008 | NM_022936 | w, x, aa, bb | Tetrachloroethene degradation |
| 2033 | 15244 | NM_019191 | ll | TGF beta signaling pathway, tgf-beta |
| 2286 | 18315 | NM_031561 | e, u | TSP-1 Induced Apoptosis in Microvascular Endothelial Cell |
| 2286 | 18316 | NM_031561 | e | TSP-1 Induced Apoptosis in Microvascular Endothelial Cell |
| 2286 | 18317 | NM_031561 | r, aa, bb, ii | TSP-1 Induced Apoptosis in Microvascular Endothelial Cell |
| 2286 | 18319 | NM_031561 | w, x | TSP-1 Induced Apoptosis in Microvascular Endothelial Cell |
| 1740 | 11115 | NM_012531 | f, g | Tyrosine metabolism |
| 1740 | 11116 | NM_012531 | f, g | Tyrosine metabolism |

TABLE 2-continued

| SEQ ID | GLGC ID | GenBank Accession No. | Model Code | Pathways |
|---|---|---|---|---|
| 889 | 21950 | AI013861 | a, h, l | Valine, leucine and isoleucine degradation |
| 1688 | 17285 | J02827 | c | Valine, leucine and isoleucine degradation |
| 1756 | 4450 | NM_012592 | c | Valine, leucine and isoleucine degradation |
| 2577 | 13712 | NM_144744 | ii | Visceral Fat Deposits and the Metabolic Syndrome |
| 2035 | 18572 | NM_019201 | n, o | WNT Signaling Pathway |
| 2035 | 18573 | NM_019201 | f, g | WNT Signaling Pathway |

TABLE 3

| SEQ ID | GLGC ID | GenBank Accession No. | Model Code | Human Homologous Known Gene Name | Human Homologous Sequence Cluster Title |
|---|---|---|---|---|---|
| 2486 | 15408 | NM_057197 | f, g, l, m | 2,4-dienoyl CoA reductase 1, mitochondrial | 2,4-dienoyl CoA reductase 1, mitochondrial |
| 2486 | 15409 | NM_057197 | f, g | 2,4-dienoyl CoA reductase 1, mitochondrial | 2,4-dienoyl CoA reductase 1, mitochondrial |
| 1987 | 20600 | NM_017268 | ii | 3-hydroxy-3-methylglutaryl-Coenzyme A synthase 1, 3-hydroxy-3-methylglutaryl-Coenzyme A synthase 1 (soluble) | 3-hydroxy-3-methylglutaryl-Coenzyme A synthase 1 (soluble), 3-hydroxy-3-methylglutaryl-Coenzyme A synthase 2, pre B-cell leukemia transcription factor 1 |
| 1987 | 20601 | NM_017268 | r | 3-hydroxy-3-methylglutaryl-Coenzyme A synthase 1, 3-hydroxy-3-methylglutaryl-Coenzyme A synthase 1 (soluble) | 3-hydroxy-3-methylglutaryl-Coenzyme A synthase 1 (soluble), 3-hydroxy-3-methylglutaryl-Coenzyme A synthase 2, pre B-cell leukemia transcription factor 1 |
| 269 | 17742 | AA866302 | c | 4-hydroxyphenylpyruvate dioxygenase, 4-hydroxyphenylpyruvic acid dioxygenase | 4-hydroxyphenylpyruvate dioxygenase, 4 hydroxyphenylpyruvic acid dioxygenase |
| 1753 | 20313 | NM_012585 | b, u, v | 5-hydroxytryptamine (serotonin) receptor 1A | 5-hydroxytryptamine (serotonin) receptor 1A |
| 1878 | 786 | NM_013148 | n, o | 5-hydroxytryptamine (serotonin) receptor 5A | |
| 2189 | 767 | NM_024365 | b, c | 5-hydroxytryptamine (serotonin) receptor 6 | 5-hydroxytryptamine (serotonin) receptor 6 |
| 1971 | 1527 | NM_017220 | ee, ff | 6-pyruvoyl-tetrahydropterin synthase, 6-pyruvoyltetrahydropterin synthase | 6-pyruvoyl-tetrahydropterin synthase, 6-pyruvoyltetrahydropterin synthase, ESTs, Weakly similar to JC1405 6-pyruvoyltetrahydropterin synthase [*H. sapiens*], ESTs, Weakly similar to PTPS RAT 6-PYRUVOYL TETRAHYDROBIOPTERIN SYNTHASE PRECURSOR [*R. norvegicus*] |
| 1727 | 21882 | M83740 | l, m | 6-pyruvoyl-tetrahydropterin synthase/dimerization cofactor of hepatocyte nuclear factor 1 alpha (TCF1) | |
| 2693 | 19694 | Z48444 | cc, dd | a disintegrin and metalloprotease domain 10, a disintegrin and metalloproteinase domain 10 | ESTs, Moderately similar to PC4265 disintegrin and metalloproteinase 10 [*H. sapiens*], Homo sapiens cDNA FLJ13398 fis, clone PLACE1001377, highly similar to Homo sapiens ADAM10 (ADAM10) mRNA, RIKEN cDNA 1700031C13 gene, a disintegrin and metalloprotease domain 10, a disintegrin and metalloproteinase domain 10 |
| 2196 | 22626 | NM_024400 | kk | a disintegrin-like and metalloprotease (reprolysin type) with thrombospondin type 1 motif, 1 | ESTs, Highly similar to ATS8_MOUSE ADAM-TS 8 PRECURSOR (A DISINTEGRIN AND METALLOPROTEINASE WITH THROMBOSPONDIN MOTIFS 8) (ADAMTS-8) (ADAM-TS8) (METH-2) [*M. musculus*], ESTs, Weakly similar to ATS1_MOUSE ADAM-TS 1 PRECURSOR (A DISINTEGRIN AND METALLOPROTEINASE WITH THROMBOSPONDIN MOTIFS 1) (ADAMTS-1) (ADAM-TS1) [*M. musculus*], ESTs, Weakly similar to T47158 hypothetical protein DKFZp762C1110.1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | [H. sapiens], Mus musculus, Similar to a disintegrin and metalloproteinase with thrombospondin motifs 1 (ADAMTS-1), clone IMAGE:3491991, mRNA, partial cds, Mus musculus, Similar to a disintegrin-like and metalloprotease (reprolysin type) with thrombospondin type 1 motif, 4, clone MGC:38401 IMAGE:5345809, mRNA, complete cds, a disintegrin-like and metalloprotease (reprolysin type) with thrombospondin type 1 motif, 1, a disintegrin-like and metalloprotease (reprolysin type) with thrombospondin type 1 motif, 8 |
| 2475 | 19658 | NM_057103 | gg | A kinase (PRKA) anchor protein (gravin) 12 | A kinase (PRKA) anchor protein (gravin) 12, ESTs, Highly similar to gravin [H. sapiens] |
| 2630 | 2153 | U75404 | u, v | A kinase (PRKA) anchor protein (gravin) 12 | A kinase (PRKA) anchor protein (gravin) 12, ESTs, Highly similar to gravin [H. sapiens] |
| 1930 | 18956 | NM_017075 | aa | acetyl-Coenzyme A acetyltransferase 1, acetyl-Coenzyme A acetyltransferase 1 (acetoacetyl Coenzyme A thiolase) | Homo sapiens, Similar to acetyl-Coenzyme A acetyltransferase 1 (acetoacetyl Coenzyme A thiolase), clone MGC:13582 IMAGE:4278329, mRNA, complete cds, Mus musculus, Similar to Acetyl-Co A acetyltransferase 1, mitochondrial, clone MGC:39067 IMAGE:5365469, mRNA, complete cds, acetyl-Coenzyme A acetyltransferase 1 (acetoacetyl Coenzyme A thiolase), acetyl-Coenzyme A acyltransferase (peroxisomal 3-oxoacyl-Coenzyme A thiolase) |
| 1930 | 18957 | NM_017075 | r, s, t, ll | acetyl-Coenzyme A acetyltransferase 1, acetyl-Coenzyme A acetyltransferase 1 (acetoacetyl Coenzyme A thiolase) | Homo sapiens, Similar to acetyl-Coenzyme A acetyltransferase 1 (acetoacetyl Coenzyme A thiolase), clone MGC:13582 IMAGE:4278329, mRNA, complete cds, Mus musculus, Similar to Acetyl-Co A acetyltransferase 1, mitochondrial, clone MGC:39067 IMAGE:5365469, mRNA, complete cds, acetyl-Coenzyme A acetyltransferase 1 (acetoacetyl Coenzyme A thiolase), acetyl-Coenzyme A acyltransferase (peroxisomal 3-oxoacyl-Coenzyme A thiolase) |
| 1732 | 23698 | NM_012489 | l | acetyl-Coenzyme A acyltransferase (peroxisomal 3-oxoacyl-Coenzyme A thiolase), acetyl-Coenzyme A acyltransferase 1 (peroxisomal 3-oxoacyl-Coenzyme A thiolase) | Mus musculus, Similar to Acetyl-Co A acetyltransferase 1, mitochondrial, clone MGC:39067 IMAGE:5365469, mRNA, complete cds, acetyl-Coenzyme A acyltransferase (peroxisomal 3-oxoacyl-Coenzyme A thiolase), acetyl-Coenzyme A acyltransferase 1 (peroxisomal 3-oxoacyl-Coenzyme A thiolase) |
| 2037 | 18569 | NM_019212 | f, w, x, hh | actin, alpha 1, skeletal muscle | BRG1/brm-associated factor 53A, Rat messenger RNA for alpha-actin, actin, alpha 1, skeletal muscle, actin-like 6, expressed sequence AA959943 |
| 275 | 16001 | AA866452 | bb, cc, dd | actin, alpha, cardiac, actin, alpha, cardiac muscle | ESTs, Weakly similar to ACTA_HUMAN Actin, aortic smooth muscle (Alpha-actin 2) [R. norvegicus], Homo sapiens, clone MGC:33407 IMAGE:4824606, mRNA, complete cds, actin, alpha 2, smooth muscle, aorta, smooth muscle alpha-actin |
| 2212 | 21166 | NM_031005 | a, n, o | actinin, alpha 1 | ESTs, Weakly similar to alpha actinin 4 [Mus musculus] [M. musculus], RIKEN cDNA 3110023F10 gene, actinin alpha 2, actinin alpha 3, actinin, alpha 1, actinin, alpha 2, actinin, alpha 3, alpha actinin 4 |
| 2307 | 5358 | NM_031675 | r | actinin, alpha 4, alpha actinin 4 | ESTs, Weakly similar to alpha actinin 4 [Mus musculus] [M. musculus], RIKEN cDNA 3110023F10 gene, actinin, alpha 4, alpha actinin 4 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1821 | 24431 | NM_012912 | a, p, q, y, z, ee, ff | activating transcription factor 3 | ESTs, Weakly similar to A39382 liver regeneration factor LRF1 - rat [*R. norvegicus*], ESTs, Weakly similar to A54025 transcription factor ATF3 [*H. sapiens*], activating transcription factor 3 |
| 1864 | 20242 | NM_013084 | gg | acyl-Coenzyme A dehydrogenase, short/branched chain | acyl-Coenzyme A dehydrogenase, short/branched chain |
| 903 | 17957 | AI028975 | s, t | adaptor protein complex AP-1, beta 1 subunit, adaptor-related protein complex 1, beta 1 subunit | adaptor protein complex AP-1, beta 1 subunit, adaptor-related protein complex 1, beta 1 subunit |
| 1990 | 17959 | NM_017277 | s, t | adaptor protein complex AP-1, beta 1 subunit, adaptor-related protein complex 1, beta 1 subunit | adaptor protein complex AP-1, beta 1 subunit, adaptor-related protein complex 1, beta 1 subunit |
| 2495 | 17958 | NM_080583 | gg | adaptor-related protein complex 2, beta 1 subunit | adaptor protein complex AP-1, beta 1 subunit, adaptor-related protein complex 2, beta 1 subunit |
| 2495 | 17960 | NM_080583 | r | adaptor-related protein complex 2, beta 1 subunit | adaptor protein complex AP-1, beta 1 subunit, adaptor-related protein complex 2, beta 1 subunit |
| 2366 | 1596 | NM_053294 | r | adenosine A2a receptor | adenosine A2a receptor, adenosine A3 receptor |
| 1816 | 16708 | NM_012895 | u, v | adenosine kinase | adenosine kinase, expressed sequence AI987814 |
| 2053 | 8200 | NM_019285 | ll | adenylate cyclase 4 | ESTs, Moderately similar to A41542 adenylate cyclase (EC 4.6.1.1) IV - rat [*R. norvegicus*], adenylate cyclase 2 (brain), adenylate cyclase 4 |
| 2521 | 24775 | NM_133511 | c | adenylate cyclase activating polypeptide 1 (pituitary) receptor type I, adenylate cyclase activating polypeptide 1 receptor 1 | ESTs, Weakly similar to PACR MOUSE PITUITARY ADENYLATE CYCLASE ACTIVATING POLYPEPTIDE TYPE I RECEPTOR PRECURSOR [*M. musculus*], adenylate cyclase activating polypeptide 1 (pituitary) receptor type I, adenylate cyclase activating polypeptide 1 receptor 1 |
| 1905 | 17972 | NM_016989 | l, m | adenylate cyclase activating polypeptide 1, adenylate cyclase activating polypeptide 1 (pituitary) | adenylate cyclase activating polypeptide 1, adenylate cyclase activating polypeptide 1 (pituitary) |
| 2577 | 13712 | NM_144744 | ii | adipose most abundant gene transcript 1 | ESTs, Highly similar to 1917150A collagen:SUBUNIT = alpha1:ISOTYPE = VI II [*Rattus norvegicus*] [*R. norvegicus*], ESTs, Moderately similar to CA18 MOUSE COLLAGEN ALPHA 1(VIII) CHAIN PRECURSOR [*M. musculus*], ESTs, Weakly similar to ACR3 MOUSE 30 KD ADIPOCYTE COMPLEMENT-RELATED PROTEIN PRECURSOR [*M. musculus*], *Mus musculus*, Similar to DKFZP586B0621 protein, clone MGC:38635 IMAGE:5355789, mRNA, complete cds, RIKEN cDNA 5530401N20 gene, adipose most abundant gene transcript 1, collagen, type VIII, alpha 1, procollagen, type VIII, alpha 1 |
| 1728 | 3762 | M86341 | s, t | ADP-ribosylarginine hydrolase | ADP-ribosylarginine hydrolase, ESTs, Weakly similar to ADP-RIBOSYLARGININE HYDROLASE [*M. musculus*] |
| 2032 | 24019 | NM_019186 | j, k | ADP-ribosylation factor-like 4, ADP-ribosylation-like 4 | ADP-ribosylation factor 4-like, ADP-ribosylation factor-like 7, ADP-ribosylation-like 4, ESTs, Weakly similar to ADP-ribosylation-like 4 [*Mus musculus*] [*M. musculus*], *Mus musculus*, Similar to ADP-ribosylation-like 4, clone MGC:5774 IMAGE:3599701, mRNA, complete cds, RIKEN cDNA 1110036H21 gene, epithelial protein lost in neoplasm beta |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 735 | 3505 | AA998430 | w, x | adrenergic receptor kinase, beta 1, adrenergic, beta, receptor kinase 1 | ESTs, Weakly similar to GRK6 MOUSE G PROTEIN-COUPLED RECEPTOR KINASE GRK6 [*M. musculus*], G protein-coupled receptor kinase 6, adrenergic receptor kinase, beta 1, adrenergic, beta, receptor kinase 1 |
| 1906 | 64 | NM_016991 | jj, kk | adrenergic receptor, alpha 1b, adrenergic, alpha-1B-, receptor | |
| 1778 | 322 | NM_012715 | d, gg | adrenomedullin | adrenomedullin |
| 1725 | 10743 | M64780 | r, jj, kk | agrin | ESTs, Weakly similar to A38096 perlecan precursor [*H. sapiens*], ESTs, Weakly similar to AGRT agrin - rat [*R. norvegicus*], ESTs, Weakly similar to BASEMENT MEMBRANE-SPECIFIC HEPARAN SULFATE PROTEOGLYCAN CORE PROTEIN PRECURSOR [*M. musculus*], ESTs, Weakly similar to PGBM_HUMAN BASEMENT MEMBRANE-SPECIFIC HEPARAN SULFATE PROTEOGLYCAN CORE PROTEIN PRECURSOR [*H. sapiens*], Mus musculus, clone IMAGE:3494258, mRNA, partial cds, heparan sulfate proteoglycan 2 (perlecan), perlecan (heparan sulfate proteoglycan 2), serine protease inhibitor, Kazal type, 5, sialoadhesin, transmembrane protein with EGF-like and two follistatin-like domains 1 |
| 1725 | 10744 | M64780 | f | agrin | ESTs, Weakly similar to A38096 perlecan precursor [*H. sapiens*], ESTs, Weakly similar to AGRT agrin - rat [*R. norvegicus*], ESTs, Weakly similar to BASEMENT MEMBRANE-SPECIFIC HEPARAN SULFATE PROTEOGLYCAN CORE PROTEIN PRECURSOR [*M. musculus*], ESTs, Weakly similar to PGBM_HUMAN BASEMENT MEMBRANE-SPECIFIC HEPARAN SULFATE PROTEOGLYCAN CORE PROTEIN PRECURSOR [*H. sapiens*], Mus musculus, clone IMAGE:3494258, mRNA, partial cds, heparan sulfate proteoglycan 2 (perlecan), perlecan (heparan sulfate proteoglycan 2), serine protease inhibitor, Kazal type, 5, sialoadhesin, transmembrane protein with EGF-like and two follistatin-like domains 1 |
| 2082 | 23424 | NM_021680 | j, k | alanyl-tRNA synthetase | alanyl-tRNA synthetase |
| 2118 | 20915 | NM_022407 | kk | aldehyde dehydrogenase 1 family, member A1, aldehyde dehydrogenase family 1, subfamily A1 | *Mus musculus,* Similar to aldehyde dehydrogenase 8 family, member A1, clone IMAGE:4234742, mRNA, partial cds, aldehyde dehydrogenase 1 family, member A1, aldehyde dehydrogenase family 1, subfamily A1 |
| 2353 | 12299 | NM_032416 | c | aldehyde dehydrogenase 2 family (mitochondrial), aldehyde dehydrogenase 2, mitochondrial | ESTs, Moderately similar to DHAM_RAT ALDEHYDE DEHYDROGENASE, MITOCHONDRIAL PRECURSOR (ALDH CLASS 2) (ALDH1) (ALDH-E2) [*R. norvegicus*], RIKEN cDNA 2410004H02 gene, aldehyde dehydrogenase 1 family, member B1, aldehyde dehydrogenase 2 family (mitochondrial), aldehyde dehydrogenase 2, mitochondrial |
| 119 | 11901 | AA801058 | d | aldehyde dehydrogenase 9 family, member A1, aldehyde dehydrogenase 9, subfamily A1 | *Mus musculus,* Similar to aldehyde dehydrogenase 4 family, member A1, clone IMAGE:5102023, mRNA, partial cds, RIKEN cDNA 1110038I05 gene, aldehyde dehydrogenase 4 family, member A1, aldehyde dehydrogenase 9 family, member A1, aldehyde dehydrogenase 9, subfamily A1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1733 | 15511 | NM_012498 | ii | aldo-keto reductase family 1, member B1 (aldose reductase), aldo-keto reductase family 1, member B3 (aldose reductase) | EST, Weakly similar to A39763 aldehyde reductase [*H. sapiens*], ESTs, Moderately similar to ALDR_RAT Aldose reductase (AR) (Aldehyde reductase) [*R. norvegicus*], ESTs, Weakly similar to ALDR_RAT Aldose reductase (AR) (Aldehyde reductase) [*R. norvegicus*], *Rattus norvegicus* mRNA for aldose reductase-like protein, aldo-keto reductase family 1, member B1 (aldose reductase), aldo-keto reductase family 1, member B3 (aldose reductase) |
| 1802 | 15032 | NM_012816 | j, k, jj, kk | alpha-methylacyl-CoA racemase | alpha-methylacyl-CoA racemase, cDNA sequence AF397014, chromosome 7 open reading frame 10 |
| 2039 | 2079 | NM_019220 | c | amino-terminal enhancer of split | amino-terminal enhancer of split |
| 2663 | 25711 | X60468 | s, t | amyloid beta (A4) precursor protein-binding, family B, member 1, amyloid beta (A4) precursor protein-binding, family B, member 1 (Fe65) | *Mus musculus,* Similar to amyloid beta (A4) precursor protein-binding, family B, member 3, clone MGC:38710 IMAGE:5357681, mRNA, complete cds, amyloid beta (A4) precursor protein-binding, family B, member 1, amyloid beta (A4) precursor protein-binding, family B, member 1 (Fe65), amyloid beta (A4) precursor protein-binding, family B, member 2 |
| 1745 | 225 | NM_012544 | aa, bb | angiotensin I converting enzyme (peptidyl-dipeptidase A) 1, angiotensin converting enzyme | ESTs, Highly similar to A31759 peptidyl-dipeptidase A [*H. sapiens*], RIKEN cDNA 2010305L05 gene, angiotensin I converting enzyme (peptidyl-dipeptidase A) 1, angiotensin converting enzyme |
| 1818 | 7196 | NM_012904 | a, ll | annexin A1 | annexin A1 |
| 1366 | 15315 | AI177911 | h, l | annexin A2 | annexin A2, annexin A9 |
| 2073 | 574 | NM_019905 | a, h, l, z, aa, kk, ll | annexin A2, hydroxyacid oxidase (glycolate oxidase) 3, hydroxyacid oxidase 3 (medium-chain) | EST, Moderately similar to 0806162C protein COI [*M. musculus*], EST, Moderately similar to 810024C cytochrome oxidase I [*H. sapiens*], EST, Weakly similar to 0806162C protein COI [*M. musculus*], ESTs, Highly similar to hydroxyacid oxidase 3 (medium-chain) [*Rattus norvegicus*] [*R. norvegicus*], ESTs, Moderately similar to 0806162C protein COI [*M. musculus*], ESTs, Moderately similar to 810024C cytochrome oxidase I [*H. sapiens*], ESTs, Weakly similar to 0806162C protein COI [*M. musculus*], annexin A2, annexin A9, hydroxyacid oxidase (glycolate oxidase) 3, hydroxyacid oxidase 1, liver |
| 1559 | 8440 | AI235611 | b | annexin A4 | ESTs, Moderately similar to ANX4 MOUSE ANNEXIN IV [*M. musculus*], ESTs, Weakly similar to ZAP 36/annexin IV [*Rattus norvegicus*] [*R. norvegicus*], *Mus musculus,* Similar to annexin A8, clone MGC:13875 IMAGE:4013266, mRNA, complete cds, annexin A13, annexin A4, annexin A8 |
| 2181 | 561 | NM_024156 | jj, kk | annexin A6 | annexin A6 |
| 2181 | 562 | NM_024156 | r | annexin A6 | annexin A6 |
| 2398 | 19252 | NM_053576 | a | anti-oxidant protein 2 (non-selenium glutathione peroxidase, acidic calcium-independent phospholipase A2), peroxiredoxin 5 | ESTs, Moderately similar to AOP2 MOUSE ANTIOXIDANT PROTEIN 2 [*M. musculus*], ESTs, Moderately similar to AOP2_HUMAN ANTIOXIDANT PROTEIN 2 [*H. sapiens*], anti-oxidant protein 2 (non-selenium glutathione peroxidase, acidic calcium-independent phospholipase A2), peroxiredoxin 5 |
| 1819 | 1834 | NM_012905 | d | aortic preferentially expressed gene 1, nuclear protein, marker for differentiated aortic smooth muscle and down-regulated with vascular injury | aortic preferentially expressed gene 1, nuclear protein, marker for differentiated aortic smooth muscle and down-regulated with vascular injury |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2177 | 20801 | NM_024148 | d, s, t | APEX nuclease (multifunctional DNA repair enzyme), apurinic/apyrimidinic endonuclease | APEX nuclease (multifunctional DNA repair enzyme), *Mus musculus* ape2 mRNA for AP endonuclease 2, complete cds, apurinic/apyrimidinic endonuclease |
| 2552 | 16400 | NM_138828 | cc, dd | apolipoprotein E | apolipoprotein E |
| 1793 | 5758 | NM_012778 | p, q, s, t | aquaporin 1, aquaporin 1 (channel-forming integral protein, 28 kD) | aquaporin 1, aquaporin 1 (channel-forming integral protein, 28 kD) |
| 1794 | 104 | NM_012779 | ii | aquaporin 5 | aquaporin 5, aquaporin 6 |
| 1986 | 7593 | NM_017260 | w, x | arachidonate 5-lipoxygenase activating protein, arachidonate 5-lipoxygenase-activating protein | arachidonate 5-lipoxygenase activating protein, arachidonate 5-lipoxygenase-activating protein |
| 1986 | 7594 | NM_017260 | w, x, ii | arachidonate 5-lipoxygenase activating protein, arachidonate 5-lipoxygenase-activating protein | arachidonate 5-lipoxygenase activating protein, arachidonate 5-lipoxygenase-activating protein |
| 1907 | 24868 | NM_016992 | n, o | arginine vasopressin, arginine vasopressin (neurophysin II, antidiuretic hormone, diabetes insipidus, neurohypophyseal) | arginine vasopressin, arginine vasopressin (neurophysin II, antidiuretic hormone, diabetes insipidus, neurohypophyseal) |
| 1907 | 24869 | NM_016992 | n, o | arginine vasopressin, arginine vasopressin (neurophysin II, antidiuretic hormone, diabetes insipidus, neurohypophyseal) | arginine vasopressin, arginine vasopressin (neurophysin II, antidiuretic hormone, diabetes insipidus, neurohypophyseal) |
| 1464 | 23013 | AI230743 | hh | ARP3 actin-related protein 3 homolog (yeast), actin-related protein 3 homolog (yeast) | ARP3 actin-related protein 3 homolog (yeast), EST, Weakly similar to ARP3_HUMAN ACTIN-LIKE PROTEIN 3 [*H. sapiens*], EST, Weakly similar to ATRT actin, skeletal muscle - rat [*R. norvegicus*], ESTs, Moderately similar to ARP3_HUMAN ACTIN-LIKE PROTEIN 3 [*H. sapiens*], ESTs, Weakly similar to ATHU actin alpha 1, skeletal muscle [*H. sapiens*], *Homo sapiens* cDNA FLJ14201 fis, clone NT2RP3002955, actin-related protein 3-beta, hypothetical protein FLJ12785, mitochondrial ribosomal protein L47 |
| 2000 | 16844 | NM_017311 | n, o | ATP synthase, H+ transporting, mitochondrial F0 complex, subunit c (subunit 9), isoform 1 | ATP synthase, H+ transporting, mitochondrial F0 complex, subunit c (subunit 9), isoform 1, ESTs, Highly similar to AT91_HUMAN ATP SYNTHASE LIPID-BINDING PROTEIN P1 PRECURSOR [*H. sapiens*], *Homo sapiens* cDNA: FLJ23586 fis, clone LNG14376 |
| 2566 | 17203 | NM_139099 | g, hh | ATP synthase, H+ transporting, mitochondrial F1 complex, epsilon subunit | ATP synthase, H+ transporting, mitochondrial F1 complex, epsilon subunit, RIKEN cDNA 2410043G19 gene, expressed sequence AV000645 |
| 2566 | 17204 | NM_139099 | g | ATP synthase, H+ transporting, mitochondrial F1 complex, epsilon subunit | ATP synthase, H+ transporting, mitochondrial F1 complex, epsilon subunit, RIKEN cDNA 2410043G19 gene, expressed sequence AV000645 |
| 1994 | 12347 | NM_017290 | ll | ATPase, Ca++ transporting, cardiac muscle, slow twitch 2 | |
| 1994 | 12349 | NM_017290 | aa | ATPase, Ca++ transporting, cardiac muscle, slow twitch 2 | |
| 1731 | 17991 | M96626 | cc, dd, gg | ATPase, Ca++ transporting, plasma membrane 3 | ATPase, Ca++ transporting, plasma membrane 2, ATPase, Class V, type 10C, ATPase, class V, type 10A, ESTs, Highly similar to A34308 Ca2+-transporting ATPase [*R. norvegicus*], ESTs, Weakly similar to I49143 gastric H(+)-K(+)-ATPase alpha subunit - mouse [*M. musculus*], RIKEN cDNA 1110019I14 gene, RIKEN cDNA 2810442I22 gene |
| 1822 | 24783 | NM_012914 | kk | ATPase, Ca++ transporting, ubiquitous | ATPase, Ca++ transporting, ubiquitous |
| 1734 | 583 | NM_012505 | h, l | ATPase, Na+/K+ transporting, alpha 2 (+) polypeptide, | ATPase, Na+/K+ transporting, alpha 2 (+) polypeptide, ATPase, Na+/K+ |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | ATPase, Na+/K+ transporting, alpha 2 polypeptide | transporting, alpha 2 polypeptide, ATPase, Na+/K+ transporting, alpha 4 polypeptide, ESTs, Highly similar to A1A4_HUMAN Sodium/potassium-transporting ATPase alpha-4 chain (Sodium pump 4) (Na+/K+ ATPase 4) [*H. sapiens*], expressed sequence AW060654 |
| 1726 | 5733 | M81855 | d | ATP-binding cassette, sub-family B (MDR/TAP), member 1, ATP-binding cassette, sub-family B (MDR/TAP), member 1B | ATP-binding cassette, sub-family B (MDR/TAP), member 1, ATP-binding cassette, sub-family B (MDR/TAP), member 1A, ATP-binding cassette, sub-family B (MDR/TAP), member 1B, EST, Highly similar to MDR3 MOUSE MULTIDRUG RESISTANCE PROTEIN 3 [*M. musculus*], EST, Weakly similar to MULTIDRUG RESISTANCE PROTEIN 3 [*M. musculus*], ESTs, Weakly similar to MDR1 MOUSE MULTIDRUG RESISTANCE PROTEIN 1 [*M. musculus*], *Mus musculus*, clone IMAGE:3588242, mRNA, partial cds |
| 2656 | 1037 | X57523 | d | ATP-binding cassette, sub-family B (MDR/TAP), member 2, transporter 1, ATP-binding cassette, sub-family B (MDR/TAP) | ATP-binding cassette, sub-family B (MDR/TAP), member 2, ESTs, Highly similar to S13426 multidrug resistance protein homolog - rat [*R. norvegicus*], transporter 1, ATP-binding cassette, sub-family B (MDR/TAP) |
| 1853 | 733 | NM_013040 | j, k | ATP-binding cassette, sub-family C (CFTR/MRP), member 9 | ATP-binding cassette, sub-family C (CFTR/MRP), member 9, ESTs, Weakly similar to T42751 sulfonylurea receptor 2 - rat [*R. norvegicus*], *Homo sapiens* cDNA FLJ31957 fis, clone NT2RP7007381, highly similar to Sulfonylurea receptor 2A, *Mus musculus* adult male pituitary gland cDNA, RIKEN full-length enriched library, clone:5330439B14:ATP-binding cassette, sub-family C (CFTR/MRP), member 9, full insert sequence |
| 728 | 3511 | AA998152 | ee, ff | BAI1-associated protein 2, brain-specific angiogenesis inhibitor 1-associated protein 2 | BAI1-associated protein 2, ESTs, Weakly similar to brain-specific angiogenesis inhibitor 1-associated protein 2 [*Mus musculus*] [*M. musculus*], *Mus musculus*, Similar to KIAA0429 gene product, clone IMAGE:2811240, mRNA, partial cds, RIKEN cDNA 1300006M19 gene, brain-specific angiogenesis inhibitor 1-associated protein 2, hypothetical protein FLJ22582, insulin receptor tyrosine kinase substrate |
| 2370 | 1063 | NM_053328 | e | basic helix-loop-helix domain containing, class B, 2, basic helix-loop-helix domain containing, class B2 | basic helix-loop-helix domain containing, class B, 2, basic helix-loop-helix domain containing, class B, 3, basic helix-loop-helix domain containing, class B2, basic helix-loop-helix domain containing, class B3 |
| 2514 | 1061 | NM_133303 | p, q, hh | basic helix-loop-helix domain containing, class B, 3, basic helix-loop-helix domain containing, class B3 | basic helix-loop-helix domain containing, class B, 2, basic helix-loop-helix domain containing, class B2, basic helix-loop-helix domain containing, class B3 |
| 1984 | 19 | NM_017258 | p, q | B-cell translocation gene 1, anti-proliferative | B-cell translocation gene 1, anti-proliferative, *Homo sapiens* cDNA FLJ30547 fis, clone BRAWH2001439, transducer of ERBB2, 1, transducer of ERBB2, 2, transducer of ErbB-2.1 |
| 1985 | 15300 | NM_017259 | p, q, kk | B-cell translocation gene 2, anti-proliferative, BTG family, member 2 | B-cell translocation gene 2, anti-proliferative, B-cell translocation gene 4, BTG family, member 2, ESTs, Highly similar to BTG2_HUMAN BTG2 PROTEIN PRECURSOR [*H. sapiens*] |
| 1985 | 15301 | NM_017259 | j, k, p, q, y, z, gg | B-cell translocation gene 2, anti-proliferative, BTG family, member 2 | B-cell translocation gene 2, anti-proliferative, B-cell translocation gene 4, BTG family, member 2, ESTs, Highly similar to BTG2_HUMAN BTG2 PROTEIN PRECURSOR [*H. sapiens*] |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1985 | 15299 | NM_017259 | y, z | B-cell translocation gene 2, anti-proliferative, BTG family, member 2 | B-cell translocation gene 2, anti-proliferative, B-cell translocation gene 4, BTG family, member 2, ESTs, Highly similar to BTG2_HUMAN BTG2 PROTEIN PRECURSOR [*H. sapiens*] |
| 1924 | 910 | NM_017059 | d | BCL2-associated X protein, Bcl2-associated X protein | |
| 1924 | 911 | NM_017059 | d | BCL2-associated X protein, Bcl2-associated X protein | |
| 1924 | 912 | NM_017059 | d, l, m | BCL2-associated X protein, Bcl2-associated X protein | |
| 1913 | 17815 | NM_017015 | w, x | beta-glucuronidase, glucuronidase, beta | ESTs, Highly similar to A26581 beta-glucuronidase [*H. sapiens*], SMA3, beta-glucuronidase structural, glucuronidase, beta |
| 1933 | 22552 | NM_017087 | n, o | biglycan | ESTs, Highly similar to asporin (LRR class 1); periodontal ligament associated protein 1 [*Homo sapiens*] [*H. sapiens*], ESTs, Weakly similar to PGS1_RAT Bone/cartilage proteoglycan I precursor (Biglycan) (PG-S1) [*R. norvegicus*], asporin, biglycan |
| 1735 | 1745 | NM_012513 | p, q, ll | brain derived neurotrophic factor, brain-derived neurotrophic factor | brain derived neurotrophic factor, brain-derived neurotrophic factor, expressed sequence AI462899 |
| 495 | 23038 | AA900881 | a, j, k, y, z | branched chain aminotransferase 1, cytosolic | branched chain aminotransferase 1, cytosolic |
| 2117 | 24643 | NM_022400 | b, u, v | branched chain aminotransferase 2, mitochondrial | *Homo sapiens* cDNA FLJ13847 fis, clone THYRO1000852, highly similar to Human branched-chain amino acid aminotransferase (ECA40) mRNA, branched chain aminotransferase 2, mitochondrial |
| 1688 | 17285 | J02827 | c | branched chain keto acid dehydrogenase E1, alpha polypeptide (maple syrup urine disease), branched chain ketoacid dehydrogenase E1, alpha polypeptide | |
| 778 | 3278 | AI008988 | y, z | breakpoint cluster region | ESTs, Highly similar to breakpoint cluster region, isoform 1 [*Homo sapiens*] [*H. sapiens*], ESTs, Highly similar to chimerin (chimaerin) 1 [*Rattus norvegicus*] [*R. norvegicus*], ESTs, Weakly similar to SH3-BINDING PROTEIN 3BP-1 [*M. musculus*], RIKEN cDNA 1700112L09 gene, RIKEN cDNA 2310069I04 gene, RIKEN cDNA 5133400C09 gene, RIKEN cDNA 5730403H17 gene, SH3-domain binding protein 1, breakpoint cluster region, chimerin (chimaerin) 1 |
| 2347 | 18499 | NM_031984 | aa, bb | calbindin 1, (28 kD), calbindin-28K | *Mus musculus*, Similar to secretagogin, clone MGC:27615 IMAGE:4504330, mRNA, complete cds, calbindin 1, (28 kD), calbindin-28K |
| 2347 | 18500 | NM_031984 | bb | calbindin 1, (28 kD), calbindin-28K | *Mus musculus*, Similar to secretagogin, clone MGC:27615 IMAGE:4504330, mRNA, complete cds, calbindin 1, (28 kD), calbindin-28K |
| 1780 | 1632 | NM_012717 | u, v | calcitonin receptor-like | calcitonin receptor-like |
| 1824 | 1765 | NM_012919 | u, v | calcium channel, voltage-dependent, alpha 2/delta subunit 1, calcium channel, voltage-dependent, alpha2/delta subunit 1 | ESTs, Highly similar to CIC2 RAT DIHYDROPYRIDINE-SENSITIVE L-TYPE, CALCIUM CHANNEL ALPHA-2/DELTA SUBUNITS PRECURSOR [*R. norvegicus*], ESTs, Moderately similar to CIC2 RAT DIHYDROPYRIDINE-SENSITIVE L-TYPE, CALCIUM CHANNEL ALPHA-2/DELTA SUBUNITS PRECURSOR [*R. norvegicus*], *Rattus norvegicus* L-type calcium channel alpha2/delta subunit mRNA, complete cds, calcium channel, voltage-dependent, alpha 2/delta subunit 1, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2442 | 1011 | NM_053851 | e | calcium channel, voltage-dependent, beta 2 subunit | calcium channel, voltage-dependent, alpha 2/delta subunit 2, calcium channel, voltage-dependent, alpha2/delta subunit 1 ESTs, Weakly similar to 2111412A Ca channel:SUBUNIT = beta [*M. musculus*], calcium channel, voltage-dependent, beta 2 subunit, expressed sequence AW060387 |
| 2340 | 19190 | NM_031969 | h, l | calmodulin 1, calmodulin 1 (phosphorylase kinase, delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1, expressed sequence AI327027, expressed sequence AL024000, troponin C, fast skeletal |
| 2340 | 19191 | NM_031969 | h, l | calmodulin 1, calmodulin 1 (phosphorylase kinase, delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1, expressed sequence AI327027, expressed sequence AL024000, troponin C, fast skeletal |
| 2340 | 19195 | NM_031969 | h, l, ll | calmodulin 1, calmodulin 1 (phosphorylase kinase, delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1, expressed sequence AI327027, expressed sequence AL024000, troponin C, fast skeletal |
| 2340 | 25802 | NM_031969 | h, l, aa, bb, ll | calmodulin 1, calmodulin 1 (phosphorylase kinase, delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1, expressed sequence AI327027, expressed sequence AL024000, troponin C, fast skeletal |
| 587 | 15476 | AA944426 | h, l | calmodulin 3, calmodulin 3 (phosphorylase kinase, delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1, expressed sequence AI327027, expressed sequence AL024000, troponin C, fast skeletal |
| 1736 | 20518 | NM_012518 | n, o, r | calmodulin 3, calmodulin 3 (phosphorylase kinase, delta) | RIKEN cDNA 2310068O22 gene, calmodulin 1, calmodulin 1 (phosphorylase kinase, delta), calmodulin 2, calmodulin 2 (phosphorylase kinase, delta), calmodulin 3, calmodulin-like 3, centrin 1, centrin, EF-hand protein, 1, expressed sequence AI327027, expressed sequence AL024000, troponin C, fast skeletal |
| 1698 | 6963 | L18889 | e | calnexin | |
| 2024 | 20863 | NM_019152 | cc, dd | calpain 1, calpain 1, (mu/l) large subunit | ESTs, Weakly similar to CAN1_MOUSE CALPAIN 1, LARGE [CATALYTIC] SUBUNIT (CALCIUM-ACTIVATED NEUTRAL PROTEINASE) (CANP) (MU-TYPE) [*M. musculus*], calpain 1, calpain |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | 11, small optic lobes homolog (*Drosophila*) |
| 296 | 1190 | AA875089 | hh | calpastatin | ESTs, Moderately similar to ICAL_HUMAN CALPAIN INHIBITOR [*H. sapiens*], calpastatin |
| 2064 | 23491 | NM_019359 | r | calponin 3, acidic | ESTs, Moderately similar to CALPONIN H1, SMOOTH MUSCLE [*M. musculus*], calponin 1, calponin 2, calponin 3, acidic |
| 530 | 168 | AA924985 | e | calsequestrin 2, calsequestrin 2 (cardiac muscle) | ESTs, Highly similar to CAQS MOUSE CALSEQUESTRIN, SKELETAL MUSCLE ISOFORM PRECURSOR [*M. musculus*], ESTs, Moderately similar to CAQC_RAT CALSEQUESTRIN, CARDIAC MUSCLE ISOFORM PRECURSOR [*R. norvegicus*], calsequestrin 1, calsequestrin 1 (fast-twitch, skeletal muscle), calsequestrin 2, calsequestrin 2 (cardiac muscle) |
| 1946 | 167 | NM_017131 | b, e, u, v, ll | calsequestrin 2, calsequestrin 2 (cardiac muscle) | ESTs, Highly similar to CAQS MOUSE CALSEQUESTRIN, SKELETAL MUSCLE ISOFORM PRECURSOR [*M. musculus*], ESTs, Moderately similar to CAQC_RAT CALSEQUESTRIN, CARDIAC MUSCLE ISOFORM PRECURSOR [*R. norvegicus*], calsequestrin 1, calsequestrin 1 (fast-twitch, skeletal muscle), calsequestrin 2, calsequestrin 2 (cardiac muscle) |
| 2056 | 15056 | NM_019291 | b, c | carbonic anhydrase 2, carbonic anhydrase II | EST, Weakly similar to CRMS2 carbonate dehydratase [*M. musculus*], ESTs, Weakly similar to CAH2_RAT Carbonic anhydrase II (Carbonate dehydratase II) (CA-II) [*R. norvegicus*], carbonic anhydrase 2, carbonic anhydrase I, carbonic anhydrase II, carbonic anhydrase VIII, carbonic anhydrase-like sequence 1 |
| 2029 | 17063 | NM_019170 | f, g | carbonyl reductase 1 | ESTs, Weakly similar to S52349 carbonyl reductase (NADPH) (EC 1.1.1.184) - rat [*R. norvegicus*], RIKEN cDNA 1110001J05 gene, RIKEN cDNA A930033N07 gene, carbonyl reductase 1, carbonyl reductase 3 |
| 2029 | 17064 | NM_019170 | f, g | carbonyl reductase 1 | ESTs, Weakly similar to S52349 carbonyl reductase (NADPH) (EC 1.1.1.184) - rat [*R. norvegicus*], RIKEN cDNA 1110001J05 gene, RIKEN cDNA A930033N07 gene, carbonyl reductase 1, carbonyl reductase 3 |
| 2029 | 17066 | NM_019170 | g | carbonyl reductase 1 | ESTs, Weakly similar to S52349 carbonyl reductase (NADPH) (EC 1.1.1.184) - rat [*R. norvegicus*], RIKEN cDNA 1110001J05 gene, RIKEN cDNA A930033N07 gene, carbonyl reductase 1, carbonyl reductase 3 |
| 2512 | 20879 | NM_133295 | hh | carboxylesterase 3, carboxylesterase 3 (brain) | ESTs, Weakly similar to A41010 carboxylesterase [*H. sapiens*], *Mus musculus*, Similar to carboxylesterase 2 (intestine, liver), clone MGC:18908 IMAGE:4241028, mRNA, complete cds, *Mus musculus*, clone MGC:18894 IMAGE:4239756, mRNA, complete cds, RIKEN cDNA 2310039D24 gene, T-complex expressed gene 5, carboxylesterase 1, carboxylesterase 1 (monocyte/macrophage serine esterase 1), carboxylesterase 3, carboxylesterase 3 (brain), carboxylesterase-related protein, esterase 22 |
| 1908 | 24354 | NM_016998 | c | carboxypeptidase A1, carboxypeptidase A1 (pancreatic) | EST, Weakly similar to MAST CELL CARBOXYPEPTIDASE A PRECURSOR [*M. musculus*], RIKEN cDNA 1110019K20 gene, RIKEN cDNA 4930430M09 gene, carboxypeptidase |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | A1 (pancreatic), carboxypeptidase A3, mast cell, carboxypeptidase B1 (tissue) |
| 1875 | 21840 | NM_013128 | w, ll | carboxypeptidase E | |
| 2350 | 20554 | NM_031987 | b, l, m, aa, cc, dd | carnitine O-octanoyltransferase | carnitine O-octanoyltransferase |
| 2350 | 20555 | NM_031987 | j, k | carnitine O-octanoyltransferase | carnitine O-octanoyltransferase |
| 1896 | 20855 | NM_013200 | a, w, x, hh | carnitine palmitoyltransferase 1 muscle, carnitine palmitoyltransferase I, muscle | carnitine palmitoyltransferase 1, muscle, carnitine palmitoyltransferase I, muscle |
| 1896 | 20856 | NM_013200 | a, w, x, aa, hh, ll | carnitine palmitoyltransferase 1, muscle, carnitine palmitoyltransferase I, muscle | carnitine palmitoyltransferase 1, muscle, carnitine palmitoyltransferase I, muscle |
| 1827 | 1977 | NM_012930 | a, w, x, cc, dd | carnitine palmitoyltransferase 2, carnitine palmitoyltransferase II | carnitine palmitoyltransferase 2, carnitine palmitoyltransferase II |
| 2409 | 20243 | NM_053615 | aa, bb | casein kinase 1, alpha 1 | ESTs, Weakly similar to casein kinase [*M. musculus*], RIKEN cDNA 2610208K14 gene, RIKEN cDNA 3300002K07 gene, casein kinase 1, alpha 1, casein kinase 1, delta |
| 630 | 22771 | AA946432 | b, l, m | casein kinase 1, delta | ESTs, Moderately similar to KC1D_HUMAN CASEIN KINASE I, DELTA ISOFORM [*H. sapiens*], ESTs, Weakly similar to casein kinase [*M. musculus*], RIKEN cDNA 2610208K14 gene, RIKEN cDNA 3300002K07 gene, casein kinase 1, alpha 1, casein kinase 1, delta |
| 1738 | 15741 | NM_012520 | ll | catalase, catalase 1 | catalase, catalase 1 |
| 1740 | 11115 | NM_012531 | f, g | catechol-O-methyltransferase | RIKEN cDNA 6330414C15 gene, catechol-O-methyltransferase |
| 1740 | 11116 | NM_012531 | f, g | catechol-O-methyltransferase | RIKEN cDNA 6330414C15 gene, catechol-O-methyltransferase |
| 1937 | 2150 | NM_017097 | a, ll | cathepsin C | RIKEN cDNA 4921537I17 gene, cathepsin C |
| 1882 | 3430 | NM_013156 | c, l, m, t, kk | cathepsin L | ESTs, Weakly similar to CATL MOUSE CATHEPSIN L PRECURSOR [*M. musculus*], RIKEN cDNA 4930486L24 gene, cathepsin L, expressed sequence AA408230 |
| 1882 | 3431 | NM_013156 | c, kk | cathepsin L | ESTs, Weakly similar to CATL MOUSE CATHEPSIN L PRECURSOR [*M. musculus*], RIKEN cDNA 4930486L24 gene, cathepsin L, expressed sequence AA408230 |
| 2284 | 25795 | NM_031556 | jj, kk | caveolin 1, caveolae protein, 22 kD, caveolin, caveolae protein, 22 kDa | caveolin 1, caveolae protein, 22 kD, caveolin, caveolae protein, 22 kDa |
| 2172 | 21238 | NM_024125 | p, q | CCAAT/enhancer binding protein (C/EBP), beta | CCAAT/enhancer binding protein (C/EBP), beta |
| 2172 | 21239 | NM_024125 | p, q, r, bb, ee, ff, kk | CCAAT/enhancer binding protein (C/EBP), beta | CCAAT/enhancer binding protein (C/EBP), beta |
| 1880 | 21682 | NM_013154 | j, k, p, q, y, z, gg, kk | CCAAT/enhancer binding protein (C/EBP), delta | CCAAT/enhancer binding protein (C/EBP), delta |
| 1880 | 21683 | NM_013154 | e, j, k, p, q, y, z, kk | CCAAT/enhancer binding protein (C/EBP), delta | CCAAT/enhancer binding protein (C/EBP), delta |
| 2280 | 16049 | NM_031541 | n, o | CD36 antigen (collagen type I receptor, thrombospondin receptor)-like 1, scavenger receptor class B1 | CD36 antigen (collagen type I receptor, thrombospondin receptor)-like 1, scavenger receptor class B1 |
| 2286 | 18315 | NM_031561 | e, u | CD36 antigen, CD36 antigen (collagen type I receptor, thrombospondin receptor) | CD36 antigen, CD36 antigen (collagen type I receptor, thrombospondin receptor) |
| 2286 | 18316 | NM_031561 | e | CD36 antigen, CD36 antigen (collagen type I receptor, thrombospondin receptor) | CD36 antigen, CD36 antigen (collagen type I receptor, thrombospondin receptor) |
| 2286 | 18317 | NM_031561 | r, aa, bb, ii | CD36 antigen, CD36 antigen (collagen type I receptor, thrombospondin receptor) | CD36 antigen, CD36 antigen (collagen type I receptor, thrombospondin receptor) |
| 2286 | 18319 | NM_031561 | w, x | CD36 antigen, CD36 antigen (collagen type I receptor, thrombospondin receptor) | CD36 antigen, CD36 antigen (collagen type I receptor, thrombospondin receptor) |
| 1874 | 2005 | NM_013127 | e, bb | CD38 antigen, CD38 antigen (p45) | CD38 antigen, CD38 antigen (p45) |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1826 | 1625 | NM_012924 | gg | CD44 antigen, CD44 antigen (homing function and Indian blood group system) | |
| 386 | 2832 | AA892388 | b, u, v | CD59 antigen p18-20 (antigen identified by monoclonal antibodies 16.3A5, EJ16, EJ30, EL32 and G344), CD59a antigen | |
| 1943 | 1435 | NM_017125 | kk | CD63 antigen (melanoma 1 antigen), Cd63 antigen | CD63 antigen (melanoma 1 antigen), Cd63 antigen, EST, Weakly similar to CD63 MOUSE CD63 ANTIGEN [*M. musculus*], ESTs, Weakly similar to CD63_RAT CD63 antigen (AD1 antigen) [*R. norvegicus*], Mus musculus, clone MGC:36554 IMAGE:4954874, mRNA, complete cds, RIKEN cDNA 1300010A20 gene, expressed sequence C75951, expressed sequence C80071, transmembrane 4 superfamily member 2 |
| 2424 | 10510 | NM_053743 | u, v | CDC37 cell division cycle 37 homolog (*S. cerevisiae*), cell division cycle 37 homolog (*S. cerevisiae*) | CDC37 cell division cycle 37 homolog (*S. cerevisiae*), cell division cycle 37 homolog (*S. cerevisiae*), cell division cycle 37 homolog (*S. cerevisiae*)-like |
| 73 | 13683 | AA799788 | e | cell division cycle 34 | ESTs, Highly similar to A41222 ubiquitin-protein ligase [*H. sapiens*], ESTs, Weakly similar to UBC2_HUMAN UBIQUITIN-CONJUGATING ENZYME E2-17 KD [*M. musculus*], RIKEN cDNA 2610301N02 gene, cell division cycle 34, expressed sequence AI327276, ubiquitin-conjugating enzyme E2B, RAD6 homology (*S. cerevisiae*), ubiquitin-conjugating enzyme E2C |
| 1702 | 13682 | L38482 | e | cell division cycle 34 | ESTs, Highly similar to A41222 ubiquitin-protein ligase [*H. sapiens*], ESTs, Weakly similar to UBC2_HUMAN UBIQUITIN-CONJUGATING ENZYME E2-17 KD [*M. musculus*], RIKEN cDNA 2610301N02 gene, cell division cycle 34, expressed sequence AI327276, ubiquitin-conjugating enzyme E2B, RAD6 homology (*S. cerevisiae*), ubiquitin-conjugating enzyme E2C |
| 1423 | 22845 | AI227887 | e, aa, bb | cell division cycle 42 (GTP binding protein, 25 kD), cell division cycle 42 homolog (*S. cerevisiae*) | RIKEN cDNA 4930544G11 gene, RIKEN cDNA 5830400A04 gene, cell division cycle 42 (GTP binding protein, 25 kD), plysia ras-related homolog A2, ras homolog 9 (RhoC), ras homolog A2, ras homolog gene family, member C |
| 1741 | 16520 | NM_012532 | c | ceruloplasmin, ceruloplasmin (ferroxidase) | DNA segment, Chr 3, ERATO Doi 555, expressed, EST, Highly similar to FA8_HUMAN COAGULATION FACTOR VIII PRECURSOR [*H. sapiens*], ESTs, Weakly similar to CERU MOUSE CERULOPLASMIN PRECURSOR [*M. musculus*], ESTs, Weakly similar to CERU_RAT CERULOPLASMIN PRECURSOR (FERROXIDASE) [*R. norvegicus*], ESTs, Weakly similar to KUHU ferroxidase [*H. sapiens*], ceruloplasmin, ceruloplasmin (ferroxidase), coagulation factor VIII, procoagulant component (hemophilia A) |
| 2321 | 19048 | NM_031719 | jj, kk | chloride channel, nucleotide-sensitive, 1A | chloride channel, nucleotide-sensitive, 1A |
| 2329 | 1182 | NM_031790 | b, l, m | citron, citron (rho-interacting, serine/threonine kinase 21) | EST, Highly similar to CTRO_HUMAN CITRON PROTEIN [*H. sapiens*], ESTs, Highly similar to CTRO_HUMAN CITRON PROTEIN [*H. sapiens*], KIAA0451 gene product, Nef-associated factor 1, citron, citron (rho-interacting, serine/threonine kinase 21) |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2344 | 17075 | NM_031974 | gg | clathrin, light polypeptide (Lca) | *H. sapiens* clathrin light chain a gene, clathrin, light polypeptide (Lca), clathrin, light polypeptide (Lcb), expressed sequence AV026556 |
| 216 | 13627 | AA851493 | aa, bb | claudin 7 | ESTs, Weakly similar to CLD7_RAT CLAUDIN-7 [*R. norvegicus*], *Mus musculus* claudin 19 mRNA, complete cds, claudin 10, claudin 15, claudin 7 |
| 1952 | 15364 | NM_017147 | ii | cofilin 1 (non-muscle), cofilin 1, non-muscle | cofilin 1 (non-muscle), cofilin 1, non-muscle, cofilin 2 (muscle), cofilin 2, muscle, expressed sequence AW987265 |
| 1952 | 15365 | NM_017147 | aa, bb, ll | cofilin 1 (non-muscle), cofilin 1, non-muscle | cofilin 1 (non-muscle), cofilin 1, non-muscle, cofilin 2 (muscle), cofilin 2, muscle, expressed sequence AW987265 |
| 1659 | 16610 | D28557 | c, f, u, v | cold shock domain protein A | *Mus musculus* 10 days embryo whole body cDNA, RIKEN full-length enriched library, clone:2610205I19:Y box protein 1, full insert sequence, *Mus musculus* Y-box binding protein (oxyR) mRNA, partial cds, cold shock domain protein A |
| 1485 | 15572 | AI231472 | f, g | collagen, type I, alpha 1, procollagen, type I, alpha 1 | EST, Weakly similar to CA11_HUMAN COLLAGEN ALPHA 1(I) CHAIN PRECURSOR [*H. sapiens*], EST, Weakly similar to PROCOLLAGEN ALPHA 1(I) CHAIN PRECURSOR [*M. musculus*], ESTs, Weakly similar to CA11_HUMAN COLLAGEN ALPHA 1(I) CHAIN PRECURSOR [*H. sapiens*], ESTs, Weakly similar to PROCOLLAGEN ALPHA 1(I) CHAIN PRECURSOR [*M. musculus*], F-box only protein 29, *Mus musculus,* Similar to RIKEN cDNA 1700051I12 gene, clone MGC:28741 IMAGE:4481590, mRNA, complete cds, collagen, type IV, alpha 3 (Goodpasture antigen), expressed sequence AW742721, procollagen, type I, alpha 1, procollagen, type IV, alpha 1, procollagen, type IV, alpha 4, procollagen, type IV, alpha 5, procollagen, type VI, alpha 1, putative emu1 |
| 1713 | 15571 | M27207 | g | collagen, type I, alpha 1, procollagen, type I, alpha 1 | EST, Weakly similar to CA11_HUMAN COLLAGEN ALPHA 1(I) CHAIN PRECURSOR [*H. sapiens*], EST, Weakly similar to PROCOLLAGEN ALPHA 1(I) CHAIN PRECURSOR [*M. musculus*], ESTs, Weakly similar to CA11_HUMAN COLLAGEN ALPHA 1(I) CHAIN PRECURSOR [*H. sapiens*], ESTs, Weakly similar to PROCOLLAGEN ALPHA 1(I) CHAIN PRECURSOR [*M. musculus*], F-box only protein 29, *Mus musculus,* Similar to RIKEN cDNA 1700051I12 gene, clone MGC:28741 IMAGE:4481590, mRNA, complete cds, collagen, type IV, alpha 3 (Goodpasture antigen), expressed sequence AW742721, procollagen, type I, alpha 1, procollagen, type IV, alpha 1, procollagen, type IV, alpha 4, procollagen, type IV, alpha 5, procollagen, type VI, alpha 1, putative emu1 |
| 2696 | 15569 | Z78279 | c, g, bb | collagen, type I, alpha 1, procollagen, type I, alpha 1 | EST, Weakly similar to CA11_HUMAN COLLAGEN ALPHA 1(I) CHAIN PRECURSOR [*H. sapiens*], EST, Weakly similar to PROCOLLAGEN ALPHA 1(I) CHAIN PRECURSOR [*M. musculus*], ESTs, Weakly similar to CA11_HUMAN COLLAGEN ALPHA 1(I) CHAIN PRECURSOR [*H. sapiens*], ESTs, Weakly similar to PROCOLLAGEN ALPHA 1(I) CHAIN PRECURSOR [*M. musculus*], F-box only protein 29, *Mus musculus,* Similar to RIKEN cDNA 1700051I12 gene, clone MGC:28741 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2696 | 15570 | Z78279 | c, f, g, j, k | collagen, type I, alpha 1, procollagen, type I, alpha 1 | IMAGE:4481590, mRNA, complete cds, collagen, type IV, alpha 3 (Goodpasture antigen), expressed sequence AW742721, procollagen, type I, alpha 1, procollagen, type IV, alpha 1, procollagen, type IV, alpha 4, procollagen, type IV, alpha 5, procollagen, type VI, alpha 1, putative emu1 EST, Weakly similar to CA11_HUMAN COLLAGEN ALPHA 1(I) CHAIN PRECURSOR [*H. sapiens*], EST, Weakly similar to PROCOLLAGEN ALPHA 1(I) CHAIN PRECURSOR [*M. musculus*], ESTs, Weakly similar to CA11_HUMAN COLLAGEN ALPHA 1(I) CHAIN PRECURSOR [*H. sapiens*], ESTs, Weakly similar to PROCOLLAGEN ALPHA 1(I) CHAIN PRECURSOR [*M. musculus*], F-box only protein 29, *Mus musculus*, Similar to RIKEN cDNA 1700051I12 gene, clone MGC:28741 |
| 2 | 6153 | AA875531 | g, j, k | collagen, type I, alpha 2, procollagen, type I, alpha 2 | IMAGE:4481590, mRNA, complete cds, collagen, type IV, alpha 3 (Goodpasture antigen), expressed sequence AW742721, procollagen, type I, alpha 1, procollagen, type IV, alpha 1, procollagen, type IV, alpha 4, procollagen, type IV, alpha 5, procollagen, type VI, alpha 1, putative emu1 EST, Moderately similar to 0806162B cytochrome b [*M. musculus*], EST, Moderately similar to 810024B cytochrome b [*H. sapiens*], EST, Weakly similar to 0806162B cytochrome b [*M. musculus*], EST, Weakly similar to 0812187A cytochrome b [*Rattus norvegicus*] [*R. norvegicus*], EST, Weakly similar to 810024M URF 6 [*H. sapiens*], F-box only protein 29, *Mus musculus*, clone IMAGE:5323568, mRNA, partial cds, collagen, type VI, alpha 3, procollagen, type I, alpha 2, prostate tumor over expressed gene 1, retinoblastoma binding protein 1 |
| 233 | 6158 | AA859284 | f, g | collagen, type I, alpha 2, procollagen, type I, alpha 2 | F-box only protein 29, *Mus musculus*, clone IMAGE:5323568, mRNA, partial cds, collagen, type VI, alpha 3, procollagen, type I, alpha 2, prostate tumor over expressed gene 1, retinoblastoma binding protein 1 |
| 2376 | 6154 | NM_053356 | f, g | collagen, type I, alpha 2, procollagen, type I, alpha 2 | F-box only protein 29, *Mus musculus*, clone IMAGE:5323568, mRNA, partial cds, collagen, type VI, alpha 3, procollagen, type I, alpha 2, prostate tumor over expressed gene 1, retinoblastoma binding protein 1 |
| 2376 | 6155 | NM_053356 | g | collagen, type I, alpha 2, procollagen, type I, alpha 2 | F-box only protein 29, *Mus musculus*, clone IMAGE:5323568, mRNA, partial cds, collagen, type VI, alpha 3, procollagen, type I, alpha 2, prostate tumor over expressed gene 1, retinoblastoma binding protein 1 |
| 2376 | 6156 | NM_053356 | g | collagen, type I, alpha 2, procollagen, type I, alpha 2 | F-box only protein 29, *Mus musculus*, clone IMAGE:5323568, mRNA, partial cds, collagen, type VI, alpha 3, procollagen, type I, alpha 2, prostate tumor over expressed gene 1, retinoblastoma binding protein 1 |
| 2376 | 6157 | NM_053356 | f, g | collagen, type I, alpha 2, procollagen, type I, alpha 2 | F-box only protein 29, *Mus musculus*, clone IMAGE:5323568, mRNA, partial cds, collagen, type VI, alpha 3, procollagen, type I, alpha 2, prostate tumor over expressed gene 1, retinoblastoma binding protein 1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1711 | 16427 | M21354 | f, g | collagen, type III, alpha 1 (Ehlers-Danlos syndrome type IV, autosomal dominant), procollagen, type III, alpha 1 | EST, Highly similar to CA13_HUMAN COLLAGEN ALPHA 1(III) CHAIN PRECURSOR [*H. sapiens*], EST, Moderately similar to CA13_HUMAN COLLAGEN ALPHA 1(III) CHAIN PRECURSOR [*H. sapiens*], EST, Weakly similar to CA13 MOUSE COLLAGEN ALPHA 1(III) CHAIN PRECURSOR [*M. musculus*], EST, Weakly similar to CA13_HUMAN COLLAGEN ALPHA 1(III) CHAIN PRECURSOR [*H. sapiens*], ESTs, Weakly similar to CA13 MOUSE COLLAGEN ALPHA 1(III) CHAIN PRECURSOR [*M. musculus*], ESTs, Weakly similar to S41067 collagen alpha 1(III) chain - rat [*R. norvegicus*], *Mus musculus*, Similar to putative protein phosphatase 1 nuclear targeting subunit, clone IMAGE:3157989, mRNA, partial cds, RIKEN cDNA 2010011D20 gene, cleavage and polyadenylation specific factor 6, 68 kD subunit, collagen type V, alpha 2, collagen, type III, alpha 1 (Ehlers-Danlos syndrome type IV, autosomal dominant), procollagen, type III, alpha 1 |
| 2674 | 16426 | X70369 | c, g, bb | collagen, type III, alpha 1 (Ehlers-Danlos syndrome type IV, autosomal dominant), procollagen, type III, alpha 1 | EST, Highly similar to CA13_HUMAN COLLAGEN ALPHA 1(III) CHAIN PRECURSOR [*H. sapiens*], EST, Moderately similar to CA13_HUMAN COLLAGEN ALPHA 1(III) CHAIN PRECURSOR [*H. sapiens*], EST, Weakly similar to CA13 MOUSE COLLAGEN ALPHA 1(III) CHAIN PRECURSOR [*M. musculus*], EST, Weakly similar to CA13_HUMAN COLLAGEN ALPHA 1(III) CHAIN PRECURSOR [*H. sapiens*], ESTs, Weakly similar to CA13 MOUSE COLLAGEN ALPHA 1(III) CHAIN PRECURSOR [*M. musculus*], ESTs, Weakly similar to S41067 collagen alpha 1(III) chain - rat [*R. norvegicus*], *Mus musculus*, Similar to putative protein phosphatase 1 nuclear targeting subunit, clone IMAGE:3157989, mRNA, partial cds, RIKEN cDNA 2010011D20 gene, cleavage and polyadenylation specific factor 6, 68 kD subunit, collagen type V, alpha 2, collagen, type III, alpha 1 (Ehlers-Danlos syndrome type IV, autosomal dominant), procollagen, type III, alpha 1 |
| 251 | 2262 | AA859757 | hh | collagen, type V, alpha 1, procollagen, type V, alpha 1 | EST, Weakly similar to CGHU1V collagen alpha 1(V) chain precursor [*H. sapiens*], *Homo sapiens* cDNA FLJ30442 fis, clone BRACE2009212, *Homo sapiens* proline-rich acidic protein mRNA, complete cds, *Mus musculus*, clone IMAGE:3490511, mRNA, partial cds, collagen, type V, alpha 1, collagen, type XI, alpha 1, endoplasmic reticulum chaperone SIL1, homolog of yeast, hypothetical protein MGC2705, procollagen, type V, alpha 1, procollagen, type V, alpha 3, procollagen, type XI, alpha 1 |
| 2544 | 25237 | NM_134452 | r | collagen, type V, alpha 1, procollagen, type V, alpha 1 | EST, Weakly similar to CGHU1V collagen alpha 1(V) chain precursor [*H. sapiens*], *Homo sapiens* cDNA FLJ30442 fis, clone BRACE2009212, *Homo sapiens* proline-rich acidic protein mRNA, complete cds, *Mus musculus*, clone IMAGE:3490511, mRNA, partial cds, collagen, type V, alpha 1, collagen, type XI, alpha 1, endoplasmic reticulum |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1399 | 15438 | AI179399 | e, g | collagen, type V, alpha 2, procollagen, type V, alpha 2 | chaperone SIL1, homolog of yeast, hypothetical protein MGC2705, procollagen, type V, alpha 1, procollagen, type V, alpha 3, procollagen, type XI, alpha 1 EST, Weakly similar to CGHU2V collagen alpha 2(V) chain precursor [*H. sapiens*], EST, Weakly similar to I49607 procollagen type V alpha 2 - mouse [*M. musculus*], ESTs, Weakly similar to I49607 procollagen type V alpha 2 - mouse [*M. musculus*], ESTs, Weakly similar to S41067 collagen alpha 1(III) chain - rat [*R. norvegicus*], *Mus musculus*, Similar to putative protein phosphatase 1 nuclear targeting subunit, clone IMAGE:3157989, mRNA, partial cds, RIKEN cDNA 2810002D19 gene, collagen, type V, alpha 2, procollagen, type III, alpha 1, procollagen, type V, alpha 2 |
| 2050 | 21443 | NM_019262 | kk, ll | complement component 1, q subcomponent, beta polypeptide | |
| 2050 | 21444 | NM_019262 | jj, kk | complement component 1, q subcomponent, beta polypeptide | |
| 2304 | 1727 | NM_031642 | jj, kk | core promoter element binding protein | DNA segment, Chr 12, ERATO Doi 427, expressed, EST, Moderately similar to core promoter element binding protein [*Rattus norvegicus*] [*R. norvegicus*], ESTs, Weakly similar to core promoter element binding protein [*Rattus norvegicus*] [*R. norvegicus*], Kruppel-like factor 7 (ubiquitous), core promoter element binding protein |
| 2040 | 15347 | NM_019222 | ll | coronin, actin binding protein 1B, coronin, actin-binding protein, 1B | ESTs, Moderately similar to CO1B_RAT Coronin 1B (Coronin 2) [*R. norvegicus*], coronin 6, coronin, actin binding protein 1B, coronin, actin binding protein, 1C, coronin, actin binding protein, 1C, hypothetical protein DKFZp762I166 |
| 1739 | 4467 | NM_012529 | f, g | creatine kinase, brain | |
| 1739 | 4468 | NM_012529 | g | creatine kinase, brain | |
| 1742 | 20357 | NM_012534 | cc, dd | crystallin, alpha A | crystallin, alpha A, expressed sequence AI323437 |
| 1829 | 13723 | NM_012935 | aa, bb | crystallin, alpha B | ESTs, Moderately similar to T46637 transcription factor 1, neural - rat [*R. norvegicus*], ESTs, Weakly similar to A35804 nucleolin [*H. sapiens*], ESTs, Weakly similar to alpha-crystallin chain B [*M. musculus*], *Homo sapiens* mRNA; cDNA DKFZp434E0922 (from clone DKFZp434E0922), *Mus musculus* 10, 11 days embryo whole body cDNA, RIKEN full-length enriched library, clone:2810003I18:myelin transcription factor 1-like, full insert sequence, crystallin, alpha B, myelin transcription factor 1-like, nucleolin |
| 1830 | 487 | NM_012937 | n | crystallin, beta B2 | EST, Highly similar to CRB2_MOUSE BETA CRYSTALLIN B2 (BP) [*R. norvegicus*], EST, Weakly similar to A Chain A, The N-Terminal Domain Of Beta-B2-Crystallin Resembles The Putative Ancestral Homodimer [*M. musculus*], *Homo sapiens*, clone IMAGE:3542716, mRNA, partial cds, crystallin, beta B2 |
| 2312 | 8844 | NM_031690 | b | crystallin, beta B3 | absent in melanoma 1, absent in melanoma 1-like, crystallin, beta B3 |
| 2035 | 18572 | NM_019201 | n, o | C-terminal binding protein 1 | C-terminal binding protein 1, *Homo sapiens* mRNA; cDNA DKFZp434B0914 (from clone DKFZp434B0914); partial cds |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2035 | 18573 | NM_019201 | f, g | C-terminal binding protein 1 | C-terminal binding protein 1, *Homo sapiens* mRNA; cDNA DKFZp434B0914 (from clone DKFZp434B0914); partial cds |
| 1657 | 25041 | D14014 | f | cyclin D1, cyclin D1 (PRAD1: parathyroid adenomatosis 1) | EST, Moderately similar to JC2342 cyclin D1 - rat [*R. norvegicus*], cyclin D1, cyclin D1 (PRAD1: parathyroid adenomatosis 1) |
| 2677 | 24232 | X75207 | aa, bb | cyclin D1, cyclin D1 (PRAD1: parathyroid adenomatosis 1) | EST, Moderately similar to JC2342 cyclin D1 - rat [*R. norvegicus*], cyclin D1, cyclin D1 (PRAD1: parathyroid adenomatosis 1) |
| 1825 | 20757 | NM_012923 | cc, dd | cyclin G, cyclin G1 | ESTs, Weakly similar to CGG1_RAT Cyclin G1 (Cyclin G) [*R. norvegicus*], cyclin G, cyclin G2, cyclin I |
| 1468 | 14430 | AI230798 | r | cyclin-dependent kinase inhibitor 3 (CDK2-associated dual specificity phosphatase) | cyclin-dependent kinase inhibitor 3 (CDK2-associated dual specificity phosphatase) |
| 1804 | 2853 | NM_012838 | n, o | cystatin B, cystatin B (stefin B) | cystatin B, cystatin B (stefin B) |
| 1482 | 24327 | AI231292 | gg | cystatin C, cystatin C (amyloid angiopathy and cerebral hemorrhage) | ESTs, Moderately similar to CYTC MOUSE CYSTATIN C PRECURSOR [*M. musculus*], ESTs, Weakly similar to CYTC MOUSE CYSTATIN C PRECURSOR [*M. musculus*], RIKEN cDNA 1110017E11 gene, RIKEN cDNA 9230101F08 gene, cystatin C, cystatin C (amyloid angiopathy and cerebral hemorrhage), cystatin D, cystatin S, cystatin SA, cystatin SN |
| 2483 | 1892 | NM_057144 | a, o, x, ee, ff, kk | cysteine and glycine-rich protein 3 (cardiac LIM protein), cysteine-rich protein 3 | RIKEN cDNA 1200007O21 gene, cysteine and glycine-rich protein 3 (cardiac LIM protein), cysteine-rich protein 3 |
| 1968 | 14694 | NM_017202 | aa | cytochrome c oxidase subunit IV isoform 1, cytochrome c oxidase, subunit IVa | EST, Weakly similar to COX4_HUMAN CYTOCHROME C OXIDASE POLYPEPTIDE IV PRECURSO [*H. sapiens*], ESTs, Moderately similar to COX4_HUMAN CYTOCHROME C OXIDASE POLYPEPTIDE IV PRECURSO [*H. sapiens*], cytochrome c oxidase subunit IV isoform 1, cytochrome c oxidase, subunit IVa |
| 2383 | 21866 | NM_053472 | u, v | cytochrome c oxidase subunit IV isoform 2, cytochrome c oxidase, subunit IVb | cytochrome c oxidase subunit IV isoform 2, cytochrome c oxidase, subunit IVb |
| 1138 | 23574 | AI104520 | hh | cytochrome c oxidase subunit VIa polypeptide 1, cytochrome c oxidase, subunit VIa, polypeptide 1 | |
| 1743 | 20704 | NM_012541 | aa, bb | cytochrome P450, 1a2, aromatic compound inducible, cytochrome P450, subfamily I (aromatic compound-inducible), polypeptide 2 | cytochrome P450, 1a2, aromatic compound inducible, cytochrome P450, subfamily I (aromatic compound-inducible), polypeptide 2 |
| 1831 | 190 | NM_012940 | j, k | cytochrome P450, 1b1, benz[a]anthracene inducible, cytochrome P450, subfamily I (dioxin-inducible), polypeptide 1 (glaucoma 3, primary infantile) | cytochrome P450, 1b1, benz[a]anthracene inducible, cytochrome P450, subfamily I (dioxin-inducible), polypeptide 1 (glaucoma 3, primary infantile) |
| 2281 | 4010 | NM_031543 | u, v | cytochrome P450, 2e1, ethanol inducible, cytochrome P450, subfamily IIE (ethanol-inducible) | |
| 2281 | 4011 | NM_031543 | v | cytochrome P450, 2e1, ethanol inducible, cytochrome P450, subfamily IIE (ethanol-inducible) | |
| 1832 | 20928 | NM_012941 | l, m | cytochrome P450, 51, cytochrome P450, 51 (lanosterol 14-alpha-demethylase) | cytochrome P450, 51, cytochrome P450, 51 (lanosterol 14-alpha-demethylase) |
| 1708 | 20714 | M14972 | s, t | cytochrome P450, subfamily IVB, polypeptide 1, cytochrome P450, subfamily IVB, polypeptide 1 | EST, Moderately similar to I65981 fatty acid omega-hydroxylase [*H. sapiens*], *Mus musculus*, Similar to cytochrome P450, 4a10, clone MGC:18880 IMAGE:4237837, mRNA, complete cds, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1909 | 20921 | NM_016999 | s, t | cytochrome P450, subfamily IVB, polypeptide 1, cytochrome P450, subfamily IVB, polypeptide 1 | *Mus musculus,* Similar to cytochrome P450, 4a10, clone MGC:25972 IMAGE:4240359, mRNA, complete cds, RIKEN cDNA A230105L22 gene, cytochrome P450, 4a10, cytochrome P450, subfamily IVA, polypeptide 11, expressed sequence AI314743 EST, Moderately similar to I65981 fatty acid omega-hydroxylase [*H. sapiens*], *Mus musculus,* Similar to cytochrome P450, 4a10, clone MGC:18880 IMAGE:4237837, mRNA, complete cds, *Mus musculus,* Similar to cytochrome P450, 4a10, clone MGC:25972 IMAGE:4240359, mRNA, complete cds, RIKEN cDNA A230105L22 gene, cytochrome P450, 4a10, cytochrome P450, subfamily IVA, polypeptide 11, expressed sequence AI314743 |
| 1744 | 1762 | NM_012543 | f | D site albumin promoter binding protein, D site of albumin promoter (albumin D-box) binding protein | D site albumin promoter binding protein, D site of albumin promoter (albumin D-box) binding protein, RIKEN cDNA 2310028D20 gene |
| 1744 | 1763 | NM_012543 | hh | D site albumin promoter binding protein, D site of albumin promoter (albumin D-box) binding protein | D site albumin promoter binding protein, D site of albumin promoter (albumin D-box) binding protein, RIKEN cDNA 2310028D20 gene |
| 2174 | 17226 | NM_024131 | b, c, u, v | D-dopachrome tautomerase | D-dopachrome tautomerase, EST, Moderately similar to DOPD_HUMAN D-DOPACHROME TAUTOMERASE [*H. sapiens*] |
| 2174 | 17227 | NM_024131 | c | D-dopachrome tautomerase | D-dopachrome tautomerase, EST, Moderately similar to DOPD_HUMAN D-DOPACHROME TAUTOMERASE [*H. sapiens*] |
| 2691 | 18352 | Z12298 | aa, bb | decorin | RIKEN cDNA 5530600M07 gene, decorin, expressed sequence C85409, extracellular matrix protein 2, female organ and adipocyte specific |
| 2260 | 1638 | NM_031143 | d, e, ii, kk | diacylglycerol kinase zeta, diacylglycerol kinase, zeta (104 kD) | EST, Weakly similar to diacylglycerol kinase zeta [*Rattus norvegicus*] [*R. norvegicus*], ESTs, Highly similar to KDGA MOUSE DIACYLGLYCEROL KINASE, ALPHA [*M. musculus*], ESTs, Weakly similar to diacylglycerol kinase [*Rattus norvegicus*] [*R. norvegicus*], ESTs, Weakly similar to KDGA MOUSE DIACYLGLYCEROL KINASE, ALPHA [*M. musculus*], diacylglycerol kinase, alpha (80 kDa), diacylglycerol kinase, gamma 3, diacylglycerol kinase, iota, diacylglycerol kinase, zeta (104 kD) |
| 1 | 19424 | AA850922 | h, l | dimethylarginine dimethylaminohydrolase 1 | ESTs, Highly similar to DDH1_HUMAN NG,NG-DIMETHYLARGININE DIMETHYLAMINOHYDROLASE 1 [*H. sapiens*], ESTs, Weakly similar to dimethylarginine dimethylaminohydrolase 1; NG,NG dimethylarginine dimethylaminohydrolase [*Rattus norvegicus*] [*R. norvegicus*], dimethylarginine dimethylaminohydrolase 1, dimethylarginine dimethylaminohydrolase 2 |
| 3 | 19421 | AA945152 | bb | dimethylarginine dimethylaminohydrolase 1 | ESTs, Highly similar to DDH1_HUMAN NG,NG-DIMETHYLARGININE DIMETHYLAMINOHYDROLASE 1 [*H. sapiens*], ESTs, Weakly similar to dimethylarginine dimethylaminohydrolase 1; NG,NG dimethylarginine dimethylaminohydrolase [*Rattus norvegicus*] [*R. norvegicus*], dimethylarginine |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2104 | 19423 | NM_022297 | u, v | dimethylarginine dimethylaminohydrolase 1 | dimethylaminohydrolase 1, dimethylarginine dimethylaminohydrolase 2 ESTs, Highly similar to DDH1_HUMAN NG,NG-DIMETHYLARGININE DIMETHYLAMINOHYDROLASE 1 [*H. sapiens*], ESTs, Weakly similar to dimethylarginine dimethylaminohydrolase 1; NG,NG dimethylarginine dimethylaminohydrolase [*Rattus norvegicus*] [*R. norvegicus*], dimethylarginine dimethylaminohydrolase 1, dimethylarginine dimethylaminohydrolase 2 |
| 774 | 7785 | AI008758 | jj, kk | dipeptidylpeptidase 4, dipeptidylpeptidase IV (CD26, adenosine deaminase complexing protein 2) | ESTs, Weakly similar to DPP4 MOUSE DIPEPTIDYL PEPTIDASE IV [*M. musculus*], ESTs, Weakly similar to DPP4_RAT Dipeptidyl peptidase IV (DPP IV) (GP110 glycoprotein) (Bile canaliculus domain-specific membrane glycoprotein) [*R. norvegicus*], dipeptidylpeptidase 4, dipeptidylpeptidase 8, fibroblast activation protein, fibroblast activation protein, alpha |
| 153 | 6054 | AA818658 | p, q, ee, ff | diphtheria toxin receptor (heparin-binding epidermal growth factor-like growth factor), heparin binding epidermal growth factor-like growth factor | diphtheria toxin receptor (heparin-binding epidermal growth factor-like growth factor), heparin binding epidermal growth factor-like growth factor |
| 1833 | 223 | NM_012945 | a, p, q, ee, ff | diphtheria toxin receptor (heparin-binding epidermal growth factor-like growth factor), heparin binding epidermal growth factor-like growth factor | diphtheria toxin receptor (heparin-binding epidermal growth factor-like growth factor), heparin binding epidermal growth factor-like growth factor |
| 1796 | 1952 | NM_012788 | gg | discs, large (*Drosophila*) homolog 1, discs, large homolog 1 (*Drosophila*) | *Mus musculus* mRNA for mDLG6B, complete cds, discs, large (*Drosophila*) homolog 1, discs, large (*Drosophila*) homolog 5, discs, large homolog 1 (*Drosophila*), discs, large homolog 5 (*Drosophila*), guanylate kinase 1 |
| 1951 | 24106 | NM_017141 | s, t, bb | DNA polymerase beta, polymerase (DNA directed), beta | *Mus musculus,* Similar to DNA polymerase beta, clone MGC:6386 IMAGE:3581916, mRNA, complete cds, polymerase (DNA directed), beta |
| 1951 | 24107 | NM_017141 | ll | DNA polymerase beta, polymerase (DNA directed), beta | *Mus musculus,* Similar to DNA polymerase beta, clone MGC:6386 IMAGE:3581916, mRNA, complete cds, polymerase (DNA directed), beta |
| 1652 | 18686 | D00729 | g, hh | dodecenoyl-Coenzyme A delta isomerase (3,2 trans-enoyl-Coenzyme A isomerase), dodecenoyl-Coenzyme A delta isomerase (3,2 trans-enoyl-Coenzyme A isomerase) | dodecenoyl-Coenzyme A delta isomerase (3,2 trans-enoyl-Coenyme A isomerase), dodecenoyl-Coenzyme A delta isomerase (3,2 trans-enoyl-Coenzyme A isomerase) |
| 1999 | 18687 | NM_017306 | hh | dodecenoyl-Coenzyme A delta isomerase (3,2 trans-enoyl-Coenzyme A isomerase), dodecenoyl-Coenzyme A delta isomerase (3,2 trans-enoyl-Coenzyme A isomerase) | dodecenoyl-Coenzyme A delta isomerase (3,2 trans-enoyl-Coenyme A isomerase), dodecenoyl-Coenzyme A delta isomerase (3,2 trans-enoyl-Coenzyme A isomerase) |
| 1950 | 492 | NM_017140 | l, m, n, aa | dopamine receptor 3, dopamine receptor D3 | dopamine receptor 3, dopamine receptor D3 |
| 2218 | 1719 | NM_031024 | jj, kk | drebrin 1 | drebrin 1 |
| 2427 | 15996 | NM_053769 | cc, dd | dual specificity phosphatase 1, protein tyrosine phosphatase, non-receptor type 16 | *Mus musculus,* clone MGC:11703 IMAGE:3964527, mRNA, complete cds, RIKEN cDNA 2310076D10 gene, RIKEN cDNA 4930527G07 gene, dual specificity phosphatase 1, expressed |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1797 | 24113 | NM_012791 | e | dual-specificity tyrosine-(Y)-phosphorylation regulated kinase 1A, dual-specificity tyrosine-(Y)-phosphorylation regulated kinase 1a | sequence BB104621, protein tyrosine phosphatase, non-receptor type 16 ESTs, Moderately similar to DYRA_RAT Dual-specificity tyrosine-phosphorylation regulated kinase 1A (Protein kinase minibrain homolog) (MNBH) (RP86) (Dual specificity YAK1-related kinase) [R. norvegicus], ESTs, Weakly similar to DYRK MOUSE DUAL-SPECIFICITY TYROSINE-(Y)-PHOSPHORYLATION REGULATED KINASE [M. musculus], Mus musculus, clone MGC:6699 IMAGE:3584001, mRNA, complete cds, dual-specificity tyrosine-(Y)-phosphorylation regulated kinase 1A, dual-specificity tyrosine-(Y)-phosphorylation regulated kinase 1a |
| 1797 | 18135 | NM_012791 | e, gg, ll | dual-specificity tyrosine-(Y)-phosphorylation regulated kinase 1A, dual-specificity tyrosine-(Y)-phosphorylation regulated kinase 1a | ESTs, Moderately similar to DYRA_RAT Dual-specificity tyrosine-phosphorylation regulated kinase 1A (Protein kinase minibrain homolog) (MNBH) (RP86) (Dual specificity YAK1-related kinase) [R. norvegicus], ESTs, Weakly similar to DYRK MOUSE DUAL-SPECIFICITY TYROSINE-(Y)-PHOSPHORYLATION REGULATED KINASE [M. musculus], Mus musculus, clone MGC:6699 IMAGE:3584001, mRNA, complete cds, dual-specificity tyrosine-(Y)-phosphorylation regulated kinase 1A, dual-specificity tyrosine-(Y)-phosphorylation regulated kinase 1a |
| 2415 | 1118 | NM_053655 | u | dynamin 1-like | ESTs, Moderately similar to dynamin 2 [Mus musculus] [M. musculus], Mus musculus, Similar to KIAA0820 protein, clone MGC:37713 IMAGE:5066120, mRNA, complete cds, Mus musculus, Similar to dynamin 1-like, clone MGC:41233 IMAGE:1395338, mRNA, complete cds, dynamin 1-like, dynamin 2 |
| 1895 | 1693 | NM_013199 | gg | dynamin 2 | ESTs, Highly similar to A53165 dynamin II isoform aa - rat [R. norvegicus], ESTs, Moderately similar to dynamin 2 [Mus musculus] [M. musculus], Mus musculus, Similar to KIAA0820 protein, clone MGC:37713 IMAGE:5066120, mRNA, complete cds, Mus musculus, Similar to dynamin 1-like, clone MGC:41233 IMAGE:1395338, mRNA, complete cds, RIKEN cDNA 1200011N24 gene, dynamin 2 |
| 1775 | 425 | NM_012698 | hh | dystrophin (muscular dystrophy, Duchenne and Becker types), dystrophin, muscular dystrophy | dystrobrevin alpha, dystrobrevin, beta, utrophin |
| 1746 | 23868 | NM_012551 | a, h, l, p, q, y, z, ee, ff | early growth response 1 | early growth response 1, expressed sequence AI835008 |
| 1746 | 23869 | NM_012551 | a, h, l, p, q, y, z | early growth response 1 | early growth response 1, expressed sequence AI835008 |
| 1746 | 23871 | NM_012551 | p, q, y, z, ii | early growth response 1 | early growth response 1, expressed sequence AI835008 |
| 1746 | 23872 | NM_012551 | p, q, y, z | early growth response 1 | early growth response 1, expressed sequence AI835008 |
| 2020 | 16227 | NM_019137 | l, m | early growth response 4 | RIKEN cDNA 4930563M09 gene, early growth response 4 |
| 1450 | 23042 | AI230130 | s, t, ii | ectonucleoside triphosphate diphosphohydrolase 2 | ESTs, Weakly similar to CD39 MOUSE VASCULAR ATP-DIPHOSPHOHYDROLASE [M. musculus], RIKEN cDNA 2010320H07 gene, ecto-apyrase, ectonucleoside triphosphate diphosphohydrolase 1, ectonucleoside triphosphate diphosphohydrolase 3, lysosomal apyrase-like 1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2476 | 9528 | NM_057104 | r | ectonucleotide pyrophosphatase/phosphodi-esterase 2, ectonucleotide pyrophosphatase/phosphodi-esterase 2 (autotaxin) | ectonucleotide pyrophosphatase/phosphodiesterase 2, ectonucleotide pyrophosphatase/phosphodiesterase 2 (autotaxin) |
| 2067 | 1323 | NM_019371 | c, aa, bb, ii | EGL nine homolog 3 (*C. elegans*), egl nine homolog 3 (*C. elegans*) | EGL nine homolog 3 (*C. elegans*), ESTs, Moderately similar to A53770 growth factor-responsive protein, vascular smooth muscle - rat [*R. norvegicus*], ESTs, Weakly similar to A53770 growth factor-responsive protein, vascular smooth muscle - rat [*R. norvegicus*], *Mus musculus*, Similar to EGL nine homolog 3 (*C. elegans*), clone MGC:36685 IMAGE:5371854, mRNA, complete cds, egl nine homolog 1 (*C. elegans*), egl nine homolog 3 (*C. elegans*) |
| 2067 | 1324 | NM_019371 | f, g, aa, bb, kk | EGL nine homolog 3 (*C. elegans*), egl nine homolog 3 (*C. elegans*) | EGL nine homolog 3 (*C. elegans*), ESTs, Moderately similar to A53770 growth factor-responsive protein, vascular smooth muscle - rat [*R. norvegicus*], ESTs, Weakly similar to A53770 growth factor-responsive protein, vascular smooth muscle - rat [*R. norvegicus*], *Mus musculus*, Similar to EGL nine homolog 3 (*C. elegans*), clone MGC:36685 IMAGE:5371854, mRNA, complete cds, egl nine homolog 1 (*C. elegans*), egl nine homolog 3 (*C. elegans*) |
| 2143 | 20925 | NM_022594 | g, hh | enoyl Coenzyme A hydratase 1, peroxisomal, enoyl coenzyme A hydratase 1, peroxisomal | EST, Moderately similar to Peroxisomal enoyl hydratase-like protein; enoyl hydratase-like protein, peroxisomal [*Rattus norvegicus*] [*R. norvegicus*], enoyl Coenzyme A hydratase 1, peroxisomal, enoyl coenzyme A hydratase 1, peroxisomal |
| 2644 | 2464 | X13411 | u, v | Eph receptor B2, EphB2 | EST, Highly similar to putative protein-tyrosine kinase [*Homo sapiens*] [*H. sapiens*], Eph receptor B1, Eph receptor B2, Eph receptor B3, EphB1, expressed sequence AW456895, expressed sequence AW488255 |
| 1805 | 338 | NM_012843 | r | epithelial membrane protein 1 | epithelial membrane protein 1 |
| 1806 | 17541 | NM_012844 | c, d | epoxide hydrolase 1, microsomal, epoxide hydrolase 1, microsomal (xenobiotic) | epoxide hydrolase 1, microsomal, epoxide hydrolase 1, microsomal (xenobiotic) |
| 2362 | 24420 | NM_033539 | jj, kk, ll | eukaryotic translation elongation factor 1 alpha 2 | EST, Weakly similar to S21055 translation elongation factor eEF-1 alpha chain - rat [*R. norvegicus*], ESTs, Highly similar to EFHU1 translation elongation factor eEF-1 alpha-1 chain [*H. sapiens*], ESTs, Weakly similar to S21055 translation elongation factor eEF-1 alpha chain - rat [*R. norvegicus*], G1 to S phase transition 1, G1 to phase transition 1, G1 to phase transition 2, eukaryotic translation elongation factor 1 alpha 1 |
| 1980 | 17561 | NM_017245 | l, m | eukaryotic translation elongation factor 2 | ESTs, Highly similar to EF2_RAT Elongation factor 2 (EF-2) [*R. norvegicus*], ESTs, Weakly similar to EF2_MOUSE Elongation factor 2 (EF-2) [*M. musculus*], ESTs, Weakly similar to EF2_RAT Elongation factor 2 (EF-2) [*R. norvegicus*], G elongation factor, *Mus musculus*, Similar to elongation factor G2, clone MGC:28160 IMAGE:3984129, mRNA, complete cds, U5 small nuclear ribonucleoprotein 116 kDa, U5 snRNP-specific protein, 116 kD, eukaryotic translation elongation factor 2, expressed sequence AI451340 |
| 1980 | 17563 | NM_017245 | h, l | eukaryotic translation elongation factor 2 | ESTs, Highly similar to EF2_RAT Elongation factor 2 (EF-2) [*R. norvegicus*], ESTs, Weakly similar to |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | EF2_MOUSE Elongation factor 2 (EF-2) [*M. musculus*], ESTs, Weakly similar to EF2_RAT Elongation factor 2 (EF-2) [*R. norvegicus*], G elongation factor, *Mus musculus*, Similar to elongation factor G2, clone MGC:28160 IMAGE:3984129, mRNA, complete cds, U5 small nuclear ribonucleoprotein 116 kDa, U5 snRNP-specific protein, 116 kD, eukaryotic translation elongation factor 2, expressed sequence AI451340 |
| 1206 | 23152 | AI169170 | r | eukaryotic translation initiation factor 4A, isoform 2 | ESTs, Weakly similar to EUKARYOTIC INITIATION FACTOR 4A-II [*M. musculus*], eukaryotic translation initiation factor 4A, isoform 2 |
| 2075 | 18713 | NM_020075 | p, q, s, t | eukaryotic translation initiation factor 5 | DNA segment, Chr 1, ERATO Doi 692, expressed, ESTs, Highly similar to EUKARYOTIC TRANSLATION INITIATION FACTOR 5 [*R. norvegicus*], KIAA1856 protein, eukaryotic translation initiation factor 5 |
| 2075 | 18715 | NM_020075 | ee, ff | eukaryotic translation initiation factor 5 | DNA segment, Chr 1, ERATO Doi 692, expressed, ESTs, Highly similar to EUKARYOTIC TRANSLATION INITIATION FACTOR 5 [*R. norvegicus*], KIAA1856 protein, eukaryotic translation initiation factor 5 |
| 2184 | 16476 | NM_024162 | aa | fatty acid binding protein 3, muscle and heart, fatty acid binding protein 3, muscle and heart (mammary-derived growth inhibitor) | EST, Moderately similar to FABH MOUSE FATTY ACID-BINDING PROTEIN, HEART [*M. musculus*], fatty acid binding protein 3, muscle and heart, fatty acid binding protein 3, muscle and heart (mammary-derived growth inhibitor) |
| 431 | 20985 | AA893242 | ll | fatty acid Coenzyme A ligase, long chain 2, fatty-acid-Coenzyme A ligase, long-chain 2 | ESTs, Weakly similar to fatty acid Coenzyme A ligase, long chain 2; acetyl-Coenzyme A synthetase; acetate-CoA ligase; acetyl-Coenzyme A synthetase 1 (ADP forming); acetyl-CoA synthetase [*Mus musculus*] [*M. musculus*], *Mus musculus*, Similar to fatty-acid-Coenzyme A ligase, long-chain 6, clone MGC:28744 IMAGE:4481949, mRNA, complete cds, *Mus musculus*, Similar to hypothetical protein FLJ20920, clone MGC:25878 IMAGE:4210220, mRNA, complete cds, fatty acid Coenzyme A ligase, long chain 2, fatty acid Coenzyme A ligase, long chain 5, fatty-acid-Coenzyme A ligase, long-chain 1, gonadotropin-regulated long chain acyl-CoA synthetase, lipidosis-related protein lipidosin |
| 431 | 20986 | AA893242 | ll | fatty acid Coenzyme A ligase, long chain 2, fatty-acid-Coenzyme A ligase, long-chain 2 | ESTs, Weakly similar to fatty acid Coenzyme A ligase, long chain 2; acetyl-Coenzyme A synthetase; acetate-CoA ligase; acetyl-Coenzyme A synthetase 1 (ADP forming); acetyl-CoA synthetase [*Mus musculus*] [*M. musculus*], *Mus musculus*, Similar to fatty-acid-Coenzyme A ligase, long-chain 6, clone MGC:28744 IMAGE:4481949, mRNA, complete cds, *Mus musculus*, Similar to hypothetical protein FLJ20920, clone MGC:25878 IMAGE:4210220, mRNA, complete cds, fatty acid Coenzyme A ligase, long chain 2, fatty acid Coenzyme A ligase, long chain 5, fatty-acid-Coenzyme A ligase, long-chain 1, gonadotropin-regulated long chain acyl-CoA synthetase, lipidosis-related protein lipidosin |
| 972 | 20983 | AI044900 | a, h, l, ee, ff, kk | fatty acid Coenzyme A ligase, long chain 2, fatty-acid-Coenzyme A ligase, long-chain 2 | ESTs, Weakly similar to fatty acid Coenzyme A ligase, long chain 2; acetyl-Coenzyme A synthetase; acetate-CoA ligase; acetyl-Coenzyme A synthetase 1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1668 | 20984 | D90109 | ll | fatty acid Coenzyme A ligase, long chain 2, fatty-acid-Coenzyme A ligase, long-chain 2 | (ADP forming); acetyl-CoA synthetase [*Mus musculus*] [*M. musculus*], *Mus musculus,* Similar to fatty-acid-Coenzyme A ligase, long-chain 6, clone MGC:28744 IMAGE:4481949, mRNA, complete cds, *Mus musculus,* Similar to hypothetical protein FLJ20920 clone MGC:25878 IMAGE:4210220, mRNA, complete cds, fatty acid Coenzyme A ligase, long chain 2, fatty acid Coenzyme A ligase, long chain 5, fatty-acid-Coenzyme A ligase, long-chain 1, gonadotropin-regulated long chain acyl-CoA synthetase, lipidosis-related protein lipidosin ESTs, Weakly similar to fatty acid Coenzyme A ligase, long chain 2; acetyl-Coenzyme A synthetase; acetate-CoA ligase; acetyl-Coenzyme A synthetase 1 (ADP forming); acetyl-CoA synthetase [*Mus musculus*] [*M. musculus*], *Mus musculus,* Similar to fatty-acid-Coenzyme A ligase, long-chain 6, clone MGC:28744 IMAGE:4481949, mRNA, complete cds, *Mus musculus,* Similar to hypothetical protein FLJ20920, clone MGC:25878 IMAGE:4210220, mRNA, complete cds, fatty acid Coenzyme A ligase, long chain 2, fatty acid Coenzyme A ligase, long chain 5, fatty-acid-Coenzyme A ligase, long-chain 1, gonadotropin-regulated long chain acyl-CoA synthetase, lipidosis-related protein lipidosin |
| 2410 | 13005 | NM_053623 | j, k, y, z | fatty acid-Coenzyme A ligase, long chain 4, fatty-acid-Coenzyme A ligase, long-chain 4 | |
| 1319 | 10182 | AI176185 | p, q, gg | FBJ osteosarcoma oncogene, v-fos FBJ murine osteosarcoma viral oncogene homolog | FBJ murine osteosarcoma viral oncogene homolog B, FBJ osteosarcoma oncogene, FBJ osteosarcoma oncogene B, v-fos FBJ murine osteosarcoma viral oncogene homolog |
| 2641 | 10181 | X06769 | p, q | FBJ osteosarcoma oncogene, v-fos FBJ murine osteosarcoma viral oncogene homolog | FBJ murine osteosarcoma viral oncogene homolog B, FBJ osteosarcoma oncogene, FBJ osteosarcoma oncogene B, v-fos FBJ murine osteosarcoma viral oncogene homolog |
| 2440 | 20868 | NM_053843 | kk | Fc fragment of IgG, low affinity IIIa, receptor for (CD16), Fc receptor, IgG, low affinity III | |
| 2440 | 20869 | NM_053843 | w, x, kk | Fc fragment of IgG, low affinity IIIa, receptor for (CD16), Fc receptor, IgG, low affinity III | |
| 2359 | 12364 | NM_033351 | e, y, z, ee, ff | Fc fragment of IgG, receptor, transporter, alpha, Fc receptor, IgG, alpha chain transporter | Fc fragment of IgG, receptor, transporter, alpha, Fc receptor, IgG, alpha chain transporter |
| 2359 | 12365 | NM_033351 | e | Fc fragment of IgG, receptor, transporter, alpha, Fc receptor, IgG, alpha chain transporter | Fc fragment of IgG, receptor, transporter, alpha, Fc receptor, IgG, alpha chain transporter |
| 1944 | 21662 | NM_017126 | a, ee, ff | ferredoxin 1 | ferredoxin 1, similar to RIKEN cDNA B230118G17 gene |
| 1944 | 21663 | NM_017126 | a, h, l, p, q, y, z, ee, ff | ferredoxin 1 | ferredoxin 1, similar to RIKEN cDNA B230118G17 gene |
| 2119 | 8211 | NM_022500 | jj, kk | ferritin light chain 1, ferritin, light polypeptide | ESTs, Moderately similar to ferritin light chain 1 [*Rattus norvegicus*] [*R. norvegicus*], ESTs, Moderately similar to FRL2 MOUSE FERRITIN LIGHT CHAIN 2 [*M. musculus*], RIKEN cDNA |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2119 | 8212 | NM_022500 | h, l, kk, ll | ferritin light chain 1, ferritin, light polypeptide | 4933416E14 gene, ferritin light chain 1, ferritin light chain 2, ferritin, light polypeptide ESTs, Moderately similar to ferritin light chain 1 [*Rattus norvegicus*] [*R. norvegicus*], ESTs, Moderately similar to FRL2 MOUSE FERRITIN LIGHT CHAIN 2 [*M. musculus*], RIKEN cDNA 4933416E14 gene, ferritin light chain 1, ferritin light chain 2, ferritin, light polypeptide |
| 2600 | 8210 | S61960 | jj, kk | ferritin light chain 1, ferritin, light polypeptide | ESTs, Moderately similar to ferritin light chain 1 [*Rattus norvegicus*] [*R. norvegicus*], ESTs, Moderately similar to FRL2 MOUSE FERRITIN LIGHT CHAIN 2 [*M. musculus*], RIKEN cDNA 4933416E14 gene, ferritin light chain 1, ferritin light chain 2, ferritin, light polypeptide |
| 1747 | 6477 | NM_012559 | z | fibrinogen, gamma polypeptide | |
| 1747 | 6478 | NM_012559 | y, z | fibrinogen, gamma polypeptide | |
| 2091 | 20177 | NM_021867 | d, jj, kk | fibroblast growth factor 16 | fibroblast growth factor 16 |
| 1729 | 13489 | M91599 | cc, dd | fibroblast growth factor receptor 4 | |
| 2022 | 5618 | NM_019143 | s, t | fibronectin 1 | EST, Highly similar to FIBRONECTIN PRECURSOR [*R. norvegicus*], ESTs, Weakly similar to PROTEIN-TYROSINE PHOSPHATASE ETA PRECURSOR [*M. musculus*], fibronectin 1 |
| 2022 | 5622 | NM_019143 | n, o | fibronectin 1 | EST, Highly similar to FIBRONECTIN PRECURSOR [*R. norvegicus*], ESTs, Weakly similar to PROTEIN-TYROSINE PHOSPHATASE ETA PRECURSOR [*M. musculus*], fibronectin 1 |
| 2025 | 6451 | NM_019153 | f, g | fibulin 5 | |
| 1318 | 6782 | AI176170 | e | FK506 binding protein 1A (12 kD), FK506 binding protein 1a (12 kDa) | FK506 binding protein 10 (65 kDa), FK506 binding protein 1A (12 kD), FK506 binding protein 1a (12 kDa), FK506 binding protein 5, FK506 binding protein 7 (23 kDa), FK506 binding protein 8 (38 kDa) |
| 2155 | 24346 | NM_022701 | gg | flotillin 1 | flotillin 1 |
| 1696 | 25359 | L13202 | n, o | forkhead box D3 | |
| 2309 | 18403 | NM_031677 | d, jj, kk | four and a half LIM domains 2 | EST, Weakly similar to four and a half LIM domains 2 [*Rattus norvegicus*] [*R. norvegicus*], activator of CREM in testis, four and a half LIM domains 2, four and a half LIM domains 3, vascular Rab-GAP/TBC-containing |
| 2411 | 1228 | NM_053625 | j, k | G elongation factor, mitochondrial elongation factor G | |
| 2358 | 23715 | NM_033237 | j, k, y, z, jj, kk | galanin | |
| 2496 | 506 | NM_080586 | ii | gamma-aminobutyric acid (GABA) A receptor, gamma 1, gamma-aminobutyric acid (GABA-A) receptor, subunit gamma 1 | gamma-aminobutyric acid (GABA) A receptor, gamma 2, gamma-aminobutyric acid (GABA-A) receptor, subunit gamma 1 |
| 1749 | 482 | NM_012567 | s, t | gap junction membrane channel protein alpha 1, gap junction protein, alpha 1, 43 kD (connexin 43) | gap junction membrane channel protein alpha 1, gap junction protein, alpha 1, 43 kD (connexin 43) |
| 2051 | 1143 | NM_019280 | w, x | gap junction membrane channel protein alpha 5, gap junction protein, alpha 5, 40 kD (connexin 40) | gap junction membrane channel protein alpha 5, gap junction protein, alpha 5, 40 kD (connexin 40) |
| 2031 | 23481 | NM_019185 | aa, bb | GATA binding protein 6 | GATA binding protein 5, GATA binding protein 6 |
| 1934 | 1383 | NM_017088 | ll | GDP dissociation inhibitor 1, guanosine diphosphate (GDP) dissociation inhibitor 1 | GDP dissociation inhibitor 1, guanosine diphosphate (GDP) dissociation inhibitor 2 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2374 | 18949 | NM_053345 | ii | general transcription factor II A, 2 (12 kD subunit), general transcription factor IIA, 2 (12 kD subunit) | general transcription factor II A, 2 (12 kD subunit), general transcription factor IIA, 2 (12 kD subunit) |
| 1748 | 619 | NM_012565 | l, m, n, o | glucokinase, glucokinase (hexokinase 4, maturity onset diabetes of the young 2) | |
| 2293 | 5496 | NM_031589 | a, ee, ff | glucose-6-phosphatase, transport (glucose-6-phosphate) protein 1, glucose-6-phosphatase, transport protein 1 | Mus musculus, Similar to solute carrier family 37 (glycerol-3-phosphate transporter), member 1, clone MGC:28167 IMAGE:3985469, mRNA, complete cds, glucose-6-phosphatase, transport (glucose-6-phosphate) protein 1, glucose-6-phosphatase, transport protein 1, solute carrier family 37 (glycerol-3-phosphate transporter), member 1 |
| 2293 | 5497 | NM_031589 | ii | glucose-6-phosphatase, transport (glucose-6-phosphate) protein 1, glucose-6-phosphatase, transport protein 1 | Mus musculus, Similar to solute carrier family 37 (glycerol-3-phosphate transporter), member 1, clone MGC:28167 IMAGE:3985469, mRNA, complete cds, glucose-6-phosphatase, transport (glucose-6-phosphate) protein 1, glucose-6-phosphatase, transport protein 1, solute carrier family 37 (glycerol-3-phosphate transporter), member 1 |
| 2597 | 15693 | S56679 | aa, bb | glutamate receptor, ionotropic, AMPA 1, glutamate receptor, ionotropic, AMPA1 (alpha 1) | glutamate receptor, ionotropic, AMPA1, glutamate receptor, ionotropic, AMPA1 (alpha 1) |
| 1911 | 24676 | NM_017010 | aa, bb | glutamate receptor, ionotropic, N-methyl D-aspartate 1, glutamate receptor, ionotropic, NMDA1 (zeta 1) | |
| 1929 | 11152 | NM_017073 | c, s, t, kk | glutamate-ammonia ligase (glutamine synthase), glutamine synthetase | |
| 1929 | 11153 | NM_017073 | y, kk | glutamate-ammonia ligase (glutamine synthase), glutamine synthetase | |
| 1998 | 14004 | NM_017305 | aa, bb | glutamate-cysteine ligase, modifier subunit, glutamate-cysteine ligase, modifier subunit | glutamate-cysteine ligase, modifier subunit, glutamate-cysteine ligase, modifier subunit |
| 544 | 5206 | AA925755 | ll | glutaminase | ESTs, Highly similar to GLSK RAT GLUTAMINASE, KIDNEY ISOFORM PRECURSOR [R. norvegicus], ESTs, Moderately similar to GLSK_HUMAN GLUTAMINASE, KIDNEY ISOFORM, MITOCHONDRIAL PRECURSOR (GLS) (L-GLUTAMINE AMIDOHYDROLASE) (K-GLUTAMINASE) [H. sapiens], Homo sapiens glutaminase isoform M precursor, mRNA, complete cds, expressed sequence AI314027, glutaminase |
| 1150 | 23596 | AI105435 | bb | glutaryl-Coenzyme A dehydrogenase | expressed sequence AI266902, expressed sequence D17825, glutaryl-Coenzyme A dehydrogenase |
| 2202 | 1852 | NM_030826 | aa, gg | glutathione peroxidase 1 | ESTs, Weakly similar to GSHC_RAT Glutathione peroxidase (GSHPX-1) (Cellular glutathione peroxidase) [R. norvegicus], glutathione peroxidase 1, glutathione peroxidase 2, glutathione peroxidase 2 (gastrointestinal) |
| 1958 | 17686 | NM_017165 | hh | glutathione peroxidase 4, glutathione peroxidase 4 (phospholipid hydroperoxidase) | ESTs, Weakly similar to GSHH_RAT Phospholipid hydroperoxide glutathione peroxidase, mitochondrial precursor (PHGPx) (GPX-4) [R. norvegicus], RIKEN cDNA 2310016C16 gene, RIKEN cDNA 3110050F08 gene, glutathione peroxidase 4, glutathione peroxidase 4 (phospholipid hydroperoxidase) |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1912 | 21013 | NM_017014 | b | glutathione S-transferase M2 (muscle), glutathione S-transferase, mu 2 | |
| 1799 | 961 | NM_012796 | g | glutathione S-transferase theta 2, glutathione S-transferase, theta 2 | glutathione S-transferase theta 2, glutathione S-transferase, theta 2 |
| 1910 | 8417 | NM_017008 | aa | glyceraldehyde-3-phosphate dehydrogenase | ESTs, Moderately similar to G3P MOUSE GLYCERALDEHYDE 3-PHOSPHATE DEHYDROGENASE [*M. musculus*], Mus musculus 12 days embryo head cDNA, RIKEN full-length enriched library, clone:3000002C10:glyceraldehyde-3-phosphate dehydrogenase, full insert sequence, RIKEN cDNA 4930448K20 gene, glyceraldehyde-3-phosphate dehydrogenase |
| 1784 | 25650 | NM_012736 | d | glycerol phosphate dehydrogenase 1, mitochondrial, glycerol-3-phosphate dehydrogenase 2 (mitochondrial) | *Mus musculus* 10 days embryo whole body cDNA, RIKEN full-length enriched library, clone:2610001M21:glycerol phosphate dehydrogenase 1, mitochondrial, full insert sequence, glycerol phosphate dehydrogenase 1, mitochondrial, glycerol-3-phosphate dehydrogenase 2 (mitochondrial) |
| 2513 | 19456 | NM_133298 | h, l, w, x | glycoprotein (transmembrane) nmb | glycoprotein (transmembrane) nmb |
| 2513 | 4048 | NM_133298 | h, l, n, o, w, x | glycoprotein (transmembrane) nmb | glycoprotein (transmembrane) nmb |
| 2513 | 4049 | NM_133298 | c, h, l, n, o, w, x | glycoprotein (transmembrane) nmb | glycoprotein (transmembrane) nmb |
| 143 | 16756 | AA818089 | ll | glycyl-tRNA synthetase | glycyl-tRNA synthetase |
| 2203 | 21746 | NM_030828 | c | glypican 1 | glypican 1 |
| 2019 | 15975 | NM_019132 | ii | GNAS (guanine nucleotide binding protein, alpha stimulating) complex locus, GNAS complex locus | ESTs, Moderately similar to S34421 GTP-binding regulatory protein Gs alpha chain [*H. sapiens*], GNAS (guanine nucleotide binding protein, alpha stimulating) complex locus, GNAS complex locus, RIKEN cDNA 5530400H20 gene, Sang, XLas protein |
| 12 | 21152 | X14848 | bb | golgi SNAP receptor complex member 1 | *Homo sapiens*, Similar to golgi SNAP receptor complex member 1, clone MGC:13657 IMAGE:4250494, mRNA, complete cds, golgi SNAP receptor complex member 1 |
| 1941 | 20745 | NM_017113 | f, g | granulin | granulin |
| 1941 | 20746 | NM_017113 | j, cc, dd, gg | granulin | granulin |
| 2173 | 352 | NM_024127 | p, q | growth arrest and DNA-damage-inducible 45 alpha, growth arrest and DNA-damage-inducible, alpha | growth arrest and DNA-damage-inducible 45 alpha, growth arrest and DNA-damage-inducible 45 beta, growth arrest and DNA-damage-inducible, alpha |
| 2173 | 353 | NM_024127 | q, ee, ff, gg | growth arrest and DNA-damage-inducible 45 alpha, growth arrest and DNA-damage-inducible, alpha | growth arrest and DNA-damage-inducible 45 alpha, growth arrest and DNA-damage-inducible 45 beta, growth arrest and DNA-damage-inducible, alpha |
| 2173 | 354 | NM_024127 | p, q, ee, ff | growth arrest and DNA-damage-inducible 45 alpha, growth arrest and DNA-damage-inducible, alpha | growth arrest and DNA-damage-inducible 45 alpha, growth arrest and DNA-damage-inducible 45 beta, growth arrest and DNA-damage-inducible, alpha |
| 1026 | 17506 | AI070068 | p, q | growth arrest and DNA-damage-inducible, beta | growth arrest and DNA-damage-inducible 45 beta, growth arrest and DNA-damage-inducible, alpha, growth arrest and DNA-damage-inducible, beta |
| 2473 | 25290 | NM_057100 | d, u, v | growth arrest specific 6, growth arrest-specific 6 | ESTs, Highly similar to growth arrest specific 6 [*Rattus norvegicus*] [*R. norvegicus*], growth arrest specific 6, growth arrest-specific 6 |
| 2301 | 15767 | NM_031623 | aa, bb, jj, kk, ll | growth factor receptor bound protein 14, growth factor receptor-bound protein 14 | amyloid beta (A4) precursor protein-binding, family B, member 1 interacting protein, growth factor receptor bound protein 10, growth factor receptor bound protein 14, growth factor receptor-bound protein 10, growth factor receptor-bound protein 14 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1902 | 1396 | NM_013222 | d | growth factor, augmenter of liver regeneration (ERV1 homolog, S. cerevisiae), growth factor, erv1 (S. cerevisiae)-like (augmenter of liver regeneration) | growth factor, augmenter of liver regeneration (ERV1 homolog, S. cerevisiae), growth factor, ervi (S. cerevisiae)-like (augmenter of liver regeneration) |
| 815 | 17524 | AI010568 | jj, kk | growth hormone receptor | growth hormone receptor |
| 1936 | 10886 | NM_017094 | ii | growth hormone receptor | growth hormone receptor |
| 1936 | 10887 | NM_017094 | jj, kk | growth hormone receptor | growth hormone receptor |
| 1936 | 10888 | NM_017094 | e, r, hh | growth hormone receptor | growth hormone receptor |
| 2290 | 942 | NM_031577 | u | growth hormone releasing hormone | |
| 1807 | 1249 | NM_012850 | u, v | growth hormone releasing hormone receptor | growth hormone releasing hormone receptor |
| 2199 | 862 | NM_024487 | hh | GrpE-like 1, mitochondrial, GrpE-like protein cochaperone | |
| 2187 | 15349 | NM_024356 | a, y, z | GTP cyclohydrolase 1, GTP cyclohydrolase 1 (dopa-responsive dystonia) | GTP cyclohydrolase 1, GTP cyclohydrolase 1 (dopa-responsive dystonia) |
| 2187 | 15353 | NM_024356 | j, k, y, z, ii | GTP cyclohydrolase 1, GTP cyclohydrolase 1 (dopa-responsive dystonia) | GTP cyclohydrolase 1, GTP cyclohydrolase 1 (dopa-responsive dystonia) |
| 1296 | 19118 | AI175281 | hh | guanidinoacetate N-methyltransferase, guanidinoacetate methyltransferase | expressed sequence AA571402, guanidinoacetate N-methyltransferase, guanidinoacetate methyltransferase |
| 1798 | 16947 | NM_012793 | b, u, v, jj, kk | guanidinoacetate N-methyltransferase, guanidinoacetate methyltransferase | expressed sequence AA571402, guanidinoacetate N-methyltransferase, guanidinoacetate methyltransferase |
| 2220 | 690 | NM_031034 | w, x | guanine nucleotide binding protein (G protein) alpha 12, guanine nucleotide binding protein, alpha 12 | ESTs, Moderately similar to guanine nucleotide binding protein (G protein) alpha 12 [Rattus norvegicus] [R. norvegicus], guanine nucleotide binding protein (G protein), alpha 13, guanine nucleotide binding protein, alpha 12, guanine nucleotide binding protein, alpha 13 |
| 1870 | 19949 | NM_013106 | l, m | guanine nucleotide binding protein (G protein), alpha inhibiting activity polypeptide 3, guanine nucleotide binding protein, alpha inhibiting 3 | guanine nucleotide binding protein (G protein), alpha inhibiting activity polypeptide 3, guanine nucleotide binding protein, alpha inhibiting 3 |
| 139 | 2143 | AA817892 | r | guanine nucleotide binding protein (G protein), beta polypeptide 2, guanine nucleotide binding protein, beta 2 | ESTs, Weakly similar to C Chain C, Apaf-1 Card In Complex With Prodomain Of Procaspase-9 {SUB 1-95 [H. sapiens], Homo sapiens mRNA expressed only in placental villi, clone SMAP5, PWP2 periodic tryptophan protein homolog (yeast), Rattus norvegicus guanine nucleotide binding protein beta 4 subunit mRNA, partial cds, guanine nucleotide binding protein (G protein), beta polypeptide 2, guanine nucleotide binding protein, beta 2 |
| 2506 | 14959 | NM_130734 | w, x | guanine nucleotide binding protein (G protein), beta polypeptide 2-like 1, guanine nucleotide binding protein, beta 2, related sequence 1 | EST, Weakly similar to B33928 GTP-binding protein beta chain homolog [H. sapiens], EST, Weakly similar to GBLP_HUMAN GUANINE NUCLEOTIDE-BINDING PROTEIN BETA SUBUNIT-LIKE PROTEIN 12.3 [H. sapiens], Homo sapiens cDNA: FLJ21913 fis, clone HEP03888, Mus musculus, Similar to hypothetical protein FLJ10385, clone MGC:28622 IMAGE:4220923, mRNA, complete cds, expressed sequence AL033335, guanine nucleotide binding protein (G protein), beta polypeptide 1-like, guanine nucleotide binding protein (G protein), beta polypeptide 2-like 1, guanine nucleotide binding protein, beta 2, |
| 1250 | 14960 | AI171319 | w, x | guanine nucleotide binding protein (G protein), beta | EST, Weakly similar to B33928 GTP-binding protein beta chain homolog |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | polypeptide 2-like 1, guanine nucleotide binding protein, beta 2, related sequence 1 | [*H. sapiens*], EST, Weakly similar to GBLP__HUMAN GUANINE NUCLEOTIDE-BINDING PROTEIN BETA SUBUNIT-LIKE PROTEIN 12.3 [*H. sapiens*], *Homo sapiens* cDNA: FLJ21913 fis, clone HEP03888, *Mus musculus*, Similar to hypothetical protein FLJ10385, clone MGC:28622 IMAGE:4220923, mRNA, complete cds, SWI/SNF related, matrix associated, actin dependent regulator of chromatin, subfamily b, member 1, expressed sequence AL033335, guanine nucleotide binding protein (G protein), beta polypeptide 1-like, guanine nucleotide binding protein (G protein), beta polypeptide 2-like 1, guanine nucleotide binding protein, beta 2, related sequence |
| 2175 | 1879 | NM_024138 | l, m | guanine nucleotide binding protein (G protein), gamma 7, guanine nucleotide binding protein (G protein), gamma 7 subunit | guanine nucleotide binding protein (G protein), gamma 12, guanine nucleotide binding protein (G protein), gamma 7 |
| 1750 | 16025 | NM_012578 | p, q | H1 histone family, member 0 | H1 histone family, member 0, H1 histone family, member O (oocyte-specific) |
| 1750 | 16026 | NM_012578 | p, q, s, t, ee, ff | H1 histone family, member 0 | H1 histone family, member 0, H1 histone family, member O (oocyte-specific) |
| 1964 | 1488 | NM_017182 | h | H2A histone family, member Y | H2A histone family, member Y, RIKEN cDNA 4933432H23 gene |
| 2147 | 17661 | NM_022674 | d, gg | H2A histone family, member Z | EST, Weakly similar to histone H2A.F/Z variant [*Homo sapiens*] [*H. sapiens*], ESTs, Highly similar to S03644 histone H2A.Z - rat [*R. norvegicus*], ESTs, Weakly similar to H2AZ__HUMAN HISTONE H2A [*H. sapiens*], H2A histone family, member Z, *Homo sapiens* cDNA FLJ32241 fis, clone PLACE6005231, RIKEN cDNA C530002L11 gene, histone H2A.F/Z variant |
| 1834 | 5033 | NM_012966 | s, t | heat shock 10 kDa protein 1 (chaperonin 10), heat shock 10 kD protein 1 (chaperonin 10) | ESTs, Weakly similar to S47532 chaperonin groES [*H. sapiens*], expressed sequence AW108200, heat shock 10 kDa protein 1 (chaperonin 10), heat shock 10 kD protein 1 (chaperonin 10) |
| 1834 | 5034 | NM_012966 | ee, ff | heat shock 10 kDa protein 1 (chaperonin 10), heat shock 10 kD protein 1 (chaperonin 10) | ESTs, Weakly similar to S47532 chaperonin groES [*H. sapiens*], expressed sequence AW108200, heat shock 10 kDa protein 1 (chaperonin 10), heat shock 10 kD protein 1 (chaperonin 10) |
| 2505 | 11709 | NM_130431 | s | heat shock 27 kD protein 2 | EST, Moderately similar to heat shock 27 kD protein 2 [*Rattus norvegicus*] [*R. norvegicus*], heat shock 27 kD protein 2 |
| 1707 | 1466 | M14050 | e | heat shock 70 kD protein 5 (glucose-regulated protein, 78 kD) | EST, Weakly similar to GR78__RAT 78 KD GLUCOSE-REGULATED PROTEIN PRECURSOR (GRP 78) (IMMUNOGLOBULIN HEAVY CHAIN BINDING PROTEIN) (BIP) (STEROIDOGENESIS-ACTIVATOR POLYPEPTIDE) [*R. norvegicus*], expressed sequence AL022860, heat shock 70 kD protein 5 (glucose-regulated protein, 78 kD) |
| 2185 | 17764 | NM_024351 | e, p, r, ee, ff | heat shock 70 kD protein 8 | EST, Moderately similar to HS7C__HUMAN HEAT SHOCK COGNATE 71 KDA PROTEI [*H. sapiens*], EST, Weakly similar to A27077 dnaK-type molecular chaperone [*H. sapiens*], EST, Weakly similar to A45935 dnaK-type molecular chaperone hsc70 - mouse [*M. musculus*], ESTs, Moderately similar to HS7C MOUSE HEAT SHOCK COGNATE 71 KDA PROTEIN [*M. musculus*], ESTs, Weakly similar to HS7C MOUSE HEAT SHOCK |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2185 | 17765 | NM_024351 | e, p, q, r, ee, ff | heat shock 70 kD protein 8 | COGNATE 71 KDA PROTEIN [*M. musculus*], heat shock 70 kD protein 8 EST, Moderately similar to HS7C_HUMAN HEAT SHOCK COGNATE 71 KDA PROTEI [*H. sapiens*], EST, Weakly similar to A27077 dnaK-type molecular chaperone [*H. sapiens*], EST, Weakly similar to A45935 dnaK-type molecular chaperone hsc70 - mouse [*M. musculus*], ESTs, Moderately similar to HS7C MOUSE HEAT SHOCK COGNATE 71 KDA PROTEIN [*M. musculus*], ESTs, Weakly similar to HS7C MOUSE HEAT SHOCK COGNATE 71 KDA PROTEIN [*M. musculus*], heat shock 70 kD protein 8 |
| 1402 | 16081 | AI179610 | a, p, q, r, y, z, gg, kk | heme oxygenase (decycling) 1 | heme oxygenase (decycling) 1 |
| 1751 | 16080 | NM_012580 | p, q, y, z, kk | heme oxygenase (decycling) 1 | heme oxygenase (decycling) 1 |
| 1389 | 18907 | AI178971 | c, v | hemoglobin alpha, adult chain 2, hemoglobin, alpha 1 | EST, Moderately similar to HBA_RAT HEMOGLOBIN ALPHA-1 AND ALPHA-2 CHAINS [*R. norvegicus*], EST, Weakly similar to HBA_RAT HEMOGLOBIN ALPHA-1 AND ALPHA-2 CHAINS [*R. norvegicus*], ESTs, Moderately similar to HBA_RAT HEMOGLOBIN ALPHA-1 AND ALPHA-2 CHAINS [*R. norvegicus*], RIKEN cDNA 2510042H12 gene, hemoglobin alpha chain complex, hemoglobin alpha, adult chain 1, hemoglobin, alpha 1, hemoglobin, alpha 2, hemoglobin, theta 1 |
| 1406 | 1686 | AI179971 | c | hemoglobin alpha, adult chain 2, hemoglobin, alpha 1 | EST, Moderately similar to HBA_RAT HEMOGLOBIN ALPHA-1 AND ALPHA-2 CHAINS [*R. norvegicus*], EST, Weakly similar to HBA_RAT HEMOGLOBIN ALPHA-1 AND ALPHA-2 CHAINS [*R. norvegicus*], ESTs, Moderately similar to HBA_RAT HEMOGLOBIN ALPHA-1 AND ALPHA-2 CHAINS [*R. norvegicus*], RIKEN cDNA 2510042H12 gene, hemoglobin alpha chain complex, hemoglobin alpha, adult chain 1, hemoglobin, alpha 1, hemoglobin, alpha 2, hemoglobin, theta 1 |
| 1406 | 1687 | AI179971 | b, c, v | hemoglobin alpha, adult chain 2, hemoglobin, alpha 1 | EST, Moderately similar to HBA_RAT HEMOGLOBIN ALPHA-1 AND ALPHA-2 CHAINS [*R. norvegicus*], EST, Weakly similar to HBA_RAT HEMOGLOBIN ALPHA-1 AND ALPHA-2 CHAINS [*R. norvegicus*], ESTs, Moderately similar to HBA_RAT HEMOGLOBIN ALPHA-1 AND ALPHA-2 CHAINS [*R. norvegicus*], RIKEN cDNA 2510042H12 gene, hemoglobin alpha chain complex, hemoglobin alpha, adult chain 1, hemoglobin, alpha 1, hemoglobin, alpha 2, hemoglobin, theta 1 |
| 1869 | 1684 | NM_013096 | b, c, v | hemoglobin alpha, adult chain 2, hemoglobin, alpha 1 | EST, Moderately similar to HBA_RAT HEMOGLOBIN ALPHA-1 AND ALPHA-2 CHAINS [*R. norvegicus*], EST, Weakly similar to HBA_RAT HEMOGLOBIN ALPHA-1 AND ALPHA-2 CHAINS [*R. norvegicus*], ESTs, Moderately similar to HBA_RAT HEMOGLOBIN ALPHA-1 AND ALPHA-2 CHAINS [*R. norvegicus*], RIKEN cDNA 2510042H12 gene, hemoglobin alpha chain complex, hemoglobin alpha, adult chain 1, hemoglobin, alpha 1, hemoglobin, alpha 2, hemoglobin, theta 1 |
| 1869 | 1685 | NM_013096 | b, c, v | hemoglobin alpha, adult chain 2, hemoglobin, alpha 1 | EST, Moderately similar to HBA_RAT HEMOGLOBIN ALPHA-1 AND ALPHA-2 CHAINS [*R. norvegicus*], EST, Weakly |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | similar to HBA_RAT HEMOGLOBIN ALPHA-1 AND ALPHA-2 CHAINS [*R. norvegicus*], ESTs, Moderately similar to HBA_RAT HEMOGLOBIN ALPHA-1 AND ALPHA-2 CHAINS [*R. norvegicus*], RIKEN cDNA 2510042H12 gene, hemoglobin alpha chain complex, hemoglobin alpha, adult chain 1, hemoglobin, alpha 1, hemoglobin, alpha 2, hemoglobin, theta 1 |
| 1869 | 1688 | NM_013096 | c | hemoglobin alpha, adult chain 2, hemoglobin, alpha 1 | EST, Moderately similar to HBA_RAT HEMOGLOBIN ALPHA-1 AND ALPHA-2 CHAINS [*R. norvegicus*], EST, Weakly similar to HBA_RAT HEMOGLOBIN ALPHA-1 AND ALPHA-2 CHAINS [*R. norvegicus*], ESTs, Moderately similar to HBA_RAT HEMOGLOBIN ALPHA-1 AND ALPHA-2 CHAINS [*R. norvegicus*], RIKEN cDNA 2510042H12 gene, hemoglobin alpha chain complex, hemoglobin alpha, adult chain 1, hemoglobin, alpha 1, hemoglobin, alpha 2, hemoglobin, theta 1 |
| 1869 | 1689 | NM_013096 | b, c, v | hemoglobin alpha, adult chain 2, hemoglobin, alpha 1 | EST, Moderately similar to HBA_RAT HEMOGLOBIN ALPHA-1 AND ALPHA-2 CHAINS [*R. norvegicus*], EST, Weakly similar to HBA_RAT HEMOGLOBIN ALPHA-1 AND ALPHA-2 CHAINS [*R. norvegicus*], ESTs, Moderately similar to HBA_RAT HEMOGLOBIN ALPHA-1 AND ALPHA-2 CHAINS [*R. norvegicus*], RIKEN cDNA 2510042H12 gene, hemoglobin alpha chain complex, hemoglobin alpha, adult chain 1, hemoglobin, alpha 1, hemoglobin, alpha 2, hemoglobin, theta 1 |
| 305 | 18897 | AA875207 | t | hemoglobin beta chain complex, hemoglobin, beta | EST, Moderately similar to HBB1_RAT Hemoglobin beta chain, major-form [*R. norvegicus*], expressed sequence AI036344, hemoglobin, beta, hemoglobin, beta adult major chain, hemoglobin, beta adult minor chain, hemoglobin, delta |
| 839 | 17830 | AI011943 | c | hemoglobin beta chain complex, hemoglobin, beta | EST, Moderately similar to HBB1_RAT Hemoglobin beta chain, major-form [*R. norvegicus*], expressed sequence AI036344, hemoglobin, beta, hemoglobin, beta adult major chain, hemoglobin, beta adult minor chain, hemoglobin, delta |
| 2356 | 25468 | NM_033234 | b, c, v | hemoglobin beta chain complex, hemoglobin, beta | EST, Moderately similar to HBB1_RAT Hemoglobin beta chain, major-form [*R. norvegicus*], expressed sequence AI036344, hemoglobin, beta, hemoglobin, beta adult major chain, hemoglobin, beta adult minor chain, hemoglobin, delta |
| 2356 | 17829 | NM_033234 | c | hemoglobin beta chain complex, hemoglobin, beta | EST, Moderately similar to HBB1_RAT Hemoglobin beta chain, major-form [*R. norvegicus*], expressed sequence AI036344, hemoglobin, beta, hemoglobin, beta adult major chain, hemoglobin, beta adult minor chain, hemoglobin, delta |
| 2356 | 17832 | NM_033234 | b, c, v | hemoglobin beta chain complex, hemoglobin, beta | EST, Moderately similar to HBB1_RAT Hemoglobin beta chain, major-form [*R. norvegicus*], expressed sequence AI036344, hemoglobin, beta, hemoglobin, beta adult major chain, hemoglobin, beta adult minor chain, hemoglobin, delta |
| 875 | 6758 | AI013394 | d, jj, kk | heparan sulfate (glucosamine) 3-O-sulfotransferase 1 | EST, Highly similar to HSS2 MOUSE HEPARIN SULFATE N-DEACETYLASE/N-SULFOTRANSFERASE [*M. musculus*], |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | ESTs, Weakly similar to HSS2 MOUSE HEPARIN SULFATE N-DEACETYLASE/N-SULFOTRANSFERASE [*M. musculus*], ESTs, Weakly similar to HSS2_HUMAN HEPARIN SULFATE N-DEACETYLASE/N-SULFOTRANSFERASE [*H. sapiens*], N-deacetylase/N-sulfotransferase (heparan glucosaminyl) 2, N-deacetylase/N-sulfotransferase (heparan glucosaminyl) 3, N-deacetylase/N-sulfotransferase (heparin glucosaminyl) 4, N-deacetylase/N-sulfotransferase 4, RIKEN cDNA 4930439H17 gene, heparan sulfate (glucosamine) 3-O-sulfotransferase 3A, heparan sulfate (glucosamine) 3-O-sulfotransferase 4 |
| 1587 | 18151 | AI237212 | f, g, hh | hepatitis B virus x interacting protein | hepatitis B virus x interacting protein |
| 2269 | 4235 | NM_031330 | b, d, f, g, l, m | heterogeneous nuclear ribonucleoprotein A/B | DAZ associated protein 1, Musashi homolog 1 (*Drosophila*), Musashi homolog 2 (*Drosophila*), RIKEN cDNA 4933434H11 gene, expressed sequence AA959857, heterogeneous nuclear ribonucleoprotein A/B, musashi homolog 1 (*Drosophila*) |
| 1981 | 17501 | NM_017248 | l, m | heterogeneous nuclear ribonucleoprotein A1 | ESTs, Highly similar to I52962 FBRNP [*H. sapiens*], ESTs, Highly similar to heterogeneous ribonuclear particle protein A1 [*H. sapiens*], ESTs, Moderately similar to heterogeneous ribonuclear particle protein A1 [*H. sapiens*], ESTs, Weakly similar to ROA1_RAT Heterogeneous nuclear ribonucleoprotein A1 (Helix-destabilizing protein) (Single-strand binding protein) (hnRNP core protein A1) (HDP) [*R. norvegicus*], Homo sapiens cDNA: FLJ22720 fis, clone HSI14320, *Mus musculus*, Similar to TAR DNA binding protein, clone MGC:19284 IMAGE:4016437, mRNA, complete cds, RIKEN cDNA 4930547K05 gene, heterogeneous nuclear ribonucleoprotein A1 |
| 1981 | 17502 | NM_017248 | l, m | heterogeneous nuclear ribonucleoprotein A1 | ESTs, Highly similar to I52962 FBRNP [*H. sapiens*], ESTs, Highly similar to heterogeneous ribonuclear particle protein A1 [*H. sapiens*], ESTs, Moderately similar to heterogeneous ribonuclear particle protein A1 [*H. sapiens*], ESTs, Weakly similar to ROA1_RAT Heterogeneous nuclear ribonucleoprotein A1 (Helix-destabilizing protein) (Single-strand binding protein) (hnRNP core protein A1) (HDP) [*R. norvegicus*], Homo sapiens cDNA: FLJ22720 fis, clone HSI14320, *Mus musculus*, Similar to TAR DNA binding protein, clone MGC:19284 IMAGE:4016437, mRNA, complete cds, RIKEN cDNA 4930547K05 gene, heterogeneous nuclear ribonucleoprotein A1 |
| 2482 | 2413 | NM_057141 | b, g, n, o, u, v | heterogeneous nuclear ribonucleoprotein K | ESTs, Highly similar to heterogeneous nuclear ribonucleoprotein K, isoform b; dC-stretch binding protein; transformation upregulated nuclear protein [*Homo sapiens*] [*H. sapiens*], ESTs, Weakly similar to heterogeneous nuclear ribonucleoprotein K [*Rattus norvegicus*] [*R. norvegicus*], heterogeneous nuclear ribonucleoprotein K, poly(rC) binding protein 3, poly(rC) binding protein 4 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2482 | 2416 | NM_057141 | t | heterogeneous nuclear ribonucleoprotein K | ESTs, Highly similar to heterogeneous nuclear ribonucleoprotein K, isoform b; dC-stretch binding protein; transformation upregulated nuclear protein [*Homo sapiens*] [*H. sapiens*], ESTs, Weakly similar to heterogeneous nuclear ribonucleoprotein K [*Rattus norvegicus*] [*R. norvegicus*], heterogeneous nuclear ribonucleoprotein K, poly(rC) binding protein 3, poly(rC) binding protein 4 |
| 761 | 10108 | AI007857 | u, v | HGF-regulated tyrosine kinase substrate, hepatocyte growth factor-regulated tyrosine kinase substrate | ESTs, Weakly similar to HGF-regulated tyrosine kinase substrate [*Mus musculus*] [*M. musculus*], HGF-regulated tyrosine kinase substrate, RIKEN cDNA 1700013B03 gene, WD40- and FYVE-domain containing protein 2, hepatocyte growth factor-regulated tyrosine kinase substrate, myotubularin related protein 3, phosphoinositide-binding protein SR1, target of myb1 homolog (chicken), zinc finger protein, subfamily 2A (FYVE domain containing), 1 |
| 1942 | 1375 | NM_017122 | n, o | hippocalcin | ESTs, Highly similar to HIPP_HUMAN Neuron specific calcium-binding protein hippocalcin (P23K) (Calcium-binding protein BDR-2) [*R. norvegicus*], ESTs, Weakly similar to HIPP RAT NEURON SPECIFIC CALCIUM-BINDING PROTEIN HIPPOCALCIN [*M. musculus*], hippocalcin |
| 369 | 17345 | AA892014 | hh | HLA-B associated transcript 1, HLA-B-associated transcript 1A | ESTs, Highly similar to S33681 translation initiation factor eIF-4A.I [*H. sapiens*], ESTs, Weakly similar to A42811 nuclear RNA helicase (DEAD family) homolog - rat [*R. norvegicus*], RIKEN cDNA 2610307C23 gene, hypothetical protein MGC6664 |
| 1839 | 571 | NM_012982 | cc, dd | homeo box, msh-like 2, msh homeo box homolog 2 (*Drosophila*) | homeo box, msh-like 2, msh homeo box homolog 2 (*Drosophila*) |
| 2368 | 15748 | NM_053309 | ii | Homer, neuronal immediate early gene, 2, homer, neuronal immediate early gene, 2 | Homer, neuronal immediate early gene, 2, homer, neuronal immediate early gene, 1 |
| 1888 | 22306 | NM_013179 | aa, bb | hypocretin, hypocretin (orexin) neuropeptide precursor | hypocretin, hypocretin (orexin) neuropeptide precursor |
| 2188 | 1146 | NM_024359 | y, z | hypoxia inducible factor 1, alpha subunit, hypoxia-inducible factor 1, alpha subunit (basic helix-loop-helix transcription factor) | *Mus musculus* inhibitory PAS domain protein (Ipas) mRNA, complete cds, hypoxia inducible factor 1, alpha subunit, hypoxia-inducible factor 1, alpha subunit (basic helix-loop-helix transcription factor), neuronal PAS domain protein 1, single-minded 1, single-minded 2, single-minded homolog 1 (*Drosophila*) |
| 2302 | 21772 | NM_031624 | y, z | immunoglobulin (CD79A) binding protein 1 | expressed sequence C81413, immunoglobulin (CD79A) binding protein 1, immunoglobulin (CD79A) binding protein 1b |
| 1927 | 1427 | NM_017063 | hh | importin beta, karyopherin (importin) beta 1 | importin beta, karyopherin (importin) beta 1, karyopherin (importin) beta 3 |
| 1800 | 10248 | NM_012797 | b, j, k, s, t, u, jj, kk | inhibitor of DNA binding 1, inhibitor of DNA binding 1, dominant negative helix-loop-helix protein | |
| 1857 | 15253 | NM_013058 | n, o, s, t | inhibitor of DNA binding 3, inhibitor of DNA binding 3, dominant negative helix-loop-helix protein | |
| 2223 | 18188 | NM_031046 | gg | inositol 1,4,5-triphosphate receptor 2, inositol 1,4,5-triphosphate receptor, type 2 | ESTs, Highly similar to IP3R MOUSE INOSITOL 1,4,5-TRISPHOSPHATE-BINDING PROTEIN TYPE 1 RECEPTOR [*M. musculus*], ESTs, Moderately similar to IP3R MOUSE |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | INOSITOL 1,4,5-TRISPHOSPHATE-BINDING PROTEIN TYPE 1 RECEPTOR [*M. musculus*], ESTs, Weakly similar to IP3R MOUSE INOSITOL 1,4,5-TRISPHOSPHATE-BINDING PROTEIN TYPE 1 RECEPTOR [*M. musculus*], inositol 1,4,5-triphosphate receptor 1, inositol 1,4,5-triphosphate receptor 2, inositol 1,4,5-triphosphate receptor 5, inositol 1,4,5-triphosphate receptor, type 2, ryanodine receptor 2 (cardiac), ryanodine receptor 2, cardiac, ryanodine receptor 3 |
| 260 | 23336 | AA859981 | ee, ff, jj, kk | inositol(myo)-1(or 4)-monophosphatase 2 | ESTs, Moderately similar to A Chain A, Inositol Monophosphatase [*H. sapiens*], RIKEN cDNA 2900059K10 gene, inositol(myo)-1(or 4)-monophosphatase 1, inositol(myo)-1(or 4)-monophosphatase 2 |
| 2363 | 25072 | NM_052807 | j, k | insulin-like growth factor 1 receptor, insulin-like growth factor I receptor | EST, Highly similar to IG1R_MOUSE INSULIN-LIKE GROWTH FACTOR I RECEPTOR PRECURSOR [*M. musculus*], EST, Moderately similar to IG1R_MOUSE INSULIN-LIKE GROWTH FACTOR I RECEPTOR PRECURSOR [*M. musculus*], ESTs, Highly similar to IG1R_MOUSE INSULIN-LIKE GROWTH FACTOR I RECEPTOR PRECURSOR [*M. musculus*], insulin receptor-related receptor, insulin-like growth factor 1 receptor, insulin-like growth factor I receptor |
| 1754 | 15098 | NM_012588 | bb | insulin-like growth factor binding protein 3 | insulin-like growth factor binding protein 3 |
| 1356 | 14989 | AI177366 | f, g, l, m, kk | integrin beta 1 (fibronectin receptor beta), integrin, beta 1 (fibronectin receptor, beta polypeptide, antigen CD29 includes MDF2, MSK12) | integrin beta 1 (fibronectin receptor beta), integrin beta 2, integrin beta 7, integrin, beta 1 (fibronectin receptor, beta polypeptide, antigen CD29 includes MDF2, MSK12), integrin, beta 2 (antigen CD18 (p95), lymphocyte function-associated antigen 1; macrophage antigen 1 (mac-1) beta subunit), integrin, beta 7 |
| 1835 | 2555 | NM_012967 | a, y, z, kk | intercellular adhesion molecule, intercellular adhesion molecule 1 (CD54), human rhinovirus receptor | ESTs, Weakly similar to ICA1_HUMAN INTERCELLULAR ADHESION MOLECULE-1 PRECURSOR [*H. sapiens*], intercellular adhesion molecule, intercellular adhesion molecule 1 (CD54), human rhinovirus receptor, intercellular adhesion molecule 3, intercellular adhesion molecule 5, telencephalin |
| 2017 | 20318 | NM_019127 | n, o | interferon beta, fibroblast, interferon, beta 1, fibroblast | interferon beta, fibroblast, interferon, beta 1, fibroblast |
| 2044 | 17908 | NM_019242 | a, p, q, y, z, bb, ee, ff | interferon-related developmental regulator 1 | ESTs, Weakly similar to IFR1_RAT INTERFERON-RELATED DEVELOPMENTAL REGULATOR 1 (NERVE GROWTH FACTOR-INDUCIBLE PROTEIN PC4) (IRPR) [*R. norvegicus*], interferon-related developmental regulator 1, interferon-related developmental regulator 2 |
| 2516 | 657 | NM_133380 | j, k, y, z | interleukin 4 receptor, interleukin 4 receptor, alpha | colony stimulating factor 2 receptor, beta 1, low-affinity (granulocyte-macrophage), interleukin 4 receptor, interleukin 4 receptor, alpha |
| 1914 | 6598 | NM_017020 | j, k | interleukin 6 receptor, interleukin 6 receptor, alpha | interleukin 6 receptor |
| 1755 | 24716 | NM_012589 | j, k, p, q | interleukin 6, interleukin 6 (interferon, beta 2) | |
| 2158 | 202 | NM_022863 | h, l | iron responsive element binding protein 2, iron-responsive element binding protein 2 | |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2275 | 17427 | NM_031510 | b, u, v | isocitrate dehydrogenase 1 (NADP+), soluble | ESTs, Highly similar to IDHC_RAT ISOCITRATE DEHYDROGENASE [NADP] CYTOPLASMIC (OXALOSUCCINATE DECARBOXYLASE) (IDH) (NADP+-SPECIFIC ICDH) (IDP) [R. norvegicus], expressed sequence AI788952, isocitrate dehydrogenase 1 (NADP+), soluble, isocitrate dehydrogenase 2 (NADP+), mitochondrial |
| 1756 | 4450 | NM_012592 | c | isovaleryl Coenzyme A dehydrogenase, isovaleryl coenzyme A dehydrogenase | ESTs, Moderately similar to IVD_HUMAN ISOVALERYL-COA DEHYDROGENASE, MITOCHONDRIAL PRECURSOR [H. sapiens], isovaleryl Coenzyme A dehydrogenase, isovaleryl coenzyme A dehydrogenase |
| 2276 | 12580 | NM_031514 | a, h, l, j, k, y, z | Janus kinase 2, Janus kinase 2 (a protein tyrosine kinase) | ESTs, Weakly similar to JC4127 protein-tyrosine kinase (EC 2.7.1.112) - rat [R. norvegicus], Janus kinase 1, Janus kinase 1 (a protein tyrosine kinase), Janus kinase 2, Janus kinase 2 (a protein tyrosine kinase), expressed sequence AI504024, expressed sequence C81284, tyrosine kinase 2 |
| 2276 | 12581 | NM_031514 | y, z, hh | Janus kinase 2, Janus kinase 2 (a protein tyrosine kinase) | ESTs, Weakly similar to JC4127 protein-tyrosine kinase (EC 2.7.1.112) - rat [R. norvegicus], Janus kinase 1, Janus kinase 1 (a protein tyrosine kinase), Janus kinase 2, Janus kinase 2 (a protein tyrosine kinase), expressed sequence AI504024, expressed sequence C81284, tyrosine kinase 2 |
| 2038 | 2632 | NM_019213 | cc, dd | jumping translocation breakpoint | ESTs, Highly similar to jumping translocation breakpoint [Rattus norvegicus] [R. norvegicus], ESTs, Moderately similar to jumping translocation breakpoint [Rattus norvegicus] [R. norvegicus], jumping translocation breakpoint |
| 2089 | 22351 | NM_021835 | ee, ff | Jun oncogene, v-jun sarcoma virus 17 oncogene homolog (avian) | Jun oncogene, v-jun sarcoma virus 17 oncogene homolog (avian) |
| 2330 | 15864 | NM_031797 | r | kangai 1 (suppression of tumorigenicity 6, prostate), kangai 1 (suppression of tumorigenicity 6, prostate; CD82 antigen (R2 leukocyte antigen, antigen detected by monoclonal and antibody IA4)) | kangai 1 (suppression of tumorigenicity 6, prostate), kangai 1 (suppression of tumorigenicity 6, prostate; CD82 antigen (R2 leukocyte antigen, antigen detected by monoclonal and antibody IA4)), tetraspan 1 |
| 2390 | 14380 | NM_053536 | e, y, z | Kruppel-like factor 15 | |
| 2489 | 8641 | NM_057211 | bb | Kruppel-like factor 9, basic transcription element binding protein 1 | ESTs, Moderately similar to Kruppel-like factor 9 [Rattus norvegicus] [R. norvegicus], Kruppel-like factor 9, basic transcription element binding protein 1, expressed sequence AL022736 |
| 1915 | 17807 | NM_017025 | h, l | lactate dehydrogenase 1, A chain, lactate dehydrogenase A | lactate dehydrogenase 1, A chain, lactate dehydrogenase A, lactate dehydrogenase A-like, lactate dehydrogenase C |
| 1757 | 7125 | NM_012595 | aa, bb | lactate dehydrogenase 2, B chain, lactate dehydrogenase B | lactate dehydrogenase 2, B chain, lactate dehydrogenase B |
| 873 | 20086 | AI013260 | z | lamin A, lamin A/C | |
| 1949 | 24885 | NM_017138 | h, l, w, x | laminin receptor 1 (67 kD, ribosomal protein SA) | EST, Weakly similar to 1405340A protein 40 kD [M. musculus], EST, Weakly similar to RSP4 MOUSE 40S RIBOSOMAL PROTEIN SA [M. musculus], ESTs, Highly similar to A31233 ribosomal protein RS.40K, cytosolic [H. sapiens], ESTs, Moderately similar to laminin-binding protein [H. sapiens], expressed sequence AL022858, laminin receptor 1 (67 kD, ribosomal protein SA) |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1949 | 24886 | NM_017138 | h, l, w, x | laminin receptor 1 (67 kD, ribosomal protein SA) | EST, Weakly similar to 1405340A protein 40 kD [*M. musculus*], EST, Weakly similar to RSP4 MOUSE 40S RIBOSOMAL PROTEIN SA [*M. musculus*], ESTs, Highly similar to A31233 ribosomal protein RS.40K, cytosolic [*H. sapiens*], ESTs, Moderately similar to laminin-binding protein [*H. sapiens*], expressed sequence AL022858, laminin receptor 1 (67 kD, ribosomal protein SA) |
| 1836 | 22434 | NM_012974 | l, m | laminin, beta 2, laminin, beta 2 (laminin S) | ESTs, Weakly similar to LMB2_HUMAN LAMININ BETA-2 CHAIN PRECURSOR [*H. sapiens*], *Rattus norvegicus* laminin-5 alpha 3 chain mRNA, complete cds, expressed sequence AW211941, expressed sequence C80098, hypothetical protein BC018697, laminin B1 subunit 1, laminin, beta 1, laminin, beta 2, laminin, beta 2 (laminin S), laminin, beta 4 |
| 1836 | 22435 | NM_012974 | c | laminin, beta 2, laminin, beta 2 (laminin S) | ESTs, Weakly similar to LMB2_HUMAN LAMININ BETA-2 CHAIN PRECURSOR [*H. sapiens*], *Rattus norvegicus* laminin-5 alpha 3 chain mRNA, complete cds, expressed sequence AW211941, expressed sequence C80098, hypothetical protein BC018697, laminin B1 subunit 1, laminin, beta 1, laminin, beta 2, laminin, beta 2 (laminin S), laminin, beta 4 |
| 2335 | 22321 | NM_031832 | a, h, l, n, o, x, kk | lectin, galactose binding, soluble 3, lectin, galactoside-binding, soluble, 3 (galectin 3) | EST, Weakly similar to A35820 galectin 3 [*H. sapiens*], galectin-related inter-fiber protein, lectin, galactoside-binding, soluble, 3 (galectin 3) |
| 602 | 22283 | AA945172 | e | leucine aminopeptidase 3 | aminopeptidase-like 1, leucine aminopeptidase 3 |
| 2369 | 7207 | NM_053326 | hh | LIM protein (similar to rat protein kinase C-binding enigma), enigma homolog (*R. norvegicus*) | LIM and senescent cell antigen-like domains 1, LIM and senescent cell antigen-like domains 1-like, LIM protein (similar to rat protein kinase C-binding enigma), RIKEN cDNA 1110003B01 gene, enigma (LIM domain protein), enigma homolog (*R. norvegicus*), leupaxin |
| 1781 | 25563 | NM_012732 | f, g | lipase A, lysosomal acid, cholesterol esterase (Wolman disease), lysosomal acid lipase 1 | ESTs, Weakly similar to cholesterol esterase (pancreatic), see D3Wox12, D3Wox13, D3Wox26 and D3Mgh25 [*Rattus norvegicus*] [*R. norvegicus*], lipase A, lysosomal acid, cholesterol esterase (Wolman disease), lysosomal acid lipase 1 |
| 1781 | 16613 | NM_012732 | g | lipase A, lysosomal acid, cholesterol esterase (Wolman disease), lysosomal acid lipase 1 | ESTs, Weakly similar to cholesterol esterase (pancreatic), see D3Wox12, D3Wox13, D3Wox26 and D3Mgh25 [*Rattus norvegicus*] [*R. norvegicus*], lipase A, lysosomal acid, cholesterol esterase (Wolman disease), lysosomal acid lipase 1 |
| 1758 | 18387 | NM_012598 | w, x | lipoprotein lipase | ESTs, Highly similar to JH0790 lipoprotein lipase (EC 3.1.1.34) precursor - rat [*R. norvegicus*], lipase, endothelial, lipoprotein lipase |
| 1758 | 18386 | NM_012598 | w, x | lipoprotein lipase | ESTs, Highly similar to JH0790 lipoprotein lipase (EC 3.1.1.34) precursor - rat [*R. norvegicus*], Lipoprotein lipase, lipase, endothelial, lipoprotein lipase |
| 2375 | 9352 | NM_053347 | u, v | LIS1-interacting protein NUDE1, rat homolog, nuclear distribution gene E homolog (*Aspergillus*) | |
| 217 | 21713 | AA851637 | e, r | Lutheran blood group (Auberger b antigen included) | Lutheran blood group (Auberger b antigen included) |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1808 | 18770 | NM_012857 | hh | lysosomal membrane glycoprotein 1, lysosomal-associated membrane protein 1 | CD68 antigen, ESTs, Weakly similar to LMP1_RAT LYSOSOME-ASSOCIATED MEMBRANE GLYCOPROTEIN 1 PRECURSOR (LAMP-1) (120 KD LYSOSOMAL MEMBRANE GLYCOPROTEIN) (LGP-120) (CD107A) [R. norvegicus], chromosome 20 open reading frame 103, lysosomal membrane glycoprotein 1, lysosomal-associated membrane protein 1, lysosomal associated membrane protein 3 |
| 1928 | 6653 | NM_017068 | d | lysosomal membrane glycoprotein 2, lysosomal-associated membrane protein 2 | CD68 antigen, ESTs, Weakly similar to JC4317 lysosome-associated membrane protein 2 precursor, splice form B [H. sapiens], lysosomal membrane glycoprotein 2, lysosomal-associated membrane protein 2 |
| 1928 | 6654 | NM_017068 | b, v | lysosomal membrane glycoprotein 2, lysosomal-associated membrane protein 2 | CD68 antigen, ESTs, Weakly similar to JC4317 lysosome-associated membrane protein 2 precursor, splice form B [H. sapiens], lysosomal membrane glycoprotein 2, lysosomal-associated membrane protein 2 |
| 410 | 12118 | AA892775 | a, n, x | lysozyme, lysozyme (renal amyloidosis) | EST, Weakly similar to LYC1_RAT Lysozyme C, type 1 precursor (1,4-beta-N-acetylmuramidase C) [R. norvegicus], RIKEN cDNA 9530003J23 gene, lysozyme, lysozyme (renal amyloidosis), similar to lysozyme C-1 (1,4-beta-N-acylmuramidase C, EC 3.2.1.17) |
| 1926 | 1942 | NM_017061 | f, ll | lysyl oxidase | ESTs, Moderately similar to LYOX_HUMAN PROTEIN-LYSINE 6-OXIDASE PRECURSOR [H. sapiens], ESTs, Moderately similar to LYOX_RAT Protein-lysine 6-oxidase precursor (Lysyl oxidase) [R. norvegicus], ESTs, Weakly similar to LYOX_RAT Protein-lysine 6-oxidase precursor (Lysyl oxidase) [R. norvegicus], lysyl oxidase, lysyl oxidase-like, lysyl oxidase-like 1, lysyl oxidase-like 2 |
| 1926 | 1943 | NM_017061 | s, t | lysyl oxidase | ESTs, Moderately similar to LYOX_HUMAN PROTEIN-LYSINE 6-OXIDASE PRECURSOR [H. sapiens], ESTs, Moderately similar to LYOX_RAT Protein-lysine 6-oxidase precursor (Lysyl oxidase) [R. norvegicus], ESTs, Weakly similar to LYOX_RAT Protein-lysine 6-oxidase precursor (Lysyl oxidase) [R. norvegicus], lysyl oxidase, lysyl oxidase-like, lysyl oxidase-like 1, lysyl oxidase-like 2 |
| 2033 | 15244 | NM_019191 | ll | MAD homolog 2 (Drosophila), MAD, mothers against decapentaplegic homolog 2 (Drosophila) | MAD homolog 2 (Drosophila), MAD, mothers against decapentaplegic homolog 2 (Drosophila) |
| 1809 | 13151 | NM_012862 | n, o, ll | matrix Gla protein, matrix gamma-carboxyglutamate (gla) protein | EST, Weakly similar to MGP_HUMAN MATRIX GLA-PROTEIN PRECURSOR [H. sapiens], ESTs, Highly similar to MGP_HUMAN MATRIX GLA-PROTEIN PRECURSOR [H. sapiens], matrix Gla protein, matrix gamma-carboxyglutamate (gla) protein |
| 2615 | 16675 | U17565 | r, ii | MCM6 minichromosome maintenance deficient 6 (MIS5 homolog, S. pombe) (S. cerevisiae), mini chromosome maintenance deficient 6 (S. cerevisiae) | EST, Weakly similar to MCM5_HUMAN DNA REPLICATION LICENSING FACTOR MCM5 [H. sapiens], ESTs, Weakly similar to MCM6_HUMAN DNA REPLICATION LICENSING FACTOR MCM6 [H. sapiens], MCM2 minichromosome maintenance deficient 2, mitotin (S. cerevisiae), MCM6 minichromosome maintenance deficient 6 (MIS5 homolog, S. pombe) (S. cerevisiae), mini chromosome maintenance deficient 2 (S. cerevisiae), |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | mini chromosome maintenance deficient 5 (*S. cerevisiae*), mini chromosome maintenance deficient 6 (*S. cerevisiae*), mini chromosome maintenance deficient 7 (*S. cerevisiae*) |
| 2675 | 25737 | X70667 | l, m | melanocortin 3 receptor | |
| 344 | 19321 | AA891666 | cc, dd | melanoma antigen, family D, 1 | RIKEN cDNA 1700056A17 gene, RIKEN cDNA 1700080O16 gene, RIKEN cDNA 2410003J06 gene, RIKEN cDNA 3830417A13 gene, melanoma antigen, family D, 1, melanoma antigen, family L, 2 |
| 2494 | 2541 | NM_080479 | aa, bb | melanoma antigen, family D, 2 | RIKEN cDNA 2010107K23 gene, RIKEN cDNA 5730494G16 gene, general transcription factor II H, polypeptide 1 (62 kD subunit), melanoma antigen, family B, 3, melanoma antigen, family D, 2, melanoma antigen, family E, 1 |
| 1877 | 5837 | NM_013143 | cc, dd | meprin 1 alpha, meprin A, alpha (PABA peptide hydrolase) | expressed sequence AI098089, meprin 1 alpha, meprin A, alpha (PABA peptide hydrolase) |
| 1954 | 17287 | NM_017149 | ii | mesenchyme homeo box 2 (growth arrest-specific homeo box), mesenchyme homeobox 2 | homeo box A11, mesenchyme homeo box 1, mesenchyme homeo box 2 (growth arrest-specific homeo box), mesenchyme homeobox 1, mesenchyme homeobox 2 |
| 2550 | 15189 | NM_138826 | j, k, y, z, ee, ff, kk | metallothionein 1, metallothionein 1A (functional) | EST, Moderately similar to Cd-7 Metallothionein-2 [*H. sapiens*], EST, Moderately similar to SMHU1E metallothionein 1E [*H. sapiens*], ESTs, Moderately similar to MT1_RAT METALLOTHIONEIN-I (MT-I) [*R. norvegicus*], metallothionein 1, metallothionein 4, metallothionein IV |
| 2550 | 15190 | NM_138826 | j, k, y, z, ii | metallothionein 1, metallothionein 1A (functional) | EST, Moderately similar to Cd-7 Metallothionein-2 [*H. sapiens*], EST, Moderately similar to SMHU1E metallothionein 1E [*H. sapiens*], ESTs, Moderately similar to MT1_RAT METALLOTHIONEIN-I (MT-I) [*R. norvegicus*], metallothionein 1, metallothionein 4, metallothionein IV |
| 2142 | 20762 | NM_022588 | r, s, t | metastasis associated 1 | ESTs, Highly similar to metastasis associated 1 [*Rattus norvegicus*] [*R. norvegicus*], ESTs, Weakly similar to metastasis associated 1 [*Rattus norvegicus*] [*R. norvegicus*], KIAA1266 protein, KIAA1610 protein, metastasis associated 1, metastasis associated 1-like 1, metastasis associated 3, metastasis-associated 1-like 1 |
| 1970 | 13938 | NM_017212 | jj, kk | microtubule-associated protein tau | |
| 1970 | 13940 | NM_017212 | a | microtubule-associated protein tau | |
| 2510 | 17564 | NM_133283 | hh | mitogen activated protein kinase kinase 2, mitogen-activated protein kinase kinase 2 | |
| 2300 | 14957 | NM_031622 | f | mitogen-activated protein kinase 6 | ESTs, Weakly similar to B40033 protein kinase (EC 2.7.1.37) ERK3 - rat [*R. norvegicus*], mitogen-activated protein kinase 4, mitogen-activated protein kinase 6 |
| 536 | 16499 | AA925300 | p, ee, ff, gg | mitogen-activated protein kinase kinase kinase 3 | ESTs, Highly similar to M3K3 MOUSE MITOGEN-ACTIVATED PROTEIN KINASE KINASE KINASE 3 [*M. musculus*], ESTs, Moderately similar to S12207 hypothetical protein [*M. musculus*], ESTs, Weakly similar to M3K3_HUMAN MITOGEN-ACTIVATED PROTEIN KINASE KINASE KINASE 3 [*H. sapiens*], hypothetical protein FLJ23074, mitogen activated protein kinase kinase kinase 1, mitogen activated protein kinase kinase kinase 2, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | mitogen activated protein kinase kinase kinase 3, mitogen-activated protein kinase kinase kinase 2, mitogen-activated protein kinase kinase kinase 3 |
| 2156 | 58 | NM_022715 | u, v | Mitral valve prolapse, familial, major vault protein | |
| 2036 | 21508 | NM_019208 | ii | multiple endocrine neoplasia 1, multiple endocrine neoplasia I | multiple endocrine neoplasia 1, multiple endocrine neoplasia I |
| 1152 | 15291 | AI111401 | hh | multiple inositol polyphosphate histidine phosphatase 1, multiple inositol polyphosphate histidine phosphatase, 1 | |
| 2034 | 21421 | NM_019196 | ll | multiple PDZ domain protein | ESTs, Highly similar to multiple PDZ domain protein [Mus musculus] [M. musculus], ESTs, Weakly similar to T30259 multiple PDZ domain protein - mouse [M. musculus], ESTs, Weakly similar to T46612 multi PDZ domain protein 1 - rat [R. norvegicus], Homo sapiens cDNA FLJ25282 fis, clone STM06685, highly similar to Rattus norvegicus mRNA for multi PDZ domain protein, RIKEN cDNA 2810455B10 gene, channel-interacting PDZ domain protein, multiple PDZ domain protein |
| 2306 | 17448 | NM_031668 | h, l | MYB binding protein (P160) 1a | |
| 1759 | 2628 | NM_012603 | a, p, q, y, z | myelocytomatosis oncogene, v-myc myelocytomatosis viral oncogene homolog (avian) | myelocytomatosis oncogene, v-myc myelocytomatosis viral oncogene homolog (avian) |
| 1759 | 2629 | NM_012603 | a, j, k, p, q, y, z, ee, ff, kk | myelocytomatosis oncogene, v-myc myelocytomatosis viral oncogene homolog (avian) | myelocytomatosis oncogene, v-myc myelocytomatosis viral oncogene homolog (avian) |
| 1978 | 1498 | NM_017239 | d | myosin heavy chain, cardiac muscle, adult, myosin, heavy polypeptide 6, cardiac muscle, alpha (cardiomyopathy, hypertrophic 1) | EST, Weakly similar to MYH6_RAT Myosin heavy chain, cardiac muscle alpha isoform (MyHC-alpha) [R. norvegicus], ESTs, Moderately similar to MYOSIN HEAVY CHAIN, CARDIAC MUSCLE ALPHA ISOFORM [M. musculus], ESTs, Weakly similar to MYSA_HUMAN MYOSIN HEAVY CHAIN, CARDIAC MUSCLE ALPHA ISOFORM [H. sapiens], KIAA1000 protein, myosin heavy chain, cardiac muscle, adult, myosin, heavy polypeptide 2, skeletal muscle, adult, myosin, heavy polypeptide 4, skeletal muscle, myosin, heavy polypeptide 7, cardiac muscle, beta |
| 1979 | 20482 | NM_017240 | c, g | myosin heavy chain, cardiac muscle, adult, myosin, heavy polypeptide 6, cardiac muscle, alpha (cardiomyopathy, hypertrophic 1), myosin, heavy polypeptide 7, cardiac muscle, beta | EST, Highly similar to MYH7_RAT Myosin heavy chain, cardiac muscle beta isoform (MyHC-beta) [R. norvegicus], ESTs, Moderately similar to MYOSIN HEAVY CHAIN, CARDIAC MUSCLE ALPHA ISOFORM [M. musculus], ESTs, Weakly similar to MYHB_MOUSE MYOSIN HEAVY CHAIN, SMOOTH MUSCLE ISOFORM (SMMHC) [M. musculus], ESTs, Weakly similar to PCNT MOUSE PERICENTRIN [M. musculus], RIKEN cDNA 4932408L24 gene, myosin heavy chain, cardiac muscle, adult, myosin heavy chain-like, myosin, heavy polypeptide 2, skeletal muscle, adult, myosin, heavy polypeptide 4, skeletal muscle, myosin, heavy polypeptide 7, cardiac muscle, beta |
| 1979 | 20483 | NM_017240 | d | myosin heavy chain, cardiac muscle, adult, myosin, heavy polypeptide 6, cardiac muscle, alpha (cardiomyopathy, | EST, Highly similar to MYH7_RAT Myosin heavy chain, cardiac muscle beta isoform (MyHC-beta) [R. norvegicus], ESTs, Moderately similar to MYOSIN HEAVY CHAIN, CARDIAC |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | hypertrophic 1), myosin, heavy polypeptide 7, cardiac muscle, beta | MUSCLE ALPHA ISOFORM [*M. musculus*], ESTs, Weakly similar to MYHB_MOUSE MYOSIN HEAVY CHAIN, SMOOTH MUSCLE ISOFORM (SMMHC) [*M. musculus*], ESTs, Weakly similar to PCNT MOUSE PERICENTRIN [*M. musculus*], RIKEN cDNA 4932408L24 gene, myosin heavy chain, cardiac muscle, adult, myosin heavy chain-like, myosin, heavy polypeptide 2, skeletal muscle, adult, myosin, heavy polypeptide 4, skeletal muscle, myosin, heavy polypeptide 7, cardiac muscle, beta |
| 1979 | 20484 | NM_017240 | e | myosin heavy chain, cardiac muscle, adult, myosin, heavy polypeptide 6, cardiac muscle, alpha (cardiomyopathy, hypertrophic 1), myosin, heavy polypeptide 7, cardiac muscle, beta | EST, Highly similar to MYH7_RAT Myosin heavy chain, cardiac muscle beta isoform (MyHC-beta) [*R. norvegicus*], ESTs, Moderately similar to MYOSIN HEAVY CHAIN, CARDIAC MUSCLE ALPHA ISOFORM [*M. musculus*], ESTs, Weakly similar to MYHB_MOUSE MYOSIN HEAVY CHAIN, SMOOTH MUSCLE ISOFORM (SMMHC) [*M. musculus*], ESTs, Weakly similar to PCNT MOUSE PERICENTRIN [*M. musculus*], RIKEN cDNA 4932408L24 gene, myosin heavy chain, cardiac muscle, adult, myosin heavy chain-like, myosin, heavy polypeptide 2, skeletal muscle, adult, myosin, heavy polypeptide 4, skeletal muscle, myosin, heavy polypeptide 7, cardiac muscle, beta |
| 1978 | 1497 | NM_017239 | d | myosin heavy chain, cardiac muscle, adult, myosin, heavy polypeptide 6, cardiac muscle, alpha (cardiomyopathy, hypertrophic 1), myosin, heavy polypeptide 7, cardiac muscle, beta | EST, Weakly similar to MYH6_RAT Myosin heavy chain, cardiac muscle alpha isoform (MyHC-alpha) [*R. norvegicus*], ESTs, Moderately similar to MYOSIN HEAVY CHAIN, CARDIAC MUSCLE ALPHA ISOFORM [*M. musculus*], ESTs, Weakly similar to MYSA_HUMAN MYOSIN HEAVY CHAIN, CARDIAC MUSCLE ALPHA ISOFORM [*H. sapiens*], KIAA1000 protein, myosin heavy chain, cardiac muscle, adult, myosin, heavy polypeptide 2, skeletal muscle, adult, myosin, heavy polypeptide 4, skeletal muscle, myosin, heavy polypeptide 7, cardiac muscle, beta |
| 2463 | 17653 | NM_053986 | cc, dd | myosin IB | EST, Highly similar to MY1A_RAT Myosin IA (Myosin I alpha) (MMI-alpha) (MMIa) (Myosin heavy chain myr 1) [*R. norvegicus*], EST, Weakly similar to MYOSIN I ALPHA [*M. musculus*], *Mus musculus* adult male small intestine cDNA, RIKEN full-length enriched library, clone:2010010B23:myosin, heavy polypeptide-like (110 kD), full insert sequence, myosin IB |
| 470 | 24329 | AA899253 | aa, bb | myristoylated alanine rich protein kinase C substrate, myristoylated alanine-rich protein kinase C substrate | *Mus musculus* 8 days embryo whole body cDNA, RIKEN full-length enriched library, clone:5730519L10:myristoylated alanine rich protein kinase C substrate, full insert sequence, myristoylated alanine rich protein kinase C substrate, myristoylated alanine-rich protein kinase C substrate |
| 2041 | 20938 | NM_019223 | hh | NADH dehydrogenase (ubiquinone) Fe—S protein 6 (13 kD) (NADH-coenzyme Q reductase), NADH dehydrogenase Fe—S protein 6 | ESTs, Highly similar to NUMM MOUSE NADH-UBIQUINONE OXIDOREDUCTASE 13 KD-A SUBUNIT [*M. musculus*], NADH dehydrogenase (ubiquinone) Fe—S protein 6 (13 kD) (NADH-coenzyme Q reductase) |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2282 | 18389 | NM_031545 | a, d, y, ee, ff | natriuretic peptide precursor B, natriuretic peptide precursor type B | EST, Moderately similar to ANFB MOUSE BRAIN NATRIURETIC PEPTIDE PRECURSOR [M. musculus], natriuretic peptide precursor B, natriuretic peptide precursor type B |
| 1762 | 638 | NM_012613 | aa, bb | natriuretic peptide receptor 1, natriuretic peptide receptor A/guanylate cyclase A (atrionatriuretic peptide receptor A) | ESTs, Weakly similar to ATRIAL NATRIURETIC PEPTIDE RECEPTOR A PRECURSOR [M. musculus], Mus musculus, Similar to natriuretic peptide receptor 2, clone IMAGE:5052434, mRNA, partial cds, natriuretic peptide receptor 1, natriuretic peptide receptor A/guanylate cyclase A (atrionatriuretic peptide receptor A) |
| 1761 | 1298 | NM_012610 | d | nerve growth factor receptor, nerve growth factor receptor (TNFR superfamily, member 16) | Mus musculus, clone IMAGE:5097359, mRNA, partial cds, nerve growth factor receptor, nerve growth factor receptor (TNFR superfamily, member 16), p75-like apoptosis-inducing death domain protein PLAIDD |
| 1761 | 1299 | NM_012610 | cc, dd | nerve growth factor receptor, nerve growth factor receptor (TNFR superfamily, member 16) | Mus musculus, clone IMAGE:5097359, mRNA, partial cds, nerve growth factor receptor, nerve growth factor receptor (TNFR superfamily, member 16), p75-like apoptosis-inducing death domain protein PLAIDD |
| 1945 | 24522 | NM_017130 | u, v | neuraminidase 2, sialidase 2 (cytosolic sialidase) | neuraminidase 2, sialidase 2 (cytosolic sialidase) |
| 2441 | 1780 | NM_053846 | u, v | neurexin 2, neurexin II | ESTs, Highly similar to C40228 neurexin II-alpha precursor - rat [R. norvegicus], ESTs, Moderately similar to NX1A_MOUSE_2 [Segment 2 of 2] Neurexin 1-alpha (Neurexin I-alpha) (Fragments) [M. musculus], ESTs, Weakly similar to NX1A_MOUSE_1 [Segment 1 of 2] Neurexin 1-alpha (Neurexin I-alpha) (Fragments) [M. musculus], RIKEN cDNA 4933401A11 gene, chondroitin sulfate proteoglycan 4 |
| 2298 | 19022 | NM_031609 | s, t, jj, kk | neuroblastoma, suppression of tumorigenicity 1 | dante, neuroblastoma, suppression of tumorigenicity 1 |
| 2098 | 20450 | NM_022239 | b, l, m, u, v | neuromedin, neuromedin U | neuromedin, neuromedin U |
| 1763 | 24506 | NM_012614 | c | neuropeptide Y | RIKEN cDNA 0710005A05 gene, neuropeptide Y |
| 2047 | 24849 | NM_019248 | aa, bb | neurotrophic tyrosine kinase, receptor, type 3 | neurotrophic tyrosine kinase, receptor, type 3 |
| 2629 | 1715 | U72660 | a, jj, kk | ninjurin 1 | ninjurin 1, ninjurin 2 |
| 1649 | 20127 | AJ011116 | j, k, n, o | nitric oxide synthase 3 (endothelial cell), nitric oxide synthase 3, endothelial cell | ESTs, Moderately similar to A Chain A, Human Endothelial Nitric Oxide Synthase With Arginine Substrate {SUB 66-492 [H. sapiens], Homo sapiens cDNA FLJ14885 fis, clone PLACE1003711, nitric oxide synthase 3 (endothelial cell), nitric oxide synthase 3, endothelial cell |
| 1840 | 764 | NM_012988 | ee, ff | nuclear factor I/A | nuclear factor I/A, nuclear factor I/B, nuclear factor I/C, nuclear factor I/X, nuclear factor I/X (CCAAT-binding transcription factor) |
| 743 | 17963 | AB012231 | jj, kk | nuclear factor I/B | Nuclear Factor IA, nuclear factor I/A, nuclear factor I/B, nuclear factor I/C, nuclear factor I/X, nuclear factor I/X (CCAAT-binding transcription factor) |
| 1331 | 24763 | AI176488 | jj, kk | nuclear factor I/B | Nuclear Factor IA, nuclear factor I/A, nuclear factor I/B, nuclear factor I/C, nuclear factor I/X, nuclear factor I/X (CCAAT-binding transcription factor) |
| 2670 | 25090 | X63594 | j, k | nuclear factor of kappa light chain gene enhancer in B-cells inhibitor, alpha, nuclear factor of kappa light polypeptide gene enhancer in B-cells inhibitor, alpha | |
| 2058 | 24674 | NM_019328 | j, k | nuclear receptor subfamily 4, group A, member 2 | nuclear receptor subfamily 4, group A, member 2 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2303 | 567 | NM_031628 | p, q | nuclear receptor subfamily 4, group A, member 3 | nuclear receptor subfamily 4, group A, member 3 |
| 755 | 18731 | AF093139 | d | nuclear RNA export factor 1, nuclear RNA export factor 1 homolog (*S. cerevisiae*) | |
| 299 | 4339 | AA875121 | jj, kk | nuclear transcription factor Y, gamma, nuclear transcription factor-Y gamma | |
| 1810 | 4338 | NM_012866 | u, v | nuclear transcription factor Y, gamma, nuclear transcription factor-Y gamma | |
| 1841 | 17394 | NM_012992 | hh, kk | nucleophosmin (nucleolar phosphoprotein B23, numatrin), nucleophosmin 1 | ESTs, Highly similar to A32915 nucleophosmin [*H. sapiens*], nucleophosmin 1 |
| 752 | 16006 | AF062594 | gg | nucleosome assembly protein 1-like 1 | ESTs, Highly similar to 2008109A set gene [*Rattus norvegicus*] [*R. norvegicus*], ESTs, Highly similar to SET_HUMAN SET PROTEIN [*H. sapiens*], SET translocation, SET translocation (myeloid leukemia-associated), nucleosome assembly protein 1-like 1 |
| 752 | 16007 | AF062594 | hh | nucleosome assembly protein 1-like 1 | ESTs, Highly similar to 2008109A set gene [*Rattus norvegicus*] [*R. norvegicus*], ESTs, Highly similar to SET_HUMAN SET PROTEIN [*H. sapiens*], SET translocation, SET translocation (myeloid leukemia-associated), nucleosome assembly protein 1-like 1 |
| 926 | 7665 | AI030668 | a | nucleosome assembly protein 1-like 1 | ESTs, Highly similar to 2008109A set gene [*Rattus norvegicus*] [*R. norvegicus*], ESTs, Highly similar to SET_HUMAN SET PROTEIN [*H. sapiens*], SET translocation, SET translocation (myeloid leukemia-associated), nucleosome assembly protein 1-like 1 |
| 1862 | 13283 | NM_013078 | b | ornithine carbamoyltransferase, ornithine transcarbamylase | ornithine carbamoyltransferase, ornithine transcarbamylase |
| 2141 | 21062 | NM_022585 | gg | ornithine decarboxylase antizyme inhibitor | ESTs, Weakly similar to ODCI_MOUSE Ornithine decarboxylase antizyme inhibitor [*M. musculus*], ornithine decarboxylase antizyme inhibitor |
| 2141 | 21063 | NM_022585 | f, y, z | ornithine decarboxylase antizyme inhibitor | ESTs, Weakly similar to ODCI_MOUSE Ornithine decarboxylase antizyme inhibitor [*M. musculus*], ornithine decarboxylase antizyme inhibitor |
| 2333 | 15840 | NM_031817 | h, l | osteomodulin | osteoglycin, osteomodulin |
| 2515 | 4318 | NM_133306 | p, q | oxidised low density lipoprotein (lectin-like) receptor 1, oxidized low density lipoprotein (lectin-like) receptor 1 | ESTs, Weakly similar to JE0111 lectin-like oxidized LDL receptor - mouse [*M. musculus*], Mus musculus NKRP1F mRNA, complete cds, killer cell lectin-like receptor subfamily B member 1A, killer cell lectin-like receptor subfamily B member 1B, killer cell lectin-like receptor subfamily B member 1C, killer cell lectin-like receptor subfamily B member 1D, oxidised low density lipoprotein (lectin-like) receptor 1, oxidized low density lipoprotein (lectin-like) receptor 1 |
| 1690 | 20549 | K01701 | b | oxytocin, oxytocin, prepro- (neurophysin I) | ESTs, Moderately similar to NEU1 MOUSE OXYTOCIN-NEUROPHYSIN 1 PRECURSOR [*M. musculus*], oxytocin, oxytocin, prepro- (neurophysin I) |
| 2289 | 1918 | NM_031576 | gg | P450 (cytochrome) oxidoreductase | |
| 2289 | 1920 | NM_031576 | s | P450 (cytochrome) oxidoreductase | |
| 2289 | 1921 | NM_031576 | j, k, s, t | P450 (cytochrome) oxidoreductase | |
| 1843 | 24263 | NM_012999 | f | paired basic amino acid cleaving system 4, proprotein convertase subtilisin/kexin type 6 | EST, Highly similar to I53282 gene PACE4 protein - rat [*R. norvegicus*], RIKEN cDNA A930029K19 gene, paired basic amino acid cleaving system 4, proprotein convertase subtilisin/kexin type 6 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1843 | 24264 | NM_012999 | g | paired basic amino acid cleaving system 4, proprotein convertase subtilisin/kexin type 6 | EST, Highly similar to I53282 gene PACE4 protein - rat [R. norvegicus], RIKEN cDNA A930029K19 gene, paired basic amino acid cleaving system 4, proprotein convertase subtilisin/kexin type 6 |
| 2046 | 11218 | NM_019247 | b, u, v | paired-like homeodomain transcription factor 3 | ESTs, Weakly similar to PIX3_RAT Pituitary homeobox 3 (Homeobox protein PTX3) [R. norvegicus], RIKEN cDNA 1600026O01 gene, diencephalon/mesencephalon-expressed brain homeobox 1, newborn ovary homeobox gene, paired-like homeodomain transcription factor 3 |
| 2066 | 18819 | NM_019367 | l, m | palmitoyl-protein thioesterase 2 | palmitoyl-protein thioesterase 2 |
| 2066 | 18820 | NM_019367 | s, t | palmitoyl-protein thioesterase 2 | palmitoyl-protein thioesterase 2 |
| 2014 | 1581 | NM_017365 | l, p, q, s, t | PDZ and LIM domain 1 (elfin) | EST, Moderately similar to CL36_HUMAN LIM DOMAIN PROTEIN CLP-36 [H. sapiens], ESTs, Weakly similar to PDL1_RAT PDZ and LIM domain protein 1 (LIM domain protein CLP-36) (C-terminal LIM domain protein 1) (Elfin) [R. norvegicus], Mus musculus, clone MGC:37634 IMAGE:4990983, mRNA, complete cds, PDZ and LIM domain 1 (elfin), PDZ and LIM domain 3, Rattus norvegicus LIM-domain protein LMP-1 mRNA, complete cds, actinin alpha 2 associated LIM protein |
| 1974 | 18148 | NM_017226 | n, o | peptidyl arginine deiminase, type II | ESTs, Highly similar to PROTEIN-ARGININE DEIMINASE [M. musculus], peptidyl arginine deiminase, type II |
| 1974 | 15108 | NM_017226 | u, v | peptidyl arginine deiminase, type II | ESTs, Highly similar to PROTEIN-ARGININE DEIMINASE [M. musculus], peptidyl arginine deiminase, type II, ribosomal protein S18 |
| 1939 | 4391 | NM_017101 | s, t | peptidylprolyl isomerase A, peptidylprolyl isomerase A (cyclophilin A) | EST, Moderately similar to A Chain A, Cyclophilin A [H. sapiens], ESTs, Highly similar to CYPH MOUSE PEPTIDYL-PROLYL CIS-TRANS ISOMERASE A [M. musculus], ESTs, Moderately similar to A Chain A, Human Cyclophilin A Complexed With 2-Thr Cyclosporin [H. sapiens], ESTs, Weakly similar to A Chain A, Cyclophilin A [H. sapiens], ESTs, Weakly similar to A Chain A, Human Cyclophilin A Complexed With 2-Thr Cyclosporin [H. sapiens], ESTs, Weakly similar to CYPH_RAT Peptidyl-prolyl cis-trans isomerase A (PPIase) (Rotamase) (Cyclophilin A) (Cyclosporin A-binding protein) (P31) [R. norvegicus], RIKEN cDNA 2510026K04 gene, expressed sequence AI256741, expressed sequence AW457192, peptidylprolyl isomerase A |
| 2310 | 15041 | NM_031678 | jj, kk | period homolog 2 (Drosophila) | EST, Weakly similar to period homolog 2 (Drosophila) [Rattus norvegicus] [R. norvegicus], ESTs, Highly similar to period homolog 2 (Drosophila) [Rattus norvegicus] [R. norvegicus], period homolog 1 (Drosophila), period homolog 2 (Drosophila) |
| 1917 | 4500 | NM_017037 | ii | peripheral myelin protein 22, peripheral myelin protein, 22 kDa | peripheral myelin protein 22, peripheral myelin protein, 22 kDa |
| 745 | 22567 | AB017544 | aa | peroxisomal biogenesis factor 14 | peroxisomal biogenesis factor 14 |
| 1848 | 20178 | NM_013014 | w, x | persephin | EST, Weakly similar to persephin [Rattus norvegicus] [R. norvegicus], artemin, persephin |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2297 | 11296 | NM_031606 | f | phosphatase and tensin homolog, phosphatase and tensin homolog (mutated in multiple advanced cancers 1) | ESTs, Weakly similar to PTEN MOUSE PROTEIN-TYROSINE PHOSPHATASE PTEN [*M. musculus*], Mus musculus mRNA for tyrosine phosphatase (Tpte gene), isoform A, splice variant A, phosphatase and tensin homolog, phosphatase and tensin homolog (mutated in multiple advanced cancers 1), phosphatase and tensin homolog (mutated in multiple advanced cancers 1), pseudogene 1 |
| 1977 | 15598 | NM_017236 | ii | phosphatidylethanolamine binding protein, prostatic binding protein | Homo sapiens, clone MGC:22776 IMAGE:4700840, mRNA, complete cds, RIKEN cDNA 1700023A18 gene, RIKEN cDNA 1700081D17 gene, phosphatidylethanolamine binding protein, prostatic binding protein |
| 1975 | 24598 | NM_017231 | hh | phosphatidylinositol transfer protein, phosphotidylinositol transfer protein | EST, Weakly similar to PPI1_RAT PHOSPHATIDYLINOSITOL TRANSFER PROTEIN ALPHA ISOFORM (PTDINS TRANSFER PROTEIN ALPHA) (PTDINSTP) (PI-TP-ALPHA) [*R. norvegicus*], phosphatidylinositol transfer protein, phosphotidylinositol transfer protein, retinal degeneration B2 homolog (*Drosophila*) |
| 2558 | 945 | NM_138882 | j, k, s, t | phosphatidylserine-specific phospholipase A1, phosphatidylserine-specific phospholipase A1 alpha | ESTs, Weakly similar to A34671 triacylglycerol lipase [*M. musculus*], ESTs, Weakly similar to S15893 triacylglycerol lipase [*M. musculus*], Homo sapiens membrane-bound phosphatidic acid-selective phospholipase A1 mRNA, complete cds, expressed sequence AA986889, lipase, endothelial, pancreatic lipase-related protein 2 |
| 63 | 14250 | AA799729 | j, k | phosphodiesterase 4B, cAMP specific, phosphodiesterase 4B, cAMP-specific (phosphodiesterase E4 dunce homolog, *Drosophila*) | phosphodiesterase 4B, cAMP specific, phosphodiesterase 4B, cAMP-specific (phosphodiesterase E4 dunce homolog, *Drosophila*), phosphodiesterase 9A |
| 1916 | 14247 | NM_017031 | h, l | phosphodiesterase 4B, cAMP specific, phosphodiesterase 4B, cAMP-specific (phosphodiesterase E4 dunce homolog, *Drosophila*) | phosphodiesterase 4B, cAMP specific, phosphodiesterase 4B, cAMP-specific (phosphodiesterase E4 dunce homolog, *Drosophila*), phosphodiesterase 9A |
| 2320 | 1340 | NM_031715 | jj, kk | phosphofructokinase, muscle | ESTs, Highly similar to phosphofructokinase, muscle; phosphofructokinase-1 A isozyme [*Mus musculus*] [*M. musculus*], expressed sequence AI131669, phosphofructokinase, muscle |
| 1701 | 12058 | L25387 | w | phosphofructokinase, platelet | ESTs, Highly similar to K6PP_MOUSE 6-PHOSPHOFRUCTOKINASE, TYPE C (PHOSPHOFRUCTOKINASE 1) (PHOSPHOHEXOKINASE) (PHOSPHOFRUCTO-1-KINASE ISOZYME C) (PFK-C) [*M. musculus*], ESTs, Moderately similar to A53047 6-phosphofructokinase [*R. norvegicus*], ESTs, Weakly similar to JC2055 6-phosphofructokinase [*H. sapiens*], ESTs, Weakly similar to K6PL MOUSE 6-PHOSPHOFRUCTOKINASE, LIVER TYPE [*M. musculus*], phosphofructokinase, platelet |
| 1701 | 25377 | L25387 | hh | phosphofructokinase, platelet | |
| 2365 | 1311 | NM_053291 | e | phosphoglycerate kinase 1 | ESTs, Highly similar to A33792 phosphoglycerate kinase (EC 2.7.2.3) - rat [*R. norvegicus*], phosphoglycerate kinase 1, phosphoglycerate kinase 2 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2003 | 24533 | NM_017328 | n, o | phosphoglycerate mutase 2, phosphoglycerate mutase 2 (muscle) | EST, Weakly similar to PMGM MOUSE PHOSPHOGLYCERATE MUTASE, MUSCLE FORM [*M. musculus*], EST, Weakly similar to PMHUYM phosphoglycerate mutase [*H. sapiens*], phosphoglycerate mutase 2, phosphoglycerate mutase 2 (muscle) |
| 2446 | 11405 | NM_053866 | f | phospholipase A2, activating protein, phospholipase A2-activating protein | phospholipase A2, activating protein, phospholipase A2-activating protein |
| 2528 | 244 | NM_133551 | a, j, k, y, z, ee, ff, kk | phospholipase A2, group IVA (cytosolic, calcium-dependent) | ESTs, Highly similar to FGD1_HUMAN PUTATIVE RHO/RAG GUANINE NUCLEOTIDE EXCHANGE FACTOR [*H. sapiens*], ESTs, Weakly similar to B39898 phospholipase A2 [*M. musculus*], ESTs, Weakly similar to FGD1 MOUSE PUTATIVE RHO/RAC GUANINE NUCLEOTIDE EXCHANGE FACTOR [*M. musculus*], ESTs, Weakly similar to FGD1_HUMAN PUTATIVE RHO/RAC GUANINE NUCLEOTIDE EXCHANGE FACTOR [*H. sapiens*], FGD1 family, member 3, *Homo sapiens* cDNA FLJ32732 fis, clone TESTI2001141, highly similar to *Rattus norvegicus* actin-filament binding protein Frabin mRNA, *Mus musculus* actin-binding protein frabin-alpha mRNA, complete cds, RIKEN cDNA 2310026J01 gene, RIKEN cDNA 2610311B01 gene, RIKEN cDNA 5830461L01 gene, faciogenital dysplasia homolog, hypothetical protein FLJ11183, phospholipase A2, group IVA (cytosolic, calcium-dependent), phospholipase A2, group IVB (cytosolic) |
| 1962 | 9378 | NM_017174 | jj, kk | phospholipase A2, group V | phospholipase A2, group V |
| 2186 | 20933 | NM_024353 | h, l | phospholipase C, beta 4 | *Homo sapiens* mRNA; cDNA DKFZp434E235 (from clone DKFZp434E235), phospholipase C, beta 1 |
| 2288 | 546 | NM_031573 | h, ii | phosphorylase kinase gamma, phosphorylase kinase, gamma 1 (muscle) | ESTs, Moderately similar to KPBG_HUMAN PHOSPHORYLASE B KINASE GAMMA CATALYTIC CHAIN, SKELETAL MUSCLE ISOFORM [*H. sapiens*], endoplasmic reticulum (ER) to nucleus signalling 2, phosphorylase kinase gamma, phosphorylase kinase, gamma 1 (muscle) |
| 92 | 4832 | AA800190 | a, e, ii, kk | phosphorylase, glycogen; brain | liver glycogen phosphorylase, muscle glycogen phosphorylase, phosphorylase, glycogen; brain |
| 2595 | 4834 | NM_153821 | h, l | phosphorylase, glycogen; brain | liver glycogen phosphorylase, muscle glycogen phosphorylase, phosphorylase, glycogen; brain |
| 2423 | 13369 | NM_053742 | n, o | phosphotidylinositol transfer protein, beta | ESTs, Highly similar to PPI2_HUMAN PHOSPHATIDYLINOSITOL TRANSFER PROTEIN BETA ISOFORM [*H. sapiens*], phosphotidylinositol transfer protein, beta |
| 872 | 1332 | AI013222 | e | platelet derived growth factor, alpha, platelet-derived growth factor alpha polypeptide | platelet derived growth factor, alpha, platelet-derived growth factor alpha polypeptide |
| 2074 | 15911 | NM_019907 | cc, dd | postsynaptic protein CRIPT, postsynaptic protein Cript | |
| 1995 | 82 | NM_017297 | ii | potassium inwardly-rectifying channel, subfamily J, member 5 | potassium inwardly-rectifying channel, subfamily J, member 5 |
| 1938 | 15517 | NM_017099 | c | potassium inwardly-rectifying channel, subfamily J, member 8 | potassium inwardly-rectifying channel, subfamily J, member 8 |
| 1997 | 1028 | NM_017304 | ii | potassium voltage-gated channel, shaker-related subfamily, beta member 2 | potassium voltage-gated channel, shaker-related subfamily, beta member 2 |
| 1091 | 13267 | AI101847 | h, l | potassium voltage-gated channel, shaker-related subfamily, member 5 | potassium voltage-gated channel, shaker-related subfamily, member 5 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1940 | 15776 | NM_017108 | u, v | potassium voltage-gated channel, subfamily H (eag-related), member 3 | RIKEN cDNA C030044P22 gene, expressed sequence AU019351, potassium voltage-gated channel, subfamily H (eag-related), member 3 |
| 1982 | 16601 | NM_017252 | s, t | POU domain, class 3, transcription factor 4 | POU domain, class 3, transcription factor 4 |
| 2524 | 2788 | NM_133528 | s, t | preimplantation protein 3 | preimplantation protein 3 |
| 2361 | 23895 | NM_033485 | aa | PRKC, apoptosis, WT1, regulator | ESTs, Weakly similar to Ser/Arg-related nuclear matrix protein; plenty-of-prolines-101; serine/arginine repetitive matrix protein 1 [*Mus musculus*] [*M. musculus*], *Mus musculus*, Similar to hypothetical protein MGC13125, clone MGC:38070 IMAGE:5252666, mRNA, complete cds, PRKC, apoptosis, WT1, regulator, expressed sequence AI480556, glucocorticoid-induced gene 1, serine/arginine repetitive matrix 1 |
| 2043 | 15503 | NM_019237 | n, o | procollagen C-endopeptidase enhancer, procollagen C-proteinase enhancer protein | EST, Weakly similar to PCO1_HUMAN PROCOLLAGEN C-PROTEINASE ENHANCER PROTEIN PRECURSOR [*H. sapiens*], ESTs, Weakly similar to PCO1_RAT Procollagen C-proteinase enhancer protein precursor (PCPE) (Type I procollagen COOH-terminal proteinase enhancer) (Type 1 procollagen C-proteinase enhancer protein) [*R. norvegicus*], expressed sequence AI043106, membrane frizzled-related protein, procollagen C-endopeptidase enhancer, procollagen C-endopeptidase enhancer 2, procollagen C-proteinase enhancer protein |
| 1842 | 19393 | NM_012998 | h, l | procollagen-proline, 2-oxoglutarate 4-dioxygenase (proline 4-hydroxylase), beta polypeptide (protein disulfide isomerase; thyroid hormone binding protein p55), prolyl 4-hydroxylase, beta polypeptide | |
| 2068 | 20298 | NM_019374 | l, m | prodynorphin | |
| 2088 | 17936 | NM_021766 | d, r, gg | progesterone receptor membrane component 1 | *Homo sapiens*, clone MGC:32124 IMAGE:4877960, mRNA, complete cds, RIKEN cDNA 4631434O19 gene, progesterone receptor membrane component 1 |
| 2107 | 11454 | NM_022381 | d, l, m, n, o, s, t | proliferating cell nuclear antigen | proliferating cell nuclear antigen |
| 2107 | 11455 | NM_022381 | s | proliferating cell nuclear antigen | proliferating cell nuclear antigen |
| 1847 | 23545 | NM_013013 | l, m | prosaposin, prosaposin (variant Gaucher disease and variant metachromatic leukodystrophy) | |
| 1776 | 501 | NM_012704 | ii | prostaglandin E receptor 3 (subtype EP3) | |
| 1776 | 503 | NM_012704 | n, o | prostaglandin E receptor 3 (subtype EP3) | |
| 2045 | 21108 | NM_019243 | f | prostaglandin F2 receptor negative regulator | RIKEN cDNA 4833439O17 gene, immunoglobulin superfamily, member 2, immunoglobulin superfamily, member 3, immunoglobulin superfamily, member 8, prostaglandin F2 receptor negative regulator |
| 2285 | 692 | NM_031557 | s, t, ll | prostaglandin I2 (prostacyclin) synthase | EST, Highly similar to PTGI_RAT Prostacyclin synthase (Prostaglandin I2 synthase) [*R. norvegicus*], cytochrome P450, subfamily VIIIB (sterol 12-alpha-hydroxylase), polypeptide 1, prostaglandin I2 (prostacyclin) synthase |
| 1976 | 20193 | NM_017232 | p, q | prostaglandin-endoperoxide synthase 2, prostaglandin-endoperoxide synthase 2 (prostaglandin G/H synthase and cyclooxygenase) | prostaglandin-endoperoxide synthase 2, prostaglandin-endoperoxide synthase 2 (prostaglandin G/H synthase and cyclooxygenase) |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1991 | 15142 | NM_017278 | l, m | proteasome (prosome, macropain) subunit, alpha type 1, proteasome (prosome, macropain) subunit, alpha type, 1 | proteasome (prosome, macropain) subunit, alpha type 1, proteasome (prosome, macropain) subunit, alpha type, 1 |
| 190 | 18673 | AA849028 | t | proteasome (prosome, macropain) subunit, alpha type 3, proteasome (prosome, macropain) subunit, alpha type, 3 | EST, Weakly similar to SNHUC8 multicatalytic endopeptidase complex [*H. sapiens*], ESTs, Highly similar to PRC8 MOUSE PROTEASOME COMPONENT C8 [*M. musculus*], ESTs, Weakly similar to PRC8 MOUSE PROTEASOME COMPONENT C8 [*M. musculus*], proteasome (prosome, macropain) subunit, alpha type 3, proteasome (prosome, macropain) subunit, alpha type, 3 |
| 1992 | 15538 | NM_017283 | r | proteasome (prosome, macropain) subunit, alpha type 6, proteasome (prosome, macropain) subunit, alpha type, 6 | ESTs, Highly similar to S30274 multicatalytic endopeptidase complex [*H. sapiens*], ESTs, Weakly similar to JX0230 multicatalytic endopeptidase complex (EC 3.4.99.46) iota chain - rat [*R. norvegicus*], proteasome (prosome, macropain) subunit, alpha type 6 |
| 1662 | 9029 | D30804 | hh | proteasome (prosome, macropain) subunit, alpha type 7, proteasome (prosome, macropain) subunit, alpha type, 7 | EST, Highly similar to PSA7_HUMAN PROTEASOME SUBUNIT ALPHA TYPE 7 (PROTEASOME SUBUNIT RC6-1) (PROTEASOME SUBUNIT XAPC7) [*H. sapiens*], EST, Highly similar to S60038 multicatalytic endopeptidase complex (EC 3.4.99.46) alpha chain RC6 I - rat [*R. norvegicus*], Homo sapiens, similar to Proteasome subunit alpha type 7 (Proteasome subunit RC6-1), clone MGC:26605 IMAGE:4829939, mRNA, complete cds, RIKEN cDNA 2410072D24 gene, proteasome (prosome, macropain) subunit, alpha type 7, proteasome (prosome, macropain) subunit, alpha type, 7 |
| 1777 | 4003 | NM_012708 | e | proteasome (prosome, macropain) subunit, beta type, 9 (large multifunctional protease 2), proteosome (prosome, macropain) subunit, beta type 9 (large multifunctional protease 2) | proteasome (prosome, macropain) subunit, beta type, 9 (large multifunctional protease 2), proteosome (prosome, macropain) subunit, beta type 9 (large multifunctional protease 2) |
| 2346 | 17601 | NM_031976 | a, jj, kk | protein kinase, AMP-activated, beta 1 non-catalytic subunit | expressed sequence AW049591, protein kinase, AMP-activated, beta 1 non-catalytic subunit |
| 1859 | 21287 | NM_013065 | l, m | protein phosphatase 1, catalytic subunit, beta isoform | protein phosphatase 1, catalytic subunit, beta isoform |
| 2503 | 9633 | NM_130403 | jj, kk | protein phosphatase 1, regulatory (inhibitor) subunit 14A | RIKEN cDNA 2010107K19 gene, RIKEN cDNA 4933415F23 gene, protein phosphatase 1, regulatory (inhibitor) subunit 14A, protein phosphatase 1, regulatory (inhibitor) subunit 14B, protein phosphatase 1, regulatory (inhibitor) subunit 14C, protein phosphatase 1, regulatory (inhibitor) subunit 14c |
| 2148 | 24564 | NM_022676 | f | protein phosphatase 1, regulatory (inhibitor) subunit 1A | EST, Weakly similar to IPP1_HUMAN PROTEIN PHOSPHATASE INHIBITOR 1 [*H. sapiens*], ESTs, Moderately similar to PROTEIN PHOSPHATASE INHIBITOR 1 [*R. norvegicus*], Mus musculus, clone MGC:18770 IMAGE:4164563, mRNA, complete cds, RIKEN cDNA 4930565M23 gene, protein phosphatase 1 regulatory subunit 1A, protein phosphatase 1, regulatory (inhibitor) subunit 1A |
| 1918 | 3203 | NM_017039 | c | protein phosphatase 2 (formerly 2A), catalytic subunit, alpha isoform, protein phosphatase 2a, | protein phosphatase 2 (formerly 2A), catalytic subunit, alpha isoform, protein phosphatase 2a, catalytic subunit, alpha isoform |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1919 | 24597 | NM_017040 | b, l, m, u, v | catalytic subunit, alpha isoform protein phosphatase 2 (formerly 2A), catalytic subunit, beta isoform, protein phosphatase 2a, catalytic subunit, beta isoform | *Mus musculus* adult female placenta cDNA, RIKEN full-length enriched library, clone:1600017J22:protein phosphatase 2a, catalytic subunit, beta isoform, full insert sequence, protein phosphatase 2 (formerly 2A), catalytic subunit, beta isoform, protein phosphatase 2a, catalytic subunit, beta isoform |
| 2292 | 24219 | NM_031579 | d, p, q, y, z, kk | protein tyrosine phosphatase 4a1, protein tyrosine phosphatase type IVA, member 1 | protein tyrosine phosphatase 4a1, protein tyrosine phosphatase 4a3, protein tyrosine phosphatase type IVA, member 1, protein tyrosine phosphatase type IVA, member 3 |
| 1767 | 1841 | NM_012637 | d, jj, kk | protein tyrosine phosphatase, non-receptor type 1 | EST, Moderately similar to A34845 protein-tyrosine-phosphatase (EC 3.1.3.48), nonreceptor type 1B - rat [*R. norvegicus*], ESTs, Moderately similar to PTN1_HUMAN PROTEIN-TYROSINE PHOSPHATASE, NON-RECEPTOR TYPE 1 [*H. sapiens*], protein tyrosine phosphatase, non-receptor type 1 |
| 1767 | 1844 | NM_012637 | p, q, y, z | protein tyrosine phosphatase, non-receptor type 1 | EST, Moderately similar to A34845 protein-tyrosine-phosphatase (EC 3.1.3.48), nonreceptor type 1B - rat [*R. norvegicus*], ESTs, Moderately similar to PTN1_HUMAN PROTEIN-TYROSINE PHOSPHATASE, NON-RECEPTOR TYPE 1 [*H. sapiens*], protein tyrosine phosphatase, non-receptor type 1 |
| 2021 | 14973 | NM_019140 | aa | protein tyrosine phosphatase, receptor type, D | ESTs, Weakly similar to 2103274A receptor type protein Tyr phosphatase [*M. musculus*], RIKEN cDNA 1600019O04 gene, expressed sequence AU040377, protein tyrosine phosphatase, receptor type, S |
| 2085 | 22916 | NM_021740 | ii | prothymosin alpha, prothymosin, alpha (gene sequence 28) | ESTs, Highly similar to THYA_HUMAN PROTHYMOSIN ALPHA [*H. sapiens*], RIKEN cDNA 2610009E16 gene, prothymosin alpha, prothymosin, alpha (gene sequence 28) |
| 1510 | 4716 | AI232313 | c, r | purinergic receptor P2X, ligand-gated ion channel 4, purinergic receptor P2X, ligand-gated ion channel, 4 | purinergic receptor P2X, ligand-gated ion channel 4, purinergic receptor P2X, ligand-gated ion channel, 4 |
| 2499 | 363 | NM_080780 | d, e, p, q, ee, ff | purinergic receptor P2X, ligand-gated ion channel, 5 | purinergic receptor P2X, ligand-gated ion channel, 5 |
| 1983 | 1496 | NM_017255 | aa, bb | purinergic receptor P2Y, G-protein coupled 2, purinergic receptor P2Y, G-protein coupled, 2 | G protein-coupled receptor 31, G protein-coupled receptor 35, *Mus musculus*, clone MGC:28142 IMAGE:3982042, mRNA, complete cds, RIKEN cDNA 2610302I02 gene, RIKEN cDNA 5830408N17 gene, expressed sequence AI662791, purinergic receptor P2Y, G-protein coupled 2, purinergic receptor P2Y, G-protein coupled, 2 |
| 2208 | 1928 | NM_030872 | s, t | pyruvate dehydrogenase 2, pyruvate dehydrogenase kinase, isoenzyme 2 | *Mus musculus*, Similar to pyruvate dehydrogenase kinase, isoenzyme 1, clone MGC:28719 IMAGE:4458562, mRNA, complete cds, *Mus musculus*, Similar to pyruvate dehydrogenase kinase, isoenzyme 3, clone MGC:6383 IMAGE:3500763, mRNA, complete cds, pyruvate dehydrogenase 2, pyruvate dehydrogenase kinase, isoenzyme 2 |
| 2208 | 1929 | NM_030872 | hh | pyruvate dehydrogenase 2, pyruvate dehydrogenase kinase, isoenzyme 2 | *Mus musculus*, Similar to pyruvate dehydrogenase kinase, isoenzyme 1, clone MGC:28719 IMAGE:4458562, mRNA, complete cds, *Mus musculus*, Similar to pyruvate dehydrogenase kinase, isoenzyme 3, clone MGC:6383 IMAGE:3500763, mRNA, complete cds, pyruvate dehydrogenase 2, pyruvate dehydrogenase kinase, isoenzyme 2 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2012 | 20417 | NM_017359 | h, l, hh | RAB10, member RAS oncogene family | ESTs, Weakly similar to RAB8_HUMAN RAS-RELATED PROTEIN RAB-8 [*H. sapiens*], RAB10, member RAS oncogene family, RAB12, member RAS oncogene family, RAB38, member RAS oncogene family, expressed sequence AA536966, expressed sequence AW107754 |
| 1849 | 20229 | NM_013018 | kk | RAB3A, member RAS oncogene family | ESTs, Weakly similar to C34323 GTP-binding protein Rab3A [*H. sapiens*], RAB3A, member RAS oncogene family |
| 2231 | 18307 | NM_031091 | w, x | RAB3B, member RAS oncogene family | RAB3B, member RAS oncogene family |
| 2231 | 18308 | NM_031091 | w, x | RAB3B, member RAS oncogene family | RAB3B, member RAS oncogene family |
| 2133 | 6577 | NM_022532 | u, v | raf-related oncogene, v-raf murine sarcoma 3611 viral oncogene homolog 1 | *Mus musculus* adult male lung cDNA, RIKEN full-length enriched library, clone:1200013E08:raf-related oncogene, full insert sequence, expressed sequence AW495444, raf-related oncogene, v-raf murine sarcoma 3611 viral oncogene homolog 1 |
| 2351 | 21807 | NM_032067 | gg | Ral-interacting protein 1, ralA binding protein 1 | Ral-interacting protein 1, ralA binding protein 1 |
| 2351 | 21809 | NM_032067 | ll | Ral-interacting protein 1, ralA binding protein 1 | Ral-interacting protein 1, ralA binding protein 1 |
| 1661 | 25278 | D30734 | gg | RAS p21 protein activator 2 | |
| 1547 | 22152 | AI234822 | j, k | RAS, dexamethasone-induced 1 | *Mus musculus* small GTP-binding tumor suppressor 1 (Gbts 1) mRNA, complete cds, *Mus musculus*, Similar to RAP1A, member of RAS oncogene family, clone MGC:18653 IMAGE:3600519, mRNA, complete cds, RAP2B, member of RAS oncogene family, RAS, dexamethasone-induced 1, RIKEN cDNA 1110065D03 gene, RIKEN cDNA 2010200P20 gene, RIKEN cDNA 5830461H18 gene, rap2A-like protein, ras homolog gene family, member I |
| 1898 | 23362 | NM_013216 | e | RAS-homolog enriched in brain, Ras homolog enriched in brain 2 | ESTs, Weakly similar to RALA MOUSE RAS-RELATED PROTEIN RAL-A [*M. musculus*], RAS-homolog enriched in brain, RIKEN cDNA 1810036J22 gene, Ras homolog enriched in brain 2, ras-like protein VT558635 |
| 2373 | 1609 | NM_053338 | j, p, q, y, z | Ras-related associated with diabetes | ESTs, Weakly similar to Ras-related associated with diabetes [*Rattus norvegicus*] [*R. norvegicus*], GTP binding protein (gene overexpressed in skeletal muscle), GTP binding protein overexpressed in skeletal muscle, Ras-related associated with diabetes, rad and gem related GTP binding protein |
| 2305 | 16062 | NM_031646 | n, o | receptor (calcitonin) activity modifying protein 2 | receptor (calcitonin) activity modifying protein 2 |
| 2062 | 2088 | NM_019341 | aa, bb | regulator of G-protein signaling 5, regulator of G-protein signalling 5 | regulator of G-protein signaling 5, regulator of G-protein signalling 5 |
| 1947 | 20916 | NM_017132 | d | reticulocalbin 2, reticulocalbin 2, EF-hand calcium binding domain | ESTs, Weakly similar to I56519 taipoxin-associated calcium binding protein-49 precursor - rat [*R. norvegicus*], calumenin, reticulocalbin, reticulocalbin 2, reticulocalbin 2, EF-hand calcium binding domain |
| 1658 | 17264 | D25233 | d | retinoblastoma 1, retinoblastoma 1 (including osteosarcoma) | EST, Moderately similar to RETINOBLASTOMA-ASSOCIATED PROTEIN [*M. musculus*], ESTs, Highly similar to RB MOUSE RETINOBLASTOMA-ASSOCIATED PROTEIN [*M. musculus*], retinoblastoma 1, retinoblastoma 1 (including osteosarcoma) |
| 1419 | 1377 | AI227715 | a, ee, ff | retinoblastoma-like 2, retinoblastoma-like 2 (p130) | *Mus musculus* 11 days embryo whole body cDNA, RIKEN full-length enriched library, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2233 | 1376 | NM_031094 | ii | retinoblastoma-like 2, retinoblastoma-like 2 (p130) | clone:2700054A06:retinoblastoma-like 1 (p107), full insert sequence, retinoblastoma-like 1 (p107), retinoblastoma-like 2, retinoblastoma-like 2 (p130) *Mus musculus* 11 days embryo whole body cDNA, RIKEN full-length enriched library, clone:2700054A06:retinoblastoma-like 1 (p107), full insert sequence, retinoblastoma-like 1 (p107), retinoblastoma-like 2, retinoblastoma-like 2 (p130) |
| 1782 | 23806 | NM_012733 | j, k | retinol binding protein 1, cellular | ESTs, Weakly similar to RET1_RAT Retinol-binding protein I, cellular (Cellular retinol-binding protein) (CRBP) [*R. norvegicus*], retinoid binding protein 7, retinol binding protein 1, cellular, retinol binding protein 5, cellular, retinol binding protein 7, cellular |
| 1850 | 1338 | NM_013022 | r | Rho-associated coiled-coil forming kinase 2, Rho-associated, coiled-coil containing protein kinase 2 | Rho-associated coiled-coil forming kinase 2, Rho-associated, coiled-coil containing protein kinase 2, expressed sequence AU014939 |
| 2314 | 21575 | NM_031698 | w, x | ribophorin II | EST, Moderately similar to RIB2_HUMAN DOLICHYL-DIPHOSPHOOLIGOSACCHARIDE-PROTEIN GLYCOSYLTRANSFERASE 63 KDA SUBUNIT PRECURSOR [*H. sapiens*], ESTs, Moderately similar to RIB2_HUMAN DOLICHYL-DIPHOSPHOOLIGOSACCHARIDE-PROTEIN GLYCOSYLTRANSFERASE 63 KDA SUBUNIT PRECURSOR [*H sapiens*], ribophorin 2, related sequence 1, ribophorin II |
| 2227 | 11849 | NM_031065 | h, l, n, o | ribosomal protein L10A, ribosomal protein L10a | EST, Moderately similar to R10A MOUSE 60S RIBOSOMAL PROTEIN L10A [*M. musculus*], ribosomal protein L10A, ribosomal protein L10a |
| 2237 | 23854 | NM_031101 | f, w, x, ii | ribosomal protein L13 | EST, Moderately similar to JC2368 ribosomal protein L13, cytosolic [validated] - rat [*R. norvegicus*], EST, Weakly similar to JC2368 ribosomal protein L13, cytosolic [validated] - rat [*R. norvegicus*], ESTs, Highly similar to ribosomal protein L13; 60S ribosomal protein L13; breast basic conserved protein 1 [*Homo sapiens*] [*H. sapiens*], ESTs, Moderately similar to RL13 MOUSE 60S RIBOSOMAL PROTEIN L13 [*M. musculus*], Homo sapiens cDNA FLJ30941 fis, clone FEBRA2007458, Human RPL13-2 pseudogene mRNA, complete cds, ribosomal protein L13 |
| 2238 | 20472 | NM_031102 | h, l | ribosomal protein L18 | ESTs, Weakly similar to 60S RIBOSOMAL PROTEIN L18 [*M. musculus*], ribosomal protein L18 |
| 2239 | 16938 | NM_031103 | g | ribosomal protein L19 | EST, Weakly similar to RL19 MOUSE 60S RIBOSOMAL PROTEIN L19 [*M. musculus*], ESTs, Weakly similar to RL19_HUMAN 60S RIBOSOMAL PROTEIN L1 [*M. musculus*], ESTs, Weakly similar to RL19_HUMAN 60S ribosomal protein L19 [*R. norvegicus*], ribosomal protein L19 |
| 2371 | 14927 | NM_053330 | e | ribosomal protein L21 | EST, Moderately similar to 2113200B ribosomal protein L21 [*H. sapiens*], EST, Moderately similar to RL21_RAT 60S RIBOSOMAL PROTEIN L21 [*R. norvegicus*], EST, Weakly similar to 2113200B ribosomal protein L21 [*H. sapiens*], EST, Weakly similar to RL21 MOUSE 60S RIBOSOMAL PROTEIN L21 [*M. musculus*], EST, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2371 | 14929 | NM_053330 | h, l | ribosomal protein L21 | Weakly similar to RL21_HUMAN 60S RIBOSOMAL PROTEIN L21 [H. sapiens], ESTs, Highly similar to 2113200B ribosomal protein L21 [H. sapiens], ESTs, Highly similar to RL21 MOUSE 60S RIBOSOMAL PROTEIN L21 [M. musculus], ESTs, Moderately similar to RL21 MOUSE 60S RIBOSOMAL PROTEIN L21 [M. musculus], ribosomal protein L21 EST, Moderately similar to 2113200B ribosomal protein L21 [H. sapiens], EST, Moderately similar to RL21_RAT 60S RIBOSOMAL PROTEIN L21 [R. norvegicus], EST, Weakly similar to 2113200B ribosomal protein L21 [H. sapiens], EST, Weakly similar to RL21 MOUSE 60S RIBOSOMAL PROTEIN L21 [M. musculus], EST, Weakly similar to RL21_HUMAN 60S RIBOSOMAL PROTEIN L21 [H. sapiens], ESTs, Highly similar to 2113200B ribosomal protein L21 [H. sapiens], ESTs, Highly similar to RL21 MOUSE 60S RIBOSOMAL PROTEIN L21 [M. musculus], ESTs, Moderately similar to RL21 MOUSE 60S RIBOSOMAL PROTEIN L21 [M. musculus], ribosomal protein L21 |
| 2658 | 5667 | X58200 | h, l, w, x | ribosomal protein L23 | |
| 2125 | 2696 | NM_022515 | cc, dd | ribosomal protein L24 | Homo sapiens, clone MGC:27044 IMAGE:4793412, mRNA, complete cds, Mus musculus, Similar to 60S ribosomal protein L30 isolog, clone MGC:6735 IMAGE:3590401, mRNA, complete cds, ribosomal protein L24 |
| 2125 | 2697 | NM_022515 | f, g, gg | ribosomal protein L24 | Homo sapiens, clone MGC:27044 IMAGE:4793412, mRNA, complete cds, Mus musculus, Similar to 60S ribosomal protein L30 isolog, clone MGC:6735 IMAGE:3590401, mRNA, complete cds, ribosomal protein L24 |
| 2124 | 3027 | NM_022514 | w, x | ribosomal protein L27 | ribosomal protein L27 |
| 2152 | 17729 | NM_022697 | f, g, w, x, cc, dd | ribosomal protein L28 | ribosomal protein L28 |
| 2658 | 18611 | X58200 | g | ribosomal protein L29 | EST, Moderately similar to RL29_HUMAN 60S RIBOSOMAL PROTEIN L29 [H. sapiens], EST, Moderately similar to RL29_RAT 60S RIBOSOMAL PROTEIN L29 (P23) [R. norvegicus], ESTs, Highly similar to S65784 ribosomal protein L29, cytosolic [H. sapiens], ribosomal protein L29 |
| 2078 | 15335 | NM_021264 | w | ribosomal protein L35a | |
| 2120 | 4259 | NM_022504 | f, g | ribosomal protein L36 | EST, Moderately similar to ribosomal protein L36 [Rattus norvegicus] [R. norvegicus], RIKEN cDNA 1110038G14 gene, ribosomal protein L36 |
| 2564 | 15380 | NM_139083 | u, v, cc, dd | ribosomal protein L41 | ESTs, Highly similar to YZA1_HUMAN HYPOTHETICAL PROTEIN [H. sapiens], ribosomal protein L41 |
| 2666 | 15875 | X62145 | h, r | ribosomal protein L8 | EST, Highly similar to RL8_HUMAN 60S ribosomal protein L8 [R. norvegicus], EST, Weakly similar to JN0923 ribosomal protein L8, cytosolic [H. sapiens], ESTs, Highly similar to R5RTL8 ribosomal protein L8, cytosolic [validated] - rat [R. norvegicus], ESTs, Highly similar to RL8_HUMAN 60S RIBOSOMAL PROTEIN L [M. musculus], ESTs, Moderately similar to RL8_HUMAN 60S RIBOSOMAL PROTEIN L [M. musculus], expressed sequence AL024098, ribosomal protein L8 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2650 | 18250 | X51706 | w, x | ribosomal protein L9 | EST, Moderately similar to S65792 ribosomal protein L9, cytosolic [*H. sapiens*], EST, Weakly similar to RL9_RAT 60S RIBOSOMAL PROTEIN L9 [*R. norvegicus*], ESTs, Weakly similar to 60S RIBOSOMAL PROTEIN L9 [*M. musculus*], RIKEN cDNA 4930401B11 gene, ribosomal protein L9 |
| 2653 | 20427 | X53378 | h | ribosomal protein S13 | ESTs, Moderately similar to RS13_HUMAN 40S RIBOSOMAL PROTEIN S13 [*H. sapiens*], ribosomal protein S13 |
| 1955 | 16953 | NM_017151 | g | ribosomal protein S15 | EST, Moderately similar to R3HU15 ribosomal protein S15, cytosolic [*H. sapiens*], ESTs, Highly similar to RS15_HUMAN 40S RIBOSOMAL PROTEIN S15 [*M. musculus*], ribosomal protein S15 |
| 1955 | 16954 | NM_017151 | gg | ribosomal protein S15 | EST, Moderately similar to R3HU15 ribosomal protein S15, cytosolic [*H. sapiens*], ESTs, Highly similar to RS15_HUMAN 40S RIBOSOMAL PROTEIN S15 [*M. musculus*], ribosomal protein S15 |
| 1955 | 16955 | NM_017151 | l, m, s, t | ribosomal protein S15 | EST, Moderately similar to R3HU15 ribosomal protein S15, cytosolic [*H. sapiens*], ESTs, Highly similar to RS15_HUMAN 40S RIBOSOMAL PROTEIN S15 [*M. musculus*], ribosomal protein S15 |
| 2648 | 15626 | X17665 | w, x | ribosomal protein S16 | EST AI317031, EST, Weakly similar to R3HU16 ribosomal protein S16, cytosolic [*H. sapiens*], expressed sequence AA420385, ribosomal protein S16 |
| 2651 | 20872 | X51707 | l, w, x | ribosomal protein S19 | EST, Moderately similar to R3RT19 ribosomal protein S19, cytosolic [validated] - rat [*R. norvegicus*], EST, Weakly similar to RS19_HUMAN 40S RIBOSOMAL PROTEIN S19 [*H. sapiens*] |
| 2492 | 10498 | NM_078617 | c, g, w, x | ribosomal protein S23 | ESTs, Highly similar to 40S RIBOSOMAL PROTEIN S23 [*H. sapiens*], ESTs, Weakly similar to ribosomal protein S23 [*Rattus norvegicus*] [*R. norvegicus*], Mus musculus, Similar to mitochondrial ribosomal protein S12, clone MGC:13892 IMAGE:4209358, mRNA, complete cds, mitochondrial ribosomal protein S12, ribosomal protein S23 |
| 2246 | 20839 | NM_031113 | w, x | ribosomal protein S27a | ESTs, Highly similar to ribosomal protein S27a [*Mus musculus*] [*M. musculus*], ESTs, Highly similar to ubiquitin/ribosomal protein S27a [*H. sapiens*], ESTs, Weakly similar to ribosomal protein S27a [*Rattus norvegicus*] [*R. norvegicus*], Mus musculus, Similar to ubiquitin-like 4, clone MGC:19132 IMAGE:4215699, mRNA, complete cds, neural precursor cell expressed, developmentally down-regulated 8, ribosomal protein S27a |
| 1813 | 17305 | NM_012876 | g, hh | ribosomal protein S29 | EST, Moderately similar to RS29_HUMAN 40S RIBOSOMAL PROTEIN S29 [*M. musculus*], ESTs, Weakly similar to RS29_HUMAN 40S RIBOSOMAL PROTEIN S29 [*H. sapiens*], ribosomal protein S29 |
| 1813 | 17306 | NM_012876 | f | ribosomal protein S29 | EST, Moderately similar to RS29_HUMAN 40S RIBOSOMAL PROTEIN S29 [*M. musculus*], ESTs, Weakly similar to RS29_HUMAN 40S RIBOSOMAL PROTEIN S29 [*H. sapiens*], ribosomal protein S29 |
| 2649 | 10819 | X51536 | gg | ribosomal protein S3 | EST, Moderately similar to RS3_MOUSE 40 ribosomal protein S3 [*R. norvegicus*], EST, Weakly similar to RS3_MOUSE |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | 40S ribosomal protein S3 [*R. norvegicus*], ESTs, Highly similar to RS3_MOUSE 40S ribosomal protein S3 [*R. norvegicus*], ESTs, Moderately similar to RS3_HUMAN 40S RIBOSOMAL PROTEIN S [*H. sapiens*], ESTs, Weakly similar to RS3 MOUSE 40S RIBOSOMAL PROTEIN S3 [*M. musculus*], hypothetical protein FLJ11252, hypothetical protein FLJ23059, myo-inositol 1-phosphate synthase A1, ribosomal protein S3 |
| 2649 | 25686 | X51536 | w, x, hh | ribosomal protein S3 | |
| 2659 | 25702 | X58465 | g, w, x | ribosomal protein S5 | EST, Moderately similar to 2113200E ribosomal protein S5 [*H. sapiens*], EST, Weakly similar to 2113200E ribosomal protein S5 [*H. sapiens*], ribosomal protein S5 |
| 2659 | 10109 | X58465 | g, w, x | ribosomal protein S5 | EST, Moderately similar to 2113200E ribosomal protein S5 [*H. sapiens*], EST, Weakly similar to 2113200E ribosomal protein S5 [*H. sapiens*], ribosomal protein S5 |
| 1957 | 17104 | NM_017160 | h, l | ribosomal protein S6 | EST, Moderately similar to R3HU6 ribosomal protein S6, cytosolic [*H. sapiens*], EST, Moderately similar to RS6_HUMAN 40S RIBOSOMAL PROTEIN S6 [*H. sapiens*], EST, Weakly similar to R3HU6 ribosomal protein S6, cytosolic [*H. sapiens*], ESTs, Highly similar to RS6_HUMAN 40S RIBOSOMAL PROTEIN S6 [*H. sapiens*], ESTs, Weakly similar to RS6_HUMAN 40S RIBOSOMAL PROTEIN S6 [*H. sapiens*], ribosomal protein S6 |
| 1957 | 17105 | NM_017160 | h, l | ribosomal protein S6 | EST, Moderately similar to R3HU6 ribosomal protein S6, cytosolic [*H. sapiens*], EST, Moderately similar to RS6_HUMAN 40S RIBOSOMAL PROTEIN S6 [*H. sapiens*], EST, Weakly similar to R3HU6 ribosomal protein S6, cytosolic [*H. sapiens*], ESTs, Highly similar to RS6_HUMAN 40S RIBOSOMAL PROTEIN S6 [*H. sapiens*], ESTs, Weakly similar to RS6_HUMAN 40S RIBOSOMAL PROTEIN 36 [*H. sapiens*], ribosomal protein S6 |
| 1957 | 17106 | NM_017160 | n, o | ribosomal protein S6 | EST, Moderately similar to R3HU6 ribosomal protein S6, cytosolic [*H. sapiens*], EST, Moderately similar to RS6_HUMAN 40S RIBOSOMAL PROTEIN S6 [*H. sapiens*], EST, Weakly similar to R3HU6 ribosomal protein S6, cytosolic [*H. sapiens*], ESTs, Highly similar to RS6_HUMAN 40S RIBOSOMAL PROTEIN S6 [*H. sapiens*], ESTs, Weakly similar to RS6_HUMAN 40S RIBOSOMAL PROTEIN S6 [*H. sapiens*], ribosomal protein S6 |
| 2287 | 9620 | NM_031570 | w, x, cc, dd | ribosomal protein S7 | EST, Moderately similar to JC4388 ribosomal protein S7, cytosolic [*H. sapiens*], EST, Weakly similar to RS7_HUMAN 40S RIBOSOMAL PROTEIN S7 [*M. musculus*], EST, Weakly similar to RS7_HUMAN 40S ribosomal protein S7 (S8) [*R. norvegicus*], ESTs, Highly similar to JC4388 ribosomal protein S7, cytosolic [*H. sapiens*], ESTs, Highly similar to RS7_HUMAN 40S RIBOSOMAL PROTEIN S7 [*H. sapiens*], ESTs, Moderately similar to RS7_HUMAN 40S RIBOSOMAL PROTEIN S7 [*H. sapiens*], ribosomal protein S7 |
| 2315 | 16204 | NM_031706 | f, g, jj, kk | ribosomal protein S8 | EST, Weakly similar to 40S RIBOSOMAL PROTEIN S8 [*M. musculus*], ESTs, Highly similar to |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2315 | 16205 | NM_031706 | jj, kk | ribosomal protein S8 | S25022 ribosomal protein S8, cytosolic [*H. sapiens*], ESTs, Moderately similar to RS8_HUMAN 40S RIBOSOMAL PROTEIN S [*H. sapiens*], RIKEN cDNA 1110008P08 gene, ribosomal protein S8 EST, Weakly similar to 40S RIBOSOMAL PROTEIN S8 [*M. musculus*], ESTs, Highly similar to S25022 ribosomal protein S8, cytosolic [*H. sapiens*], ESTs, Moderately similar to RS8_HUMAN 40S RIBOSOMAL PROTEIN S [*H. sapiens*], RIKEN cDNA 1110008P08 gene, ribosomal protein S8 |
| 64 | 18061 | AA799735 | r | RuvB-like 1 (*E. coli*), RuvB-like protein 1 | Homer, neuronal immediate early gene, 1B, homer, neuronal immediate early gene, 1 |
| 2316 | 18054 | NM_031707 | f, g, n, o | RuvB-like 1 (*E. coli*), RuvB-like protein 1 | Homer, neuronal immediate early gene, 1B, homer, neuronal immediate early gene, 1 |
| 2316 | 18057 | NM_031707 | r | RuvB-like 1 (*E. coli*), RuvB-like protein 1 | Homer, neuronal immediate early gene, 1B, homer, neuronal immediate early gene, 1 |
| 2316 | 18059 | NM_031707 | p, q, ee, ff | RuvB-like 1 (*E. coli*), RuvB-like protein 1 | Homer, neuronal immediate early gene, 1B, homer, neuronal immediate early gene, 1 |
| 2247 | 19040 | NM_031114 | a, c, h, l, y, ee, ff | S100 calcium binding protein A10 (annexin II ligand, calpactin I, light polypeptide (p11)), S100 calcium binding protein A10 (calpactin) | EST, Moderately similar to S110_RAT Calpactin I light chain (P10 protein) (P11) (Cellular ligand of annexin II) (Nerve growth factor induced protein 42C) [*R. norvegicus*], S100 calcium binding protein A10 (annexin II ligand, calpactin I, light polypeptide (p11)), S100 calcium binding protein A10 (calpactin) |
| 1764 | 20589 | NM_012618 | h, l, n, o, w, x | S100 calcium binding protein A4, S100 calcium binding protein A4 (calcium protein, calvasculin, metastasin, murine placental homolog) | S100 calcium binding protein A2, S100 calcium binding protein A4 (calcium protein, calvasculin, metastasin, murine placental homolog) |
| 2386 | 16394 | NM_053485 | h, l, w, x | S100 calcium binding protein A6 (calcyclin) | |
| 1967 | 20779 | NM_017201 | b, l, m | S-adenosylhomocysteine hydrolase | *Mus musculus*, S-adenosylhomocysteine hydrolase-like 1, clone MGC:18748 IMAGE:4007102, mRNA, complete cds, S-adenosylhomocysteine hydrolase, S-adenosylhomocysteine hydrolase, related sequence 3, expressed sequence AL024110 |
| 2214 | 15682 | NM_031011 | n, o | S-adenosylmethionine decarboxylase 1 | S-adenosylmethionine decarboxylase 1, S-adenosylmethionine decarboxylase 2 |
| 2214 | 15683 | NM_031011 | cc, dd, gg | S-adenosylmethionine decarboxylase 1 | S-adenosylmethionine decarboxylase 1, S-adenosylmethionine decarboxylase 2 |
| 1770 | 16217 | NM_012656 | c, aa, bb | secreted acidic cysteine rich glycoprotein, secreted protein, acidic, cysteine-rich (osteonectin) | secreted acidic cysteine rich glycoprotein, secreted protein, acidic, cysteine-rich (osteonectin) |
| 1770 | 16218 | NM_012656 | n, o | secreted acidic cysteine rich glycoprotein, secreted protein, acidic, cysteine-rich (osteonectin) | secreted acidic cysteine rich glycoprotein, secreted protein, acidic, cysteine-rich (osteonectin) |
| 1770 | 16219 | NM_012656 | r, gg | secreted acidic cysteine rich glycoprotein, secreted protein, acidic, cysteine-rich (osteonectin) | secreted acidic cysteine rich glycoprotein, secreted protein, acidic, cysteine-rich (osteonectin) |
| 1770 | 16220 | NM_012656 | h, l, aa, bb | secreted acidic cysteine rich glycoprotein, secreted protein, acidic, cysteine-rich (osteonectin) | secreted acidic cysteine rich glycoprotein, secreted protein, acidic, cysteine-rich (osteonectin) |
| 1770 | 16221 | NM_012656 | d | secreted acidic cysteine rich glycoprotein, secreted protein, acidic, cysteine-rich (osteonectin) | secreted acidic cysteine rich glycoprotein, secreted protein, acidic, cysteine-rich (osteonectin) |
| 1814 | 23651 | NM_012881 | h, l, n, o, w, x | secreted phosphoprotein 1, secreted phosphoprotein 1 (osteopontin, bone | |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1851 | 17894 | NM_013027 | gg | sialoprotein I, early T-lymphocyte activation 1) selenoprotein W, 1, selenoprotein W, muscle 1 | ESTs, Weakly similar to SELW MOUSE SELENOPROTEIN W [*M. musculus*], selenoprotein W, 1, selenoprotein W, muscle 1 |
| 1718 | 21400 | M36410 | ee, ff, gg | sepiapterin reductase, sepiapterin reductase (7,8-dihydrobiopterin:NADP+ oxidoreductase) | ESTs, Highly similar to A36024 sepiapterin reductase (EC 1.1.1.153) - rat [*R. norvegicus*], sepiapterin reductase, sepiapterin reductase (7,8-dihydrobiopterin:NADP+ oxidoreductase) |
| 1765 | 15540 | NM_012620 | a, kk | serine (or cysteine) proteinase inhibitor, clade E (nexin, plasminogen activator inhibitor type 1), member 1 | |
| 1961 | 17301 | NM_017173 | c, f, g, j, k, y, z | serine (or cysteine) proteinase inhibitor, clade H (heat shock protein 47), member 1, serine (or cysteine) proteinase inhibitor, clade H (heat shock protein 47), member 1, (collagen binding protein 1) | serine (or cysteine) proteinase inhibitor, clade H (heat shock protein 47), member 1, serine (or cysteine) proteinase inhibitor, clade H (heat shock protein 47), member 1, (collagen binding protein 1), serine (or cysteine) proteinase inhibitor, clade H (heat shock protein 47), member 2 |
| 2322 | 15507 | NM_031735 | u | serine/threonine kinase 3 (STE20 homolog, yeast), serine/threonine kinase 3 (Ste20, yeast homolog) | serine/threonine kinase 24 (STE20 homolog, yeast), serine/threonine kinase 25 (STE20 homolog, yeast), serine/threonine kinase 25 (yeast), serine/threonine kinase 3 (STE20 homolog, yeast), serine/threonine kinase 3 (Ste20, yeast homolog), serine/threonine kinase 4 |
| 2042 | 20433 | NM_019232 | p, q, kk | serum/glucocorticoid regulated kinase | EST, Weakly similar to SGK_RAT Serine/threonine-protein kinase Sgk (Serum/glucocorticoid-regulated kinase) [*R. norvegicus*], Mus musculus, hypothetical protein MGC11287 similar to ribosomal protein S6 kinase, clone MGC:38756 IMAGE:5358742, mRNA, complete cds, RIKEN cDNA 1190006F07 gene, serine/threonine protein kinase CISK, serum/glucocorticoid regulated kinase, serum/glucocorticoid regulated kinase 2, serum/glucocorticoid regulated kinase-like |
| 2334 | 2655 | NM_031821 | d | serum-inducible kinase | ESTs, Highly similar to SNK_RAT Serine/threonine-protein kinase SNK (Serum inducible kinase) [*R. norvegicus*], ESTs, Weakly similar to SNK MOUSE SERINE/THREONINE-PROTEIN KINASE SNK [*M. musculus*], ESTs, Weakly similar to SNK_RAT Serine/threonine-protein kinase SNK (Serum inducible kinase) [*R. norvegicus*], Homo sapiens cDNA FLJ30246 fis, clone BRACE2002202, weakly similar to SERINE/THREONINE-PROTEIN KINASE SNK (EC 2.7.1.—), NIMA (never in mitosis gene a)-related expressed kinase 1, NIMA (never in mitosis gene a)-related kinase 4, serum-inducible kinase |
| 1966 | 9124 | NM_017199 | h, l, hh | signal sequence receptor, delta, signal sequence receptor, delta (translocon-associated protein delta) | EST, Moderately similar to SSRD_RAT TRANSLOCON-ASSOCIATED PROTEIN, DELTA SUBUNIT PRECURSOR (TRAP-DELTA) (SIGNAL SEQUENCE RECEPTOR DELTA SUBUNIT) (SSR-DELTA) [*R. norvegicus*], EST, Weakly similar to SSRD_HUMAN TRANSLOCON-ASSOCIATED PROTEIN, DELTA SUBUNIT PRECURSOR [*H. sapiens*], Mus musculus, clone IMAGE:4038523, mRNA, partial cds, signal sequence receptor, delta, signal sequence receptor, delta (translocon-associated protein delta) |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2167 | 15727 | NM_022953 | u, v | slit homolog 1 (*Drosophila*) | EST, Highly similar to T42626 secreted leucine-rich repeat-containing protein SLIT2 - mouse (fragment) [*M. musculus*], ESTs, Weakly similar to hypothetical protein MGC7599; clone MGC:7599 [*Mus musculus*] [*M. musculus*], ESTs, Weakly similar to integral membrane glycoprotein [*Mus musculus*] [*M. musculus*], ESTs, Weakly similar to ALS MOUSE INSULIN-LIKE GROWTH FACTOR BINDING PROTEIN COMPLEX ACID LABILE CHAIN PRECURSOR [*M. musculus*], ESTs, Weakly similar to JG0193 G protein-coupled receptor FEX - mouse [*M. musculus*], ESTs, Weakly similar to Slit-1 protein [*H. sapiens*], *Mus musculus*, Similar to leucine-rich repeat-containing 3, clone MGC:30505 IMAGE:4481142, mRNA, complete cds, RIKEN cDNA 9530074E10 gene, slit homolog 1 (*Drosophila*), slit homolog 2 (*Drosophila*), slit homolog 3 (*Drosophila*) |
| 2277 | 20448 | NM_031530 | a, d, z, ee, ff, jj, kk | small inducible cytokine A2, small inducible cytokine A2 (monocyte chemotactic protein 1) | EST, Weakly similar to S07723 immediate-early serum-responsive protein JE precursor - rat [*R. norvegicus*], expressed sequence AI323594, small inducible cytokine A2, small inducible cytokine A24, small inducible cytokine subfamily A (Cys-Cys), member 24 |
| 2277 | 20449 | NM_031530 | a, z, ee, ff, kk | small inducible cytokine A2, small inducible cytokine A2 (monocyte chemotactic protein 1) | EST, Weakly similar to S07723 immediate-early serum-responsive protein JE precursor - rat [*R. norvegicus*], expressed sequence AI323594, small inducible cytokine A2, small inducible cytokine A24, small inducible cytokine subfamily A (Cys-Cys), member 24 |
| 2545 | 19077 | NM_134455 | aa, bb | small inducible cytokine subfamily D (Cys-X3-Cys), member 1 (fractalkine, neurotactin), small inducible cytokine subfamily D, 1 | small inducible cytokine subfamily D (Cys-X3-Cys), member 1 (fractalkine, neurotactin), small inducible cytokine subfamily D, 1 |
| 1801 | 20246 | NM_012807 | l, m, s | smoothened homolog (*Drosophila*) | EST, Moderately similar to SMO_HUMAN SMOOTHENED HOMOLOG PRECURSOR [*H. sapiens*], smoothened homolog (*Drosophila*) |
| 1993 | 20579 | NM_017288 | aa, bb | sodium channel, voltage-gated, type I, beta polypeptide | *Mus musculus* brain and heart sodium channel beta 3 subunit mRNA, complete cds, sodium channel beta 3 subunit, sodium channel, voltage-gated, type I, beta polypeptide |
| 1664 | 21147 | D63772 | j, k, p | solute carrier family 1 (neuronal/epithelial high affinity glutamate transporter, system Xag), member 1, solute carrier family 1, member 1 | ESTs, Weakly similar to EAA3_RAT Excitatory amino acid transporter 3 (Sodium-dependent glutamate/aspartate transporter 3) (Excitatory amino-acid carrier 1) [*R. norvegicus*], *Mus musculus* adult mate testis cDNA, RIKEN full-length enriched library, clone:4931413K05:solute carrier family 1, member 1, full insert sequence, *Rattus norvegicus* mRNA for sodium-dependent neutral amino acid transporter, ASCT2, solute carrier family 1 (neuronal/epithelial high affinity glutamate transporter, system Xag), member 1, solute carrier family 1, member 1, solute carrier family 1, member 7 |
| 2279 | 1005 | NM_031537 | l, m | solute carrier family 11 (proton-coupled divalent metal ion transporters), member 1 | |
| 2331 | 2114 | NM_031798 | aa, bb | solute carrier family 12 (sodium/potassium/chloride transporters), member 2, | *Mus musculus* strain ILS K-Cl cotransporter (Slc12a5) mRNA, complete cds, cation-chloride |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | solute carrier family 12, member 2 | cotransporter 6, cation-chloride cotransporter 9, cation-chloride cotransporter-interacting protein 1, solute carrier family 12 (sodium/potassium/chloride transporters), member 2, solute carrier family 12, member 2 |
| 1779 | 20888 | NM_012716 | c, e | solute carrier family 16 (monocarboxylic acid transporters), member 1 | RIKEN cDNA 1110004H10 gene, RIKEN cDNA 1200003C15 gene, solute carrier family 16 (monocarboxylic acid transporters), member 1 |
| 1779 | 20889 | NM_012716 | e, aa, bb | solute carrier family 16 (monocarboxylic acid transporters), member 1 | RIKEN cDNA 1110004H10 gene, RIKEN cDNA 1200003C15 gene, solute carrier family 16 (monocarboxylic acid transporters), member 1 |
| 1996 | 23825 | NM_017299 | cc, dd | solute carrier family 19 (folate transporter), member 1, solute carrier family 19 (sodium/hydrogen exchanger), member 1 | solute carrier family 19 (folate transporter), member 1, solute carrier family 19 (sodium/hydrogen exchanger), member 1, solute carrier family 19 (sodium/hydrogen exchanger), member 3, solute carrier family 19 (thiamine transporter), member 2, solute carrier family 19 (thiamine transproter), member 2, solute carrier family 19, member 3 |
| 2551 | 16248 | NM_138827 | y, z | solute carrier family 2 (facilitated glucose transporter), member 1 | Mus musculus, clone MGC:8298 IMAGE:3593581, mRNA, complete cds, solute carrier family 2 (facilitated glucose transporter), member 1 |
| 2551 | 16249 | NM_138827 | j, k | solute carrier family 2 (facilitated glucose transporter), member 1 | Mus musculus, clone MGC:8298 IMAGE:3593581, mRNA, complete cds, solute carrier family 2 (facilitated glucose transporter), member 1 |
| 1973 | 1510 | NM_017224 | ll | solute carrier family 22 (organic anion transporter), member 6 | Homo sapiens, Similar to ust3, clone MGC:23972 IMAGE:4714598, mRNA, complete cds, Mus musculus, Similar to solute carrier family 22 (organic anion transporter), member 7, clone MGC:18877 IMAGE:4236556, mRNA, complete cds, Rattus norvegicus mRNA for organic anion transporter 5, complete cds, expressed sequence AI648912, putative integral membrane transport UST1r, solute carrier family 22 (organic anion transporter), member 6, solute carrier family 22 (organic cation transporter)-like 2, ust3 |
| 1655 | 18018 | D12771 | f, g | solute carrier family 25 (mitochondrial carrier; adenine nucleotide translocator), member 5 | EST, Moderately similar to S03894 ADP, ATP carrier protein T3 [*H. sapiens*], EST, Weakly similar to A29132 ADP, ATP carrier protein T2 [*H. sapiens*], Homo sapiens, clone IMAGE:5215220, mRNA, Mus musculus, Similar to CG4995 gene product, clone MGC:7958 IMAGE:3584570, mRNA, complete cds, RIKEN cDNA 4933440H19 gene, folate transporter/carrier, solute carrier family 25 (mitochondrial carrier; adenine nucleotide translocator), member 5, solute carrier family 25 (mitochondrial carrier; adenine nucleotide translocator), member 6 |
| 2311 | 20743 | NM_031684 | a, x, z, kk | solute carrier family 29 (nucleoside transporters), member 1 | ESTs, Weakly similar to solute carrier family 29 (nucleoside transporters), member 1 [*Rattus norvegicus*] [*R. norvegicus*], RIKEN cDNA 4933435C21 gene, solute carrier family 29 (nucleoside transporters), member 1 |
| 2052 | 20734 | NM_019283 | j, k, t, u, v, jj, kk | solute carrier family 3 (activators of dibasic and neutral amino acid transport), member 2 | solute carrier family 3 (activators of dibasic and neutral amino acid transport), member 2 |
| 2052 | 20735 | NM_019283 | j, k, t, y, z, kk | solute carrier family 3 (activators of dibasic and neutral amino acid transport), member 2 | solute carrier family 3 (activators of dibasic and neutral amino acid transport), member 2 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1852 | 18076 | NM_013030 | cc, dd | solute carrier family 34 (sodium phosphate), member 1 | *Rattus norvegicus* mRNA for Na+/Pi-cotransporter type IIc, complete cds, *Rattus norvegicus* mRNA for NaPi-2 alpha, complete cds, expressed sequence AI649385, solute carrier family 34 (sodium phosphate), member 1 |
| 985 | 16335 | AI045744 | b, u, v | solute carrier family 4 (anion exchanger), member 1, solute carrier family 4, anion exchanger, member 1 (erythrocyte membrane protein band 3, Diego blood group) | ESTs, Moderately similar to B3AT MOUSE BAND 3 ANION EXCHANGE PROTEIN [*M. musculus*], expressed sequence AI503023, solute carrier family 4 (anion exchanger), member 1, solute carrier family 4, anion exchanger, member 1 (erythrocyte membrane protein band 3, Diego blood group) |
| 1920 | 24697 | NM_017048 | u, v, ii | solute carrier family 4 (anion exchanger), member 2, solute carrier family 4, anion exchanger, member 2 (erythrocyte membrane protein band 3-like 1) | solute carrier family 4 (anion exchanger), member 2, solute carrier family 4, anion exchanger, member 2 (erythrocyte membrane protein band 3-like 1) |
| 1969 | 24859 | NM_017206 | h, l | solute carrier family 6 (neurotransmitter transporter, taurine), member 6 | solute carrier family 6 (neurotransmitter transporter, taurine), member 6 |
| 1923 | 1876 | NM_017052 | w, x | sorbitol dehydrogenase, sorbitol dehydrogenase 1 | ESTs, Highly similar to A54674 L-iditol 2-dehydrogenase [*H. sapiens*], sorbitol dehydrogenase, sorbitol dehydrogenase 1 |
| 2049 | 23419 | NM_019257 | t | splicing factor, arginine/serine-rich 5, splicing factor, arginine/serine-rich 5 (SRp40, HRS) | ESTs, Weakly similar to SFR5 MOUSE SPLICING FACTOR, ARGININE/SERINE-RICH 5 [*M. musculus*], *Mus musculus*, clone MGC:36924 IMAGE:4945988, mRNA, complete cds, RIKEN cDNA 1210001E11 gene, RIKEN cDNA 6330415C05 gene, splicing factor, arginine/serine-rich 1 (splicing factor 2, alternate splicing factor), splicing factor, arginine/serine-rich 4, splicing factor, arginine/serine-rich 5, splicing factor, arginine/serine-rich 5 (SRp40, HRS) |
| 1948 | 16681 | NM_017136 | ii | squalene epoxidase | *Homo sapiens* cDNA FLJ30795 fis, clone FEBRA2001124, squalene epoxidase |
| 2294 | 14542 | NM_031596 | r | squamous cell carcinoma antigen recognised by T cells, squamous cell carcinoma antigen recognized by T-cells 1 | |
| 2294 | 14543 | NM_031596 | b, u, v | squamous cell carcinoma antigen recognised by T cells, squamous cell carcinoma antigen recognized by T-cells 1 | |
| 865 | 20924 | AI012832 | ii, ll | stannin | RIKEN cDNA 2810407J07 gene, stannin |
| 2491 | 15707 | NM_058208 | d | STAT induced STAT inhibitor-2, cytokine inducible SH2-containing protein 2 | ESTs, Weakly similar to cytokine inducible SH2-containing protein CIS4 [*Mus musculus*] [*M. musculus*], JAK binding protein, RIKEN cDNA 5830401B18 gene, STAT induced STAT inhibitor-4, Socs-5, cytokine inducible SH2-containing protein 2 |
| 1771 | 21087 | NM_012661 | cc, dd | steroid sulfatase, steroid sulfatase (microsomal), arylsulfatase C, isozyme S | ESTs, Highly similar to I37186 arylsulfatase D [*H. sapiens*], ESTs, Weakly similar to STS MOUSE STERYL-SULFATASE PRECURSOR [*M. musculus*], ESTs, Weakly similar to STS_RAT STERYL-SULFATASE PRECURSOR (STEROID SULFATASE) (STERYL-SULFATE SULFOHYDROLASE) (ARYLSULFATASE C) (ASC) [*R. norvegicus*], arylsulfatase E (chondrodysplasia punctata 1), arylsulfatase F, steroid sulfatase, steroid sulfatase (microsomal), arylsulfatase C, isozyme S |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1236 | 15393 | AI170663 | cc, dd | sterol regulatory element binding transcription factor 2 | sterol regulatory element binding factor 1, sterol regulatory element binding factor 2, sterol regulatory element binding transcription factor 2 |
| 1694 | 17508 | L08814 | ii | structure specific recognition protein 1 | ESTs, Weakly similar to S35637 high mobility group 1 protein homolog - rat (fragment) [R. norvegicus], Mus musculus, clone IMAGE:4948318, mRNA, partial cds, Mus musculus, clone IMAGE:5355658, mRNA, structure specific recognition protein 1 |
| 2425 | 18175 | NM_053752 | aa, bb | succinate-CoA ligase, GDP-forming, alpha subunit | |
| 2336 | 4748 | NM_031834 | s, t, aa, bb | sulfotransferase family 1A, phenol-preferring, member 1, sulfotransferase family, cytosolic, 1A, phenol-preferring, member 1 | Aryl sulfotransferase cytosolic, 1A, phenol-preferring, member 3, RIKEN cDNA 1110030E23 gene, sulfotransferase family 1A, phenol-preferring, member 1, sulfotransferase family, cytosolic, 1A, phenol-preferring, member 1, sulfotransferase family, cytosolic, 1A, phenol-preferring, member 2 |
| 2336 | 4749 | NM_031834 | t, bb | sulfotransferase family 1A, phenol-preferring, member 1, sulfotransferase family, cytosolic, 1A, phenol-preferring, member 1 | Aryl sulfotransferase cytosolic, 1A, phenol-preferring, member 3, RIKEN cDNA 1110030E23 gene, sulfotransferase family 1A, phenol-preferring, member 1, sulfotransferase family, cytosolic, 1A, phenol-preferring, member 1, sulfotransferase family, cytosolic, 1A, phenol-preferring, member 2 |
| 1922 | 20875 | NM_017050 | hh | superoxide dismutase 1, soluble, superoxide dismutase 1, soluble (amyotrophic lateral sclerosis 1 (adult)) | EST, Weakly similar to SODC MOUSE SUPEROXIDE DISMUTASE [M. musculus], superoxide dismutase 1, soluble (amyotrophic lateral sclerosis 1 (adult)) |
| 1922 | 20876 | NM_017050 | r | superoxide dismutase 1, soluble, superoxide dismutase 1, soluble (amyotrophic lateral sclerosis 1 (adult)) | EST, Weakly similar to SODC MOUSE SUPEROXIDE DISMUTASE [M. musculus], superoxide dismutase 1, soluble (amyotrophic lateral sclerosis 1 (adult)) |
| 2164 | 18098 | NM_022947 | l | suppressor of K+ transport defect 3, suppressor of potassium transport defect 3 | |
| 2130 | 4601 | NM_022524 | l, m | sushi-repeat-containing protein, sushi-repeat-containing protein, X chromosome | ESTs, Weakly similar to down-regulated by v-src gene [Rattus norvegicus] [R. norvegicus], Homo sapiens mRNA; cDNA DKFZp586N2022 (from clone DKFZp586N2022), RIKEN cDNA 1110039C07 gene, RIKEN cDNA 2610001E17 gene, sushi-repeat protein, sushi-repeat-containing protein, sushi-repeat-containing protein, X chromosome |
| 833 | 15917 | AI011498 | b | SWI/SNF related, matrix associated, actin dependent regulator of chromatin, subfamily d, member 2 | SWI/SNF related, matrix associated, actin dependent regulator of chromatin, subfamily d, member 2, SWI/SNF related, matrix associated, actin dependent regulator of chromatin, subfamily d, member 3 |
| 2027 | 20440 | NM_019166 | b, l, m | synaptogyrin 1 | ESTs, Moderately similar to SNG1_RAT SYNAPTOGYRIN 1 (P29) [R. norvegicus], synaptogyrin 1, synaptogyrin 3, synaptogyrin 4 |
| 2352 | 1171 | NM_032071 | y, z | synaptojanin 2 | EST, Weakly similar to JW0105 synaptojanin 2 alpha protein - mouse [M. musculus], ESTs, Moderately similar to PW0049 synaptojanin 2 zeta protein - mouse (fragment) [M. musculus], ESTs, Weakly similar to JW0105 synaptojanin 2 alpha protein - mouse [M. musculus], ESTs, Weakly similar to T42384 inositol-1,4,5-trisphosphate 5-phosphatase [M. musculus], Homo sapiens cDNA: FLJ23105 fis, clone LNG07677, inositol polyphosphate 5-phosphatase, oculocerebrorenal syndrome of Lowe, phosphatidylinositol (4,5) bisphosphate 5- |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | phosphatase homolog; phosphatidylinositol polyphosphate 5-phosphatase type IV, phosphatidylinositol (4,5) bisphosphate 5-phosphatase, A, synaptojanin 2 |
| 2015 | 20536 | NM_019122 | b, l, m, u, v | synaptotagmin 3, synaptotagmin III | |
| 1769 | 9423 | NM_012649 | j, k, y, z | syndecan 4, syndecan 4 (amphiglycan, ryudocan) | syndecan 4, syndecan 4 (amphiglycan, ryudocan) |
| 2250 | 1265 | NM_031124 | u, v | syntaxin 3, syntaxin 3A | syntaxin 3, syntaxin 3A |
| 2028 | 7486 | NM_019169 | n, o | synuclein, alpha, synuclein, alpha (non A4 component of amyloid precursor) | synuclein, alpha, synuclein, alpha (non A4 component of amyloid precursor) |
| 1963 | 19031 | NM_017180 | p, q | T-cell death associated gene, pleckstrin homology-like domain, family A, member 1 | ESTs, Weakly similar to S58222 PQ-rich protein [*H. sapiens*], T-cell death associated gene, pleckstrin homology-like domain, family A, member 1, pleckstrin homology-like domain, family A, member 3, tumor suppressing subtransferable candidate 3, tumor-suppressing subchromosomal transferable fragment 3 |
| 2620 | 25593 | U26310 | gg | tensin | |
| 2291 | 21715 | NM_031578 | aa | testis specific protein kinase 1, testis-specific kinase 1 | RIKEN cDNA 4833428C18 gene, RIKEN cDNA 4930584N22 gene, hypothetical protein BC007901, testis specific protein kinase 1, testis-specific kinase 1, testis-specific kinase 2 |
| 2299 | 24234 | NM_031614 | r, y, z, jj, kk | thioredoxin reductase 1 | thioredoxin reductase 1, thioredoxin reductase 2 |
| 2299 | 24235 | NM_031614 | y, z, kk | thioredoxin reductase 1 | thioredoxin reductase 1, thioredoxin reductase 2 |
| 2140 | 21076 | NM_022584 | e, w, x | thioredoxin reductase 2 | thioredoxin reductase 2 |
| 450 | 12031 | AA893860 | y, z | threonyl-tRNA synthetase | threonyl-tRNA synthetase |
| 1815 | 16871 | NM_012887 | y, ll | thymopoietin | ESTs, Highly similar to THPA_HUMAN THYMOPOIETIN ALPHA [*H. sapiens*], RIKEN cDNA 5630400D24 gene, thymopoietin |
| 2077 | 20816 | NM_021261 | c | thymosin, beta 10 | |
| 1855 | 11113 | NM_013046 | l, k, p, q, u, v, gg | thyrotropin releasing hormone, thyrotropin-releasing hormone | thyrotropin releasing hormone, thyrotropin-releasing hormone |
| 1855 | 11114 | NM_013046 | k, n, o, y, z, kk | thyrotropin releasing hormone, thyrotropin-releasing hormone | thyrotropin releasing hormone, thyrotropin-releasing hormone |
| 2092 | 243 | NM_021989 | h, l, n, o, ll | tissue inhibitor of metalloproteinase 2 | *Homo sapiens* mRNA; cDNA DKFZp761A0617 (from clone DKFZp761A0617), tissue inhibitor of metalloproteinase 2 |
| 229 | 17236 | AA858903 | s, t, gg | tissue inhibitor of metalloproteinase 3, tissue inhibitor of metalloproteinase 3 (Sorsby fundus dystrophy, pseudoinflammatory) | tissue inhibitor of metalloproteinase 3, tissue inhibitor of metalloproteinase 3 (Sorsby fundus dystrophy, pseudoinflammatory) |
| 512 | 17231 | AA924107 | ii | tissue inhibitor of metalloproteinase 3, tissue inhibitor of metalloproteinase 3 (Sorsby fundus dystrophy, pseudoinflammatory) | tissue inhibitor of metalloproteinase 3, tissue inhibitor of metalloproteinase 3 (Sorsby fundus dystrophy, pseudoinflammatory) |
| 697 | 17232 | AA965161 | ll | tissue inhibitor of metalloproteinase 3, tissue inhibitor of metalloproteinase 3 (Sorsby fundus dystrophy, pseudoinflammatory) | tissue inhibitor of metalloproteinase 3, tissue inhibitor of metalloproteinase 3 (Sorsby fundus dystrophy, pseudoinflammatory) |
| 476 | 23778 | AA899854 | c | topoisomerase (DNA) II alpha, topoisomerase (DNA) II alpha (170 kD) | ESTs, Moderately similar to A40493 DNA topoisomerase [*H. sapiens*], ESTs, Weakly similar to topoisomerase (DNA) II alpha [*Rattus norvegicus*] [*R. norvegicus*], topoisomerase (DNA) II alpha, topoisomerase (DNA) II beta |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2094 | 23780 | NM_022183 | jj, kk | topoisomerase (DNA) II alpha, topoisomerase (DNA) II alpha (170 kD) | ESTs, Moderately similar to A40493 DNA topoisomerase [*H. sapiens*], ESTs, Weakly similar to topoisomerase (DNA) II alpha [*Rattus norvegicus*] [*R. norvegicus*], topoisomerase (DNA) II alpha, topoisomerase (DNA) II beta |
| 2378 | 622 | NM_053369 | a, j, k | transcription factor 4 | EST, Highly similar to TRANSCRIPTION FACTOR 4 [*M. musculus*], transcription factor 4 |
| 2378 | 623 | NM_053369 | r, hh | transcription factor 4 | EST, Highly similar to TRANSCRIPTION FACTOR 4 [*M. musculus*], transcription factor 4 |
| 2079 | 18729 | NM_021578 | r | transforming growth factor, beta 1, transforming growth factor, beta 1 (Camurati-Engelmann disease) | |
| 1723 | 457 | M60666 | aa | tropomyosin 1 (alpha), tropomyosin 1, alpha | *Homo sapiens* cDNA FLJ30635 fis, clone CTONG2002520, expressed sequence AI854628, expressed sequence C76867, tropomyosin 4, tuftelin 1 |
| 2018 | 455 | NM_019131 | b, u, v | tropomyosin 1 (alpha), tropomyosin 1, alpha | *Homo sapiens* cDNA FLJ30635 fis, clone CTONG2002520, expressed sequence AI854628, expressed sequence C76867, tropomyosin 4, tuftelin 1 |
| 2018 | 461 | NM_019131 | b, l, m | tropomyosin 1 (alpha), tropomyosin 1, alpha | *Homo sapiens* cDNA FLJ30635 fis, clone CTONG2002520, expressed sequence AI854628, expressed sequence C76867, tropomyosin 4, tuftelin 1 |
| 1773 | 24854 | NM_012676 | aa, bb | troponin T2, cardiac | EST, Weakly similar to TRT2 MOUSE TROPONIN T, CARDIAC MUSCLE ISOFORMS [*M. musculus*], hypothetical protein FLJ10498 |
| 1811 | 24617 | NM_012870 | ii | tumor necrosis factor receptor superfamily, member 11b (osteoprotegerin) | tumor necrosis factor receptor superfamily, member 11a, tumor necrosis factor receptor superfamily, member 11a, activator of NFKB, tumor necrosis factor receptor superfamily, member 11b (osteoprotegerin), tumor necrosis factor receptor superfamily, member 21, tumor necrosis factor receptor superfamily, member 5, tumor necrosis factor receptor superfamily, member 6b, decoy |
| 1935 | 23665 | NM_017092 | u, v | TYRO3 protein tyrosine kinase, TYRO3 protein tyrosine kinase 3 | AXL receptor tyrosine kinase, TYRO3 protein tyrosine kinase, TYRO3 protein tyrosine kinase 3 |
| 2295 | 19341 | NM_031603 | h, l | tyrosine 3-monooxygenase/tryptophan 5-monooxygenase activation protein, epsilon polypeptide | ESTs, Highly similar to I38947 14-3-3 protein epsilon isoform [*H. sapiens*], tyrosine 3-monooxygenase/tryptophan 5-monooxygenase activation protein, epsilon polypeptide |
| 554 | 3817 | AA926328 | p, q | tyrosine 3-monooxygenase/tryptophan 5-monooxygenase activation protein, zeta polypeptide | ESTs, Highly similar to A Chain A, 14-3-3 ZetaPHOSPHOPEPTIDE COMPLEX [*H. sapiens*], tyrosine 3-monooxygenase/tryptophan 5-monooxygenase activation protein, zeta polypeptide |
| 1846 | 25279 | NM_013011 | p, q | tyrosine 3-monooxygenase/tryptophan 5-monooxygenase activation protein, zeta polypeptide | ESTs, Highly similar to A Chain A, 14-3-3 ZetaPHOSPHOPEPTIDE COMPLEX [*H. sapiens*], tyrosine 3-monooxygenase/tryptophan 5-monooxygenase activation protein, zeta polypeptide |
| 1846 | 3404 | NM_013011 | p, q | tyrosine 3-monooxygenase/tryptophan 5-monooxygenase activation protein, zeta polypeptide | ESTs, Highly similar to A Chain A, 14-3-3 ZetaPHOSPHOPEPTIDE COMPLEX [*H. sapiens*], tyrosine 3-monooxygenase/tryptophan 5-monooxygenase activation protein, zeta polypeptide |
| 1712 | 15049 | M24542 | aa, bb | ubiquinol-cytochrome c reductase, Rieske iron-sulfur polypeptide 1 | EST, Weakly similar to UCRI_HUMAN UBIQUINOL-CYTOCHROME C REDUCTASE IRON-SULFUR SUBUNIT, MITOCHONDRIAL PRECURSOR [*H. sapiens*], ESTs, Moderately similar to UCRI_HUMAN UBIQUINOL- |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | CYTOCHROME C REDUCTASE IRON-SULFUR SUBUNIT, MITOCHONDRIAL PRECURSOR [*H. sapiens*], RIKEN cDNA 4430402G14 gene, ubiquinol-cytochrome c reductase, Rieske iron-sulfur polypeptide 1 |
| 2477 | 15125 | NM_057105 | jj, kk, ll | UDP glycosyltransferase 1 family, polypeptide A6 | UDP glycosyltransferase 1 family, polypeptide A6, UDP glycosyltransferase 1 family, polypeptide A8 |
| 133 | 23828 | AA817823 | ii | UDP-Gal:betaGlcNAc beta 1,4-galactosyltransferase, polypeptide 2 | *Mus musculus*, Similar to xylosylprotein beta 1,4-galactosyltransferase, polypeptide 7 (galactosyltransferase I), clone MGC:28643 IMAGE:4224150, mRNA, complete cds, UDP-Gal:betaGlcNAc beta 1,4-galactosyltransferase, polypeptide 1, UDP-Gal:betaGlcNAc beta 1,4-galactosyltransferase, polypeptide 2 |
| 2426 | 7927 | NM_053765 | d | UDP-N-acetylglucosamine-2-epimerase/N-acetylmannosamine kinase | UDP-N-acetylglucosamine-2-epimerase/N-acetylmannosamine kinase |
| 2023 | 278 | NM_019150 | aa, bb | urocortin | urocortin |
| 2688 | 19279 | Y00350 | a, aa, bb, jj, kk | uroporphyrinogen decarboxylase | |
| 1215 | 6888 | AI169615 | s, t | VAMP (vesicle-associated membrane protein)-associated protein A (33 kD), vesicle-associated membrane protein, associated protein A (33 kDa) | VAMP (vesicle-associated membrane protein)-associated protein A (33 kD), vesicle-associated membrane protein, associated protein A (33 kDa) |
| 1439 | 16203 | AI229196 | w, x, cc, dd | vesicle-associated membrane protein 1, vesicle-associated membrane protein 1 (synaptobrevin 1), vesicle-associated membrane protein 2, vesicle-associated membrane protein 2 (synaptobrevin 2) | vesicle-associated membrane protein 1, vesicle-associated membrane protein 2, vesicle-associated membrane protein 4 |
| 1772 | 16197 | NM_012663 | j, k | vesicle-associated membrane protein 2, vesicle-associated membrane protein 2 (synaptobrevin 2) | |
| 2472 | 23250 | NM_057097 | f, g | vesicle-associated membrane protein 3, vesicle-associated membrane protein 3 (cellubrevin) | ESTs, Weakly similar to vesicle-associated membrane protein 3 [*Rattus norvegicus*] [*R. norvegicus*], vesicle-associated membrane protein 3, vesicle-associated membrane protein 3 (cellubrevin), vesicle-associated membrane protein 4 |
| 2026 | 24362 | NM_019156 | jj, kk | vitronectin, vitronectin (serum spreading factor, somatomedin B, complement S-protein) | |
| 1956 | 21975 | NM_017154 | d, e, j, k, n, o, y, z, kk | xanthene dehydrogenase, xanthine dehydrogenase | |
| 1960 | 20919 | NM_017172 | a | zinc finger protein 36, C3H type-like 1 | ESTs, Weakly similar to S10471 cMG1 protein - rat [*R. norvegicus*], zinc finger protein 36, C3H type-like 1, zinc finger protein 36, C3H type-like 2 |
| 2511 | 25730 | NM_133290 | j, k, p, q | zinc finger protein 36, zinc finger protein 36, C3H type, homolog (mouse) | zinc finger protein 36, zinc finger protein 36, C3H type, homolog (mouse) |
| 2541 | 8692 | NM_134387 | hh | | 2,4-dienoyl CoA reductase 1, mitochondrial, 2,4-dienoyl CoA reductase 2, peroxisomal, 2-4-dienoyl-Coenzyme A reductase 2, peroxisomal, RIKEN cDNA 1810027P18 gene, putative peroxisomal 2,4-dienoyl-CoA reductase |
| 177 | 19451 | AA819788 | c | | 28 kD interferon responsive protein, RIKEN cDNA 5830458K16 gene |
| 1646 | 23219 | AJ000347 | n, o | | 3'(2'), 5'-bisphosphate nucleotidase 1, ESTs, Moderately similar to INPP MOUSE INOSITOL POLYPHOSPHATE 1-PHOSPHATASE [*M. musculus*], |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1715 | 15580 | M33648 | y, z | | bisphosphate 3-nucleotidase 1, hypothetical protein FLJ20421, inositol polyphosphate-1-phosphatase 3-hydroxy-3-methylglutaryl-Coenzyme A synthase 2, 3-hydroxy-3-methylglutaryl-Coenzyme A synthase 2 (mitochondrial) |
| 2465 | 17739 | NM_053995 | g | | 3-hydroxybutyrate dehydrogenase (heart, mitochondrial), ESTs, Weakly similar to BDH_RAT D-beta-hydroxybutyrate dehydrogenase, mitochondrial precursor (BDH) (3-hydroxybutyrate dehydrogenase) [R. norvegicus], RIKEN cDNA 0610039E24 gene, RIKEN cDNA 2310032J20 gene, retinol dehydrogenase 7, retinol dehydrogenase type 5 |
| 889 | 21950 | AI013861 | a, h, l | | 3-hydroxyisobutyrate dehydrogenase, ESTs, Highly similar to D3HI_HUMAN 3-HYDROXYISOBUTYRATE DEHYDROGENASE, MITOCHONDRIAL PRECURSOR (HIBADH) [H. sapiens], RIKEN cDNA 3930401K13 gene |
| 2060 | 1238 | NM_019333 | gg | | 6-phosphofructo-2-kinase/fructose-2,6-biphosphatase 1, 6-phosphofructo-2-kinase/fructose-2,6-biphosphatase 4, ESTs, Moderately similar to F26L MOUSE 6PF-2-K/FRU-2,6-P2ASE LIVER ISOZYME [M. musculus] |
| 2076 | 13486 | NM_020306 | aa, bb | | a disintegrin and metalloproteinase domain 17, a disintegrin and metalloproteinase domain 17 (tumor necrosis factor, alpha, converting enzyme) |
| 2323 | 20724 | NM_031753 | d | | activated leucocyte cell adhesion molecule, activated leukocyte cell adhesion molecule |
| 2198 | 938 | NM_024486 | u, v | | activin A receptor, type 1, activin A receptor, type I |
| 2083 | 19661 | NM_021686 | n | | activin receptor interacting protein 1, connector enhancer of KSR2, expressed sequence AA407180, phosphoinositide-binding protein PIP3-E |
| 472 | 4636 | AA899491 | e | | adaptor-related protein complex 1, mu 1 subunit |
| 2532 | 1271 | NM_133593 | a, ee, ff, jj, kk | | adaptor-related protein complex 3, mu 1 subunit, adaptor-related protein complex AP-3, mu 1 subunit |
| 2317 | 24081 | NM_031708 | e | | adhesion regulating molecule 1 |
| 1445 | 15212 | AI229753 | p, q, t, y, z, ee, ff | | ADP-ribosylation factor 1, ADP-ribosylation factor 2, ARF protein |
| 2178 | 1742 | NM_024150 | p, q, y, ee, ff | | ADP-ribosylation factor 1, ADP-ribosylation factor 2, ARF protein |
| 2127 | 4145 | NM_022518 | jj, kk | | ADP-ribosylation factor 1, ADP-ribosylation-like 6, ESTs, Weakly similar to ADP-RIBOSYLATION FACTOR 1 [M. musculus], expressed sequence T25534 |
| 2127 | 4151 | NM_022518 | b, l, m | | ADP-ribosylation factor 1, ADP-ribosylation-like 6, ESTs, Weakly similar to ADP-RIBOSYLATION FACTOR 1 [M. musculus], expressed sequence T25534 |
| 2179 | 17517 | NM_024151 | f | | ADP-ribosylation factor 4 |
| 2180 | 21696 | NM_024152 | y, z | | ADP-ribosylation factor 6, ESTs, Weakly similar to ARF6_HUMAN ADP-RIBOSYLATION FACTOR 6 [M. musculus], ESTs, Weakly similar to ARF6_HUMAN ADP-ribosylation factor 6 [R. norvegicus], RIKEN cDNA 1110033P22 gene, RIKEN cDNA 2310075M17 gene, RIKEN cDNA 9130014L17 gene, SAR1 protein, SAR1a gene homolog (S. cerevisiae), hypothetical protein FLJ22595 |
| 552 | 20327 | AA926265 | cc, dd | | ADP-ribosylation factor-like 5, ADP-ribosylation-like 6, expressed sequence |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2480 | 727 | NM_057123 | s, t | | T25534, hypothetical protein DKFZp434L1123 similar to mouse Arl6 AFG3 ATPase family gene 3-like 1 (yeast), BCS1-like (yeast), EST, Weakly similar to PRS4_HUMAN 26S protease regulatory subunit 4 (P26S4) [*M. musculus*], ESTs, Highly similar to PRS4_HUMAN 26S protease regulatory subunit 4 (P26S4) [*H. sapiens*], *Homo sapiens* cDNA FLJ31926 fis, clone NT2RP7005502, moderately similar to *Homo sapiens* mRNA for paraplegin-like protein, protease (prosome, macropain) 26S subunit, ATPase 1, proteasome (prosome, macropain) 26S subunit, ATPase, 1 |
| 2418 | 2063 | NM_053682 | e | | AFG3 ATPase family gene 3-like 2 (yeast), AFG3(ATPase family gene 3)-like 1 (yeast), *Mus musculus*, clone IMAGE:5040761, mRNA, partial cds, YME1-like 1 (*S. cerevisiae*), spastic paraplegia 7, paraplegin (pure and complicated autosomal recessive) |
| 1403 | 3094 | AI179700 | b, l, m | | Agrin, ESTs, Weakly similar to A38096 perlecan precursor [*H. sapiens*], ESTs, Weakly similar to BASEMENT MEMBRANE-SPECIFIC HEPARAN SULFATE PROTEOGLYCAN CORE PROTEIN PRECURSOR [*M. musculus*], ESTs, Weakly similar to PGBM_HUMAN BASEMENT MEMBRANE-SPECIFIC HEPARAN SULFATE PROTEOGLYCAN CORE PROTEIN PRECURSOR [*H. sapiens*], *Mus musculus*, clone IMAGE:3494258, mRNA, partial cds, heparan sulfate proteoglycan 2 (perlecan), perlecan (heparan sulfate proteoglycan 2), serine protease inhibitor, Kazal type, 5, sialoadhesin, transmembrane protein with EGF-like and two follistatin-like domains 1 |
| 280 | 16074 | AA874874 | p, q | | alcohol dehydrogenase 5, alcohol dehydrogenase 5 (class III), chi polypeptide |
| 2343 | 24644 | NM_031972 | cc, dd | | aldehyde dehydrogenase 3 family, member B1, aldehyde dehydrogenase 3 family, member B2, aldehyde dehydrogenase 3 family, member A1, aldehyde dehydrogenase family 3, subfamily A1 |
| 485 | 4725 | AA900290 | t, y, z, ee, ff | | Alpha-2-macroglobulin, CCR4 carbon catabolite repression 4-like (*S. cerevisiae*), ESTs, Weakly similar to A2MG MOUSE ALPHA-2-MACROGLOBULIN PRECURSOR [*M. musculus*], *Homo sapiens*, clone MGC:1119 IMAGE:2959975, mRNA, complete cds, *Mus musculus*, clone MGC:29037 IMAGE:3598248, mRNA, complete cds, *Mus musculus*, clone MGC:29167 IMAGE:5052974, mRNA, complete cds, alpha-2-macroglobulin, carbon catabolite repression 4 homolog (*S. cerevisiae*), pregnancy-zone protein |
| 2171 | 8269 | NM_023103 | b, l, m | | alpha-2-macroglobulin, murinoglobulin 1, murinoglobulin 2, murinoglobulin, pseudogene 1 |
| 1876 | 16649 | NM_013132 | c, gg | | annexin A5 |
| 222 | 15260 | AA858518 | f, g | | APC11 anaphase promoting complex subunit 11 homolog (yeast), ESTs, Highly similar to T51146 ring-box protein 1 [*H. sapiens*], ESTs, Weakly similar to T51146 ring-box protein 1 [*H. sapiens*], ring finger protein 7, ring-box 1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 687 | 18830 | AA964496 | a, z | | ARP2 actin-related protein 2 homolog (yeast), ARP3 actin-related protein 3 homolog (yeast), EST, Weakly similar to ACTB_HUMAN Actin, cytoplasmic 1 (Beta-actin) [*R. norvegicus*], ESTs, Highly similar to ACTB_HUMAN ACTIN, CYTOPLASMIC 1 [*M. musculus*], ESTs, Weakly similar to A29861 actin gamma [*H. sapiens*], ESTs, Weakly similar to ACTB_HUMAN ACTIN, CYTOPLASMIC 1 [*M. musculus*], *Homo sapiens* cDNA FLJ31247 fis, clone KIDNE2005296, weakly similar to ACTIN, CYTOPLASMIC 1, *Homo sapiens* cDNA FLJ32120 fis, clone PEBLM1000068, highly similar to ACTIN, CYTOPLASMIC TYPE 5, *Homo sapiens* mRNA; cDNA DKFZp434B2115 (from clone DKFZp434B2115), RIKEN cDNA 1700052K15 gene, actin, beta, actin, beta, cytoplasmic, calcitonin gene-related peptide-receptor component protein, expressed sequence AV259599 |
| 1137 | 18831 | AI104357 | bb | | ARP2 actin-related protein 2 homolog (yeast), ARP3 actin-related protein 3 homolog (yeast), EST, Weakly similar to ACTB_HUMAN Actin, cytoplasmic 1 (Beta-actin) [*R. norvegicus*], ESTs, Highly similar to ACTB_HUMAN ACTIN, CYTOPLASMIC 1 [*M. musculus*], ESTs, Weakly similar to A29861 actin gamma [*H. sapiens*], ESTs, Weakly similar to ACTB_HUMAN ACTIN, CYTOPLASMIC 1 [*M. musculus*], *Homo sapiens* cDNA FLJ31247 fis, clone KIDNE2005296, weakly similar to ACTIN, CYTOPLASMIC 1, *Homo sapiens* cDNA FLJ32120 fis, clone PEBLM1000068, highly similar to ACTIN, CYTOPLASMIC TYPE 5, *Homo sapiens* mRNA; cDNA DKFZp434B2115 (from clone DKFZp434B2115), RIKEN cDNA 1700052K15 gene, actin, beta, actin, beta, cytoplasmic, calcitonin gene-related peptide-receptor component protein, expressed sequence AV259599 |
| 230 | 5867 | AA858953 | kk | | asparaginyl-tRNA synthetase, hypothetical protein FLJ23441 |
| 1383 | 15091 | AI178740 | cc, dd | | AT2 receptor-interacting protein 1, *Homo sapiens* cDNA FLJ32157 fis, clone PLACE6000205, moderately similar to TRANSCRIPTIONAL REPRESSOR PROTEIN YY1, YY1 transcription factor |
| 2559 | 7395 | NM_138883 | r | | ATP synthase, H+ transporting, mitochondrial F1 complex, O subunit, ATP synthase, H+ transporting, mitochondrial F1 complex, O subunit (oligomycin sensitivity conferring protein), EST, Weakly similar to ATPO_HUMAN ATP SYNTHASE OLIGOMYCIN SENSITIVITY CONFERRAL PROTEIN PRECURSOR, MITOCHONDRIAL [*H. sapiens*], ESTs, Highly similar to ATPO_HUMAN ATP SYNTHASE OLIGOMYCIN SENSITIVITY CONFERRAL PROTEIN PRECURSOR, MITOCHONDRIAL [*H. sapiens*], ESTs, Moderately similar to ATPO_HUMAN ATP SYNTHASE OLIGOMYCIN SENSITIVITY CONFERRAL PROTEIN PRECURSOR, MITOCHONDRIAL [*H. sapiens*] |
| 2509 | 20738 | NM_131907 | c | | ATPase, Ca++ transporting, type 2C, member 1, ATPase, Ca++ transporting, ubiquitous, *Homo sapiens* cDNA: |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | FLJ21771 fis, clone COLF7779, *Homo sapiens* mRNA; cDNA DKFZp434L231 (from clone DKFZp434L231), KIAA0703 gene product, putative secretory pathway Ca-ATPase SPCA2 |
| 2448 | 20939 | NM_053884 | gg | | ATPase, H+ transporting, lysosomal 14 kD, V1 subunit F |
| 1209 | 22661 | AI169265 | gg | | ATPase, H+ transporting, lysosomal interacting protein 1, EST, Weakly similar to I54197 hypothetical protein [*H. sapiens*], ESTs, Weakly similar to VAS1_RAT Vacuolar ATP synthase subunit S1 precursor (V-ATPase S1 subunit) (V-ATPase S1 accessory protein) (V-ATPase Ac45 subunit) (C7-1 protein) [*R. norvegicus*], Homo sapiens cDNA FLJ12563 fis, clone NT2RM4000820, weakly similar to VACUOLAR ATP SYNTHASE SUBUNIT AC45 PRECURSOR (EC 3.6.1.34), expressed sequence AW108110 |
| 2327 | 16178 | NM_031785 | f | | ATPase, H+ transporting, lysosomal interacting protein 1, EST, Weakly similar to I54197 hypothetical protein [*H. sapiens*], ESTs, Weakly similar to VAS1_RAT Vacuolar ATP synthase subunit S1 precursor (V-ATPase S1 subunit) (V-ATPase S1 accessory protein) (V-ATPase Ac45 subunit) (C7-1 protein) [*R. norvegicus*], Homo sapiens cDNA FLJ12563 fis, clone NT2RM4000820, weakly similar to VACUOLAR ATP SYNTHASE SUBUNIT AC45 PRECURSOR (EC 3.6.1.34), expressed sequence AW108110 |
| 2296 | 20840 | NM_031604 | cc, dd | | ATPase, H+ transporting, lysosomal V0 subunit A isoform 4, ATPase, H+ transporting, lysosomal V0 subunit a isoform 1, ATPase, H+ transporting, lysosomal V0 subunit a isoform 2, ATPase, H+ transporting, lysosomal V0 subunit a isoform 4, EST, Weakly similar to B38656 vacuolar proton pump 116K chain - rat [*R. norvegicus*], ESTs, Moderately similar to B38656 vacuolar proton pump 116K chain - rat [*R. norvegicus*] |
| 1871 | 23709 | NM_013113 | f, g | | ATPase, Na+/K+ transporting, beta 1 polypeptide |
| 1871 | 23710 | NM_013113 | hh | | ATPase, Na+/K+ transporting, beta 1 polypeptide |
| 1560 | 3650 | AI235738 | r | | ATP-binding cassette, sub-family C (CFTR/MRP), member 4, ATP-binding cassette, sub-family C (CFTR/MRP), member 9, ESTs, Weakly similar to ATP binding cassette, sub-family C, member 9, isoform c; sulfonylurea-binding protein 2; sulfonylurea receptor 2 [*Mus musculus*] [*M. musculus*], Homo sapiens cDNA FLJ31957 fis, clone NT2RP7007381, highly similar to Sulfonylurea receptor 2A, *Mus musculus* adult male pituitary gland cDNA, RIKEN full-length enriched library, clone:5330439B14:ATP-binding cassette, sub-family C (CFTR/MRP), member 9, full insert sequence |
| 1217 | 24146 | AI169668 | ii | | ATP-binding cassette, sub-family F (GCN20), member 2 |
| 248 | 20582 | AA859688 | w, hh | | AU RNA binding protein/enoyl-Coenzyme A hydratase, AU RNA binding protein/enoyl-coenzyme A hydratase, ESTs, Weakly similar to I37195 AU-specific RNA-binding protein/enoyl-CoA hydratase homolog [*H. sapiens*], Mus |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 798 | 22545 | AI009747 | a | | musculus, Similar to 3-hydroxyisobutyryl-Coenzyme A hydrolase, clone MGC:31364 IMAGE:4238681, mRNA, complete cds, RIKEN cDNA 1300017C12 gene, uncharacterized hypothalamus protein HCDASE |
| 2055 | 23679 | NM_019290 | p, q | | B-cell translocation gene 1, anti-proliferative, ESTs, Highly similar to TOB1_HUMAN TOB1 PROTEIN [*H. sapiens*], transducer of ERBB2, 1, transducer of ERBB2, 2, transducer of ErbB-2.1 |
| 2500 | 23033 | NM_080888 | r | | B-cell translocation gene 3, BTG family, member 3 |
| 2153 | 17757 | NM_022698 | cc, dd | | BCL2/adenovirus E1B 19 kDa-interacting protein 3-like, BCL2/adenovirus E1B 19 kD interacting protein 3-like |
| 781 | 21632 | AI009167 | a, y, z, ee, ff | | BCL2-antagonist of cell death, Bcl-associated death promoter |
| 1493 | 15171 | AI231792 | ee, ff | | BCL2-associated athanogene 2 |
| | | | | | BCL2-associated athanogene 3, BCL2-associated athanogene 5, Bcl2-associated athanogene 3, RIKEN cDNA 1700081D05 gene |
| 558 | 22677 | AA942718 | s, t, kk | | BCL2-related ovarian killer, Bcl2-like |
| 660 | 23957 | AA957123 | c | | brain expressed, X-linked 1, hypothetical protein FLJ10097 |
| 1466 | 22387 | AI230753 | f, g | | brain protein I3 |
| 412 | 11997 | AA892828 | f, h, l | | branched chain ketoacid dehydrogenase E1, beta polypeptide, pyruvate dehydrogenase (lipoamide) beta |
| 1313 | 5876 | AI176117 | hh | | branched chain ketoacid dehydrogenase E1, beta polypeptide, pyruvate dehydrogenase (lipoamide) beta |
| 2209 | 21801 | NM_030987 | cc, dd, ii | | BUB3 budding uninhibited by benzimidazoles 3 homolog (yeast), ESTs, Weakly similar to guanine nucleotide-binding protein, beta-1# subunit [*Rattus norvegicus*] [*R. norvegicus*], *Mus musculus*, clone MGC:7934 IMAGE:3583848, mRNA, complete cds, budding uninhibited by benzimidazoles 3 homolog (*S. cerevisiae*), guanine nucleotide binding protein, beta 1, neural precursor cell expressed, developmentally down-regulated gene 1 |
| 2209 | 21805 | NM_030987 | cc, dd | | BUB3 budding uninhibited by benzimidazoles 3 homolog (yeast), ESTs, Weakly similar to guanine nucleotide-binding protein, beta-1# subunit [*Rattus norvegicus*] [*R. norvegicus*], *Mus musculus*, clone MGC:7934 IMAGE:3583848, mRNA, complete cds, budding uninhibited by benzimidazoles 3 homolog (*S. cerevisiae*), guanine nucleotide binding protein, beta 1, neural precursor cell expressed, developmentally down-regulated gene 1 |
| 698 | 2582 | AA965164 | gg | | CAC-1, RIKEN cDNA 1810017F10 gene, RIKEN cDNA 2010001C09 gene |
| 2594 | 15711 | NM_153629 | p | | calcium binding protein, 140 kDa, heat shock 70 kDa protein 4, heat shock 70 kD protein 4, heat shock protein (hsp110 family), osmotic stress protein 94 kDa, oxygen regulated protein (150 kD) |
| 435 | 11935 | AA893328 | gg | | calmegin, calnexin |
| 67 | 17875 | AA799755 | cc, dd | | Carboxypeptidase E, ESTs, Weakly similar to carboxypeptidase E [*Rattus norvegicus*] [*R. norvegicus*], |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | carboxypeptidase E, carboxypeptidase X 1 (M14 family), expressed sequence AA589379, expressed sequence AA986902 |
| 1791 | 18066 | NM_012762 | aa, bb | | CARD only protein, ESTs, Moderately similar to A57511 interleukin-1 beta converting enzyme [*H. sapiens*], ESTs, Weakly similar to A56084 interleukin-1 beta converting enzyme beta isozyme [*H. sapiens*], Homo sapiens mRNA; cDNA DKFZp586A181 (from clone DKFZp586A181); partial cds, ICEBERG caspase-1 inhibitor, caspase 1, caspase 1, apoptosis-related cysteine protease (interleukin 1, beta, convertase) |
| 1791 | 18068 | NM_012762 | e | | CARD only protein, ESTs, Moderately similar to A57511 interleukin-1 beta converting enzyme [*H. sapiens*], ESTs, Weakly similar to A56084 interleukin-1 beta converting enzyme beta isozyme [*H. sapiens*], Homo sapiens mRNA; cDNA DKFZp586A181 (from clone DKFZp586A181); partial cds, ICEBERG caspase-1 inhibitor, caspase 1, caspase 1, apoptosis-related cysteine protease (interleukin 1, beta, convertase) |
| 1467 | 24270 | AI230758 | n, o | | cargo selection protein (mannose 6 phosphate receptor binding protein) |
| 2002 | 1894 | NM_017320 | b, l, m, kk | | cathepsin S |
| 1343 | 16124 | AI176963 | p, q, r, bb, ee, ff, jj, kk | | Cbp/p300-interacting transactivator with Glu/Asp-rich carboxy-terminal domain 1, Cbp/p300-interacting transactivator, with Glu/Asp-rich carboxy-terminal domain, 1, Cbp/p300-interacting transactivator, with Glu/Asp-rich carboxy-terminal domain, 2, Cbp/p300-interacting transactivator, with Glu/Asp-rich carboxy-terminal domain, 4 |
| 2419 | 16122 | NM_053698 | p, q, ee, ff | | Cbp/p300-interacting transactivator with Glu/Asp-rich carboxy-terminal domain 1, Cbp/p300-interacting transactivator, with Glu/Asp-rich carboxy-terminal domain, 1, Cbp/p300-interacting transactivator, with Glu/Asp-rich carboxy-terminal domain, 2, Cbp/p300-interacting transactivator, with Glu/Asp-rich carboxy-terminal domain, 4 |
| 2419 | 16123 | NM_053698 | d, p, q, jj, kk | | Cbp/p300-interacting transactivator with Glu/Asp-rich carboxy-terminal domain 1, Cbp/p300-interacting transactivator, with Glu/Asp-rich carboxy-terminal domain, 1, Cbp/p300-interacting transactivator, with Glu/Asp-rich carboxy-terminal domain, 2, Cbp/p300-interacting transactivator, with Glu/Asp-rich carboxy-terminal domain, 4 |
| 494 | 4790 | AA900875 | ee, ff | | Cbp/p300-interacting transactivator, with Glu/Asp-rich carboxy-terminal domain, 1, Cbp/p300-interacting transactivator, with Glu/Asp-rich carboxy-terminal domain, 4 |
| 1867 | 8899 | NM_013087 | d, f | | CD 81 antigen, CD81 antigen (target of antiproliferative antibody 1), ESTs, Weakly similar to CD81 ANTIGEN [*M. musculus*], ESTs, Weakly similar to CD81_RAT CD81 antigen (26 kDa cell surface protein TAPA-1) (Target of the antiproliferative antibody 1) [*R. norvegicus*] |
| 2086 | 19710 | NM_021744 | a, j, k, q, hh, kk | | CD14 antigen |
| 2129 | 4412 | NM_022523 | l, m | | CD151 antigen, EST AI426782, ESTs, Moderately similar to C151 MOUSE PLATELET-ENDOTHELIAL TETRASPAN ANTIGEN 3 [*M. musculus*], RIKEN cDNA 1110014F12 gene, RIKEN cDNA 2210021G21 gene, RIKEN cDNA 2610042G18 gene, RIKEN cDNA |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1932 | 1523 | NM_017079 | h, l, n, o, w, x | | 2700063A19 gene, transmembrane 4 superfamily member 6 CD1B antigen, b polypeptide, CD1D antigen, d polypeptide, CD1E antigen, e polypeptide, CD1d1 antigen, CD1d2 antigen, expressed sequence AI747460 |
| 2567 | 17854 | NM_139103 | ii | | CD2 antigen family, member 10, CD48 antigen, CD48 antigen (B-cell membrane protein), CD84 antigen, ESTs, Weakly similar to CD48_RAT MRC OX-45 surface antigen precursor (BCM1 surface antigen) (BLAST-1) (CD48) [*R. norvegicus*], RIKEN cDNA 5830408F06 gene, expressed sequence AI449234 |
| 666 | 24040 | AA957422 | n, o, w, x | | CD3 antigen, zeta polypeptide, CD3Z antigen, zeta polypeptide (TiT3 complex), Fc fragment of IgE, high affinity I, receptor for; gamma polypeptide, Fc receptor, IgE, high affinity I, gamma polypeptide, *Homo sapiens*, Similar to Fc fragment of IgE, high affinity I, receptor for; gamma polypeptide, clone MGC:22620 IMAGE:4704425, mRNA, complete cds, T-cell receptor CD3, subunit zeta |
| 393 | 24873 | AA892498 | jj, kk | | CD63 antigen (melanoma 1 antigen), Cd63 antigen, EST, Weakly similar to CD63 MOUSE CD63 ANTIGEN [*M. musculus*], expressed sequence C75951, tetraspan 3, transmembrane 4 superfamily member 8 |
| 2111 | 22499 | NM_022393 | a, p, q, cc, dd, ee, ff, jj, kk | | CD72 antigen, *Mus musculus* strain BALB/c dectin-2 gamma isoform mRNA, complete cds, alternatively spliced, NK receptor Ly-49Q, asialoglycoprotein receptor 1, macrophage galactose N-acetyl-galactosamine specific lectin |
| 2523 | 20890 | NM_133526 | ii | | CD9 antigen, CD9 antigen (p24), ESTs, Highly similar to 2103288A CD9 protein [*Rattus norvegicus*] [*R. norvegicus*], *Mus musculus*, clone MGC:38363 IMAGE:5344986, mRNA, complete cds, RIKEN cDNA 6330415F13 gene, transmembrane 4 superfamily member 3, uroplakin 1A |
| 304 | 15372 | AA875205 | y, z | | CDA02 protein, ESTs, Weakly similar to IF39_HUMAN EUKARYOTIC TRANSLATION INITIATION FACTOR 3 SUBUNIT 9 [*H. sapiens*] |
| 1685 | 15374 | H34186 | j, k | | CDA02 protein, ESTs, Weakly similar to IF39_HUMAN EUKARYOTIC TRANSLATION INITIATION FACTOR 3 SUBUNIT 9 [*H. sapiens*] |
| 2387 | 14904 | NM_053492 | s, t | | CDw92 antigen, ESTs, Weakly similar to CTL2 gene [*Homo sapiens*] [*H. sapiens*], ESTs, Weakly similar to transporter-like protein [*Rattus norvegicus*] [*R. norvegicus*], *Homo sapiens*, clone MGC:34032 IMAGE:4828797, mRNA, complete cds, *Mus musculus*, Similar to transporter-like protein, clone MGC:7894 IMAGE:3582543, mRNA, complete cds, RIKEN cDNA 1110028E10 gene, RIKEN cDNA 2210409B01 gene, chromosome 6 open reading frame 29, expressed sequence AW547365 |
| 2530 | 1827 | NM_133572 | r, u, v | | cell division cycle 25 homolog B (*S. cerevisiae*), cell division cycle 25 homolog C (*S. cerevisiae*), cell division cycle 25B, cell division cycle 25C |
| 2530 | 1830 | NM_133572 | v | | cell division cycle 25 homolog B (*S. cerevisiae*), cell division cycle 25 homolog C (*S. cerevisiae*), cell division cycle 25B, cell division cycle 25C |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2530 | 1831 | NM_133572 | v | | cell division cycle 25 homolog B (*S. cerevisiae*), cell division cycle 25 homolog C (*S. cerevisiae*), cell division cycle 25B, cell division cycle 25C |
| 416 | 22871 | AA892859 | gg | | cerebral cell adhesion molecule |
| 33 | 23294 | AA799472 | b | | CGI-116 protein |
| 443 | 19505 | AA893634 | r, ii | | CGI-120 protein, COPZ2 for nonclathrin coat protein zeta-COP, coatomer protein complex, subunit zeta 1 |
| 1588 | 3368 | AI237331 | c | | CGI-143 protein |
| 1029 | 18 | AI070195 | w, x | | CGI-20 protein |
| 1520 | 3100 | AI232741 | hh | | CGI-51 protein, EST, Weakly similar to CG51_HUMAN PROTEIN CGI-51 [*H. sapiens*] |
| 647 | 14327 | AA956111 | h, l | | CGI-69 protein, EST, Moderately similar to T43493 hypothetical protein DKFZp434C119.1 [*H. sapiens*], mitochondrial carrier family protein |
| 2565 | 734 | NM_139094 | gg | | CGI-74-like SR-rich, DNA segment, Chr 17, human D6S45, EST, Weakly similar to SRA4_HUMAN CTD-BINDING SR-LIKE PROTEIN RA4 [*H. sapiens*], ESTs, Highly similar to T31420 C-terminal domain-binding protein rA8 - rat [*R. norvegicus*], ESTs, Moderately similar to RD PROTEIN [*M. musculus*], ESTs, Weakly similar to RD PROTEIN [*M. musculus*], ESTs, Weakly similar to T31420 C-terminal domain-binding protein rA8 - rat [*R. norvegicus*], KIAA1116 protein, expressed sequence AI447644, expressed sequence AI448652, hypothetical protein FLJ10290, pre-mRNA splicing SR protein rA4 |
| 1629 | 17215 | AI639268 | h, l, n, o, jj, kk | | CGI-86 protein, DKFZP566O084 protein, ESTs, Weakly similar to T17307 hypothetical protein DKFZp566O084.1 [*H. sapiens*], hypothetical protein MGC4172, retinal short chain dehydrogenase reductase |
| 294 | 16319 | AA875047 | e | | chaperonin containing TCP1, subunit 6A (zeta 1), chaperonin subunit 6a (zeta) |
| 607 | 22615 | AA945643 | kk | | chitinase 3-like 1, chitinase 3-like 1 (cartilage glycoprotein-39) |
| 2216 | 1024 | NM_031016 | s, u, v | | cholinergic receptor, muscarinic 2 |
| 2216 | 1025 | NM_031016 | u, v | | cholinergic receptor, muscarinic 2 |
| 84 | 18881 | AA799992 | c, h, l, n, o, w, x | | chromosome 11 open reading frame 17, predicted gene ICRFP703B1614Q5.6 |
| 84 | 18883 | AA799992 | c, n, o, kk | | chromosome 11 open reading frame 17, predicted gene ICRFP703B1614Q5.6 |
| 878 | 23444 | AI013448 | d | | chromosome 20 open reading frame 30 |
| 1861 | 17181 | NM_013073 | gg | | chromosome 20 open reading frame 36, protein-L-isoaspartate (D-aspartate) O-methyltransferase, protein-L-isoaspartate (D-aspartate) O-methyltransferase 1 |
| 1861 | 21830 | NM_013073 | aa, bb | | chromosome 20 open reading frame 36, protein-L-isoaspartate (D-aspartate) O-methyltransferase, protein-L-isoaspartate (D-aspartate) O-methyltransferase 1 |
| 77 | 21000 | AA799816 | h, l | | chromosome 7 open reading frame 2, lipocalin-interacting membrane receptor |
| 2602 | 951 | S69206 | ii | | chymase 1, mast cell, mast cell protease 1 |
| 2438 | 17154 | NM_053835 | b, gg | | clathrin, light polypeptide (Lca), clathrin, light polypeptide (Lcb), expressed sequence AV026556 |
| 2438 | 17155 | NM_053835 | g | | clathrin, light polypeptide (Lca), clathrin, light polypeptide (Lcb), expressed sequence AV026556 |
| 2438 | 18065 | NM_053835 | c | | clathrin, light polypeptide (Lca), clathrin, light polypeptide (Lcb), expressed sequence AV026556 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1604 | 17108 | AI639017 | ll | | CLLL8 protein, EST, Highly similar to S30385 G9a protein [*H. sapiens*], ESTs, Weakly similar to T17453 ERG-associated protein ESET - mouse [*M. musculus*], SET domain, bifurcated 1, euchromatic histone methyltransferase 1, suppressor of variegation 3-9 (*Drosophila*) homolog 2; hypothetical protein FLJ23414 |
| 2501 | 9952 | NM_080902 | cc, dd | | CLST 11240 protein, DKFZP564K247 protein, ESTs, Highly similar to T14766 hypothetical protein DKFZp564K247.1 [*H. sapiens*], ESTs, Weakly similar to hypoxia induced gene 1 [*Rattus norvegicus*] [*R. norvegicus*], Homo sapiens mRNA; cDNA DKFZp434A1627 (from clone DKFZp434A1627), RIKEN cDNA 2010110M21 gene, RIKEN cDNA 2310056K19 gene, hypothetical protein MGC2198, hypoxia induced gene 1 |
| 1856 | 24874 | NM_013057 | r | | coagulation factor III, coagulation factor III (thromboplastin, tissue factor) |
| 2546 | 19894 | NM_138518 | t, ll | | Cocoacrisp, EST, Highly similar to epididymal glycoprotein [*Rattus norvegicus*] [*R. norvegicus*], acidic epididymal glycoprotein 1, acidic epididymal glycoprotein 2, epididymal glycoprotein, glioma pathogenesis-related protein |
| 991 | 8012 | AI058330 | ee, ff, kk | | Complement component 4 binding protein, alpha, *Mus musculus* decay accelerating factor glycosylphoshatidylinositol-anchored form (DAF) mRNA, partial cds, complement component 4 binding protein, complement component 4 binding protein, alpha, decay accelerating factor 1, expressed sequence AI195242, expressed sequence AI323748, zona pellucida 3 receptor |
| 196 | 24128 | AA849766 | bb | | component of oligomeric golgi complex 4 |
| 1358 | 24129 | AI177590 | b | | component of oligomeric golgi complex 4 |
| 2101 | 6585 | NM_022266 | q, kk | | connective tissue growth factor |
| 1428 | 22915 | AI228299 | bb | | craniofacial development protein 1 |
| 2009 | 468 | NM_017348 | w, x | | Creatine transporter [human, brainstem/spinal cord, mRNA, 2283 nt], ESTs, Highly similar to G02277 creatine transporter [*H. sapiens*], Mus musculus, Similar to solute carrier family 6 (neurotransmitter transporter, GABA), member 13, clone MGC:28956 IMAGE:4240641, mRNA, complete cds, X transporter protein 3, expressed sequence AA589632, solute carrier family 6 (neurotransmitter transporter, creatine), member 8 |
| 1254 | 22958 | AI171374 | p, q, t | | CTAGE-1 protein, ESTs, Moderately similar to MEA6_HUMAN MENINGIOMA-EXPRESSED ANTIGEN 6/11 (MEA6) (MEA11) [*H. sapiens*], ESTs, Weakly similar to MEA6_HUMAN MENINGIOMA-EXPRESSED ANTIGEN 6/11 (MEA6) (MEA11) [*H. sapiens*], KIAA0268 protein, meningioma expressed antigen 6 (coiled-coil proline-rich) |
| 1451 | 7650 | AI230142 | w, x | | C-type (calcium dependent, carbohydrate recognition domain) lectin, superfamily member 13, ESTs, Weakly similar to KUCR_RAT Kupffer cell receptor [*R. norvegicus*], Kupffer cell receptor, Langerhans cell specific c-type lectin |
| 1792 | 17257 | NM_012766 | e, aa, bb, ee, ff | | cyclin D3 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1792 | 17261 | NM_012766 | l, m | | cyclin D3 |
| 736 | 2782 | AA998565 | c, l, m | | cyclin-dependent kinase inhibitor 1C (P57), cyclin-dependent kinase inhibitor 1C (p57, Kip2) |
| 2268 | 11258 | NM_031327 | y, z, ee, ff, gg | | cysteine rich protein 61, cysteine-rich, angiogenic inducer, 61 |
| 2183 | 20770 | NM_024160 | n, o | | cytochrome b-245, alpha polypeptide |
| 1795 | 449 | NM_012786 | hh | | cytochrome c oxidase, subunit VIIIb, heme-regulated initiation factor 2-alpha kinase |
| 1795 | 450 | NM_012786 | f, hh | | cytochrome c oxidase, subunit VIIIb, heme-regulated initiation factor 2-alpha kinase |
| 547 | 5227 | AA925924 | l, o, kk | | cytokine receptor-like factor 1 |
| 1528 | 5228 | AI233311 | h, l, n, o | | cytokine receptor-like factor 1 |
| 2395 | 4327 | NM_053563 | a, n, o, y, z, jj, kk | | DEAD/H (Asp-Glu-Ala-Asp/His) box polypeptide 20, DEAD/H (Asp-Glu-Ala-Asp/His) box polypeptide 20, 103 kD, DEAD/H (Asp-Glu-Ala-Asp/His) box polypeptide 39, DEAD/H (Asp-Glu-Ala-Asp/His) box polypeptide 6 (RNA helicase, 54 kD), DEAD/H (Asp-Glu-Ala-Asp/His) box polypeptide 7 (RNA helicase, 52 kD), EST, Moderately similar to HLA-B-associated transcript 1A; DNA segment, Chr 17, human D6S81E 1; nuclear RNA helicase Bat1 [*Mus musculus*] [*M. musculus*], HLA-B-associated transcript 1A |
| 2139 | 12422 | NM_022546 | n, o | | death-associated kinase 3, death-associated protein kinase 1, death-associated protein kinase 3, expressed sequence AI120141, serine/threonine kinase 17a (apoptosis-inducing), serine/threonine kinase 17b (apoptosis-inducing) |
| 2332 | 16155 | NM_031810 | ii | | defensin beta 1, defensin beta 2, defensin, beta 1, expressed sequence AW260221 |
| 2132 | 6100 | NM_022531 | n, o | | desmin |
| 2502 | 4739 | NM_130400 | aa, bb | | dihydrofolate reductase |
| 2182 | 4504 | NM_024159 | d | | disabled homolog 1 (*Drosophila*), disabled homolog 2 (*Drosophila*), disabled homolog 2, mitogen-responsive phosphoprotein (*Drosophila*) |
| 939 | 7880 | AI043714 | ii | | DKFZP434B0335 protein |
| 2453 | 531 | NM_053951 | gg | | DKFZP434I216 protein, ESTs, Highly similar to DBS MOUSE GUANINE NUCLEOTIDE EXCHANGE FACTOR DBS [*M. musculus*], ESTs, Weakly similar to DBS MOUSE GUANINE NUCLEOTIDE EXCHANGE FACTOR DBS [*M. musculus*], ESTs, Weakly similar to TIAM MOUSE T-LYMPHOMA INVASION AND METASTASIS INDUCING PROTEIN 1 [*M. musculus*], *Homo sapiens* cDNA: FLJ21933 fis, clone HEP04337, KIAA0861 protein, KIAA1209 protein, MCF.2 cell line derived transforming sequence, MCF.2 cell line derived transforming sequence-like, RIKEN cDNA 2410008H17 gene, T-cell lymphoma invasion and metastasis 2, expressed sequence AA408740, hypothetical protein MGC2780, likely ortholog of mouse common-site lymphoma/leukemia GEF, mcf.2 transforming sequence |
| 2401 | 24875 | NM_053583 | ii, jj, kk | | DKFZP564D0764 protein ESTs, Weakly similar to zinc finger protein 319 [*Mus musculus*] [*M. musculus*], KIAA1805 protein, *Mus musculus*, clone MGC:29358 IMAGE:5038671, mRNA, complete cds, OLF-1/EBF associated zinc finger gene, RIKEN cDNA |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1166 | 10780 | AI136555 | c | | 4931408L03 gene, early B-cell factor associated zinc finger protein DKFZP564O0823 protein, ESTs, Weakly similar to S59856 collagen alpha 1(III) chain precursor - mouse [*M. musculus*], hypothetical protein DKFZp547D065, hypothetical protein FLJ13725, mucin and cadherin-like, splicing factor 3a, subunit 2, 66 kD |
| 482 | 11268 | AA899969 | l, m | | DKFZP566C0424 protein |
| 1015 | 8347 | AI059519 | n, o | | DKFZP566D213 protein, EST, Moderately similar to EPIDERMAL GROWTH FACTOR PRECURSOR [*M. musculus*], Homo sapiens mRNA; cDNA DKFZp434O0213 (from clone DKFZp434O0213); partial cds, hypothetical protein MGC11256, nidogen 2 |
| 2580 | 1948 | NM_145092 | b, l, m | | DKFZP586G011 protein, ESTs, Weakly similar to T08767 probable lamina-associated protein DKFZp586G011.1 [*H. sapiens*], Mus musculus, clone MGC:6357 IMAGE:3493883, mRNA, complete cds |
| 742 | 21666 | AB012214 | n, o | | DNA (cytosine-5-)-methyltransferase 1, DNA methyltransferase (cytosine-5) 1, EST, Weakly similar to JE0378 DNA (cytosine-5-)-methyltransferase (EC 2.1.1.37) - rat [*R. norvegicus*], F-box and leucine-rich repeat protein 11, Mus musculus DNA cytosine methyltransferase mRNA, methyl-CpG binding domain protein 1, protein containing CXXC domain 2 |
| 2283 | 1822 | NM_031553 | ii | | DNA polymerase epsilon, subunit 3, ESTs, Moderately similar to CCAAT-BINDING TRANSCRIPTION FACTOR SUBUNIT A [*M. musculus*], ESTs, Weakly similar to A23692 transcription factor, CCAAT-binding, chain A1 - rat [*R. norvegicus*], RIKEN cDNA 1810034K18 gene, down-regulator of transcription 1, down-regulator of transcription 1, TBP-binding (negative cofactor 2), nuclear transcription factor Y, beta, nuclear transcription factor-Y beta, polymerase (DNA directed), epsilon 3 (p17 subunit) |
| 1650 | 2401 | AJ011607 | u | | DNA primase, p58 subunit, primase, polypeptide 2A (58 kD) |
| 2248 | 23568 | NM_031122 | e | | DNA segment, Chr 1, Brigham & Women's Genetics 0212 expressed, EST, Weakly similar to suppression of tumorigenicity 13 (colon carcinoma) Hsp70-interacting protein [*Rattus norvegicus*] [*R. norvegicus*], ESTs, Weakly similar to suppression of tumorigenicity 13 (colon carcinoma) Hsp70-interacting protein [*Rattus norvegicus*] [*R. norvegicus*], RIKEN cDNA 1700010I24 gene, RIKEN cDNA 2310040B03 gene, expressed sequence AW538196, sperm associated antigen 1, suppression of tumorigenicity 13 (colon carcinoma) (Hsp70 interacting protein) |
| 2248 | 23569 | NM_031122 | r | | DNA segment, Chr 1, Brigham & Women's Genetics 0212 expressed, EST, Weakly similar to suppression of tumorigenicity 13 (colon carcinoma) Hsp70-interacting protein [*Rattus norvegicus*] [*R. norvegicus*], ESTs, Weakly similar to suppression of tumorigenicity 13 (colon carcinoma) Hsp70-interacting protein [*Rattus norvegicus*] [*R. norvegicus*], RIKEN cDNA 1700010I24 gene, RIKEN cDNA |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2526 | 1824 | NM_133545 | j, k, r | | 2310040B03 gene, expressed sequence AW538196, sperm associated antigen 1, suppression of tumorigenicity 13 (colon carcinoma) (Hsp70 interacting protein) DNA segment, Chr 10, ERATO Doi 398, expressed, EST, Weakly similar to 2102279A protein Tyr phosphatase [*Rattus norvegicus*] [*R. norvegicus*], ESTs, Weakly similar to 41 MOUSE PROTEIN 4.1 [*M. musculus*], protein tyrosine phosphatase, non-receptor type 14, protein tyrosine phosphatase, non-receptor type 21 |
| 2255 | 13358 | NM_031135 | d | | DNA segment, Chr 12, ERATO Doi 427, expressed, RIKEN cDNA 7420700M05 gene, TGFB inducible early growth response, TGFB inducible early growth response 2 |
| 2255 | 13359 | NM_031135 | s, t | | DNA segment, Chr 12, ERATO Doi 427, expressed, RIKEN cDNA 7420700M05 gene, TGFB inducible early growth response, TGFB inducible early growth response 2 |
| 2570 | 14463 | NM_139110 | ii | | DNA segment, Chr 17, ERATO Doi 479, expressed, EGF-like module containing, mucin-like, hormone receptor-like sequence 1, EST, Highly similar to T08685 hypothetical protein DKFZp564O1923.1 [*H. sapiens*], EST, Weakly similar to EMR1 MOUSE CELL SURFACE GLYCOPROTEIN EMR1 PRECURSOR [*M. musculus*], ESTs, Weakly similar to EMR1 MOUSE CELL SURFACE GLYCOPROTEIN EMR1 PRECURSOR [*M. musculus*], KIAA0758 protein, cadherin EGF LAG seven-pas G-type receptor 2, hypothetical protein FLJ22684, latrophilin |
| 2103 | 23511 | NM_022294 | n, o | | DNA segment, Chr 17, ERATO Doi 479, expressed, EGF-like module containing, mucin-like, hormone receptor-like sequence 1, EST, Weakly similar to EMR1 MOUSE CELL SURFACE GLYCOPROTEIN EMR1 PRECURSOR [*M. musculus*], ESTs, Weakly similar to EMR1 MOUSE CELL SURFACE GLYCOPROTEIN EMR1 PRECURSOR [*M. musculus*], egf-like module containing, mucin-like, hormone receptor-like sequence 1 |
| 2236 | 20812 | NM_031100 | g, h, l | | DNA segment, Chr 3, University of California at Los Angeles 2, EST, Weakly similar to RL10 MOUSE 60S RIBOSOMAL PROTEIN L10 [*M. musculus*], EST, Weakly similar to RL10_MOUSE 60S ribosomal protein L10 (QM protein homolog) [*R. norvegicus*], ribosomal protein 10, ribosomal protein L10, ribosomal protein L10-like |
| 2625 | 1283 | U61729 | cc, dd, ll | | DNA segment, Chr 4, Brigham & Women's Genetics 0593 expressed, ESTs, Moderately similar to JC4899 proline rich protein - rat [*R. norvegicus*], RIKEN cDNA 0610011E17 gene, hypothetical protein FLJ20312, proline rich 2 |
| 2242 | 16847 | NM_031109 | h, l, x | | DNA segment, Chr 4, ERATO Doi 429, expressed, EST, Weakly similar to 2113200G ribosomal protein S10 [*H. sapiens*], EST, Weakly similar to ribosomal protein S10 [*H. sapiens*], ESTs, Highly similar to 2113200G ribosomal protein S10 [*H. sapiens*], ESTs, Highly similar to RS10 RAT 40S |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 461 | 16434 | AA894174 | h, l | | RIBOSOMAL PROTEIN S10 [R. norvegicus], ESTs, Moderately similar to RIKEN cDNA 2210402A09 [Mus musculus] [M. musculus], RIKEN cDNA 2210402A09 gene, ribosomal protein S10 DNA segment, Chr 9, ERATO Doi 394, expressed, Mus musculus, Similar to electron-transfer-flavoprotein, alpha polypeptide (glutaric aciduria II), clone MGC:6481 IMAGE:2646522, mRNA, complete cds, electron-transfer-flavoprotein, alpha polypeptide (glutaric aciduria II) |
| 2145 | 21115 | NM_022602 | j, k | | DNA segment, Chr X, Celltech Chiroscience 3, Mus musculus, serine threonine kinase pim3, clone MGC:27707 IMAGE:4924687, mRNA, complete cds, pim-1 oncogene, pim-2 oncogene, proviral integration site 1 |
| 29 | 17137 | AA799438 | ee, ff, jj, kk | | DNA segment, EST 1068184, ESTs, Highly similar to S68418 protein phosphatase 1M chain M110 isoform-rat [R. norvegicus], ESTs, Weakly similar to S68418 protein phosphatase 1M chain M110 isoform - rat (fragment) [R. norvegicus], ESTs, Weakly similar to T42713 ankyrin 3, splice form 1 - mouse [M. musculus], RIKEN cDNA 1810037O03 gene, ankyrin repeat and SOCS box-containing 1, ankyrin repeat and SOCS box-containing 2, ankyrin repeat and SOCS box-containing 3, leukocyte receptor cluster (LRC) member 3, protein phosphatase 1, regulatory (inhibitor) subunit 12A |
| 2207 | 1048 | NM_030863 | s, t, hh | | DNA segment, KIST 6, ESTs, Moderately similar to T47177 hypothetical protein DKFZp762H157.1 [H. sapiens], ESTs, Weakly similar to MOES MOUSE MOESIN [M. musculus], RIKEN cDNA 4933415I03 gene, expressed sequence AA408511, moesin, radixin, villin 2 (ezrin) |
| 2262 | 23097 | NM_031145 | n, o, cc, dd | | DNA-dependent protein kinase catalytic subunit-interacting protein 3, EST, Moderately similar to A Chain A, Homology-Based Model Of Apo Cib [H. sapiens], ESTs, Weakly similar to CIB_HUMAN SNK INTERACTING PROTEIN 2-28 [H. sapiens], ESTs, Weakly similar to KIP1_RAT DNA-PKcs interacting protein (Kinase interacting protein) (KIP) (Calcium and integrin binding protein) (CIB) [R. norvegicus], Mus musculus, Similar to protein kinase, DNA activated, catalytic polypeptide interacting protein, clone MGC:7098 IMAGE:3157513, mRNA, complete cds, RIKEN cDNA 1700041E20 gene, calcium and integrin binding 1 (calmyrin) |
| 246 | 16318 | AA859648 | p, q | | DnaJ (Hsp40) homolog, subfamily A, member 1, DnaJ (Hsp40) homolog, subfamily A, member 4, DnaJ (Hsp40) homolog, subfamily B, member 1, DnaJ (Hsp40) homolog, subfamily B, member 12, ESTs, Weakly similar to DJA1_MOUSE DnaJ homolog subfamily A member 1 (Heat shock 40 kDa protein 4) (DnaJ protein homolog 2) (HSJ-2) [R. norvegicus], ESTs, Weakly similar to HSJ2_HUMAN DNAJ PROTEIN HOMOLOG 2 [H. sapiens], Homo sapiens cDNA FLJ13992 fis, clone Y79AA1002139, weakly similar to DNAJ PROTEIN HOMOLOG 1, RIKEN cDNA |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 103 | 6892 | AA800551 | e, ee, ff, ii | | 1700014P03 gene, RIKEN cDNA 2010306G19 gene, RIKEN cDNA 5730551F12 gene, similar to MRJ gene for a member of the DNAJ protein family (*H. sapiens*) DnaJ (Hsp40) homolog, subfamily A, member 1, DnaJ (Hsp40) homolog, subfamily A, member 4, ESTs, Highly similar to HS44 MOUSE HEAT SHOCK 40 KDA PROTEIN 4 [*M. musculus*], ESTs, Moderately similar to DJA1_MOUSE DnaJ homolog subfamily A member 1 (Heat shock 40 kDa protein 4) (DnaJ protein homolog 2) (HSJ-2) [*R. norvegicus*], ESTs, Weakly similar to DnaJ-like protein [*Rattus norvegicus*] [*R. norvegicus*], ESTs, Weakly similar to HS44 MOUSE HEAT SHOCK 40 KDA PROTEIN 4 [*M. musculus*], Homo sapiens mRNA full length insert cDNA clone EUROIMAGE 730912, *Mus musculus* SEC63 (Sec63) mRNA, complete cds, similar to DNAJ |
| 2161 | 6891 | NM_022934 | ee, ff | | DnaJ (Hsp40) homolog, subfamily A, member 1, DnaJ (Hsp40) homolog, subfamily A, member 4, ESTs, Highly similar to HS44 MOUSE HEAT SHOCK 40 KDA PROTEIN 4 [*M. musculus*], ESTs, Moderately similar to DJA1_MOUSE DnaJ homolog subfamily A member 1 (Heat shock 40 kDa protein 4) (DnaJ protein homolog 2) (HSJ-2) [*R. norvegicus*], ESTs, Weakly similar to DnaJ-like protein [*Rattus norvegicus*] [*R. norvegicus*], ESTs, Weakly similar to HS44 MOUSE HEAT SHOCK 40 KDA PROTEIN 4 [*M. musculus*], Homo sapiens mRNA full length insert cDNA clone EUROIMAGE 730912, *Mus musculus* SEC63 (Sec63) mRNA, complete cds, similar to DNAJ |
| 1252 | 18047 | AI171359 | bb | | DnaJ (Hsp40) homolog, subfamily A, member 1, DnaJ (Hsp40) homolog, subfamily B, member 6, DnaJ-like protein, ESTs, Highly similar to HS44 MOUSE HEAT SHOCK 40 KDA PROTEIN 4 [*M. musculus*], Homo sapiens mRNA full length insert cDNA clone EUROIMAGE 730912, RIKEN cDNA 4930483N21 gene |
| 769 | 3808 | AI008643 | p, q, ee, ff | | DnaJ (Hsp40) homolog, subfamily B, member 1, DnaJ (Hsp40) homolog, subfamily B, member 5, *Homo sapiens* cDNA FLJ25366 fis, clone TST01784, RIKEN cDNA 1700014P03 gene, RIKEN cDNA 2010306G19 gene, RIKEN cDNA 5730551F12 gene, hypothetical protein FLJ14281 |
| 657 | 5990 | AA956907 | u, v | | DnaJ (Hsp40) homolog, subfamily C, member 8, *Homo sapiens* cDNA FLJ13613 fis, clone PLACE1010856, *Homo sapiens* mRNA; cDNA DKFZp434C2016 (from clone DKFZp434C2016), hypothetical protein DKFZp434B227 |
| 2080 | 18946 | NM_021584 | s, t | | doublecortex; lissencephaly, X-linked (doublecortin), doublecortin |
| 2621 | 399 | U31668 | p, q | | E2F transcription factor 4, p107/p130-binding, E2F transcription factor 5, E2F transcription factor 5, p130-binding, ESTs, Moderately similar to E2F5 MOUSE TRANSCRIPTION FACTOR E2F5 [*M. musculus*], ESTs, Moderately similar to E2F5_RAT TRANSCRIPTION FACTOR E2F5 (E2F-5) [*R. norvegicus*], |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1146 | 24375 | AI104979 | j, k | | *Mus musculus,* Similar to E2F transcription factor 4, p107/p130-binding, clone MGC:37558 IMAGE:4987691, mRNA, complete cds EBNA1 binding protein 2, ESTs, Moderately similar to EBNA1 binding protein 2; nucleolar protein p40; homolog of yeast EBNA1-binding protein; nuclear FGF3 binding protein; EBNA1-binding protein 2 [*Homo sapiens*] [*H. sapiens*] |
| 2151 | 17586 | NM_022694 | w, x | | EBNA-2 co-activator (100 kD), ESTs, Moderately similar to I38968 100 kDa coactivator [*H. sapiens*], staphylococcal nuclease domain containing 1 |
| 1667 | 22762 | D89730 | bb | | EGF-containing fibulin-like extracellular matrix protein 1, ESTs, Weakly similar to JC5621 epidermal growth factor-like protein, T16 precursor - rat [*R. norvegicus*], *Mus musculus,* Similar to EGF-containing fibulin-like extracellular matrix protein 1, clone IMAGE:5357328, mRNA, partial cds, epidermal growth factor-containing fibulin-like extracellular matrix protein 1, epidermal growth factor-containing fibulin-like extracellular matrix protein 2 |
| 2568 | 17868 | NM_139104 | r, s, t | | EGF-like-domain, multiple 6, ESTs, Moderately similar to T17324 hypothetical protein DKFZp564P2063.1 [*H. sapiens*], ESTs, Weakly similar to MEGF6 [*Rattus norvegicus*] [*R. norvegicus*], ESTs, Weakly similar to fibulin 5 [*Mus musculus*] [*M. musculus*], ESTs, Weakly similar to T09065 hypothetical protein - mouse [*M. musculus*], ESTs, Weakly similar to T17324 hypothetical protein DKFZp564P2063.1 [*H. sapiens*], ESTs, Weakly similar to TIE1 MOUSE TYROSINE-PROTEIN KINASE RECEPTOR TIE-1 PRECURSOR [*M. musculus*], MEGF6, NEU1 protein, RIKEN cDNA 6130401L20 gene, expressed sequence AW047140 |
| 1550 | 13293 | AI235032 | hh | | ELAV (embryonic lethal, abnormal vision, *Drosophila*)-like 2 (Hu antigen B), ELAV (embryonic lethal, abnormal vision, *Drosophila*)-like 4 (Hu antigen D), ESTs, Highly similar to ELV4_RAT ELAV-like protein 4 (Paraneoplastic encephalomyelitis antigen HuD) (Hu-antigen D) [*R. norvegicus*], ESTs, Moderately similar to ELV4_RAT ELAV-like protein 4 (Paraneoplastic encephalomyelitis antigen HuD) (Hu-antigen D) [*R. norvegicus*], ESTs, Weakly similar to HUD_HUMAN PARANEOPLASTIC ENCEPHALOMYELITIS ANTIGEN HUD [*H. sapiens*] |
| 1390 | 17358 | AI179147 | g | | electron-transfer-flavoprotein, beta polypeptide |
| 1328 | 17920 | AI176422 | ll | | electron-transferring-flavoprotein dehydrogenase |
| 943 | 7913 | AI043849 | ee, ff | | ELL-related RNA polymerase II, elongation factor, ESTs, Weakly similar to ELL MOUSE RNA POLYMERASE II ELONGATION FACTOR ELL [*M. musculus*], *Mus musculus,* clone IMAGE:3583970, mRNA, partial cds, RIKEN cDNA 9430098E02 gene, eleven-nineteen lysine-rich leukemia gene, hypothetical protein FLJ22637 |
| 669 | 23732 | AA957653 | ee, ff | | Ena-vasodilator stimulated phosphoprotein, RNB6, enabled |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 352 | 6535 | AA891746 | l, m | | homolog (*Drosophila*), expressed sequence AI528774, likely ortholog of mouse NPC derived proline rich protein 1, vasodilator-stimulated phosphoprotein endothelial differentiation-related factor 1, expressed sequence AA409425 |
| 1828 | 18694 | NM_012931 | j, k, gg | | enhancer of filamentation 1 (cas-like docking; Crk-associated substrate related), expressed sequence AI385681, neural precursor cell expressed, developmentally down-regulated gene 9, signal transduction protein (SH3 containing), v-crk-associated tyrosine kinase substrate |
| 1828 | 18695 | NM_012931 | j, k, y, z | | enhancer of filamentation 1 (cas-like docking; Crk-associated substrate related), expressed sequence AI385681, neural precursor cell expressed, developmentally down-regulated gene 9, signal transduction protein (SH3 containing), v-crk-associated tyrosine kinase substrate |
| 389 | 23194 | AA892417 | gg | | ephrin A1, ephrin-A1 |
| 2205 | 21509 | NM_030847 | h, l, n, o | | epithelial membrane protein 3 |
| 1737 | 25365 | NM_012519 | u, v, ll | | ER to nucleus signalling 1, ESTs, Weakly similar to A34366 Ca2+/calmodulin-dependent protein kinase (EC 2.7.1.123) II delta chain - rat [*R. norvegicus*], *Mus musculus,* clone MGC:18731 IMAGE:3980838, mRNA, complete cds, calcium/calmodulin-dependent protein kinase (CaM kinase) II alpha, calcium/calmodulin-dependent protein kinase (CaM kinase) II delta, calcium/calmodulin-dependent protein kinase II, delta |
| 1737 | 2735 | NM_012519 | r | | ER to nucleus signalling 1, ESTs, Weakly similar to A34366 Ca2+/calmodulin-dependent protein kinase (EC 2.7.1.123) II delta chain - rat [*R. norvegicus*], *Mus musculus,* clone MGC:18731 IMAGE:3980838, mRNA, complete cds, calcium/calmodulin-dependent protein kinase (CaM kinase) II alpha, calcium/calmodulin-dependent protein kinase (CaM kinase) II delta, calcium/calmodulin-dependent protein kinase II, delta |
| 1737 | 2736 | NM_012519 | j, k | | ER to nucleus signalling 1, ESTs, Weakly similar to A34366 Ca2+/calmodulin-dependent protein kinase (EC 2.7.1.123) II delta chain - rat [*R. norvegicus*], *Mus musculus,* clone MGC:18731 IMAGE:3980838, mRNA, complete cds, calcium/calmodulin-dependent protein kinase (CaM kinase) II alpha, calcium/calmodulin-dependent protein kinase (CaM kinase) II delta, calcium/calmodulin-dependent protein kinase II, delta |
| 2136 | 8596 | NM_022538 | ll | | ER transmembrane protein Dri 42, RIKEN cDNA 1810019D05 gene, phosphatidic acid phosphatase 2a, phosphatidic acid phosphatase type 2A, phosphatidic acid phosphatase type 2B, phosphatidic acid phosphatase type 2C, phosphatidic acid phosphatase type 2c |
| 2136 | 8597 | NM_022538 | aa, bb, kk, ll | | ER transmembrane protein Dri 42, RIKEN cDNA 1810019D05 gene, phosphatidic acid phosphatase 2a, phosphatidic acid phosphatase type 2A, phosphatidic acid phosphatase type 2B, phosphatidic acid phosphatase type 2C, phosphatidic acid phosphatase type 2c |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2071 | 16 | NM_019386 | cc, dd, kk | | erythrocyte membrane protein band 4.2, transglutaminase 2 (C polypeptide, protein-glutamine-gamma-glutamyltransferase), transglutaminase 2, C polypeptide, transglutaminase 3 (E polypeptide, protein-glutamine-gamma-glutamyltransferase), transglutaminase 3, E polypeptide, transglutaminase 5, transglutaminase Z |
| 2230 | 4684 | NM_031083 | b, l, m | | EST AA437822, *Homo sapiens,* Similar to phosphatidylinositol 4-kinase, catalytic, alpha polypeptide, clone MGC:31920 IMAGE:4565073, mRNA, complete cds, phosphatidylinositol 4-kinase, catalytic, alpha polypeptide, phosphatidylinositol 4-kinase, catalytic, beta polypeptide, phosphoinositide-3-kinase, catalytic, gamma polypeptide |
| 847 | 21796 | AI012221 | a, n, o, x, z, kk | | EST X83352, ESTs, Weakly similar to intracellular chloride ion channel protein p64H1 [*Rattus norvegicus*] [*R. norvegicus*], RIKEN cDNA 5730531E12 gene, chloride intracellular channel 1, chloride intracellular channel 3, chloride intracellular channel 4 (mitochondrial), intracellular chloride ion channel protein p64H1 |
| 1119 | 11721 | AI103391 | ee, ff | | EST, Highly similar to phosphatidylinositol 3-kinase, regulatory subunit, polypeptide [*Rattus norvegicus*] [*R. norvegicus*], ESTs, Moderately similar to P55G_MOUSE PHOSPHATIDYLINOSITOL 3-KINASE REGULATORY GAMMA SUBUNIT (PI3-KINASE P85-GAMMA SUBUNIT) (PTDINS-3-KINASE P85-GAMMA) (P55PIK) [*M. musculus*], phosphatidylinositol 3-kinase, regulatory subunit, polypeptide 2 (p85 beta), phosphoinositide-3-kinase, regulatory subunit, polypeptide 2 (p85 beta) |
| 2054 | 10015 | NM_019289 | n, o, jj, kk, ll | | EST, Highly similar to AR41_HUMAN ARP2/3 COMPLEX 41 KDA SUBUNIT [*H. sapiens*], actin related protein 2/3 complex, subunit 1B (41 kD), actin related protein 2/3 complex, subunit 1B (41 kDa) |
| 2054 | 10016 | NM_019289 | a, o, jj, kk, ll | | EST, Highly similar to AR41_HUMAN ARP2/3 COMPLEX 41 KDA SUBUNIT [*H. sapiens*], actin related protein 2/3 complex, subunit 1B (41 kD), actin related protein 2/3 complex, subunit 1B (41 kDa) |
| 1722 | 24662 | M59786 | l, m, jj, kk | | EST, Highly similar to CCAC_RAT Voltage-dependent L-type calcium channel alpha-1C subunit (Calcium channel, L type, alpha-1 polypeptide, isoform 1, cardiac muscle) (RAT brain class C) (RBC) [*R. norvegicus*], ESTs, Highly similar to CCAC_HUMAN VOLTAGE-DEPENDENT L-TYPE CALCIUM CHANNEL ALPHA-1C SUBUNIT [*H. sapiens*], ESTs, Highly similar to CCAD_HUMAN VOLTAGE-DEPENDENT L-TYPE CALCIUM CHANNEL ALPHA-1D SUBUNIT [*H. sapiens*], *Mus musculus* putative ion channel protein CATSPER2 mRNA, complete cds, calcium channel, voltage-dependent, L type, alpha 1C subunit |
| 1583 | 22939 | AI236669 | y, z, jj, kk | | EST, Highly similar to DPOZ_HUMAN DNA POLYMERASE ZETA CATALYTIC SUBUNIT [*H. sapiens*], ESTs, Highly similar to DPOZ_HUMAN DNA POLYMERASE ZETA CATALYTIC |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | SUBUNIT [*H. sapiens*], ESTs, Weakly similar to DPOZ_HUMAN DNA POLYMERASE ZETA CATALYTIC SUBUNIT [*H. sapiens*], REV3-like, catalytic subunit of DNA polymerase zeta (yeast), REV3-like, catalytic subunit of DNA polymerase zeta RAD54 like (*S. cerevisiae*), expressed sequence C77370, expressed sequence C77386 |
| 1894 | 16448 | NM_013197 | b, c, v | | EST, Highly similar to HEM0_RAT 5-AMINOLEVULINIC ACID SYNTHASE, ERYTHROID-SPECIFIC, MITOCHONDRIAL PRECURSOR (DELTA-AMINOLEVULINATE SYNTHASE) (DELTA-ALA SYNTHETASE) (ALAS-E) [*R. norvegicus*], ESTs, Highly similar to SYHUAE 5-aminolevulinate synthase [*H. sapiens*], aminolevulinate, delta-, synthase 2 (sideroblastic/hypochromic anemia), aminolevulinic acid synthase 1, aminolevulinic acid synthase 2, erythroid, glycine C-acetyltransferase (2-amino-3-ketobutyrate coenzyme A ligase), glycine C-acetyltransferase (2-amino-3-ketobutyrate-coenzyme A ligase) |
| 764 | 15849 | AI008074 | r, ll | | EST, Highly similar to HS9B MOUSE HEAT SHOCK PROTEIN HSP 90-BETA [*M. musculus*], EST, Weakly similar to HHMS84 heat shock protein 84 - mouse [*M. musculus*], ESTs, Highly similar to HS9A_HUMAN HEAT SHOCK PROTEIN HSP 90-ALPHA [*H. sapiens*], ESTs, Highly similar to T46243 hypothetical protein DKFZp761K0511.1 [*H. sapiens*], expressed sequence C81438, heat shock 90 kD protein 1, beta, heat shock protein, 84 kDa 1, heat shock protein, 86 kDa 1 |
| 631 | 643 | AA946439 | d | | EST, Highly similar to HSRT4 histone H4 - rat [*R. norvegicus*], EST, Moderately similar to HSHU4 histone H4 [*H. sapiens*], H4 histone family, member E, *Mus musculus* 10 day old male pancreas cDNA, RIKEN full-length enriched library, clone: 1810029H14:histone 4 protein, full insert sequence, *Mus musculus* adult male tongue cDNA, RIKEN full-length enriched library, clone:2310067E17:histone 4 protein, full insert sequence |
| 2461 | 15468 | NM_053982 | j, w, x, jj, kk | | EST, Highly similar to JC2234 ribosomal protein S15a, cytosolic [validated] - rat [*R. norvegicus*], ESTs, Highly similar to RS1A_HUMAN 40S RIBOSOMAL PROTEIN S15A [*H. sapiens*], ribosomal protein S15a |
| 2686 | 18031 | X94551 | f, r | | EST, Highly similar to MYHA_RAT Myosin heavy chain, nonmuscle type B (Cellular myosin heavy chain, type B) (Nonmuscle myosin heavy chain-B) (NMMHC-B) [*R. norvegicus*], ESTs, Highly similar to MYHA_MOUSE Myosin heavy chain, nonmuscle type B (Cellular myosin heavy chain, type B) (Nonmuscle myosin heavy chain-B) (NMMHC-B) [*M. musculus*], Homo sapiens cDNA: FLJ23324 fis, clone HEP12482, highly similar to HUMMYOHCB Human nonmuscle myosin heavy chain-B (MYH10) mRNA, Myosin heavy chain 11, RIKEN cDNA 5730504C04 gene, laminin, gamma 1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1480 | 20845 | AI231140 | w, x | | EST, Highly similar to R3RT3A ribosomal protein L23a, cytosolic [validated] - rat [*R. norvegicus*], EST, Weakly similar to E54024 protein kinase [*H. sapiens*], ESTs, Highly similar to 60S RIBOSOMAL PROTEIN L23A [*R. norvegicus*], ESTs, Highly similar to RL2B_HUMAN 60S RIBOSOMAL PROTEIN L23A [*H. sapiens*], Mus musculus, ribosomal protein L23a, clone IMAGE:4988735, mRNA, partial cds, ribosomal protein L23a |
| 2671 | 20844 | X65228 | f, g, cc, dd | | EST, Highly similar to R3RT3A ribosomal protein L23a, cytosolic [validated] - rat [*R. norvegicus*], EST, Weakly similar to E54024 protein kinase [*H. sapiens*], ESTs, Highly similar to 60S RIBOSOMAL PROTEIN L23A [*R. norvegicus*], ESTs, Highly similar to RL2B_HUMAN 60S RIBOSOMAL PROTEIN L23A [*H. sapiens*], Mus musculus, ribosomal protein L23a, clone IMAGE:4988735, mRNA, partial cds, ribosomal protein L23a |
| 404 | 15876 | AA892582 | g, w, x | | EST, Highly similar to RL8_HUMAN 60S ribosomal protein L8 [*R. norvegicus*], EST, Weakly similar to JN0923 ribosomal protein L8, cytosolic [*H. sapiens*], ESTs, Highly similar to R5RTL8 ribosomal protein L8, cytosolic [validated] - rat [*R. norvegicus*], ESTs, Highly similar to RL8_HUMAN 60S RIBOSOMAL PROTEIN L [*M. musculus*], ESTs, Moderately similar to RL8_HUMAN 60S RIBOSOMAL PROTEIN L [*M. musculus*], expressed sequence AL024098, ribosomal protein L8 |
| 1481 | 21816 | AI231217 | ll | | EST, Highly similar to S611_HUMAN Protein transport protein Sec61 alpha subunit isoform 1 (Sec61 alpha-1) [*R. norvegicus*], ESTs, Highly similar to S611_HUMAN Protein transport protein Sec61 alpha subunit isoform 1 (Sec61 alpha-1) [*R. norvegicus*], SEC61, alpha subunit (*S. cerevisiae*), SEC61, alpha subunit 2 (*S. cerevisiae*), Sec61 alpha form 2, protein transport protein SEC61 alpha subunit isoform 1 |
| 671 | 23644 | AA957808 | gg | | EST, Highly similar to SNX9_HUMAN SORTING NEXIN 9 (SH3 AND PX DOMAIN-CONTAINING PROTEIN 1) (SDP1 PROTEIN) [*H. sapiens*], Homo sapiens cDNA FLJ11997 fis, clone HEMBB1001458, sorting nexin 9 |
| 1786 | 343 | NM_012747 | n, o | | EST, Highly similar to STA3_RAT Signal transducer and activator of transcription 3 [*R. norvegicus*], signal transducer and activator of transcription 3, signal transducer and activator of transcription 3 (acute-phase response factor) |
| 1416 | 14337 | AI180414 | b, c, l, m | | EST, Highly similar to T14106 probable GTPase-activating protein SPA-1 - rat [*R. norvegicus*], ESTs, Moderately similar to T14106 probable GTPase-activating protein SPA-1 - rat [*R. norvegicus*], KIAA0440 protein, RIKEN cDNA 2610511M17 gene, Rap1, GTPase-activating protein 1, SPA-1 like protein p1294, expressed sequence AW213287 |
| 699 | 15885 | AA965207 | t | | EST, Highly similar to T14795 hypothetical protein DKFZp434E171.1 [*H. sapiens*] |
| 493 | 3822 | AA900863 | kk | | EST, Moderately similar to HLA-B-associated transcript 1A; DNA segment, Chr 17, human D6S81E 1; nuclear RNA |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | helicase Bat1 [*Mus musculus*] [*M. musculus*], EST, Weakly similar to HE47_RAT Probable ATP-dependent RNA helicase p47 [*R. norvegicus*], ESTs, Moderately similar to IF41_HUMAN EUKARYOTIC INITIATION FACTOR 4A-I [*M. musculus*], ESTs, Weakly similar to HE47 RAT PROBABLE ATP-DEPENDENT RNA HELICASE P47 [*R. norvegicus*], HLA-B-associated transcript 1A, RIKEN cDNA 24110004K13 gene, RIKEN cDNA 2600001H07 gene, RIKEN cDNA 2610307C23 gene, eukaryotic translation initiation factor 4A, isoform 1, eukaryotic translation initiation factor 4A1 |
| 1524 | 3823 | AI233147 | y, z | | EST, Moderately similar to HLA-B-associated transcript 1A; DNA segment, Chr 17, human D6S81E 1; nuclear RNA helicase Bat1 [*Mus musculus*] [*M. musculus*], EST, Weakly similar to HE47_RAT Probable ATP-dependent RNA helicase p47 [*R. norvegicus*], ESTs, Moderately similar to IF41_HUMAN EUKARYOTIC INITIATION FACTOR 4A-I [*M. musculus*], ESTs, Weakly similar to HE47 RAT PROBABLE ATP-DEPENDENT RNA HELICASE P47 [*R. norvegicus*], HLA-B-associated transcript 1A, RIKEN cDNA 2410004K13 gene, RIKEN cDNA 2600001H07 gene, RIKEN cDNA 2610307C23 gene, eukaryotic translation initiation factor 4A, isoform 1, eukaryotic translation initiation factor 4A1 |
| 122 | 23115 | AA801165 | c | | EST, Moderately similar to RIKEN cDNA 1700113O17 [*Mus musculus*] [*M. musculus*], H2A histone family, member L, *Homo sapiens*, clone MGC:21597 IMAGE:4511035, mRNA, complete cds, *Mus musculus*, similar to H2A histone family, member O, clone MGC:36202 IMAGE:5055276, mRNA, complete cds, expressed sequence R75370 |
| 2257 | 15485 | NM_031137 | l, m | | EST, Moderately similar to tripeptidylpeptidase II [*Rattus norvegicus*] [*R. norvegicus*], ESTs, Highly similar to TRIPEPTIDYL-PEPTIDASE II [*M. musculus*], tripeptidyl peptidase II |
| 2257 | 15486 | NM_031137 | w, x | | EST, Moderately similar to tripeptidylpeptidase II [*Rattus norvegicus*] [*R. norvegicus*], ESTs, Highly similar to TRIPEPTIDYL-PEPTIDASE II [*M. musculus*], tripeptidyl peptidase II |
| 1186 | 14524 | AI137974 | d | | EST, Moderately similar to 0710252A histone H3 [*H. sapiens*], ESTs, Highly similar to I57019 H3 histone - rat [*R. norvegicus*], ESTs, Weakly similar to I57019 H3 histone - rat [*R. norvegicus*], H3 histone family, member I, *Homo sapiens*, histone gene complex 1, clone MGC:9629 IMAGE:3913365, mRNA, complete cds |
| 7 | 14980 | AI103396 | l, m | | EST, Moderately similar to 0806162B cytochrome b [*M. musculus*], EST, Moderately similar to 810024B cytochrome b [*H. sapiens*], EST, Weakly similar to 0806162B cytochrome b [*M. musculus*], EST, Weakly similar to 0812187A cytochrome b [*Rattus norvegicus*] [*R. norvegicus*], EST, Weakly similar to 810024M URF 6 [*H. sapiens*] |
| 7 | 14981 | AI103396 | e | | EST, Moderately similar to 0806162B cytochrome b [*M. musculus*], EST, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 8 | 14983 | AI179150 | bb, cc, dd | | Moderately similar to 810024B cytochrome b [*H. sapiens*], EST, Weakly similar to 0806162B cytochrome b [*M. musculus*], EST, Weakly similar to 0812187A cytochrome b [*Rattus norvegicus*] [*R. norvegicus*], EST, Weakly similar to 810024M URF 6 [*H. sapiens*] EST, Moderately similar to 0806162B cytochrome b [*M. musculus*], EST, Moderately similar to 810024B cytochrome b [*H. sapiens*], EST, Weakly similar to 0806162B cytochrome b [*M. musculus*], EST, Weakly similar to 0812187A cytochrome b [*Rattus norvegicus*] [*R. norvegicus*], EST, Weakly similar to 810024M URF 6 [*H. sapiens*] |
| 1129 | 16136 | AI103983 | p, q | | EST, Moderately similar to 0806162C protein COI [*M. musculus*], EST, Moderately similar to 810024C cytochrome oxidase I [*H. sapiens*], EST, Weakly similar to 0806162C protein COI [*M. musculus*], ESTs, Moderately similar to 0806162C protein COI [*M. musculus*], ESTs, Moderately similar to 810024C cytochrome oxidase I [*H. sapiens*], ESTs, Weakly similar to 0806162C protein COI [*M. musculus*] |
| 9 | 16130 | J01435 | bb | | EST, Moderately similar to 0806162C protein COI [*M. musculus*], EST, Moderately similar to 810024C cytochrome oxidase I [*H. sapiens*], EST, Weakly similar to 0806162C protein COI [*M. musculus*], ESTs, Moderately similar to 0806162C protein COI [*M. musculus*], ESTs, Moderately similar to 810024C cytochrome oxidase I [*H. sapiens*], ESTs, Weakly similar to 0806162C protein COI [*M. musculus*] |
| 2388 | 16135 | NM_053516 | aa, bb | | EST, Moderately similar to 0806162C protein COI [*M. musculus*], EST, Moderately similar to 810024C cytochrome oxidase I [*H. sapiens*], EST, Weakly similar to 0806162C protein COI [*M. musculus*], ESTs, Moderately similar to 0806162C protein COI [*M. musculus*], ESTs, Moderately similar to 810024C cytochrome oxidase I [*H. sapiens*], ESTs, Weakly similar to 0806162C protein COI [*M. musculus*] |
| 2444 | 1570 | NM_053857 | s, t | | EST, Moderately similar to 2021415A initiation factor 4E-binding protein:ISOTYPE = 1 [*H. sapiens*], ESTs, Weakly similar to A55258 insulin-stimulated phosphoprotein PHAS-I - rat [*R. norvegicus*], RIKEN cDNA 1110004O12 gene, eukaryotic translation initiation factor 4E binding protein 1, eukaryotic translation initiation factor 4E binding protein 2, eukaryotic translation initiation factor 4E binding protein 3 |
| 2444 | 1571 | NM_053857 | e, t, kk | | EST, Moderately similar to 2021415A initiation factor 4E-binding protein:ISOTYPE = 1 [*H. sapiens*], ESTs, Weakly similar to A55258 insulin-stimulated phosphoprotein PHAS-I - rat [*R. norvegicus*], RIKEN cDNA 1110004O12 gene, eukaryotic translation initiation factor 4E binding protein 1, eukaryotic translation initiation factor 4E binding protein 2, eukaryotic translation initiation factor 4E binding protein 3 |
| 2668 | 15387 | X62482 | w, x | | EST, Moderately similar to 40S RIBOSOMAL PROTEIN S25 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | [*R. norvegicus*], EST, Moderately similar to R3RT25 ribosomal protein S25, cytosolic [validated] - rat [*R. norvegicus*], EST, Weakly similar to 40S RIBOSOMAL PROTEIN S25 [*R. norvegicus*], EST, Weakly similar to JQ1347 ribosomal protein S25, cytosolic [*H. sapiens*], ESTs, Highly similar to JQ1347 ribosomal protein S25, cytosolic [*H. sapiens*], ribosomal protein S25 |
| 2534 | 14995 | NM_133624 | d | | EST, Moderately similar to A Chain A, Structure Of Human Guanylate Binding Protein-1 In Nucleotide Free Form [*H. sapiens*], ESTs, Weakly similar to INTERFERON-INDUCED GUANYLATE-BINDING PROTEIN 1 [*M. musculus*], Homo sapiens mRNA; cDNA DKFZp564C2478 (from clone DKFZp564C2478); complete cds, guanylate binding protein 1, interferon-inducible, 67 kD, guanylate binding protein 2, interferon-inducible, guanylate nucleotide binding protein 1, guanylate nucleotide binding protein 2 |
| 2259 | 15185 | NM_031140 | n, bb, ll | | EST, Moderately similar to A25074 vimentin [*H. sapiens*], EST, Weakly similar to A25074 vimentin [*H. sapiens*], ESTs, Weakly similar to A25074 vimentin [*H. sapiens*], Mus musculus, similar to FLJ00074 protein, clone MGC:36549 IMAGE:4952810, mRNA, complete cds, desmuslin, intermediate filament-like MGC:2625, vimentin |
| 933 | 23950 | AI031019 | s, t | | EST, Moderately similar to A55146 guanine nucleotide exchange factor eIF-2B delta chain, long form - mouse [*M. musculus*], ESTs, Moderately similar to E2BA_HUMAN TRANSLATION INITIATION FACTOR EIF-2B ALPHA SUBUNIT [*H. sapiens*], ESTs, Weakly similar to 2112359A initiation factor eIF-2B [*Rattus norvegicus*] [*R. norvegicus*], Mus musculus, Similar to eukaryotic translation initiation factor 2B, subunit 1 (alpha, 26 kD), clone MGC:6458 IMAGE:2615801, mRNA, complete cds, Mus musculus, Similar to eukaryotic translation initiation factor 2B, subunit 2 (beta, 39 kD), clone MGC:7057 IMAGE:3156632, mRNA, complete cds, RIKEN cDNA 2410018C20 gene, eukaryotic translation initiation factor 2B, subunit 1 (alpha, 26 kD) |
| 1131 | 21927 | AI104117 | w, x | | EST, Moderately similar to CL36_HUMAN LIM DOMAIN PROTEIN CLP-36 [*H. sapiens*], ESTs, Weakly similar to A55050 enigma [*H. sapiens*], ESTs, Weakly similar to PDL1_RAT PDZ and LIM domain protein 1 (LIM domain protein CLP-36) (C-terminal LIM domain protein 1) (Elfin) [*R. norvegicus*], Homo sapiens cDNA: FLJ23564 fis, clone LNG10773, Homo sapiens, Similar to enigma homolog (*R. norvegicus*), clone MGC:23807 IMAGE:4271274, mRNA, complete cds, LIM domain binding 3, PDZ and LIM domain 1 (elfin), PDZ and LIM domain 3, RIKEN cDNA 2410002J21 gene, expressed sequence AV278559, expressed sequence AW123232, paxillin, transforming growth factor beta 1 induced transcript 1 |
| 746 | 3799 | AF002281 | p, u, v, ee, ff, kk, ll | | EST, Moderately similar to CL36_HUMAN LIM DOMAIN PROTEIN CLP-36 [*H. sapiens*], ESTs, Weakly |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | similar to PDL1_RAT PDZ and LIM domain protein 1 (LIM domain protein CLP-36) (C-terminal LIM domain protein 1) (Elfin) [R. norvegicus], Mus musculus, clone MGC:37634 IMAGE:4990983, mRNA, complete cds, PDZ and LIM domain 1 (elfin), PDZ and LIM domain 3, PDZ-LIM protein mystique, Rattus norvegicus LIM-domain protein LMP-1 mRNA, complete cds, alpha-actinin-2-associated LIM protein |
| 1291 | 7740 | AI175011 | r, hh | | EST, Moderately similar to COF1_HUMAN COFILIN, NON-MUSCLE ISOFOR [H. sapiens], EST, Weakly similar to COF1_HUMAN COFILIN, NON-MUSCLE ISOFOR [H. sapiens], ESTs, Highly similar to DEST_HUMAN DESTRIN [H. sapiens], ESTs, Moderately similar to COF1_HUMAN COFILIN, NON-MUSCLE ISOFOR [H. sapiens], Homo sapiens cDNA FLJ30934 fis, clone FEBRA2007017, moderately similar to Homo sapiens TRAF4-associated factor |
| 2065 | 23225 | NM_019360 | c | | EST, Moderately similar to COXI_MOUSE Cytochrome c oxidase polypeptide VIC-2 [R. norvegicus], ESTs, Moderately similar to COXH_HUMAN CYTOCHROME C OXIDASE POLYPEPTIDE VIC PRECURSOR [H. sapiens], cytochrome c oxidase subunit VIc, cytochrome c oxidase, subunit VIc |
| 1812 | 20945 | NM_012875 | cc, dd | | EST, Moderately similar to G02654 ribosomal protein L39 [H. sapiens], EST, Moderately similar to RL39_HUMAN 60S ribosomal protein L39 [R. norvegicus], ESTs, Highly similar to G02654 ribosomal protein L39 [H. sapiens], ESTs, Moderately similar to G02654 ribosomal protein L39 [H. sapiens], RIKEN cDNA 2810465O16 gene, RIKEN cDNA 3930402I10 gene, RIKEN cDNA 4930517K11 gene, ribosomal protein L39, ribosomal protein L39-like |
| 532 | 23173 | AA925057 | h, l, w, x | | EST, Moderately similar to G02666 cysteine-rich protein 1 [H. sapiens], cysteine rich intestinal protein, cysteine-rich protein 1 (intestinal), expressed sequence AW743261 |
| 2608 | 17626 | S78556 | gg | | EST, Moderately similar to GR75_HUMAN MITOCHONDRIAL STRESS-70 PROTEIN PRECURSOR [H. sapiens], ESTs, Highly similar to I56581 dnaK-type molecular chaperone grp75 precursor - rat [R. norvegicus], ESTs, Moderately similar to GR75_HUMAN MITOCHONDRIAL STRESS-70 PROTEIN PRECURSOR [H. sapiens], heat shock 70 kD protein 9B (mortalin-2), heat shock protein, 74 kDa, A |
| 1901 | 1495 | NM_013221 | y, z, aa, bb | | EST, Moderately similar to I58311 HMG-box containing protein 1 - rat [R. norvegicus], ESTs, Highly similar to I58311 HMG-box containing protein 1 - rat [R. norvegicus], ESTs, Moderately similar to I58311 HMG-box containing protein 1 - rat [R. norvegicus], HMG-box containing protein 1, Mus musculus, Similar to protein kinase, lysine deficient 4, clone IMAGE:4973225, mRNA, partial cds, RIKEN cDNA 1200010B10 gene, RIKEN cDNA 1700058O05 gene |
| 2110 | 22412 | NM_022392 | p, q | | EST, Moderately similar to ISI1_RAT Insulin-induced protein 1 (Insulin- |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | induced growth response protein CL-6) (Immediate-early protein CL-6) [R. norvegicus], RIKEN cDNA 2900053I11 gene, insulin induced gene 1, insulin induced protein 2 |
| 1127 | 4402 | AI103874 | r | | EST, Moderately similar to JQ1522 peptidylprolyl isomerase [H. sapiens], ESTs, Moderately similar to 1613455A FK506 binding protein FKBP [H. sapiens], FK506 binding protein 3 (25 kD), FK506 binding protein 7, FK506 binding protein 9 (63 kD), FK506 binding protein precursor, hypothetical protein FLJ20731 |
| 1889 | 1314 | NM_013181 | f | | EST, Moderately similar to KAP0_RAT CAMP-DEPENDENT PROTEIN KINASE TYPE I-ALPHA REGULATORY CHAIN [R. norvegicus], EST, Weakly similar to KAP1 MOUSE CAMP-DEPENDENT PROTEIN KINASE TYPE I-BETA REGULATORY CHAIN [M. musculus], protein kinase, cAMP dependent regulatory, type I beta, protein kinase, cAMP dependent regulatory, type I, alpha, protein kinase, cAMP-dependent, regulatory, type I, alpha (tissue specific extinguisher 1) |
| 2562 | 18867 | NM_138900 | b, c | | EST, Moderately similar to MAS2_HUMAN MANNAN-BINDING LECTIN SERINE PROTEASE 2 PRECURSOR [H. sapiens], ESTs, Moderately similar to CRAR_HUMAN COMPLEMENT-ACTIVATING COMPONENT OF RA-REACTIVE FACTOR PRECURSOR [H. sapiens], Mus musculus, Similar to complement component 1, s subcomponent, clone MGC:19094 IMAGE:4196654, mRNA, complete cds, Mus musculus, Similar to complement component 1, s subcomponent, clone MGC:28492 IMAGE:4166254, mRNA, complete cds, complement component 1, r subcomponent, complement component 1, s subcomponent, mannan-binding lectin serine protease 2 |
| 2126 | 162 | NM_022516 | e, u, v | | EST, Moderately similar to MDHM_RAT MALATE DEHYDROGENASE, MITOCHONDRIAL PRECURSOR [R. norvegicus], EST, Weakly similar to DEMSMM malate dehydrogenase [M. musculus], malate dehydrogenase 2, NAD (mitochondrial), malate dehydrogenase, mitochondrial |
| 1989 | 20281 | NM_017274 | gg | | EST, Moderately similar to PLSB MOUSE GLYCEROL-3-PHOSPHATE ACYLTRANSFERASE, MITOCHONDRIAL PRECURSOR [M. musculus], EST, Weakly similar to PLSB_RAT GLYCEROL-3-PHOSPHATE ACYLTRANSFERASE, MITOCHONDRIAL PRECURSOR (GPAT) [R. norvegicus], ESTs, Weakly similar to GLYCEROL-3-PHOSPHATE ACYLTRANSFERASE PRECURSOR [M. musculus], ESTs, Weakly similar to PLSB MOUSE GLYCEROL-3-PHOSPHATE ACYLTRANSFERASE, MITOCHONDRIAL PRECURSOR [M. musculus], KIAA1560 protein, glycerol-3-phosphate acyltransferase, mitochondrial |
| 1785 | 1478 | NM_012744 | n, o | | EST, Moderately similar to PYC_RAT Pyruvate carboxylase, mitochondrial precursor (Pyruvic carboxylase) (PCB) [R. norvegicus], Mus musculus, Similar to |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1193 | 18206 | AI145282 | a, jj, kk | | Propionyl Coenzyme A carboxylase, alpha polypeptide, clone MGC:11973 IMAGE:3601148, mRNA, complete cds, pyruvate carboxylase, pyruvate decarboxylase EST, Moderately similar to RBM8__HUMAN PUTATIVE RNA-BINDING PROTEIN 8 [*H. sapiens*], ESTs, Moderately similar to NUCLEOLIN [*M. musculus*], ESTs, Moderately similar to RBM8__HUMAN PUTATIVE RNA-BINDING PROTEIN 8 [*H. sapiens*], ESTs, Weakly similar to NUCL__HUMAN NUCLEOLIN [*H. sapiens*], Homo sapiens, clone MGC:22221 IMAGE:4687764, mRNA, complete cds, *Mus musculus*, Similar to fusion, derived from t(12; 16) malignant liposarcoma, clone MGC:18917 IMAGE:3153860, mRNA, complete cds, Nucleolin, RNA binding motif protein 8A, TAF15 RNA polymerase II, TATA box binding protein (TBP)-associated factor, 68 kDa, eukaryotic translation initiation factor 3, subunit 4 (delta, 44 kDa), nucleolin, pigpen |
| 1852 | 17174 | NM_013030 | l, m | | EST, Moderately similar to RL17__HUMAN 60S RIBOSOMAL PROTEIN L17 [*H. sapiens*], EST, Weakly similar to RL17 RAT 60S RIBOSOMAL PROTEIN L17 [*R. norvegicus*], EST, Weakly similar to RL17__HUMAN 60S RIBOSOMAL PROTEIN L17 [*H. sapiens*], ESTs, Highly similar to R5HU22 ribosomal protein L17, cytosolic [*H. sapiens*], ESTs, Highly similar to RL17 RAT 60S RIBOSOMAL PROTEIN L17 [*R. norvegicus*], ESTs, Weakly similar to R5HU22 ribosomal protein L17, cytosolic [*H. sapiens*], *Mus musculus* adult female placenta cDNA, RIKEN full-length enriched library, clone: 1600029O15:hexokinase 1, full insert sequence, ribosomal protein L17 |
| 2662 | 17176 | X60212 | f | | EST, Moderately similar to RL17__HUMAN 60S RIBOSOMAL PROTEIN L17 [*H. sapiens*], EST, Weakly similar to RL17 RAT 60S RIBOSOMAL PROTEIN L17 [*R. norvegicus*], EST, Weakly similar to RL17__HUMAN 60S RIBOSOMAL PROTEIN L17 [*H. sapiens*], ESTs, Highly similar to R5HU22 ribosomal protein L17, cytosolic [*H. sapiens*], ESTs, Highly similar to RL17 RAT 60S RIBOSOMAL PROTEIN L17 [*R. norvegicus*], ESTs, Weakly similar to R5HU22 ribosomal protein L17, cytosolic [*H. sapiens*], *Mus musculus* adult female placenta cDNA, RIKEN full-length enriched library, clone:1600029O15:hexokinase 1, full insert sequence, ribosomal protein L17 |
| 46 | 17212 | AA799571 | ll | | EST, Moderately similar to RL35__HUMAN 60S RIBOSOMAL PROTEIN L3 [*H. sapiens*], EST, Moderately similar to RL35__RAT 60S RIBOSOMAL PROTEIN L35 [*R. norvegicus*], Homo sapiens, clone IMAGE:4183312, mRNA, partial cds, ribosomal protein L35 |
| 1716 | 17211 | M34331 | cc, dd | | EST, Moderately similar to RL35__HUMAN 60S RIBOSOMAL PROTEIN L3 [*H. sapiens*], EST, Moderately similar to RL35__RAT 60S RIBOSOMAL PROTEIN L35 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1716 | 26030 | M34331 | g | | [*R. norvegicus*], *Homo sapiens*, clone IMAGE:4183312, mRNA, partial cds, ribosomal protein L35 EST, Moderately similar to RL35_HUMAN 60S RIBOSOMAL PROTEIN L3 [*H. sapiens*], EST, Moderately similar to RL35_RAT 60S RIBOSOMAL PROTEIN L35 [*R. norvegicus*], *Homo sapiens*, clone IMAGE:4183312, mRNA, partial cds, ribosomal protein L35 |
| 2318 | 16918 | NM_031709 | g, h, l, w, x | | EST, Moderately similar to RS12_HUMAN 40S RIBOSOMAL PROTEIN S1 [*H. sapiens*], ESTs, Moderately similar to R3HU12 ribosomal protein S12, cytosolic [*H. sapiens*], ESTs, Moderately similar to RS12 MOUSE 40S RIBOSOMAL PROTEIN S12 [*M. musculus*], ribosomal protein S12 |
| 2338 | 10269 | NM_031838 | h, l, w, x | | EST, Moderately similar to RS2 MOUSE 40S RIBOSOMAL PROTEIN S2 [*M. musculus*], EST, Weakly similar to ribosomal protein S2; 40S ribosomal protein S2 [*Homo sapiens*] [*H. sapiens*], EST, Weakly similar to RS2_HUMAN 40S RIBOSOMAL PROTEIN S2 [*H. sapiens*], EST, Weakly similar to RS2_RAT 40S RIBOSOMAL PROTEIN S2 [*R. norvegicus*], ESTs, Highly similar to ribosomal protein S2; 40S ribosomal protein S2 [*Homo sapiens*] [*H. sapiens*], ESTs, Highly similar to ribosomal protein S2; repeat family 3 gene [*Mus musculus*] [*M. musculus*], *Homo sapiens*, clone IMAGE:4816496, mRNA, partial cds, ribosomal protein S2 |
| 2244 | 19162 | NM_031111 | h, l | | EST, Moderately similar to RS21_RAT 40S RIBOSOMAL PROTEIN S21 [*R. norvegicus*], ribosomal protein S21 |
| 788 | 10820 | AI009411 | g, h, l | | EST, Moderately similar to RS3_MOUSE 40S ribosomal protein S3 [*R. norvegicus*], EST, Weakly similar to RS3_MOUSE 40S ribosomal protein S3 [*R. norvegicus*], ESTs, Highly similar to RS3_MOUSE 40S ribosomal protein S3 [*R. norvegicus*], ESTs, Moderately similar to RS3_HUMAN 40S RIBOSOMAL PROTEIN S [*H. sapiens*], ESTs, Weakly similar to RS3 MOUSE 40S RIBOSOMAL PROTEIN S3 [*M. musculus*], hypothetical protein FLJ11252, hypothetical protein FLJ23059, myo-inositol 1-phosphate synthase A1, ribosomal protein S3 |
| 1555 | 11644 | AI235282 | n, o | | EST, Moderately similar to S25111 alpha 2-macroglobulin receptor precursor - mouse [*M. musculus*], ESTs, Highly similar to S25111 alpha-2-macroglobulin receptor precursor - mouse [*M. musculus*], ESTs, Weakly similar to S25111 alpha-2-macroglobulin receptor precursor - mouse [*M. musculus*], low density lipoprotein receptor-related protein 1, low density lipoprotein-related protein 1 (alpha-2-macroglobulin receptor) |
| 383 | 13647 | AA892367 | w, x, cc, dd | | EST, Moderately similar to S34195 ribosomal protein L3, cytosolic [*H. sapiens*], EST, Weakly similar to S34195 ribosomal protein L3, cytosolic [*H. sapiens*], ESTs, Highly similar to S34195 ribosomal protein L3, cytosolic [*H. sapiens*], ESTs, Moderately similar to RL3_RAT 60S RIBOSOMAL PROTEIN L3 (L4) [*R. norvegicus*], ESTs, Weakly similar to RL3 MOUSE 60S |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2667 | 13646 | X62166 | n, o, w, x, kk, ll | | RIBOSOMAL PROTEIN L3 [*M. musculus*], RIKEN cDNA 1110057H16 gene, ribosomal protein L3, ribosomal protein L3-like EST, Moderately similar to S34195 ribosomal protein L3, cytosolic [*H. sapiens*], EST, Weakly similar to S34195 ribosomal protein L3, cytosolic [*H. sapiens*], ESTs, Highly similar to S34195 ribosomal protein L3, cytosolic [*H. sapiens*], ESTs, Moderately similar to RL3_RAT 60S RIBOSOMAL PROTEIN L3 (L4) [*R. norvegicus*], ESTs, Weakly similar to RL3 MOUSE 60S RIBOSOMAL PROTEIN L3 [*M. musculus*], RIKEN cDNA 1110057H16 gene, ribosomal protein L3, ribosomal protein L3-like |
| 520 | 18251 | AA924548 | jj, kk | | EST, Moderately similar to S65792 ribosomal protein L9, cytosolic [*H. sapiens*], EST, Weakly similar to RL9_RAT 60S RIBOSOMAL PROTEIN L9 [*R. norvegicus*], ESTs, Weakly similar to 60S RIBOSOMAL PROTEIN L9 [*M. musculus*], RIKEN cDNA 4930401B11 gene, ribosomal protein L9 |
| 1082 | 15192 | AI101099 | j, k | | EST, Moderately similar to SMHU1E metallothionein 1E [*H. sapiens*], ESTs, Highly similar to SMHU1B metallothionein 1B [*H. sapiens*], *H. sapiens* mRNA for metallothionein isoform 1R, *Homo sapiens* metallothionein 1H-like protein mRNA, complete cds, *Homo sapiens* unknown mRNA, *Homo sapiens*, Similar to RNA helicase-related protein, clone MGC:9246 IMAGE:3892441, mRNA, complete cds, *Mus musculus*, metallothionein 2A, clone MGC:30400 IMAGE:4501155, mRNA, complete cds, metallothionein 1H, metallothionein 1X, metallothionein 2 |
| 1330 | 15191 | AI176456 | h, l, j, k, y, z, ee, ff, kk | | EST, Moderately similar to SMHU1E metallothionein 1E [*H. sapiens*], ESTs, Highly similar to SMHU1B metallothionein 1B [*H. sapiens*], *H. sapiens* mRNA for metallothionein isoform 1R, *Homo sapiens* metallothionein 1H-like protein mRNA, complete cds, *Homo sapiens* unknown mRNA, *Homo sapiens*, Similar to RNA helicase-related protein, clone MGC:9246 IMAGE:3892441, mRNA, complete cds, *Mus musculus*, metallothionein 2A, clone MGC:30400 IMAGE:4501155, mRNA, complete cds, metallothionein 1H, metallothionein 1X, metallothionein 2 |
| 2456 | 16546 | NM_053965 | hh | | EST, Weakly similar to carnitine/acylcarnitine translocase; mitochondrial carnitine-acylcarnitine translocase gene [*Mus musculus*] [*M. musculus*], ESTs, Weakly similar to solute carrier family 25 (carnitine/acylcarnitine translocase), member 20 [*Rattus norvegicus*] [*R. norvegicus*], ESTs, Weakly similar to MCAT_HUMAN MITOCHONDRIAL CARNITINE/ACYLCARNITINE CARRIER PROTEIN [*H. sapiens*], *Homo sapiens*, similar to solute carrier family 25 (carnitine/acylcarnitine translocase), member 20, clone MGC:35539 IMAGE:5200129, mRNA, complete cds, *Mus musculus*, Similar to CG4995 gene |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2456 | 16547 | NM_053965 | hh | | product, clone MGC:7958 IMAGE:3584570, mRNA, complete cds, expressed sequence AW491445, expressed sequence W51672, ornithine transporter 2, solute carrier family 25 (carnitine/acylcarnitine translocase), member 20, solute carrier family 25 (mitochondrial carnitine/acylcarnitine translocase), member 20, solute carrier family 25 (mitochondrial carrier; adenine nucleotide translocator), member 3, solute carrier family 25 (mitochondrial carrier; ornithine transporter) member 15 EST, Weakly similar to carnitine/acylcarnitine translocase; mitochondrial carnitine-acylcarnitine translocase gene [Mus musculus] [M. musculus], ESTs, Weakly similar to solute carrier family 25 (carnitine/acylcarnitine translocase), member 20 [Rattus norvegicus] [R. norvegicus], ESTs, Weakly similar to MCAT_HUMAN MITOCHONDRIAL CARNITINE/ACYLCARNITINE CARRIER PROTEIN [H. sapiens], Homo sapiens, similar to solute carrier family 25 (carnitine/acylcarnitine translocase), member 20, clone MGC:35539 IMAGE:5200129, mRNA, complete cds, Mus musculus, Similar to CG4995 gene product, clone MGC:7958 IMAGE:3584570, mRNA, complete cds, expressed sequence AW491445, expressed sequence W51672, ornithine transporter 2, solute carrier family 25 (carnitine/acylcarnitine translocase), member 20, solute carrier family 25 (mitochondrial carnitine/acylcarnitine translocase), member 20, solute carrier family 25 (mitochondrial carrier; adenine nucleotide translocator), member 3, solute carrier family 25 (mitochondrial carrier; ornithine transporter) member 15 |
| 2405 | 20902 | NM_053593 | r | | EST, Weakly similar to cyclin-dependent kinase 4 [Rattus norvegicus] [R. norvegicus], ESTs, Moderately similar to cyclin-dependent kinase 4 [Rattus norvegicus] [R. norvegicus], ESTs, Moderately similar to CDK4 MOUSE CELL DIVISION PROTEIN KINASE 4 [M. musculus], cyclin-dependent kinase 4, cyclin-dependent kinase 6 |
| 390 | 9254 | AA892470 | e | | EST, Weakly similar to histone H2A.F/Z variant [Homo sapiens] [H. sapiens], ESTs, Weakly similar to H2AZ_HUMAN HISTONE H2A [H. sapiens], H2A histone family, member Z, Homo sapiens cDNA FLJ32241 fis, clone PLACE6005231, RIKEN cDNA C530002L11 gene, histone H2A.F/Z variant |
| 39 | 16942 | AA799520 | e | | EST, Weakly similar to integral membrane protein 2B [Homo sapiens] [H. sapiens], integral membrane protein 2B |
| 2072 | 904 | NM_019620 | p | | EST, Weakly similar to Kruppel associated box (KRAB) zinc finger 1 [Rattus norvegicus] [R. norvegicus], EST, Weakly similar to ZINC FINGER PROTEIN 91 [H. sapiens], ESTs, Moderately similar to DNA-binding protein; zinc finger protein 253 [Homo sapiens] [H. sapiens], ESTs, Moderately similar to ZINC FINGER PROTEIN 91 [H. sapiens], Mus musculus, Similar to RIKEN cDNA 2610036F08 gene, clone MGC:28645 IMAGE:4224834, mRNA, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | complete cds, expressed sequence AI790734, expressed sequence AU021768, zinc finger protein 386 (Kruppel-like), zinc finger protein 91 (HPF7, HTF10) |
| 2645 | 20810 | X14181 | f, g, w, x | | EST, Weakly similar to ribosomal protein L18a; 60S ribosomal protein L18a [*Homo sapiens*] [*H. sapiens*], ESTs, Highly similar to ribosomal protein L18a; 60S ribosomal protein L18a [*Homo sapiens*] [*H. sapiens*] |
| 353 | 18269 | AA891769 | e | | EST, Weakly similar to SC65 synaptonemal complex protein [*Rattus norvegicus*] [*R. norvegicus*], ESTs, Weakly similar to SC65 synaptonemal complex protein [*Rattus norvegicus*] [*R. norvegicus*], SC65 synaptonemal complex protein, cartilage associated protein, growth suppressor 1, nucleolar autoantigen (55 kD) similar to rat synaptonemal complex protein |
| 14 | 6917 | AA012709 | b | | EST, Weakly similar to splicing factor 3b, subunit 1, 155 kDa [*Mus musculus*] [*M. musculus*], ESTs, Weakly similar to S3B1_HUMAN Splicing factor 3B subunit 1 (Spliceosome associated protein 155) (SAP 155) (SF3b155) (Pre-mRNA splicing factor SF3b 155 kDa subunit) [*H. sapiens*], splicing factor 3b, subunit 1, 155 kDa, splicing factor 3b, subunit 1, 155 kD |
| 1368 | 22691 | AI177967 | r, aa, bb | | EST, Weakly similar to transforming growth factor-beta (TGF-beta) masking protein large subunit [*Rattus norvegicus*] [*R. norvegicus*], ESTs, Highly similar to FIBRILLIN 2 PRECURSOR [*M. musculus*], ESTs, Weakly similar to A57293 latent transforming growth factor beta-binding protein 3 precursor - mouse [*M. musculus*], RIKEN cDNA 2310046A13 gene, latent transforming growth factor beta binding protein 1, transforming growth factor-beta (TGF-beta) masking protein large subunit |
| 2487 | 18122 | NM_057208 | h, l | | EST, Weakly similar to tropomyosin 3, gamma [*Rattus norvegicus*] [*R. norvegicus*], ESTs, Highly similar to TPMN_HUMAN TROPOMYOSIN, CYTOSKELETAL TYPE [*H. sapiens*], ESTs, Moderately similar to TROPOMYOSIN 5, CYTOSKELETAL TYPE [*M. musculus*] |
| 2458 | 15135 | NM_053971 | h, l, n, o, w, x | | EST, Weakly similar to 60S RIBOSOMAL PROTEIN L6 [*M. musculus*], ESTs, Weakly similar to 60S RIBOSOMAL PROTEIN L6 [*M. musculus*], ribosomal protein L6 |
| 2458 | 15136 | NM_053971 | h, l, w, ii | | EST, Weakly similar to 60S RIBOSOMAL PROTEIN L6 [*M. musculus*], ESTs, Weakly similar to 60S RIBOSOMAL PROTEIN L6 [*M. musculus*], ribosomal protein L6 |
| 200 | 22026 | AA850060 | n, o | | EST, Weakly similar to 810024L URF 5 [*H. sapiens*], Homo sapiens cDNA FLJ10784 fis, clone NT2RP4000448, highly similar to *Homo sapiens* mRNA; cDNA DKFZp566G0746, RIKEN cDNA 3830414F09 gene |
| 200 | 22028 | AA850060 | cc, dd | | EST, Weakly similar to 810024L URF 5 [*H. sapiens*], Homo sapiens cDNA FLJ10784 fis, clone NT2RP4000448, highly similar to *Homo sapiens* mRNA; cDNA DKFZp566G0746, RIKEN cDNA 3830414F09 gene |
| 278 | 16029 | AA874803 | j, k | | EST, Weakly similar to 810024L URF 5 [*H. sapiens*], Homo sapiens cDNA |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 278 | 16030 | AA874803 | j, k | | FLJ10784 fis, clone NT2RP4000448, highly similar to Homo sapiens mRNA; cDNA DKFZp566G0746, RIKEN cDNA 3830414F09 gene EST, Weakly similar to 810024L URF 5 [H. sapiens], Homo sapiens cDNA FLJ10784 fis, clone NT2RP4000448, highly similar to Homo sapiens mRNA; cDNA DKFZp566G0746, RIKEN cDNA 3830414F09 gene |
| 5 | 22030 | AI011177 | h, l | | EST, Weakly similar to 810024L URF 5 [H. sapiens], Homo sapiens cDNA FLJ10784 fis, clone NT2RP4000448, highly similar to Homo sapiens mRNA; cDNA DKFZp566G0746, RIKEN cDNA 3830414F09 gene |
| 2591 | 1760 | NM_147211 | d, kk | | EST, Weakly similar to A22940 keratin, 67K type II cytoskeletal [H. sapiens], EST, Weakly similar to FORMIN 4 [M. musculus], ESTs, Weakly similar to FMN2_MOUSE Formin 2 [M. musculus], ESTs, Weakly similar to FORMIN 4 [M. musculus], ESTs, Weakly similar to LORI MOUSE LORICRIN [M. musculus], RIKEN cDNA A330103N21 gene, expressed sequence AI854843, expressed sequence AW742646, formin 2, hypothetical protein BC012775, hypothetical protein FLJ20584, similar to Wiskott-Aldrich syndrome protein interacting protein, uridine-cytidine kinase 1 |
| 2215 | 1540 | NM_031012 | n | | EST, Weakly similar to A32852 membrane alanyl aminopeptidase (EC 3.4.11.2) - rat [R. norvegicus], ESTs, Weakly similar to AMPN MOUSE AMINOPEPTIDASE N [M. musculus], RIKEN cDNA 2010111I01 gene, RIKEN cDNA 4833403I15 gene, alanyl (membrane) aminopeptidase, alanyl (membrane) aminopeptidase (aminopeptidase N, aminopeptidase M, microsomal aminopeptidase, CD13, p150) |
| 1863 | 1529 | NM_013082 | hh | | EST, Weakly similar to A33880 syndecan 2 [H. sapiens], Mus musculus, clone IMAGE:4983756, mRNA, partial cds, syndecan 2, syndecan 2 (heparan sulfate proteoglycan 1, cell surface-associated, fibroglycan) |
| 646 | 17540 | AA955914 | a | | EST, Weakly similar to A38712 fibrillarin [H. sapiens], EST, Weakly similar to FBRL MOUSE FIBRILLARIN [M. musculus], ESTs, Moderately similar to FIBRILLARIN [M. musculus], expressed sequence AL022665, fibrillarin |
| 1248 | 22432 | AI171263 | a, z | | EST, Weakly similar to A38712 fibrillarin [H. sapiens], ESTs, Moderately similar to FIBRILLARIN [M. musculus], fibrillarin |
| 2197 | 13633 | NM_024403 | e, p, q, y, z | | EST, Weakly similar to A45377 transcription factor ATF4 [H. sapiens], ESTs, Highly similar to A45377 transcription factor ATF4 [H. sapiens], activating transcription factor 4, activating transcription factor 4 (tax-responsive enhancer element B67), activating transcription factor 5 |
| 2197 | 13634 | NM_024403 | a, j, k, p, q, y, z | | EST, Weakly similar to A45377 transcription factor ATF4 [H. sapiens], ESTs, Highly similar to A45377 transcription factor ATF4 [H. sapiens], activating transcription factor 4, activating transcription factor 4 (tax-responsive enhancer element B67), activating transcription factor 5 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2407 | 2103 | NM_053597 | g | | EST, Weakly similar to A48045 ribosomal protein S27, cytosolic [H. sapiens], ESTs, Highly similar to A48045 ribosomal protein S27, cytosolic [H. sapiens], ribosomal protein S27 (metallopanstimulin 1), ribosomal protein S27-like |
| 2278 | 3292 | NM_031531 | a, j, k | | EST, Weakly similar to AACT_HUMAN ALPHA-1-ANTICHYMOTRYPSIN PRECURSOR [H. sapiens], RIKEN cDNA 4833409F13 gene, serine protease inhibitor 2-2 |
| 1719 | 17145 | M38566 | gg | | EST, Weakly similar to AACT_HUMAN ALPHA-1-ANTICHYMOTRYPSIN PRECURSOR [H. sapiens], serine (or cysteine) proteinase inhibitor, clade F (alpha-2 antiplasmin, pigment epithelium derived factor), member 2, serine protease inhibitor 2-2 |
| 2689 | 17146 | Y07534 | aa | | EST, Weakly similar to AACT_HUMAN ALPHA-1-ANTICHYMOTRYPSIN PRECURSOR [H. sapiens], serine (or cysteine) proteinase inhibitor, clade F (alpha-2 antiplasmin, pigment epithelium derived factor), member 2, serine protease inhibitor 2-2 |
| 932 | 22614 | AI031004 | t | | EST, Weakly similar to B36298 proline-rich protein PRB3S [H. sapiens], EST, Weakly similar to CGHU3B collagen alpha 3(IV) chain precursor, long splice form [H. sapiens], EST, Weakly similar to D40750 proline-rich protein PRB1/2S [H. sapiens], EST, Weakly similar to PIHUB6 salivary proline-rich protein precursor PRB1 [H. sapiens], EST, Weakly similar to PRP1_HUMAN SALIVARY PROLINE-RICH PROTEIN PRECURSOR [H. sapiens], Mus musculus adult male tongue cDNA, RIKEN full-length enriched library, clone:2310039K21:SRY-box containing gene 7, full insert sequence, SRY (sex determining region Y)-box 17, SRY (sex determining region Y)-box 18, SRY (sex determining region Y)-box 7, SRY-box containing gene 17 |
| 54 | 17380 | AA799612 | w, x | | EST, Weakly similar to B41222 ubiquitin-protein ligase [H. sapiens], ESTs, Highly similar to ubiquitin conjugating enzyme [Rattus norvegicus] [R. norvegicus], ESTs, Highly similar to A41222 ubiquitin-protein ligase [H. sapiens], ESTs, Moderately similar to B41222 ubiquitin-protein ligase [H. sapiens], ESTs, Weakly similar to UBC2_HUMAN UBIQUITIN-CONJUGATING ENZYME E2-17 KD [M. musculus], RIKEN cDNA 2610301N02 gene, expressed sequence AI327276, ubiquitin-conjugating enzyme E2A (RAD6 homolog), ubiquitin-conjugating enzyme E2A, RAD6 homolog (S. cerevisiae), ubiquitin-conjugating enzyme E2B (RAD6 homolog), ubiquitin-conjugating enzyme E2B, RAD6 homology (S. cerevisiae), ubiquitin-conjugating enzyme E2C |
| 2258 | 17379 | NM_031138 | r, w, x | | EST, Weakly similar to B41222 ubiquitin-protein ligase [H. sapiens], ESTs, Highly similar to ubiquitin conjugating enzyme [Rattus norvegicus] [R. norvegicus], ESTs, Highly similar to A41222 ubiquitin-protein ligase [H. sapiens], ESTs, Moderately similar to B41222 ubiquitin-protein ligase [H. sapiens], ESTs, Weakly similar to UBC2_HUMAN UBIQUITIN- |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 648 | 23357 | AA956114 | cc, dd | | CONJUGATING ENZYME E2-17 KD [*M. musculus*], RIKEN cDNA 2610301N02 gene, expressed sequence AI327276, ubiquitin-conjugating enzyme E2A (RAD6 homolog), ubiquitin-conjugating enzyme E2A, RAD6 homolog (*S. cerevisiae*), ubiquitin-conjugating enzyme E2B (RAD6 homolog), ubiquitin-conjugating enzyme E2B, RAD6 homology (*S. cerevisiae*), ubiquitin-conjugating enzyme E2C EST, Weakly similar to B41222 ubiquitin-protein ligase [*H. sapiens*], ESTs, Highly similar to A41222 ubiquitin-protein ligase [*H. sapiens*], ESTs, Weakly similar to UBC2__HUMAN UBIQUITIN-CONJUGATING ENZYME E2-17 KD [*M. musculus*], RIKEN cDNA 2610301N02 gene, expressed sequence AI327276, ubiquitin conjugating enzyme, ubiquitin-conjugating enzyme E2A (RAD6 homolog), ubiquitin-conjugating enzyme E2A, RAD6 homolog (*S. cerevisiae*), ubiquitin-conjugating enzyme E2B (RAD6 homolog), ubiquitin-conjugating enzyme E2B, RAD6 homology (*S. cerevisiae*), ubiquitin-conjugating enzyme E2C |
| 885 | 4253 | AI013566 | jj, kk | | EST, Weakly similar to beta-fibrinogen precursor [*H. sapiens*], ESTs, Moderately similar to ANL2__MOUSE Angiopoietin-related protein 2 precursor (Angiopoietin-like 2) [*M. musculus*], *Mus musculus*, Similar to angiopoietin-related protein 5, clone MGC:32467 IMAGE:5049765, mRNA, complete cds, *Mus musculus*, Similar to fibrinogen-like 1, clone MGC:37822 IMAGE:5098805, mRNA, complete cds, *Rattus norvegicus* Sprague-Dawley fibrinogen B beta chain mRNA, complete cds, angiopoietin-like 2, angiopoietin-related protein 5, expressed sequence AI593246, hypothetical protein FLJ11286 |
| 1461 | 22484 | AI230591 | ll | | EST, Weakly similar to CATM__HUMAN CATHEPSIN L2 PRECURSOR (CATHEPSIN V) (CATHEPSIN U) [*H. sapiens*], EST, Weakly similar to TES1__RAT TESTIN 1/2 PRECURSOR (CMB-22/CMB-23) [*R. norvegicus*], RIKEN cDNA 4930486L24 gene, *Rattus norvegicus* testin mRNA, complete cds, cytotoxic T lymphocyte-associated protein 2 alpha |
| 983 | 2662 | AI045686 | e | | EST, Weakly similar to CBP MOUSE CREB-BINDING PROTEIN [*M. musculus*], ESTs, Highly similar to BRD4__HUMAN BROMODOMAIN-CONTAINING PROTEIN 4 (HUNK1 PROTEIN) [*H. sapiens*], ESTs, Highly similar to CBP MOUSE CREB-BINDING PROTEIN [*M. musculus*], ESTs, Moderately similar to CBP MOUSE CREB-BINDING PROTEIN [*M. musculus*], ESTs, Weakly similar to CBP MOUSE CREB-BINDING PROTEIN [*M. musculus*], bromodomain-containing 4 |
| 791 | 9746 | AI009555 | r | | EST, Weakly similar to DYJ2__HUMAN DYNEIN LIGHT INTERMEDIATE CHAIN 2, CYTOSOLIC [*H. sapiens*], LIC-2 dynein light intermediate chain 53/55, RIKEN cDNA 1110053F02 gene, dynein light chain-A, dynein, cytoplasmic, light intermediate polypeptide 2, expressed sequence AA409702 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2219 | 16210 | NM_031026 | l, m | | EST, Weakly similar to DYJ2_HUMAN DYNEIN LIGHT INTERMEDIATE CHAIN 2, CYTOSOLIC [*H. sapiens*], RIKEN cDNA 1110053F02 gene, *Rattus norvegicus* dynein light intermediate chain 1 mRNA, complete cds, dynein light chain-A, dynein, cytoplasmic, light intermediate polypeptide 2, expressed sequence AA409702 |
| 2341 | 17734 | NM_031970 | a, o, q, ee, ff, kk | | EST, Weakly similar to HHHU27 heat shock protein 27 [*H. sapiens*], ESTs, Highly similar to HHHU27 heat shock protein 27 [*H. sapiens*], ESTs, Moderately similar to HHHU27 heat shock protein 27 [*H. sapiens*], heat shock 27 kD protein 1, hypothetical protein MGC10974 |
| 2341 | 17735 | NM_031970 | a, z, ee, ff, kk | | EST, Weakly similar to HHHU27 heat shock protein 27 [*H. sapiens*], ESTs, Highly similar to HHHU27 heat shock protein 27 [*H. sapiens*], ESTs, Moderately similar to HHHU27 heat shock protein 27 [*H. sapiens*], heat shock 27 kD protein 1, hypothetical protein MGC10974 |
| 2341 | 17736 | NM_031970 | a, l, o, q, ee, ff, kk | | EST, Weakly similar to HHHU27 heat shock protein 27 [*H. sapiens*], ESTs, Highly similar to HHHU27 heat shock protein 27 [*H. sapiens*], ESTs, Moderately similar to HHHU27 heat shock protein 27 [*H. sapiens*], heat shock 27 kD protein 1, hypothetical protein MGC10974 |
| 2433 | 15615 | NM_053800 | h, l | | EST, Weakly similar to Human Thioredoxin [*H. sapiens*], RIKEN cDNA 4930429J24 gene, thioredoxin, thioredoxin 1 |
| 2093 | 17100 | NM_022179 | h, l, w, x, dd | | EST, Weakly similar to HXK2 MOUSE HEXOKINASE TYPE II [*M. musculus*], ESTs, Moderately similar to HXK3_HUMAN HEXOKINASE TYPE III [*H. sapiens*], ESTs, Weakly similar to HXK2 MOUSE HEXOKINASE TYPE II [*M. musculus*], hexokinase 2, hexokinase 3 (white cell) |
| 2114 | 23705 | NM_022396 | e, j, k, ii | | EST, Weakly similar to I39159 GTP-binding regulatory protein gamma-11 chain [*H. sapiens*], ESTs, Moderately similar to GBGB_HUMAN Guanine nucleotide-binding protein G(I)/G(S)/G(O) gamma-11 subunit [*R. norvegicus*], ESTs, Weakly similar to GBGB_HUMAN Guanine nucleotide-binding protein G(I)/G(S)/G(O) gamma-11 subunit [*R. norvegicus*], RIKEN cDNA 0610037B21 gene, guanine nucleotide binding protein (G protein), gamma 1 subunit, guanine nucleotide binding protein (G protein), gamma transducing activity polypeptide 1, guanine nucleotide binding protein (G protein), gamma transducing activity polypeptide 2, guanine nucleotide binding protein 11 |
| 2013 | 20232 | NM_017364 | u, v | | EST, Weakly similar to I49636 DNA-binding protein - mouse [*M. musculus*], ESTs, Highly similar to OZF_HUMAN ZINC FINGER PROTEIN OZF [*H. sapiens*], ESTs, Weakly similar to OZF MOUSE ZINC FINGER PROTEIN OZF [*M. musculus*], ESTs, Weakly similar to OZF_HUMAN ZINC FINGER PROTEIN OZF [*H. sapiens*], *Mus musculus*, clone MGC:37070 IMAGE:4951074, mRNA, complete cds, RIKEN cDNA 2810039B14 gene, RIKEN cDNA 2810054M15 gene, zinc finger protein 146, zinc finger protein 260, zinc finger protein 63 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1573 | 22212 | AI236294 | kk | | EST, Weakly similar to IF6_HUMAN EUKARYOTIC TRANSLATION INITIATION FACTOR 6 [*H. sapiens*], ESTs, Highly similar to IF6_HUMAN EUKARYOTIC TRANSLATION INITIATION FACTOR 6 [*H. sapiens*], *Mus musculus* 10 days neonate cerebellum cDNA, RIKEN full-length enriched library, clone:6530402L05:integrin beta 4 binding protein, full insert sequence, integrin beta 4 binding protein |
| 1181 | 7414 | AI137586 | a | | EST, Weakly similar to IMB3_HUMAN IMPORTIN BETA-3 SUBUNIT [*H. sapiens*], *Homo sapiens* cDNA FLJ12978 fis, clone NT2RP2006321, RAN binding protein 6, importin 4 |
| 1591 | 11208 | AI237586 | kk | | EST, Weakly similar to JC1241 beta-interferon-induced protein - rat [*R. norvegicus*], ESTs, Moderately similar to JC1241 beta-interferon-induced protein - rat [*R. norvegicus*], *Mus musculus*, clone MGC:31632 IMAGE:4511454, mRNA, complete cds, RIKEN cDNA 1110036C17 gene, interferon induced transmembrane protein 2 (1-8D) |
| 588 | 19480 | AA944442 | r, bb | | EST, Weakly similar to JC2324 LIM protein [*H. sapiens*], ESTs, Weakly similar to JG0164 LIM protein, FHL4 - mouse [*M. musculus*], *Homo sapiens* cDNA FLJ13238 fis, clone OVARC1000440, *Homo sapiens* cDNA FLJ31627 fis, clone NT2RI2003338, RIKEN cDNA 2410002J21 gene, activator of cAMP-responsive element modulator (CREM) in testis, expressed sequence AI481106, expressed sequence AV278559, expressed sequence AW123232, hypothetical protein FLJ10044, paxillin, testis derived transcript (3 LIM domains), transforming growth factor beta 1 induced transcript 1 |
| 58 | 20092 | AA799637 | r, ll | | EST, Weakly similar to JC2324 LIM protein [*H. sapiens*], *Homo sapiens* cDNA FLJ13238 fis, clone OVARC1000440, RIKEN cDNA 2410002J21 gene, expressed sequence AV278559, expressed sequence AW123232, hypothetical protein FLJ10044, paxillin, transforming growth factor beta 1 induced transcript 1 |
| 2228 | 25600 | NM_031077 | b, l, m | | EST, Weakly similar to JC5111 cyclin-dependent kinase-related protein 1b - rat [*R. norvegicus*], EST, Weakly similar to S10889 proline-rich protein [*H. sapiens*], ESTs, Highly similar to KPT1 MOUSE SERINE/THREONINE-PROTEIN KINASE PCTAIRE-1 [*M. musculus*], ESTs, Weakly similar to KPT1 MOUSE SERINE/THREONINE-PROTEIN KINASE PCTAIRE-1 [*M. musculus*], PCTAIRE protein kinase 1, PCTAIRE-motif protein kinase 1 |
| 2228 | 6349 | NM_031077 | ee, ff | | EST, Weakly similar to JC5111 cyclin-dependent kinase-related protein 1b - rat [*R. norvegicus*], EST, Weakly similar to S10889 proline-rich protein [*H. sapiens*], ESTs, Highly similar to KPT1 MOUSE SERINE/THREONINE-PROTEIN KINASE PCTAIRE-1 [*M. musculus*], ESTs, Weakly similar to KPT1 MOUSE SERINE/THREONINE-PROTEIN KINASE PCTAIRE-1 [*M. musculus*], PCTAIRE protein kinase 1, PCTAIRE-motif protein kinase 1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2575 | 21818 | NM_139342 | bb | | EST, Weakly similar to JC5399 dual leucine zipper kinase (EC 2.7.—.—) - rat [*R. norvegicus*], ESTs, Highly similar to A55318 serine/threonine protein kinase [*M. musculus*], ESTs, Weakly similar to JC5399 dual leucine zipper kinase (EC 2.7.—.—) - rat [*R. norvegicus*], ankyrin repeat domain 3, expressed sequence C81508, receptor (TNFRSF)-interacting serine-threonine kinase 1 |
| 1881 | 24867 | NM_013155 | kk | | EST, Weakly similar to LDVR_RAT Very low-density lipoprotein receptor precursor (VLDL receptor) [*R. norvegicus*], ESTs, Weakly similar to LDVR MOUSE VERY LOW-DENSITY LIPOPROTEIN RECEPTOR PRECURSOR [*M. musculus*], ESTs, Weakly similar to LDVR_RAT Very low-density lipoprotein receptor precursor (VLDL receptor) [*R. norvegicus*], low density lipoprotein receptor-related protein 8, apolipoprotein e receptor, very low density lipoprotein receptor |
| 316 | 24470 | AA875523 | aa, bb | | EST, Weakly similar to MOHU6N myosin alkali light chain 6, nonmuscle form [*H. sapiens*], myosin light chain, alkali, nonmuscle, myosin, light polypeptide 6, alkali, smooth muscle and non-muscle |
| 316 | 24471 | AA875523 | ii | | EST, Weakly similar to MOHU6N myosin alkali light chain 6, nonmuscle form [*H. sapiens*], myosin light chain, alkali, nonmuscle, myosin, light polypeptide 6, alkali, smooth muscle and non-muscle |
| 316 | 24472 | AA875523 | ii | | EST, Weakly similar to MOHU6N myosin alkali light chain 6, nonmuscle form [*H. sapiens*], myosin light chain, alkali, nonmuscle, myosin, light polypeptide 6, alkali, smooth muscle and non-muscle |
| 464 | 24473 | AA894200 | b | | EST, Weakly similar to MOHU6N myosin alkali light chain 6, nonmuscle form [*H. sapiens*], myosin light chain, alkali, nonmuscle, myosin, light polypeptide 6, alkali, smooth muscle and non-muscle |
| 2606 | 24469 | S77858 | ll | | EST, Weakly similar to MOHU6N myosin alkali light chain 6, nonmuscle form [*H. sapiens*], myosin light chain, alkali, nonmuscle, myosin, light polypeptide 6, alkali, smooth muscle and non-muscle |
| 2633 | 17296 | U76206 | jj, kk | | EST, Weakly similar to P2YX_RAT UDP-glucose receptor (G protein-coupled receptor GPR105) (VTR 15-20) [*R. norvegicus*], ESTs, Weakly similar to GPRY_MOUSE PROBABLE G PROTEIN-COUPLED RECEPTOR GPR34 [*M. musculus*], ESTs, Weakly similar to P2YX_RAT UDP-glucose receptor (G protein-coupled receptor GPR105) (VTR 15-20) [*R. norvegicus*], G protein-coupled receptor 105, G protein-coupled receptor 34, G protein-coupled receptor 86, G protein-coupled receptor 87, Purinergic receptor P2Y, G protein-coupled, 12, platelet activating receptor homolog |
| 2123 | 2109 | NM_022511 | n, o, w, x | | EST, Weakly similar to PRO1 MOUSE PROFILIN I [*M. musculus*], EST, Weakly similar to PRO2_HUMAN PROFILIN II [*H. sapiens*], ESTs, Weakly similar to PRO2_HUMAN PROFILIN II [*H. sapiens*], Mk1 protein, profilin 1 |
| 2357 | 2577 | NM_033236 | r | | EST, Weakly similar to PRS7 MOUSE 26S PROTEASE REGULATORY SUBUNIT 7 [*M. musculus*], RIKEN cDNA 2300001E01 gene, proteasome |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2263 | 1291 | NM_031149 | c, r | | (prosome, macropain) 26S subunit, ATPase 2, syntaxin 8 EST, Weakly similar to PRS8 MOUSE 26S PROTEASE REGULATORY SUBUNIT 8 [*M. musculus*], Homo sapiens mRNA; cDNA DKFZp586I1420 (from clone DKFZp586I1420); partial cds, YME1-like 1 (*S. cerevisiae*), hypothetical protein DKFZp667C165, protease (prosome, macropain) 26S subunit, ATPase 5, proteasome (prosome, macropain) 26S subunit, ATPase, 5, proteasome (prosome, macropain) 26S subunit, ATPase, 6 |
| 606 | 24521 | AA945636 | g, h, l | | EST, Weakly similar to R6HUP1 acidic ribosomal protein P1, cytosolic [*H. sapiens*], ESTs, Highly similar to R6HUP1 acidic ribosomal protein P1, cytosolic [*H. sapiens*], ESTs, Weakly similar to RLA1 MOUSE 60S ACIDIC RIBOSOMAL PROTEIN P1 [*M. musculus*], expressed sequence AI255964, ribosomal protein, large, P1 |
| 2232 | 15201 | NM_031093 | h, l, w | | EST, Weakly similar to RALA MOUSE RAS-RELATED PROTEIN RAL-A [*M. musculus*], ESTs, Weakly similar to Crystal Structure Of The Small G Protein Rap2a With Gdp {SUB 1-167 [*H. sapiens*], ESTs, Weakly similar to RALA MOUSE RAS-RELATED PROTEIN RAL-A [*M. musculus*], v-ral simian leukemia viral oncogene homolog A (ras related) |
| 2232 | 15202 | NM_031093 | f, w, x, cc, dd | | EST, Weakly similar to RALA MOUSE RAS-RELATED PROTEIN RAL-A [*M. musculus*], ESTs, Weakly similar to Crystal Structure Of The Small G Protein Rap2a With Gdp {SUB 1-167 [*H. sapiens*], ESTs, Weakly similar to RALA MOUSE RAS-RELATED PROTEIN RAL-A [*M. musculus*], v-ral simian leukemia viral oncogene homolog A (ras related) |
| 2232 | 15203 | NM_031093 | aa, bb | | EST, Weakly similar to RALA MOUSE RAS-RELATED PROTEIN RAL-A [*M. musculus*], ESTs, Weakly similar to Crystal Structure Of The Small G Protein Rap2a With Gdp {SUB 1-167 [*H. sapiens*], ESTs, Weakly similar to RALA MOUSE RAS-RELATED PROTEIN RAL-A [*M. musculus*], v-ral simian leukemia viral oncogene homolog A (ras related) |
| 1200 | 11337 | AI145968 | l, m | | EST, Weakly similar to RB6K MOUSE RABKINESIN-6 [*M. musculus*], ESTs, Weakly similar to RB6K MOUSE RABKINESIN-6 [*M. musculus*], RAB6 interacting, kinesin-like (rabkinesin6), Rab6, kinesin-like |
| 2654 | 18606 | X53504 | g, w, x | | EST, Weakly similar to RL12_HUMAN 60S RIBOSOMAL PROTEIN L12 [*H. sapiens*], ESTs, Weakly similar to RL12_HUMAN 60S RIBOSOMAL PROTEIN L12 [*H. sapiens*], ribosomal protein L12 |
| 2647 | 19244 | X15013 | f, g, w, x | | EST, Weakly similar to RL7A MOUSE 60S RIBOSOMAL PROTEIN L7A [*M. musculus*], RIKEN cDNA 4632404N19 gene, ribosomal protein L7a |
| 2243 | 10878 | NM_031110 | g, j, k | | EST, Weakly similar to RS11_HUMAN 40S ribosomal protein S11 [*R. norvegicus*], Homo sapiens mRNA; cDNA DKFZp434A0326 (from clone DKFZp434A0326), RAD21 homolog (*S. pombe*), ribosomal protein S11 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2362 | 24419 | NM_033539 | jj, kk | | EST, Weakly similar to S21055 translation elongation factor eEF-1 alpha chain - rat [R. norvegicus], ESTs, Highly similar to EFHU1 translation elongation factor eEF-1 alpha-1 chain [H. sapiens], ESTs, Weakly similar to S21055 translation elongation factor eEF-1 alpha chain - rat [R. norvegicus], G1 to S phase transition 1, G1 to phase transition 1, G1 to phase transition 2, eukaryotic translation elongation factor 1 alpha 1 |
| 1422 | 13673 | AI227763 | gg | | EST, Weakly similar to S26650 DNA-binding protein 5 [H. sapiens], ESTs, Weakly similar to S26650 DNA-binding protein 5 [H. sapiens], hypothetical protein dJ465N24.2.1, protamine 1 |
| 1099 | 16596 | AI102486 | ee, ff, kk | | EST, Weakly similar to S37583 RING finger protein rfp - mouse [M. musculus], RIKEN cDNA 1810012B10 gene, expressed sequence AW538890, hypothetical gene MGC1127 |
| 1253 | 16599 | AI171366 | ee, ff, jj, kk | | EST, Weakly similar to S37583 RING finger protein rfp - mouse [M. musculus], RIKEN cDNA 1810012B10 gene, expressed sequence AW538890, hypothetical gene MGC1127 |
| 433 | 21652 | AA893267 | u, v | | EST, Weakly similar to S46992 protein p130 - rat [R. norvegicus], ESTs, Weakly similar to A59300 myosin-lf - mouse [M. musculus], ESTs, Weakly similar to CASL MOUSE ENHANCER OF FILMENTATION 1 [M. musculus], RIKEN cDNA 4631403P03 gene, RIKEN cDNA 9130023P14 gene, RIKEN cDNA C330006B10 gene, embryonal Fyn-associated substrate, myosin lf, peroxisomal biogenesis factor 13, proline serine-threonine phosphatase interacting protein 1 |
| 1213 | 11550 | AI169591 | r | | EST, Weakly similar to S57447 HPBRII-7 protein [H. sapiens], cleavage and polyadenylation specific factor 6, 68 kD subunit, hypothetical protein FLJ12529 |
| 1100 | 11953 | AI102505 | hh | | EST, Weakly similar to S71929 cytochrome-c oxidase (EC 1.9.3.1) chain VIII precursor, hepatic - mouse [M. musculus], cytochrome c oxidase, subunit VIIIa, heme-regulated initiation factor 2-alpha kinase |
| 1100 | 11954 | AI102505 | hh | | EST, Weakly similar to S71929 cytochrome-c oxidase (EC 1.9.3.1) chain VIII precursor, hepatic - mouse [M. musculus], cytochrome c oxidase, subunit VIIIa, heme-regulated initiation factor 2-alpha kinase |
| 1703 | 11955 | L48209 | hh | | EST, Weakly similar to S71929 cytochrome-c oxidase (EC 1.9.3.1) chain VIII precursor, hepatic - mouse [M. musculus], cytochrome c oxidase, subunit VIIIa, heme-regulated initiation factor 2-alpha kinase |
| 2135 | 8097 | NM_022536 | h, l | | EST, Weakly similar to secreted cyclophilin-like protein [H. sapiens], ESTs, Weakly similar to cyclophilin B [Rattus norvegicus] [R. norvegicus], RIKEN cDNA 3732410E19 gene, peptidylprolyl isomerase (cyclophilin)-like 1, peptidylprolyl isomerase B, peptidylprolyl isomerase B (cyclophilin B), peptidylprolyl isomerase C, peptidylprolyl isomerase C (cyclophilin C) |
| 2135 | 8098 | NM_022536 | ii | | EST, Weakly similar to secreted cyclophilin-like protein [H. sapiens], ESTs, Weakly similar to cyclophilin B [Rattus norvegicus] [R. norvegicus], |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1376 | 6502 | AI178283 | r | | RIKEN cDNA 3732410E19 gene, peptidylprolyl isomerase (cyclophilin)-like 1, peptidylprolyl isomerase B, peptidylprolyl isomerase B (cyclophilin B), peptidylprolyl isomerase C, peptidylprolyl isomerase C (cyclophilin C) EST, Weakly similar to SYFB_MOUSE PHENYLALANYL-TRNA SYNTHETASE BETA CHAIN (PHENYLALANINE-TRNA LIGASE BETA CHAIN) (PHERS) [*M. musculus*], Homo sapiens cDNA FLJ30727 fis, clone FEBRA2000007, highly similar to Homo sapiens putative phenylalanyl-tRNA synthetase beta-subunit mRNA, KIAA1185 protein, RIKEN cDNA 2900010D03 gene, expressed sequence C76708, phenylalanine-tRNA synthetase-like, phenylalanyl-tRNA synthetase beta-subunit |
| 738 | 2526 | AA998979 | u, v | | EST, Weakly similar to T00051 hypothetical protein KIAA0404 [*H. sapiens*], Homo sapiens, clone IMAGE:4657824, mRNA, KIAA0404 protein, hypothetical protein FLJ10242 |
| 861 | 23025 | AI012621 | j, k | | EST, Weakly similar to T00357 hypothetical protein KIAA0685 [*H. sapiens*], Homo sapiens mRNA for KIAA1558 protein, partial cds, KIAA0685 gene product, KIAA1115 protein, chromosome 11 open reading frame 23 |
| 832 | 24022 | AI011474 | a, ee, ff, ll | | EST, Weakly similar to T00637 hypothetical protein H_GS541B18.1 [*H. sapiens*], golgi phosphoprotein 2 |
| 436 | 22355 | AA893338 | b, u, v | | EST, Weakly similar to T12456 hypothetical protein DKFZp564M2423.1 [*H. sapiens*], ESTs, Highly similar to T12456 hypothetical protein DKFZp564M2423.1 [*H. sapiens*], PAI-1 mRNA-binding protein, RIKEN cDNA 1200009K13 gene, intracellular hyaluronan-binding protein |
| 968 | 7992 | AI044845 | cc, dd, gg | | EST, Weakly similar to T12482 hypothetical protein DKFZp564P0662.1 [*H. sapiens*], ESTs, Weakly similar to T12482 hypothetical protein DKFZp564P0662.1 [*H. sapiens*], Homo sapiens cDNA FLJ32000 fis, clone NT2RP7009370, weakly similar to PUTATIVE SERINE/THREONINE-PROTEIN KINASE PKWA (EC 2.7.1.—), echinoderm microtubule associated protein like 2 |
| 1373 | 6059 | AI178245 | c | | EST, Weakly similar to T13963 formin related protein, lymphocyte specific - mouse [*M. musculus*], ESTs, Highly similar to T13963 formin related protein, lymphocyte specific - mouse [*M. musculus*], ESTs, Moderately similar to T13963 formin related protein, lymphocyte specific - mouse [*M. musculus*], Homo sapiens mRNA; cDNA DKFZp762B245 (from clone DKFZp762B245); partial cds, formin homology 2 domain containing 1, formin-like |
| 28 | 2882 | AA799423 | ll | | EST, Weakly similar to T42637 hypothetical protein 162K - mouse [*M. musculus*], ESTs, Highly similar to MYH9_RAT Myosin heavy chain, nonmuscle type A (Cellular myosin heavy chain, type A) (Nonmuscle myosin heavy chain-A) (NMMHC-A) [*R. norvegicus*], ESTs, Weakly similar to MYH9_RAT Myosin heavy chain, nonmuscle type A (Cellular myosin |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | heavy chain, type A) (Nonmuscle myosin heavy chain-A) (NMMHC-A) [*R. norvegicus*], *Mus musculus*, clone MGC:7530 IMAGE:3492114, mRNA, complete cds, Myosin, heavy polypeptide 9, non-muscle, RIKEN cDNA 3110050K21 gene, eukaryotic translation initiation factor 3, myosin heavy chain IX, myosin, heavy polypeptide 9, non-muscle, nasopharyngeal epithelium specific protein 1 |
| 751 | 2881 | AF056034 | b, d, u, v | | EST, Weakly similar to T42637 hypothetical protein 162K - mouse [*M. musculus*], ESTs, Highly similar to MYH9_RAT Myosin heavy chain, nonmuscle type A (Cellular myosin heavy chain, type A) (Nonmuscle myosin heavy chain-A) (NMMHC-A) [*R. norvegicus*], ESTs, Weakly similar to MYH9_RAT Myosin heavy chain, nonmuscle type A (Cellular myosin heavy chain, type A) (Nonmuscle myosin heavy chain-A) (NMMHC-A) [*R. norvegicus*], *Mus musculus*, clone MGC:7530 IMAGE:3492114, mRNA, complete cds, Myosin, heavy polypeptide 9, non-muscle, RIKEN cDNA 3110050K21 gene, eukaryotic translation initiation factor 3, myosin heavy chain IX, myosin, heavy polypeptide 9, non-muscle, nasopharyngeal epithelium specific protein 1 |
| 2468 | 16566 | NM_054004 | hh | | EST, Weakly similar to T42735 TBP-interacting protein TIP120 - rat [*R. norvegicus*], *Homo sapiens* cDNA FLJ14877 fis, clone PLACE1003044, TBP-interacting protein, expressed sequence AI195005 |
| 1686 | 17159 | J00797 | w, x, aa, bb, hh, ll | | EST, Weakly similar to TBA1 MOUSE TUBULIN ALPHA-1 CHAIN [*M. musculus*], tubulin, alpha 1, tubulin, alpha 2, tubulin, alpha 3, tubulin, alpha 6, tubulin, alpha 7, tubulin, alpha, ubiquitous |
| 2105 | 17158 | NM_022298 | f, s, t | | EST, Weakly similar to TBA1 MOUSE TUBULIN ALPHA-1 CHAIN [*M. musculus*], tubulin, alpha 1, tubulin, alpha 2, tubulin, alpha 3, tubulin, alpha 6, tubulin, alpha 7, tubulin, alpha, ubiquitous |
| 2105 | 17160 | NM_022298 | b, l, m, aa | | EST, Weakly similar to TBA1 MOUSE TUBULIN ALPHA-1 CHAIN [*M. musculus*], tubulin, alpha 1, tubulin, alpha 2, tubulin, alpha 3, tubulin, alpha 6, tubulin, alpha 7, tubulin, alpha, ubiquitous |
| 2105 | 17161 | NM_022298 | a, z, kk | | EST, Weakly similar to TBA1 MOUSE TUBULIN ALPHA-1 CHAIN [*M. musculus*], tubulin, alpha 1, tubulin, alpha 2, tubulin, alpha 3, tubulin, alpha 6, tubulin, alpha 7, tubulin, alpha, ubiquitous |
| 265 | 13974 | AA860030 | n, o, w, x, ll | | EST, Weakly similar to TBB5 MOUSE TUBULIN BETA-5 CHAIN [*M. musculus*], RIKEN cDNA 2310061K05 gene, RIKEN cDNA 2410129E14 gene, RIKEN cDNA 4930542G03 gene, tubulin, beta 5, tubulin, beta polypeptide, tubulin, beta, 2, tubulin, beta, 5 |
| 1444 | 13977 | AI229707 | r | | EST, Weakly similar to TBB5 MOUSE TUBULIN BETA-5 CHAIN [*M. musculus*], RIKEN cDNA 2310061K05 gene, RIKEN cDNA 2410129E14 gene, RIKEN cDNA 4930542G03 gene, tubulin, beta 5, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1046 | 9604 | AI071230 | ee, ff, gg | | tubulin, beta polypeptide, tubulin, beta, 2, tubulin, beta, 5 EST, Weakly similar to TESTIN 2 [*M. musculus*], Homo sapiens cDNA FLJ31627 fis, clone NT2RI2003338, *Homo sapiens* cDNA FLJ31929 fis, clone NT2RP7006160 |
| 2266 | 15273 | NM_031237 | aa, bb | | EST, Weakly similar to UB5C_HUMAN Ubiquitin-conjugating enzyme E2-17 kDa 3 (Ubiquitin-protein ligase) (Ubiquitin carrier protein) (E2(17)KB 3) [*R. norvegicus*], ESTs, Weakly similar to S53358 ubiquitin-conjugating enzyme E2.17kB - rat [*R. norvegicus*], *Homo sapiens* EST from clone 37208, full insert, RIKEN cDNA 1100001F19 gene, RIKEN cDNA 1600028I17 gene, prefoldin 5, ubiquitin-conjugating enzyme E2D 3 (UBC4/5 homolog, yeast) |
| 2266 | 15277 | NM_031237 | a | | EST, Weakly similar to UB5C_HUMAN Ubiquitin-conjugating enzyme E2-17 kDa 3 (Ubiquitin-protein ligase) (Ubiquitin carrier protein) (E2(17)KB 3) [*R. norvegicus*], ESTs, Weakly similar to S53358 ubiquitin-conjugating enzyme E2.17kB - rat [*R. norvegicus*], *Homo sapiens* EST from clone 37208, full insert, RIKEN cDNA 1100001F19 gene, RIKEN cDNA 1600028I17 gene, prefoldin 5, ubiquitin-conjugating enzyme E2D 3 (UBC4/5 homolog, yeast) |
| 1292 | 17679 | AI175025 | hh | | EST, Weakly similar to WS3_HUMAN WS-3 PROTEIN [*H. sapiens*], novel RGD-containing protein |
| 1174 | 15969 | AI137302 | cc, dd | | EST, Weakly similar to ZF37_RAT Zinc finger protein 37 (Zfp-37) [*R. norvegicus*], ESTs, Weakly similar to ZF29 MOUSE ZINC FINGER PROTEIN 29 [*M. musculus*], ESTs, Weakly similar to ZF93_MOUSE ZINC FINGER PROTEIN 93 (ZFP-93) [*M. musculus*], expressed sequence AW557864, zinc finger protein 29, zinc finger protein 37, zinc finger protein 37 homolog (mouse) |
| 2234 | 1295 | NM_031097 | j, k, r | | ESTs, Highly similar to aminopeptidase B [*Rattus norvegicus*] [*R. norvegicus*], *Mus musculus*, Similar to aminopeptidase B, clone MGC:29229 IMAGE:5041005, mRNA, complete cds, RIKEN cDNA 2010111I01 gene, expressed sequence AI894167, hypothetical protein FLJ14675, leukotriene A4 hydrolase |
| 1302 | 18507 | AI175551 | h, l, w, x, kk | | ESTs, Highly similar to eukaryotic translation elongation factor 1 beta 2; eukaryotic translation elongation factor 1 beta 1 [*Homo sapiens*] [*H. sapiens*], eukaryotic translation elongation factor 1 beta 2 |
| 2548 | 5283 | NM_138535 | gg | | ESTs, Highly similar to Glutamate receptor interacting protein [*Rattus norvegicus*] [*R. norvegicus*], Glutamate receptor interacting protein, RIKEN cDNA 4931400F03 gene, channel-interacting PDZ domain protein, multiple PDZ domain protein, syntrophin, alpha 1 (dystrophin-associated protein A1, 59 kD, acidic component) |
| 38 | 15303 | AA799518 | w, x | | ESTs, Highly similar to hypothetical protein FLJ13725; KIAA1930 protein [*Homo sapiens*] [*H. sapiens*] |
| 43 | 17599 | AA799539 | c | | ESTs, Highly similar to lymphocyte activation-associated protein [*Homo sapiens*] [*H. sapiens*], ESTs, Weakly similar to KEAP_RAT Kelch-like ECH- |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | associated protein 1 (Cytosolic inhibitor of Nrf2) (INrf2) [*R. norvegicus*], Kelch-like ECH-associated protein 1, *Mus musculus*, Similar to KIAA0952 protein, clone MGC:25591 IMAGE:4011475, mRNA, complete cds, RIKEN cDNA 2700038B03 gene, kelch-like ECH-associated protein 1 |
| 2402 | 21170 | NM_053585 | s, t | | ESTs, Highly similar to MAP-kinase activating death domain; Rab3 GDP/GTP exchange protein [*Rattus norvegicus*] [*R. norvegicus*], ESTs, Weakly similar to MAP-kinase activating death domain; Rab3 GDP/GTP exchange protein [*Rattus norvegicus*] [*R. norvegicus*], MAP-kinase activating death domain, *Mus musculus*, Similar to MAP-kinase activating death domain, clone MGC:7838 IMAGE:3500720, mRNA, complete cds, RIKEN cDNA 2010004M01 gene, suppression of tumorigenicity 5 |
| 2408 | 11794 | NM_053606 | ii | | ESTs, Highly similar to Matrix metalloproteinase 23 [*Rattus norvegicus*] [*R. norvegicus*], matrix metalloproteinase 23, matrix metalloproteinase 23A, matrix metalloproteinase 23B |
| 2211 | 1991 | NM_030995 | h, l | | ESTs, Highly similar to microtubule-associated protein 1a [*Rattus norvegicus*] [*R. norvegicus*], ESTs, Moderately similar to microtubule-associated protein 1a [*Rattus norvegicus*] [*R. norvegicus*], ESTs, Weakly similar to microtubule-associated protein 1a [*Rattus norvegicus*] [*R. norvegicus*], ESTs, Weakly similar to MAPA_MOUSE Microtubule-associated protein 1A (MAP 1A) [*M. musculus*], chromatin assembly factor 1, subunit A (p150), expressed sequence AI853608, microtubule-associated protein 1A |
| 1158 | 14434 | AI112291 | ll | | ESTs, Highly similar to multiple PDZ domain protein [*Mus musculus*] [*M. musculus*], Homo sapiens cDNA FLJ25282 fis, clone STM06685, highly similar to *Rattus norvegicus* mRNA for multi PDZ domain protein, ligand of numb-protein X 1, multiple PDZ domain protein |
| 2328 | 1169 | NM_031789 | d | | ESTs, Highly similar to NF-E2-related factor 2 [*Rattus norvegicus*] [*R. norvegicus*], ESTs, Weakly similar to NF-E2-related factor 2 [*Rattus norvegicus*] [*R. norvegicus*], nuclear factor (erythroid-derived 2)-like 2, nuclear factor, erythroid derived 2, like 3, nuclear, factor, erythroid derived 2, like 2 |
| 2328 | 1170 | NM_031789 | d, l, m, jj, kk | | ESTs, Highly similar to NF-E2-related factor 2 [*Rattus norvegicus*] [*R. norvegicus*], ESTs, Weakly similar to NF-E2-related factor 2 [*Rattus norvegicus*] [*R. norvegicus*], nuclear factor (erythroid-derived 2)-like 2, nuclear factor, erythroid derived 2, like 3, nuclear, factor, erythroid derived 2, like 2 |
| 290 | 16215 | AA874999 | h, l, n, o | | ESTs, Highly similar to protein translocation complex beta; protein transport protein SEC61 beta subunit [*Homo sapiens*] [*H. sapiens*], protein translocation complex beta |
| 1162 | 4969 | AI113008 | l, k, n, o | | ESTs, Highly similar to proteoglycan 3 (megakaryocyte stimulating factor, articular superficial zone protein) [*Mus musculus*] [*M. musculus*], proteoglycan 4 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | (megakaryocyte stimulating factor, articular superficial zone protein), proteoglycan 4, (megakaryocyte stimulating factor, articular superficial zone protein, camptodactyly, arthropathy, coxa vara, pericarditis syndrome), vitronectin |
| 2240 | 22205 | NM_031105 | b | | ESTs, Highly similar to ribosomal protein L36a; 60S ribosomal protein L44; L44-like ribosomal protein; ribosomal protein L44; ribosomal protein L36a homologue; 60S ribosomal protein L36a [Homo sapiens] [H. sapiens], ESTs, Moderately similar to ribosomal protein L36a; 60S ribosomal protein L44; L44-like ribosomal protein; ribosomal protein L44; ribosomal protein L36a homologue; 60S ribosomal protein L36a [Homo sapiens] [H. sapiens], RIKEN cDNA 2410038A03 gene, ribosomal protein L36a-like, ribosomal protein L44 |
| 2393 | 17298 | NM_053553 | cc, dd | | ESTs, Highly similar to synaptogyrin 2 [Rattus norvegicus] [R. norvegicus], Mus musculus 18 days embryo whole body cDNA, RIKEN full-length enriched library, clone:1110032G03:synaptogyrin 2, full insert sequence, synaptogyrin 2 |
| 2479 | 23307 | NM_057119 | e | | ESTs, Highly similar to TLS-associated serine-arginine protein 1, isoform 1; TLS-associated serine-arginine protein 1; TLS-associated protein TASR [Homo sapiens] [H. sapiens], ESTs, Weakly similar to splicing factor, arginine/serine-rich (transformer 2 Drosophila homolog) 10 [Rattus norvegicus] [R. norvegicus], Mus musculus hexaribonucleotide binding protein 3 (Hrnbp3) mRNA, partial cds, RIKEN cDNA 1500010G04 gene, neural-salient serine/arginine-rich, silica-induced gene 41, splicing factor, arginine/serine-rich 10 (transformer 2 homolog, Drosophila) |
| 2479 | 23310 | NM_057119 | e, s, t | | ESTs, Highly similar to TLS-associated serine-arginine protein 1, isoform 1; TLS-associated serine-arginine protein 1; TLS-associated protein TASR [Homo sapiens] [H. sapiens], ESTs, Weakly similar to splicing factor, arginine/serine-rich (transformer 2 Drosophila homolog) 10 [Rattus norvegicus] [R. norvegicus], Mus musculus hexaribonucleotide binding protein 3 (Hrnbp3) mRNA, partial cds, RIKEN cDNA 1500010G04 gene, neural-salient serine/arginine-rich, silica-induced gene 41, splicing factor, arginine/serine-rich 10 (transformer 2 homolog, Drosophila) |
| 1641 | 20082 | AI639488 | d | | ESTs, Highly similar to 1814460A p53-associated protein [H. sapiens], Mdm2, transformed 3T3 cell double minute 2, p53 binding protein (mouse), transformed mouse 3T3 cell double minute 2 |
| 377 | 17350 | AA892240 | l, m, ii | | ESTs, Highly similar to 2008109A set gene [Rattus norvegicus] [R. norvegicus], ESTs, Highly similar to SET_HUMAN SET PROTEIN [H. sapiens], SET translocation, SET translocation (myeloid leukemia-associated) |
| 1529 | 23296 | AI233316 | hh | | ESTs, Highly similar to 40S RIBOSOMAL PROTEIN S23 [H. sapiens], Mus musculus, Similar to mitochondrial ribosomal protein S12, clone MGC:13892 IMAGE:4209358, mRNA, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2006 | 20848 | NM_017343 | bb, hh, jj, kk | | complete cds, mitochondrial ribosomal protein S12, ribosomal protein S23 ESTs, Highly similar to A37100 myosin regulatory light chain A, smooth muscle - rat [*R. norvegicus*], RIKEN cDNA 2900073G15 gene, myosin light chain, phosphorylatable, cardiac ventricles, myosin regulatory light chain, myosin, light polypeptide, regulatory, non-sarcomeric (20 kD) |
| 2006 | 20849 | NM_017343 | gg | | ESTs, Highly similar to A37100 myosin regulatory light chain A, smooth muscle - rat [*R. norvegicus*], RIKEN cDNA 2900073G15 gene, myosin light chain, phosphorylatable, cardiac ventricles, myosin regulatory light chain, myosin, light polypeptide, regulatory, non-sarcomeric (20 kD) |
| 175 | 16971 | AA819691 | n, o | | ESTs, Highly similar to A38351 phosphoprotein phosphatase 2-alpha regulatory chain [*H. sapiens*], RIKEN cDNA 2410004D02 gene, protein phosphatase 2 (formerly 2A), regulatory subunit B (PR 52), alpha isoform |
| 2466 | 16962 | NM_053999 | u, v | | ESTs, Highly similar to A38351 phosphoprotein phosphatase 2-alpha regulatory chain [*H. sapiens*], RIKEN cDNA 2410004D02 gene, protein phosphatase 2 (formerly 2A), regulatory subunit B (PR 52), alpha isoform |
| 2474 | 17709 | NM_057101 | u, v | | ESTs, Highly similar to A45445 janusin precursor, long form - rat [*R. norvegicus*], ESTs, Weakly similar to JQ1322 tenascin precursor - mouse [*M. musculus*], Tenascin-R (Restrictin, janusin, J1-160/180), tenascin R (restrictin, janusin), tenascin XB |
| 267 | 15884 | AA866276 | d, f, g, r | | ESTs, Highly similar to A54602 microtubule-associated serine/threonine protein kinase MAST205 - mouse [*M. musculus*], ESTs, Moderately similar to A54602 microtubule-associated serine/threonine protein kinase MAST205 - mouse [*M. musculus*], *Homo sapiens* cDNA: FLJ21699 fis, clone COL09829, KIAA0303 protein, KIAA0561 protein, KIAA0807 protein, *Mus musculus* adult male cecum cDNA, RIKEN full-length enriched library, clone:9130026D18:syntrophin associated serine/threonine kinase, full insert sequence, microtubule associated testis specific serine/threonine protein kinase, syntrophin associated serine/threonine kinase |
| 2525 | 1791 | NM_133541 | ll | | ESTs, Highly similar to A56011 transcription factor IIIC alpha chain - rat [*R. norvegicus*], ESTs, Moderately similar to A56011 transcription factor IIIC alpha chain - rat [*R. norvegicus*], ESTs, Weakly similar to A56011 transcription factor IIIC alpha chain - rat [*R. norvegicus*], general transcription factor IIIC 1, general transcription factor IIIC, polypeptide 1 (alpha subunit, 220 kD) |
| 2542 | 1530 | NM_134397 | a, e, jj, kk | | ESTs, Highly similar to A59252 myosin heavy chain, nonmuscle, form IIB [*H. sapiens*], ESTs, Weakly similar to neuronal thread protein [*Homo sapiens*] [*H. sapiens*], ESTs, Weakly similar to LORICRIN [*M. musculus*], *Homo sapiens* mRNA; cDNA DKFZp434G227 (from clone DKFZp434G227), *Homo sapiens*, clone IMAGE:4111094, mRNA, partial cds, KIAA0638 protein, *Mus musculus*, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | Similar to hypothetical protein MGC2705, clone MGC:36471 IMAGE:5359433, mRNA, complete cds, *Mus musculus*, clone MGC:32394 IMAGE:5037534, mRNA, complete cds, expressed sequence AI036317, expressed sequence AV253284, expressed sequence C77080, loricrin |
| 2431 | 11606 | NM_053795 | gg | | ESTs, Highly similar to ANK1 MOUSE ANKYRIN 1 [*M. musculus*], ESTs, Weakly similar to ANK1 MOUSE ANKYRIN 1 [*M. musculus*], GASZ, Gasz, *Homo sapiens* cDNA FLJ25053 fis, clone CBL04266, *Mus musculus* ankyrin repeat domain-containing SOCS box protein Asb-16 mRNA, complete cds, *Mus musculus*, Similar to hypothetical protein DKFZp564O043, clone MGC:36949 IMAGE:4946879, mRNA, complete cds, RIKEN cDNA 1110058D09 gene, RIKEN cDNA 4933400N19 gene, hypothetical protein similar to ankyrin repeat-containing priotein AKR1, likely homolog of rat kinase D-interacting substance of 220 kDa, regulatory factor X-associated ankyrin-containing protein |
| 2057 | 17507 | NM_019299 | f, g | | ESTs, Highly similar to B Chain B, Peptide-In-Groove Interactions Link Target Proteins To The B-Propeller Of Clathrin [*R. norvegicus*], RIKEN cDNA 1700034F02 gene, clathrin, heavy polypeptide (Hc), clathrin, heavy polypeptide-like 1, expressed sequence R74732 |
| 831 | 13787 | AI011462 | cc, dd | | ESTs, Highly similar to C259_HUMAN PROTEIN C21ORF59 [*H. sapiens*], chromosome 21 open reading frame 59 |
| 2627 | 20386 | U68562 | cc, dd | | ESTs, Highly similar to CH60_HUMAN 60 KDA HEAT SHOCK PROTEIN, MITOCHONDRIAL PRECURSOR [*H. sapiens*], ESTs, Moderately similar to CH60 MOUSE 60 KDA HEAT SHOCK PROTEIN, MITOCHONDRIAL PRECURSOR [*M. musculus*], ESTs, Weakly similar to CH60_HUMAN 60 KDA HEAT SHOCK PROTEIN, MITOCHONDRIAL PRECURSOR [*H. sapiens*], heat shock 60 kD protein 1 (chaperonin), heat shock protein, 60 kDa |
| 644 | 12426 | AA955760 | u, v | | ESTs, Highly similar to CIA1_HUMAN WD40-REPEAT CONTAINING PROTEIN CIAO 1 [*H. sapiens*], ESTs, Weakly similar to LIS1_MOUSE Platelet-activating factor acetylhydrolase IB alpha subunit (PAF acetylhydrolase 45 kDa subunit) (PAF-AH 45 kDa subunit) (PAF-AH alpha) (PAFAH alpha) (Lissencephaly-1 protein) (LIS-1) [*R. norvegicus*], F-box and WD-40 domain protein 7 (archipelago homolog, *Drosophila*), *Homo sapiens* cDNA FLJ31861 fis, clone NT2RP7001319, *Homo sapiens*, clone MGC:4710 IMAGE:3534806, mRNA, complete cds, *Mus musculus* F-box-WD40 repeat protein 6 (Fbxw6) mRNA, complete cds, *Mus musculus*, Similar to RIKEN cDNA 1500041N16 gene, clone MGC:12066 IMAGE:3708188, mRNA, complete cds, nuclear receptor co-repressor/HDAC3 complex subunit, platelet-activating factor acetylhydrolase beta subunit (PAF-AH beta), platelet-activating factor acetylhydrolase, isoform 1b, beta1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | subunit, platelet-activating factor acetylhydrolase, isoform Ib, alpha subunit (45 kD), transducin (beta)-like 1 |
| 1359 | 17570 | AI177683 | n, o, hh | | ESTs, Highly similar to DDRT helix-destabilizing protein - rat [R. norvegicus], ESTs, Highly similar to ROA3_HUMAN HETEROGENEOUS NUCLEAR RIBONUCLEOPROTEIN A3 [H. sapiens], ESTs, Highly similar to S12520 core protein A1 [H. sapiens], ESTs, Highly similar to heterogeneous ribonuclear particle protein A1 [H. sapiens], ESTs, Moderately similar to heterogeneous ribonuclear particle protein A1 [H. sapiens], ESTs, Weakly similar to ROA2 MOUSE HETEROGENEOUS NUCLEAR RIBONUCLEOPROTEINS A2/B1 [M. musculus], Mus musculus, similar to heterogeneous nuclear ribonucleoprotein A3 (H. sapiens), clone MGC:37309 IMAGE:4975085, mRNA, complete cds, RIKEN cDNA 2610510D13 gene, RIKEN cDNA 3010025E17 gene, heterogeneous nuclear ribonucleoprotein A1, heterogeneous nuclear ribonucleoprotein A2/B1, heterogeneous nuclear ribonucleoprotein A3, hypothetical protein 23851 |
| 37 | 17612 | AA799511 | ll | | ESTs, Highly similar to DDRT helix-destabilizing protein - rat [R. norvegicus], ESTs, Highly similar to S12520 core protein A1 [H. sapiens], ESTs, Highly similar to heterogeneous ribonuclear particle protein A1 [H. sapiens], ESTs, Moderately similar to heterogeneous ribonuclear particle protein A1 [H. sapiens], ESTs, Weakly similar to ROA2 MOUSE HETEROGENEOUS NUCLEAR RIBONUCLEOPROTEINS A2/B1 [M. musculus], Mus musculus, similar to heterogeneous nuclear ribonucleoprotein A3 (H. sapiens), clone MGC:37309 IMAGE:4975085, mRNA, complete cds, RIKEN cDNA 2610510D13 gene, RIKEN cDNA 3010025E17 gene, heterogeneous nuclear ribonucleoprotein A1, heterogeneous nuclear ribonucleoprotein A2/B1 |
| 181 | 17614 | AA848306 | b | | ESTs, Highly similar to DDRT helix-destabilizing protein - rat [R. norvegicus], ESTs, Highly similar to S12520 core protein A1 [H. sapiens], ESTs, Highly similar to heterogeneous ribonuclear particle protein A1 [H. sapiens], ESTs, Moderately similar to heterogeneous ribonuclear particle protein A1 [H. sapiens], ESTs, Weakly similar to ROA2 MOUSE HETEROGENEOUS NUCLEAR RIBONUCLEOPROTEINS A2/B1 [M. musculus], Mus musculus, similar to heterogeneous nuclear ribonucleoprotein A3 (H. sapiens), clone MGC:37309 IMAGE:4975085, mRNA, complete cds, RIKEN cDNA 2610510D13 gene, RIKEN cDNA 3010025E17 gene, heterogeneous nuclear ribonucleoprotein A1, heterogeneous nuclear ribonucleoprotein A2/B1 |
| 192 | 2075 | AA849394 | u, v | | ESTs, Highly similar to DDRT helix-destabilizing protein - rat [R. norvegicus], ESTs, Highly similar to S12520 core protein A1 [H. sapiens], ESTs, Highly |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | similar to heterogeneous ribonuclear particle protein A1 [*H. sapiens*], ESTs, Moderately similar to S38384 SEB4 protein - mouse [*M. musculus*], ESTs, Moderately similar to heterogeneous ribonuclear particle protein A1 [*H. sapiens*], ESTs, Weakly similar to S38384 SEB4 protein - mouse [*M. musculus*], heterogeneous nuclear ribonucleoprotein A1, seb4-like (*Xenopus laevis*) |
| 1062 | 5740 | AI072092 | l, m | | ESTs, Highly similar to DYNC_HUMAN DYNACTIN, 50 KD ISOFORM [*H. sapiens*], dynactin 2 (p50) |
| 421 | 16482 | AA892940 | gg | | ESTs, Highly similar to EF2_RAT Elongation factor 2 (EF-2) [*R. norvegicus*], ESTs, Weakly similar to EF2_MOUSE Elongation factor 2 (EF-2) [*M. musculus*], U5 small nuclear ribonucleoprotein 116 kDa, eukaryotic translation elongation factor 2 |
| 26 | 6581 | AA799412 | e | | ESTs, Highly similar to ERR3_HUMAN ESTROGEN-RELATED RECEPTOR GAMMA [*H. sapiens*], estrogen related receptor, alpha, estrogen-related receptor alpha, estrogen-related receptor gamma |
| 809 | 15644 | AI010256 | kk | | ESTs, Highly similar to H33_HUMAN HISTONE H3.3 [*H. sapiens*], H3 histone, family 3A, H3 histone, family 3B, H3 histone, family 3B (H3.3B), RIKEN cDNA 1810027O10 gene |
| 1167 | 24212 | AI136747 | cc, dd | | ESTs, Highly similar to H33_HUMAN HISTONE H3.3 [*H. sapiens*], H3 histone, family 3A, H3 histone, family 3B, H3 histone, family 3B (H3.3B), RIKEN cDNA 1810027O10 gene |
| 2462 | 15642 | NM_053985 | d | | ESTs, Highly similar to H33_HUMAN HISTONE H3.3 [*H. sapiens*], H3 histone, family 3A, H3 histone, family 3B, H3 histone, family 3B (H3.3B), RIKEN cDNA 1810027O10 gene |
| 2462 | 15645 | NM_053985 | d | | ESTs, Highly similar to H33_HUMAN HISTONE H3.3 [*H. sapiens*], H3 histone, family 3A, H3 histone, family 3B, H3 histone, family 3B (H3.3B), RIKEN cDNA 1810027O10 gene |
| 2010 | 24428 | NM_017356 | ll | | ESTs, Highly similar to HIPP_HUMAN Neuron specific calcium-binding protein hippocalcin (P23K) (Calcium-binding protein BDR-2) [*R. norvegicus*], ESTs, Moderately similar to VIS3 MOUSE VISININ-LIKE PROTEIN 3 [*M. musculus*], *Mus musculus*, clone MGC:21424 IMAGE:4500919, mRNA, complete cds, expressed sequence AI848120, guanylate cyclase activator 1A (retina), guanylate cyclase activator 1B (retina), guanylate cyclase activator 1C, guanylate cyclase activator 1a (retina), hippocalcin-like 1, hypothetical protein FLJ11767, neurocalcin delta |
| 584 | 20795 | AA944397 | e, ee | | ESTs, Highly similar to HS9B_RAT Heat shock protein HSP 90-beta (HSP 84) [*R. norvegicus*], ESTs, Highly similar to T46243 hypothetical protein DKFZp761K0511.1 [*H. sapiens*], *Mus musculus*, clone IMAGE:3584589, mRNA, partial cds, expressed sequence C81438, heat shock 90 kD protein 1, beta, heat shock protein, 84 kDa 1, heat shock protein, 86 kDa 1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1335 | 16518 | AI176546 | d, ee, ff, jj, kk | | ESTs, Highly similar to HS9B_RAT Heat shock protein HSP 90-beta (HSP 84) [*R. norvegicus*], ESTs, Highly similar to T46243 hypothetical protein DKFZp761K0511.1 [*H. sapiens*], *Mus musculus*, clone IMAGE:3584589, mRNA, partial cds, expressed sequence C81438, heat shock 90 kD protein 1, beta, heat shock protein, 84 kDa 1, heat shock protein, 86 kDa 1 |
| 17 | 25104 | AA685903 | d, e, r | | ESTs, Highly similar to HS9B_RAT Heat shock protein HSP 90-beta (HSP 84) [*R. norvegicus*], ESTs, Highly similar to T46243 hypothetical protein DKFZp761K0511.1 [*H. sapiens*], RIKEN cDNA 1810014B01 gene, expressed sequence C81438, heat shock 90 kD protein 1, beta, heat shock protein, 84 kDa 1, tumor rejection antigen (gp96) 1, tumor rejection antigen gp96 |
| 2603 | 18647 | S69316 | d, e | | ESTs, Highly similar to HS9B_RAT Heat shock protein HSP 90-beta (HSP 84) [*R. norvegicus*], ESTs, Highly similar to T46243 hypothetical protein DKFZp761K0511.1 [*H. sapiens*], RIKEN cDNA 1810014B01 gene, expressed sequence C81438, heat shock 90 kD protein 1, beta, heat shock protein, 84 kDa 1, tumor rejection antigen (gp96) 1, tumor rejection antigen gp96 |
| 1003 | 19093 | AI058869 | l, m | | ESTs, Highly similar to Human Translation Initiation Factor Eif1, Nmr, 29 Structures [*H. sapiens*], putative translation initiation factor, suppressor of initiator codon mutations, related sequence 1 (*S. cerevisiae*) |
| 1504 | 19094 | AI232021 | g | | ESTs, Highly similar to Human Translation Initiation Factor Eif1, Nmr, 29 Structures [*H. sapiens*], putative translation initiation factor, suppressor of initiator codon mutations, related sequence 1 (*S. cerevisiae*) |
| 387 | 22868 | AA892391 | ee, ff | | ESTs, Highly similar to I48722 zinc finger protein - mouse [*M. musculus*], ESTs, Moderately similar to S47073 finger protein HZF2, Krueppel-related [*H. sapiens*], Homo sapiens cDNA FLJ31843 fis, clone NT2RP7000271, moderately similar to *Mus musculus* zinc finger protein 276 C2H2 type (Zfp276) mRNA, Homo sapiens cDNA: FLJ22829 fis, clone KAIA4075, highly similar to HSCH16FAA Homo sapiens mRNA for FAA protein, ciliary neurotropic factor, hypothetical protein BC016816, hypothetical protein FLJ20531, zinc finger protein 354A, zinc finger protein 354B |
| 1105 | 22487 | AI102578 | e | | ESTs, Highly similar to I49523 Mouse primary response gene B94 mRNA, 3'end - mouse [*M. musculus*], RIKEN cDNA 1600013K19 gene, hypothetical protein MGC16332, tumor necrosis factor, alpha-induced protein 2 |
| 1410 | 19828 | AI180087 | d | | ESTs, Highly similar to I49636 DNA-binding protein - mouse [*M. musculus*], ESTs, Highly similar to OZF_HUMAN ZINC FINGER PROTEIN OZF [*H. sapiens*], ESTs, Moderately similar to I49636 DNA-binding protein - mouse [*M. musculus*], ESTs, Weakly similar to OZF_HUMAN ZINC FINGER PROTEIN OZF [*H. sapiens*], ESTs, Weakly similar to Z177_HUMAN ZINC FINGER PROTEIN 177 [*H. sapiens*], Homo |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | sapiens mRNA; cDNA DKFZp547C146 (from clone DKFZp547C146), Mus musculus, Similar to zinc finger protein 97, clone MGC:6111 IMAGE:3494875, mRNA, complete cds, Pancreas zinc finger protein, see also D1Bda10\2, zinc finger protein 177, zinc finger protein 260, zinc finger protein 63, zinc finger protein 97 |
| 707 | 8786 | AA996993 | d | | ESTs, Highly similar to I58408 IK factor [*H. sapiens*], IK cytokine |
| 870 | 16686 | AI013160 | u, v | | ESTs, Highly similar to I63168 gene Ube1x protein - rat (fragment) [*R. norvegicus*], ubiquitin-activating enzyme E1 (A1S9T and BN75 temperature sensitivity complementing), ubiquitin-activating enzyme E1, Chr X, ubiquitin-activating enzyme E1, Chr Y 1, ubiquitin-activating enzyme E1-like |
| 748 | 19649 | AF016387 | jj, kk | | ESTs, Highly similar to I67428 retinoic acid receptor homolog - rat (fragment) [*R. norvegicus*], retinoid X receptor gamma, retinoid X receptor, gamma |
| 748 | 19650 | AF016387 | jj, kk | | ESTs, Highly similar to I67428 retinoic acid receptor homolog - rat (fragment) [*R. norvegicus*], retinoid X receptor gamma, retinoid X receptor, gamma |
| 2563 | 11840 | NM_138911 | e | | ESTs, Highly similar to IEFS_HUMAN TRANSFORMATION-SENSITIVE PROTEIN IEF SSP 3521 [*H. sapiens*], ESTs, Weakly similar to small glutamine-rich tetratricopeptide repeat (TPR) containing protein (SGT) [*Rattus norvegicus*] [*R. norvegicus*], Mus musculus, clone MGC:27660 IMAGE:4527683, mRNA, complete cds, RIKEN cDNA 5330427H01 gene, hypothetical protein FLJ12788, small glutamine-rich tetratricopeptide repeat (TPR) containing protein (SGT), small glutamine-rich tetratricopeptide repeat (TPR)-containing, stress-induced phosphoprotein 1, stress-induced-phosphoprotein 1 (Hsp70/Hsp90-organizing protein) |
| 1386 | 18848 | AI178816 | n, o | | ESTs, Highly similar to IF4E_HUMAN EUKARYOTIC TRANSLATION INITIATION FACTOR 4E [*H. sapiens*], RIKEN cDNA 1300018P11 gene, RIKEN cDNA 2700069E09 gene, eukaryotic translation initiation factor 4E, eukaryotic translation initiation factor 4E-like 3 |
| 1218 | 21660 | AI169751 | a, kk | | ESTs, Highly similar to IFM3_HUMAN INTERFERON-INDUCED TRANSMEMBRANE PROTEIN 3 [*H. sapiens*], ESTs, Highly similar to S17182 interferon-induced protein 1-8U [*H. sapiens*], RIKEN cDNA 1110004C05 gene, interferon induced transmembrane protein 1 (9-27), interferon induced transmembrane protein 3 (1-8U) |
| 2665 | 21657 | X61381 | d, j, k, m, y, z, kk | | ESTs, Highly similar to IFM3_HUMAN INTERFERON-INDUCED TRANSMEMBRANE PROTEIN 3 [*H. sapiens*], ESTs, Highly similar to S17182 interferon-induced protein 1-8U [*H. sapiens*], RIKEN cDNA 1110004C05 gene, interferon induced transmembrane protein 1 (9-27), interferon induced transmembrane protein 3 (1-8U) |
| 1276 | 2140 | AI172272 | hh | | ESTs, Highly similar to JC4577 transcription elongation factor T1 [*H. sapiens*], ESTs, Highly similar to Transcriptional Elongation Factor Sii [*H. sapiens*], ESTs, Weakly similar to |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2560 | 3015 | NM_138895 | aa, bb | | JC5430 transcription elongation factor S-II-T1, testis-specific - mouse [*M. musculus*], Homo sapiens cDNA: FLJ23371 fis, clone HEP16068, highly similar to HSTFIISH *Homo sapiens* mRNA for transcription elongation factor TFIIS, PHD finger protein 3, transcription elongation factor A (SII), 3 ESTs, Highly similar to JE0190 polyubiquitin unit [*H. sapiens*], ESTs, Highly similar to UQHUC polyubiquitin 9 [*H. sapiens*], Homo sapiens, Similar to orosomucoid 1, clone MGC:24263 IMAGE:3934516, mRNA, complete cds, expressed sequence AL033289, ubiquitin B, ubiquitin C |
| 322 | 2846 | AA875639 | a | | ESTs, Highly similar to LB4D_HUMAN NADP-DEPENDENT LEUKOTRIENE B4 12-HYDROXYDEHYDROGENASE [*H. sapiens*], ESTs, Weakly similar to LB4D_HUMAN NADP-DEPENDENT LEUKOTRIENE B4 12-HYDROXYDEHYDROGENASE [*H. sapiens*], Homo sapiens, clone IMAGE:4793702, mRNA, *Mus musculus*, clone MGC:32469 IMAGE:5050433, mRNA, complete cds, crystallin, zeta, fatty acid synthase, quinone oxidoreductase homolog |
| 1890 | 1258 | NM_013185 | hh | | ESTs, Highly similar to LCK MOUSE PROTO-ONCOGENE TYROSINE-PROTEIN KINASE LCK [*M. musculus*], RIKEN cDNA 8430404F20 gene, hemopoietic cell kinase, lymphocyte protein tyrosine kinase, lymphocyte-specific protein tyrosine kinase, src-related kinase lacking C-terminal regulatory tyrosine and N-terminal myristylation sites |
| 1014 | 8729 | AI059485 | w, x | | ESTs, Highly similar to MEM2 RAT MEMBRANE-ASSOCIATED PROTEIN HEM-2 [*R. norvegicus*], ESTs, Highly similar to NCP1_RAT Nck-associated protein 1 (NAP 1) (p125Nap1) (Membrane-associated protein HEM-2) [*R. norvegicus*], NCK-associated protein 1 |
| 2583 | 305 | NM_145773 | u, v | | ESTs, Highly similar to MXI1_RAT MAX interacting protein 1 (MXI1 protein) [*R. norvegicus*], ESTs, Moderately similar to MXI1_RAT MAX interacting protein 1 (MXI1 protein) [*R. norvegicus*], Homo sapiens cDNA FLJ32472 fis, clone SKNMC2000356, highly similar to *Mus musculus* Max-interacting transcriptional repressor (Mad3) mRNA, MAX interacting protein 1, Max interacting protein 1, likely ortholog of mouse Max dimerization protein 3 |
| 1884 | 3465 | NM_013160 | h, l | | ESTs, Highly similar to MXI1_RAT MAX interacting protein 1 (MXI1 protein) [*R. norvegicus*], ESTs, Weakly similar to MXI1_RAT MAX interacting protein 1 (MXI1 protein) [*R. norvegicus*], MAX dimerization protein, MAX interacting protein 1, Max interacting protein 1 |
| 1892 | 1970 | NM_013194 | gg | | ESTs, Highly similar to MYH9_RAT Myosin heavy chain, nonmuscle type A (Cellular myosin heavy chain, type A) (Nonmuscle myosin heavy chain-A) (NMMHC-A) [*R. norvegicus*], ESTs, Highly similar to MYHA_MOUSE Myosin heavy chain, nonmuscle type B (Cellular myosin heavy chain, type B) (Nonmuscle myosin heavy chain-B) (NMMHC-B) [*M. musculus*], ESTs, Weakly similar to |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | MYH9_RAT Myosin heavy chain, nonmuscle type A (Cellular myosin heavy chain, type A) (Nonmuscie myosin heavy chain-A) (NMMHC-A) [*R. norvegicus*], ESTs, Weakly similar to MYHA_MOUSE Myosin heavy chain, nonmuscle type B (Cellular myosin heavy chain, type B) (Nonmuscle myosin heavy chain-B) (NMMHC-B) [*M. musculus*], RIKEN cDNA 2400004E04 gene, RIKEN cDNA 5730504C04 gene, TGFB1-induced anti-apoptotic factor 1, myosin heavy chain IX, myosin, heavy polypeptide 9, non-muscle, protein tyrosine phosphatase, receptor-type, F interacting protein, binding protein 2 |
| 228 | 13802 | AA858853 | b, l, m | | ESTs, Highly similar to NTC1_RAT Neurogenic locus notch homolog protein 1 precursor (Notch 1) [*R. norvegicus*], Homo sapiens cDNA FLJ25053 fis, clone CBL04266, Notch gene homolog 1, (*Drosophila*), Notch homolog 1, translocation-associated (*Drosophila*), hypothetical protein similar to ankyrin repeat-containing priotein AKR1, likely homolog of rat kinase D-interacting substance of 220 kDa |
| 2355 | 25529 | NM_033096 | n, o | | ESTs, Highly similar to P2CB_HUMAN PROTEIN PHOSPHATASE 2C BETA ISOFORM [*H. sapiens*], ESTs, Weakly similar to P2CB_HUMAN PROTEIN PHOSPHATASE 2C BETA ISOFORM [*H. sapiens*], Homo sapiens cDNA FLJ30553 fis, clone BRAWH2003689, highly similar to *Mus musculus* clone mouse 1-9 putative protein phosphatase type 2C mRNA, protein phosphatase 1B (formerly 2C), magnesium-dependent, beta isoform, protein phosphatase 1B, magnesium dependent, beta isoform |
| 2355 | 25569 | NM_033096 | r | | ESTs, Highly similar to P2CB_HUMAN PROTEIN PHOSPHATASE 2C BETA ISOFORM [*H. sapiens*], ESTs, Weakly similar to P2CB_HUMAN PROTEIN PHOSPHATASE 2C BETA ISOFORM [*H. sapiens*], Homo sapiens cDNA FLJ30553 fis, clone BRAWH2003689, highly similar to *Mus musculus* clone mouse 1-9 putative protein phosphatase type 2C mRNA, protein phosphatase 1B (formerly 2C), magnesium-dependent, beta isoform, protein phosphatase 1B, magnesium dependent, beta isoform |
| 2355 | 19148 | NM_033096 | h, l | | ESTs, Highly similar to P2CB_HUMAN PROTEIN PHOSPHATASE 2C BETA ISOFORM [*H. sapiens*], ESTs, Weakly similar to P2CB_HUMAN PROTEIN PHOSPHATASE 2C BETA ISOFORM [*H. sapiens*], Homo sapiens cDNA FLJ30553 fis, clone BRAWH2003689, highly similar to *Mus musculus* clone mouse 1-9 putative protein phosphatase type 2C mRNA, protein phosphatase 1B (formerly 2C), magnesium-dependent, beta isoform, protein phosphatase 1B, magnesium dependent, beta isoform |
| 2540 | 19840 | NM_134353 | ll | | ESTs, Highly similar to PAB1_HUMAN POLYADENYLATE-BINDING PROTEIN 1 [*H. sapiens*], ESTs, Moderately similar to NUCLEOLIN [*M. musculus*], ESTs, Moderately similar to PAB1 MOUSE POLYADENYLATE-BINDING PROTEIN 1 [*M. musculus*], ESTs, Weakly similar to NUCL_HUMAN NUCLEOLIN |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2464 | 18025 | NM_053989 | w, x | | [*H. sapiens*], ESTs, Weakly similar to PAB1 MOUSE POLYADENYLATE-BINDING PROTEIN 1 [*M. musculus*], Nucleolin, RIKEN cDNA 4932702K14 gene, nucleolin, pigpen, poly A binding protein, cytoplasmic 1, poly(A) binding protein, cytoplasmic 3, poly(A) binding protein, cytoplasmic, pseudogene 2 ESTs, Highly similar to PAB1_HUMAN POLYADENYLATE-BINDING PROTEIN 1 [*H. sapiens*], RIKEN cDNA 2810411E22 gene, RIKEN cDNA 4432411E13 gene, RIKEN cDNA 4930431E10 gene |
| 2235 | 12638 | NM_031099 | e | | ESTs, Highly similar to PC4210 ribosomal protein L5 [*H. sapiens*], ribosomal protein L5 |
| 2235 | 12639 | NM_031099 | g | | ESTs, Highly similar to PC4210 ribosomal protein L5 [*H. sapiens*], ribosomal protein L5 |
| 896 | 7212 | AI014065 | gg | | ESTs, Highly similar to PMX1_MOUSE Paired mesoderm homeobox protein 1 (PRX-1) (Paired related homeobox protein 1) (Homeobox protein MhoX) (Homeobox protein K-2) (Rhox) [*R. norvegicus*], ESTs, Weakly similar to PMX1_MOUSE Paired mesoderm homeobox protein 1 (PRX-1) (Paired related homeobox protein 1) (Homeobox protein MhoX) (Homeobox protein K-2) (Rhox) [*R. norvegicus*], paired mesoderm homeo box 1, paired related homeobox 1, paired related homeobox protein |
| 1300 | 4445 | AI175466 | r | | ESTs, Highly similar to RASH_RAT TRANSFORMING PROTEIN P21/H-RAS-1 (C-H-RAS) [*R. norvegicus*], Harvey rat sarcoma oncogene, subgroup R, Harvey rat sarcoma virus oncogene, *Mus musculus*, Similar to v-Ha-ras Harvey rat sarcoma viral oncogene homolog, clone MGC:19390 IMAGE:3152667, mRNA, complete cds, related RAS viral (r-ras) oncogene homolog, v-Ha-ras Harvey rat sarcoma viral oncogene homolog |
| 438 | 18542 | AA893493 | g | | ESTs, Highly similar to RL26_HUMAN 60S RIBOSOMAL PROTEIN L26 [*H. sapiens*], ESTs, Highly similar to S33713 ribosomal protein L26, cytosolic [*H. sapiens*], ESTs, Moderately similar to RL26_HUMAN 60S RIBOSOMAL PROTEIN L26 [*H. sapiens*], ribosomal protein L26, ribosomal protein L26-like 1 |
| 2646 | 18541 | X14671 | g | | ESTs, Highly similar to RL26_HUMAN 60S RIBOSOMAL PROTEIN L26 [*H. sapiens*], ESTs, Highly similar to S33713 ribosomal protein L26, cytosolic [*H. sapiens*], ESTs, Moderately similar to RL26_HUMAN 60S RIBOSOMAL PROTEIN L26 [*H. sapiens*], ribosomal protein L26, ribosomal protein L26-like 1 |
| 1903 | 815 | NM_013224 | g, h, l, w, x | | ESTs, Highly similar to RS26_HUMAN 40S RIBOSOMAL PROTEIN S26 [*H. sapiens*], *Homo sapiens*, clone IMAGE:4100953, mRNA, polymerase (RNA) II (DNA directed) polypeptide D, ribosomal protein S26 |
| 81 | 15011 | AA799893 | hh | | ESTs, Highly similar to S12520 core protein A1 [*H. sapiens*], ESTs, Highly similar to heterogeneous ribonuclear particle protein A1 [*H. sapiens*], ESTs, Moderately similar to heterogeneous ribonuclear particle protein A1 [*H. sapiens*], *Mus musculus*, Similar to TAR DNA binding protein, clone MGC:19284 IMAGE:4016437, mRNA, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2457 | 6357 | NM_053969 | d | | complete cds, RIKEN cDNA 2610510D13 gene, RIKEN cDNA 4930547K05 gene, heterogeneous nuclear ribonucleoprotein A1, heterogeneous nuclear ribonucleoprotein A3 ESTs, Highly similar to S57449 fusca protein homolog - rat [*R. norvegicus*], ESTs, Weakly similar to S57449 fusca protein homolog - rat [*R. norvegicus*], G protein pathway suppressor 1, *Mus musculus*, Similar to G protein pathway suppressor 1, clone MGC:7191 IMAGE:3481979, mRNA, complete cds, RIKEN cDNA 2400006A19 gene |
| 817 | 18691 | AI010605 | b | | ESTs, Highly similar to S63665 titin protein [*H. sapiens*], ESTs, Weakly similar to S63665 titin protein [*H. sapiens*], *Homo sapiens* cDNA FLJ31994 fis, clone NT2RP7009215, *Homo sapiens*, Similar to RIKEN cDNA 1810054O13 gene, clone IMAGE:3845933, mRNA, partial cds |
| 2592 | 10544 | NM_152935 | s, t, u, v | | ESTs, Highly similar to S68215 Mas 20 protein [*H. sapiens*], *Homo sapiens* cDNA FLJ30361 fis, clone BRACE2007764, RIKEN cDNA 1810060K07 gene, RIKEN cDNA 4930553D19 gene, translocase of outer mitochondrial membrane 20 (yeast) homolog |
| 60 | 20982 | AA799657 | d, e, ii | | ESTs, Highly similar to S68418 protein phosphatase 1M chain M110 isoform - rat [*R. norvegicus*], ESTs, Weakly similar to S68418 protein phosphatase 1M chain M110 isoform - rat (fragment) [*R. norvegicus*], expressed sequence AI449786, expressed sequence AI746547, leukocyte receptor cluster (LRC) member 3, myosin phosphatase, target subunit 1, protein phosphatase 1, regulatory (inhibitor) subunit 12A |
| 1388 | 23043 | AI178968 | b | | ESTs, Highly similar to S70642 ubiquitin ligase Nedd4 - rat (fragment) [*R. norvegicus*], ESTs, Moderately similar to S70642 ubiquitin ligase Nedd4 - rat (fragment) [*R. norvegicus*], *Mus musculus*, clone MGC:12070 IMAGE:3708271, mRNA, complete cds, RIKEN cDNA 1700056O17 gene, RIKEN cDNA 5830462N02 gene, expressed sequence AW212605, neural precursor cell expressed, developmentally down-regulated 4, neural precursor cell expressed, developmentally down-regulated gene 4a, thyroid hormone receptor interactor 12, ubiquitin protein ligase E3A |
| 2508 | 1502 | NM_130746 | aa | | ESTs, Highly similar to SL56_RAT SODIUM-DEPENDENT MULTIVITAMIN TRANSPORTER (NA(+)-DEPENDENT MULTIVITAMIN TRANSPORTER) [*R. norvegicus*], ESTs, Highly similar to SL56_RAT Sodium-dependent multivitamin transporter (Na(+)-dependent multivitamin transporter) [*R. norvegicus*], *Homo sapiens* cDNA FLJ14949 fis, clone PLACE2000341, highly similar to *Homo sapiens* sodium-dependent multivitamin transporter (SMVT) mRNA, *Homo sapiens* mRNA; cDNA DKFZp434F152 (from clone DKFZp434F152), solute carrier family 5 (sodium iodide symporter), member 5, solute carrier family 5 (sodium-dependent vitamin transporter), member 6 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2508 | 1503 | NM_130746 | d | | ESTs, Highly similar to SL56_RAT SODIUM-DEPENDENT MULTIVITAMIN TRANSPORTER (NA(+)-DEPENDENT MULTIVITAMIN TRANSPORTER) [*R. norvegicus*], ESTs, Highly similar to SL56_RAT Sodium-dependent multivitamin transporter (Na(+)-dependent multivitamin transporter) [*R. norvegicus*], *Homo sapiens* cDNA FLJ14949 fis, clone PLACE2000341, highly similar to *Homo sapiens* sodium-dependent multivitamin transporter (SMVT) mRNA, *Homo sapiens* mRNA; cDNA DKFZp434F152 (from clone DKFZp434F152), solute carrier family 5 (sodium iodide symporter), member 5, solute carrier family 5 (sodium-dependent vitamin transporter), member 6 |
| 2585 | 22972 | NM_145778 | e | | ESTs, Highly similar to T08726 tubulin beta chain [*H. sapiens*], ESTs, Highly similar to TBB1_RAT TUBULIN BETA CHAIN (T BETA-15) [*R. norvegicus*], RIKEN cDNA 2410129E14 gene, RIKEN cDNA 4930447K03 gene, RIKEN cDNA 4930542G03 gene, Rat mRNA for beta-tubulin T beta15, expressed sequence AI451582, expressed sequence C79445, tubulin, beta 3, tubulin, gamma 1 |
| 2449 | 385 | NM_053885 | b, o, u, v, ee, ff, kk | | ESTs, Highly similar to T42731 atrophin-1 related protein - rat [*R. norvegicus*], ESTs, Weakly similar to dentatorubral pallidoluysian atrophy [*M. musculus*], arginine-glutamic acid dipeptide (RE) repeats, dentatorubral pallidoluysian atrophy, expressed sequence AW556404, expressed sequence AW742570 |
| 1201 | 11346 | AI145991 | jj, kk | | ESTs, Highly similar to T46266 hypothetical protein DKFZp761A179.1 [*H. sapiens*], KIAA1246 protein, KIAA1580 protein, hypothetical protein FLJ14594 |
| 446 | 19411 | AA893667 | cc, dd | | ESTs, Highly similar to T46904 hypothetical protein DKFZp761D081.1 [*H. sapiens*], *Homo sapiens* cDNA: FLJ21587 fis, clone COL06946, likely ortholog of mouse Arkadia |
| 489 | 16753 | AA900474 | w, x | | ESTs, Highly similar to T50619 hypothetical protein DKFZp762M136.1 [*H. sapiens*], hypothetical protein DKFZp762M136 |
| 2192 | 11628 | NM_024383 | b | | ESTs, Highly similar to TRANSCRIPTION FACTOR HES-5 [*M. musculus*], hairy and enhancer of split (*Drosophila*) homolog 2, hairy and enhancer of split 5, (*Drosophila*) |
| 2536 | 16456 | NM_134346 | ii | | ESTs, Highly similar to TVHUR1 transforming protein rap1b [*H. sapiens*], ESTs, Weakly similar to GTP-binding protein ROC2 [*M. musculus*], *Mus musculus*, Similar to RAS-like, estrogen-regulated, growth-inhibitor, clone MGC:31467 IMAGE:4483442, mRNA, complete cds, RAP1B, member of RAS oncogene family, RAP2B, member of RAS oncogene family, RAS-like, estrogen-regulated, growth-inhibitor |
| 2256 | 15052 | NM_031136 | c, w, x, aa, bb | | ESTs, Highly similar to TYB4 MOUSE THYMOSIN BETA-4 [*M. musculus*], ESTs, Moderately similar to PC4259 ferritin associated protein [*H. sapiens*], *Homo sapiens* cDNA FLJ31414 fis, clone NT2NE2000260, weakly similar to THYMOSIN BETA-4, thymosin, beta 4, X chromosome |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1202 | 11363 | AI145997 | hh | | ESTs, Highly similar to UV EXCISION REPAIR PROTEIN PROTEIN RAD23 HOMOLOG B [*M. musculus*], RAD23 homolog B (*S. cerevisiae*), RAD23b homolog (*S. cerevisiae*) |
| 2428 | 14015 | NM_053770 | hh | | ESTs, Moderately similar to Arg/Abl-interacting protein ArgBP2 [*Rattus norvegicus*] [*R. norvegicus*], ESTs, Weakly similar to Arg/Abl-interacting protein ArgBP2 [*Rattus norvegicus*] [*R. norvegicus*], RIKEN cDNA 2010203O03 gene, SH3-domain protein 5 (ponsin), sorbin and SH3 domain containing 1 |
| 2428 | 14017 | NM_053770 | hh | | ESTs, Moderately similar to Arg/Abl-interacting protein ArgBP2 [*Rattus norvegicus*] [*R. norvegicus*], ESTs, Weakly similar to Arg/Abl-interacting protein ArgBP2 [*Rattus norvegicus*] [*R. norvegicus*], RIKEN cDNA 2010203O03 gene, SH3-domain protein 5 (ponsin), sorbin and SH3 domain containing 1 |
| 1693 | 381 | L00124 | b, l, m | | ESTs, Moderately similar to elastase 3B, pancreatic [*Mus musculus*] [*M. musculus*], ESTs, Weakly similar to EL2 MOUSE ELASTASE 2 PRECURSOR [*M. musculus*], ESTs, Weakly similar to EL2_RAT Elastase 2 precursor [*R. norvegicus*], elastase 2, elastase 2A, elastase 3A, pancreatic (protease E), elastase 3B, pancreatic |
| 2222 | 17727 | NM_031043 | c | | ESTs, Moderately similar to glycogenin 2 [*Homo sapiens*] [*H. sapiens*], glycogenin, glycogenin 1, glycogenin 2 |
| 2138 | 9541 | NM_022542 | e, r | | ESTs, Moderately similar to rhoB gene [*Rattus norvegicus*] [*R. norvegicus*], ESTs, Weakly similar to rhoB gene [*Rattus norvegicus*] [*R. norvegicus*], *Mus musculus*, clone MGC:29297 IMAGE:5003249, mRNA, complete cds, RIKEN cDNA 5830400A04 gene, ras homolog B (RhoB), ras homolog gene family, member B |
| 782 | 21596 | AI009168 | j, k | | ESTs, Moderately similar to rhoB gene [*Rattus norvegicus*] [*R. norvegicus*], *Mus musculus*, clone MGC:29297 IMAGE:5003249, mRNA, complete cds, RIKEN cDNA 5830400A04 gene, cell division cycle 42 homolog (*S. cerevisiae*), ras homolog B (RhoB), ras homolog gene family, member B, ras homolog gene family, member U, rhoB gene |
| 2348 | 18898 | NM_031985 | ii | | ESTs, Moderately similar to ribosomal protein S6 kinase, 70 kD, polypeptide 2; S6 kinase 2 [*Mus musculus*] [*M. musculus*], RIKEN cDNA 2610318I15 gene, ribosomal protein S6 kinase, 70 kD, polypeptide 1, ribosomal protein S6 kinase, 70 kD, polypeptide 2 |
| 2348 | 18899 | NM_031985 | gg | | ESTs, Moderately similar to ribosomal protein S6 kinase, 70 kD, polypeptide 2; S6 kinase 2 [*Mus musculus*] [*M. musculus*], RIKEN cDNA 2610318I15 gene, ribosomal protein S6 kinase, 70 kD, polypeptide 1, ribosomal protein S6 kinase, 70 kD, polypeptide 2 |
| 215 | 16934 | AA851403 | b | | ESTs, Moderately similar to RIKEN cDNA 2900010I05 [*Mus musculus*] [*M. musculus*], NADH dehydrogenase (ubiquinone) 1 beta subcomplex, 8 (19 kD, ASHI), RIKEN cDNA 2900010I05 gene |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2157 | 194 | NM_022861 | cc, dd | | ESTs, Moderately similar to UNC-13 homolog (C. elegans) 1 [Mus musculus] [M. musculus], unc-13-like (C. elegans), unc13 homolog (C. elegans) 1 |
| 1245 | 17783 | AI171206 | ee, ff | | ESTs, Moderately similar to 2118320A neurodegeneration-associated protein 1 [Rattus norvegicus] [R. norvegicus], KIAA0438 gene product, Mus musculus, clone IMAGE:3499845, mRNA, partial cds, hypothetical protein FLJ20552, hypothetical protein LOC51255, praja 1, praja1, RING-H2 motif containing, rotein carrying the RING-H2 sequence motif, similar to RIKEN cDNA 1300002C13, zinc finger protein 364 |
| 1959 | 20702 | NM_017166 | j, k, y, z | | ESTs, Moderately similar to A40936 stathmin [H. sapiens], expressed sequence AI131641, leukemia-associated gene, stathmin 1/oncoprotein 18 |
| 1845 | 1467 | NM_013010 | ii | | ESTs, Moderately similar to AAKG_RAT 5'-AMP-activated protein kinase, gamma-1 subunit (AMPK gamma-1 chain) (AMPKg) [R. norvegicus], Mus musculus, clone MGC:18882 IMAGE:4238045, mRNA, complete cds, RIKEN cDNA 2410051C13 gene, expressed sequence AI854673, expressed sequence BB036179, protein kinase, AMP-activated, gamma 1 non-catalytic subunit |
| 413 | 7148 | AA892842 | f, g | | ESTs, Moderately similar to CAZ3_MOUSE F-ACTIN CAPPING PROTEIN ALPHA-3 SUBUNIT (CAPZ ALPHA-3) (GERM CELL-SPECIFIC PROTEIN 3) [M. musculus], capping protein (actin filament) muscle Z-line, alpha 2, capping protein alpha 2, capping protein alpha 3 |
| 1103 | 4102 | AI102524 | gg | | ESTs, Moderately similar to CBX4_HUMAN CHROMOBOX PROTEIN HOMOLOG 4 (POLYCOMB 2 HOMOLOG) (PC2) (HPC2) [H. sapiens], chromobox homolog 4 (Pc class homolog, Drosophila), hypothetical protein MGC10561 |
| 2229 | 79 | NM_031079 | y, z, ee, ff | | ESTs, Moderately similar to CGMP-DEPENDENT 3',5'-CYCLIC PHOSPHODIESTERASE [R. norvegicus], Mus musculus, Similar to cyclic GMP stimulated phosphodiesterase, clone IMAGE:3598413, mRNA, partial cds, phosphodiesterase 10A, phosphodiesterase 2A, cGMP-stimulated |
| 1593 | 18854 | AI237636 | f, g, l, m | | ESTs, Moderately similar to CNE6_MOUSE COPINE VI (NEURONAL-COPINE) (N-COPINE) [M. musculus], ESTs, Weakly similar to CNE3_HUMAN COPINE III [H. sapiens], RIKEN cDNA 3632411M23 gene, copine 6, copine II, copine III, expressed sequence AU067659, expressed sequence AW047065 |
| 1323 | 13339 | AI176308 | s, t | | ESTs, Moderately similar to CO1B_RAT Coronin 1B (Coronin 2) [R. norvegicus], Mus musculus, Similar to coronin, actin binding protein, 2A, clone IMAGE:4984475, mRNA, partial cds, coronin, actin binding protein 1B, coronin, actin binding protein 1C, hypothetical protein DKFZp762I166 |
| 1179 | 17402 | AI137553 | ee, ff | | ESTs, Moderately similar to DIP_HUMAN DIP PROTEIN [H. sapiens], KIAA0669 gene product, RIKEN cDNA 0610009M14 gene, RIKEN cDNA 1810043J12 gene, TSC-22-like, transforming growth factor beta 1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1854 | 17401 | NM_013043 | a, p, q, z, ee, ff, kk | | induced transcript 4, transforming growth factor beta-stimulated protein TSC-22 ESTs, Moderately similar to DIP_HUMAN DIP PROTEIN [*H. sapiens*], KIAA0669 gene product, RIKEN cDNA 0610009M14 gene, RIKEN cDNA 1810043J12 gene, TSC-22-like, transforming growth factor beta 1 induced transcript 4, transforming growth factor beta-stimulated protein TSC-22 |
| 2652 | 16715 | X53054 | cc, dd, ii | | ESTs, Moderately similar to HB2D_RAT RT1 CLASS II HISTOCOMPATIBILITY ANTIGEN, D-1 BETA CHAIN PRECURSOR [*R. norvegicus*], ESTs, Weakly similar to HB2D_RAT RT1 CLASS II HISTOCOMPATIBILITY ANTIGEN, D-1 BETA CHAIN PRECURSOR [*R. norvegicus*], *Rattus norvegicus* Class II MHC RT1.D(a) beta chain precursor (RT1.D(a)) mRNA, complete cds, *Rattus norvegicus* Class II MHC RT1.D(n) beta chain precursor (RT1.D(n)) mRNA, complete cds, major histocompatibility complex, class II, DR beta 5 |
| 2652 | 16716 | X53054 | c | | ESTs, Moderately similar to HB2D_RAT RT1 CLASS II HISTOCOMPATIBILITY ANTIGEN, D-1 BETA CHAIN PRECURSOR [*R. norvegicus*], ESTs, Weakly similar to HB2D_RAT RT1 CLASS II HISTOCOMPATIBILITY ANTIGEN, D-1 BETA CHAIN PRECURSOR [*R. norvegicus*], *Rattus norvegicus* Class II MHC RT1.D(a) beta chain precursor (RT1.D(a)) mRNA, complete cds, *Rattus norvegicus* Class II MHC RT1.D(n) beta chain precursor (RT1.D(n)) mRNA, complete cds, major histocompatibility complex, class II, DR beta 5 |
| 382 | 18209 | AA892318 | s, t | | ESTs, Moderately similar to JC7220 nuclear protein SR-25 [*H. sapiens*], HSVI binding protein, SRp25 nuclear protein, expressed sequence AA408210, expressed sequence AA408365 |
| 854 | 7120 | AI012393 | v | | ESTs, Moderately similar to JE0343 terf protein - rat [*R. norvegicus*], ESTs, Weakly similar to BUTY MOUSE BUTYROPHILIN PRECURSOR [*M. musculus*], ESTs, Weakly similar to JE0343 terf protein - rat [*R. norvegicus*], butyrophilin, subfamily 1, member A1, expressed sequence AA414909, expressed sequence AW538890, ret finger protein, tripartite motif protein 17, tripartite motif-containing 17 |
| 2485 | 15460 | NM_057191 | d, ee, ff | | ESTs, Moderately similar to KHL1_MOUSE Kelch-like protein 1 [*M. musculus*], ESTs, Weakly similar to ENC1_MOUSE ECTODERM-NEURAL CORTEX-1 PROTEIN (ENC-1) [*M. musculus*], ESTs, Weakly similar to KRP1_RAT Kelch-related protein 1 (Kel-like protein 23) (Sarcosin) [*R. norvegicus*], KIAA1842 protein, *Mus musculus*, clone MGC:28950 IMAGE:4235202, mRNA, complete cds, RIKEN cDNA 1300013C10 gene, expressed sequence AL022703, kelch-like 1 (*Drosophila*), sarcomeric muscle protein, speckle-type POZ protein |
| 2485 | 15461 | NM_057191 | ee, ff | | ESTs, Moderately similar to KHL1_MOUSE Kelch-like protein 1 [*M. musculus*], ESTs, Weakly similar to ENC1_MOUSE ECTODERM-NEURAL |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1415 | 8180 | AI180353 | hh | | CORTEX-1 PROTEIN (ENC-1) [*M. musculus*], ESTs, Weakly similar to KRP1_RAT Kelch-related protein 1 (Kel-like protein 23) (Sarcosin) [*R. norvegicus*], KIAA1842 protein, *Mus musculus*, clone MGC:28950 IMAGE:4235202, mRNA, complete cds, RIKEN cDNA 1300013C10 gene, expressed sequence AL022703, kelch-like 1 (*Drosophila*), sarcomeric muscle protein, speckle-type POZ protein ESTs, Moderately similar to LYOX_HUMAN PROTEIN-LYSINE 6-OXIDASE PRECURSOR [*H. sapiens*], ESTs, Moderately similar to LYOX_RAT Protein-lysine 6-oxidase precursor (Lysyl oxidase) [*R. norvegicus*], Lysyl oxidase, lysyl oxidase, lysyl oxidase-like 2, lysyl oxidase-like 4 |
| 114 | 22386 | AA800844 | g | | ESTs, Moderately similar to LYOX_HUMAN PROTEIN-LYSINE 6-OXIDASE PRECURSOR [*H. sapiens*], ESTs, Weakly similar to LYOX_RAT Protein-lysine 6-oxidase precursor (Lysyl oxidase) [*R. norvegicus*], Lysyl oxidase, lysyl oxidase, lysyl oxidase-like, lysyl oxidase-like 1, lysyl oxidase-like 2 |
| 252 | 22385 | AA859805 | g, s, t | | ESTs, Moderately similar to LYOX_HUMAN PROTEIN-LYSINE 6-OXIDASE PRECURSOR [*H. sapiens*], ESTs, Weakly similar to LYOX_RAT Protein-lysine 6-oxidase precursor (Lysyl oxidase) [*R. norvegicus*], Lysyl oxidase, lysyl oxidase, lysyl oxidase-like, lysyl oxidase-like 1, lysyl oxidase-like 2 |
| 1787 | 8829 | NM_012749 | j, k, hh, kk | | ESTs, Moderately similar to NUCLEOLIN [*M. musculus*], ESTs, Weakly similar to A35804 nucleolin [*H. sapiens*], ESTs, Weakly similar to NUCL_HUMAN NUCLEOLIN [*H. sapiens*], ESTs, Weakly similar to NUCL_RAT Nucleolin (Protein C23) [*R. norvegicus*], RIKEN cDNA 1200009A02 gene, eukaryotic translation initiation factor 3, subunit 4 (delta, 44 kDa), nucleolin, pigpen |
| 1483 | 23304 | AI231310 | ee, ff | | ESTs, Moderately similar to P4H1_RAT Prolyl 4-hydroxylase alpha-1 subunit precursor (4-PH alpha-1) (Procollagen-proline, 2-oxoglutarate-4-dioxygenase alpha-1 subunit) [*R. norvegicus*], *Homo sapiens*, clone IMAGE:3162218, mRNA, partial cds, RIKEN cDNA 4933406E20 gene, procollagen-proline, 2-oxoglutarate 4-dioxygenase (proline 4-hydroxylase), alpha 1 polypeptide, procollagen-proline, 2-oxoglutarate 4-dioxygenase (proline 4-hydroxylase), alpha II polypeptide, procollagen-proline, 2-oxoglutarate 4-dioxygenase (proline 4-hydroxylase), alpha polypeptide I, procollagen-proline, 2-oxoglutarate 4-dioxygenase (proline 4-hydroxylase), alpha polypeptide II |
| 1536 | 15685 | AI233870 | hh | | ESTs, Moderately similar to PAB1 MOUSE POLYADENYLATE-BINDING PROTEIN 1 [*M. musculus*], ESTs, Weakly similar to PAB1 MOUSE POLYADENYLATE-BINDING PROTEIN 1 [*M. musculus*], RIKEN cDNA 4932702K14 gene, poly A binding protein, cytoplasmic 1, poly(A) binding protein, cytoplasmic 4 (inducible form) |
| 1663 | 1884 | D50695 | s, t | | ESTs, Moderately similar to PRS6_HUMAN 26S PROTEASE REGULATORY SUBUNIT 6B |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 862 | 6489 | AI012636 | ll | | [*H. sapiens*], proteasome (prosome, macropain) 26S subunit, ATPase, 4 ESTs, Moderately similar to RBMA_RAT RNA-BINDING PROTEIN 10 (RNA BINDING MOTIF PROTEIN 10) (S1-1 PROTEIN) [*R. norvegicus*], Homo sapiens cDNA FLJ10100 fis, clone HEMBA1002469, moderately similar to DXS8237E PROTEIN, *Mus musculus*, Similar to RNA binding motif protein 10, clone MGC:7826 IMAGE:3500403, mRNA, complete cds, RNA binding motif protein 10, S1-1 protein from liver |
| 1691 | 14968 | K02815 | c | | ESTs, Moderately similar to S04363 class II histocompatibility antigen RT1-B alpha chain precursor - rat [*R. norvegicus*], histocompatibility 2, O region alpha locus, major histocompatibility complex, class II, DO alpha |
| 483 | 3903 | AA899986 | w, x | | ESTs, Moderately similar to S15552 polypyrimidine tract-binding protein 1 - rat [*R. norvegicus*], ESTs, Weakly similar to S15552 polypyrimidine tract-binding protein 1 - rat [*R. norvegicus*], *Mus musculus*, Similar to regulator of differentiation (in *S. pombe*) 1, clone MGC:11742 IMAGE:3969488, mRNA, complete cds, RIKEN cDNA 2810036L13 gene, heterogeneous nuclear ribonucleoprotein L, polypyrimidine tract binding protein 1, polypyrimidine tract binding protein 2 |
| 1120 | 3905 | AI103403 | a | | ESTs, Moderately similar to S15552 polypyrimidine tract-binding protein 1 - rat [*R. norvegicus*], ESTs, Weakly similar to S15552 polypyrimidine tract-binding protein 1 - rat [*R. norvegicus*], *Mus musculus*, Similar to regulator of differentiation (in *S. pombe*) 1, clone MGC:11742 IMAGE:3969488, mRNA, complete cds, RIKEN cDNA 2810036L13 gene, heterogeneous nuclear ribonucleoprotein L, polypyrimidine tract binding protein 1, polypyrimidine tract binding protein 2 |
| 2126 | 3900 | NM_022516 | s, t | | ESTs, Moderately similar to S15552 polypyrimidine tract-binding protein 1 - rat [*R. norvegicus*], ESTs, Weakly similar to S15552 polypyrimidine tract-binding protein 1 - rat [*R. norvegicus*], *Mus musculus*, Similar to regulator of differentiation (in *S. pombe*) 1, clone MGC:11742 IMAGE:3969488, mRNA, complete cds, RIKEN cDNA 2810036L13 gene, heterogeneous nuclear ribonucleoprotein L, polypyrimidine tract binding protein 1, polypyrimidine tract binding protein 2 |
| 2126 | 3904 | NM_022516 | aa, bb, ll | | ESTs, Moderately similar to S15552 polypyrimidine tract-binding protein 1 - rat [*R. norvegicus*], ESTs, Weakly similar to S15552 polypyrimidine tract-binding protein 1 - rat [*R. norvegicus*], *Mus musculus*, Similar to regulator of differentiation (in *S. pombe*) 1, clone MGC:11742 IMAGE:3969488, mRNA, complete cds, RIKEN cDNA 2810036L13 gene, heterogeneous nuclear ribonucleoprotein L, polypyrimidine tract binding protein 1, polypyrimidine tract binding protein 2 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 946 | 7961 | AI044042 | l, m | | ESTs, Moderately similar to S47073 finger protein HZF2, Krueppel-related [*H. sapiens*], zinc finger protein 191, zinc finger protein 354A, zinc finger protein 354B |
| 638 | 22596 | AA955298 | y, z | | ESTs, Moderately similar to T46637 transcription factor 1, neural - rat [*R. norvegicus*], ESTs, Weakly similar to A35804 nucleolin [*H. sapiens*], *Homo sapiens* mRNA; cDNA DKFZp434E0922 (from clone DKFZp434E0922), *Mus musculus* 10, 11 days embryo whole body cDNA, RIKEN full-length enriched library, clone:2810003I18:myelin transcription factor 1-like, full insert sequence, myelin transcription factor 1-like, nucleolin |
| 2520 | 10660 | NM_133423 | e, cc, dd | | ESTs, Moderately similar to T46637 transcription factor 1, neural - rat [*R. norvegicus*], *Homo sapiens* mRNA; cDNA DKFZp434E0922 (from clone DKFZp434E0922), *Mus musculus* 10, 11 days embryo whole body cDNA, RIKEN full-length enriched library, clone:2810003I18:myelin transcription factor 1-like, full insert sequence, myelin transcription factor 1-like |
| 1020 | 10277 | AI059925 | u, v | | ESTs, Moderately similar to T47137 hypothetical protein DKFZp761K2213.1 [*H. sapiens*], myeloid/lymphoid or mixed lineage-leukemia translocation to 4 homolog (*Drosophila*), myeloid/lymphoid or mixed-lineage leukemia (trithorax homolog, *Drosophila*); translocated to, 4 |
| 834 | 7060 | AI011547 | b | | ESTs, Moderately similar to T47183 hypothetical protein DKFZp434K1822.1 [*H. sapiens*], ubiquitin specific protease 22 |
| 2549 | 25479 | NM_138549 | jj, kk | | ESTs, Moderately similar to T50638 synaptic glycoprotein SC2 [*H. sapiens*], ESTs, Weakly similar to T50638 synaptic glycoprotein SC2 [*H. sapiens*], expressed sequence AI173355, glycoprotein, synaptic 2, steroid 5 alpha-reductase 2, steroid 5 alpha-reductase 2-like, steroid 5-alpha-reductase 2, steroid-5-alpha-reductase, alpha polypeptide 2 (3-oxo-5 alpha-steroid delta 4-dehydrogenase alpha 2) |
| 118 | 21416 | AA800962 | hh | | ESTs, Moderately similar to TALIN [*M. musculus*], *Mus musculus*, Similar to hypothetical protein MGC11134, clone MGC:41710 IMAGE:1364225, mRNA, complete cds, talin, talin 2 |
| 1774 | 1514 | NM_012678 | bb | | ESTs, Moderately similar to TROPOMYOSIN 5, CYTOSKELETAL TYPE [*M. musculus*], tropomyosin 4 |
| 502 | 4858 | AA901238 | w, x | | ESTs, Moderately similar to UBC6_HUMAN UBIQUITIN-CONJUGATING ENZYME E2-21 KD UBCH6 [*H. sapiens*], ESTs, Weakly similar to S53358 ubiquitin-conjugating enzyme E2.17kB - rat [*R. norvegicus*], *Homo sapiens* cDNA FLJ25157 fis, clone CBR08008, highly similar to UBIQUITIN-CONJUGATING ENZYME E2-23 KDA (EC 6.3.2.19), *Mus musculus*, Similar to ubiquitin-conjugating enzyme E2E 3 (homologous to yeast UBC4/5), clone MGC:28917 IMAGE:4923869, mRNA, complete cds, RIKEN cDNA 1100001F19 gene, RIKEN cDNA 1600028I17 gene, RIKEN cDNA 6130401J04 gene, hypothetical protein FLJ11011, ubiquitin-conjugating enzyme E2D 3 (UBC4/5 homolog, yeast), ubiquitin-conjugating enzyme E2D 3 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | (homologous to yeast UBC4/5), ubiquitin-conjugating enzyme E2E 1 (UBC4/5 homolog, yeast), ubiquitin-conjugating enzyme E2E 2 (UBC4/5 homolog, yeast) |
| 2115 | 23300 | NM_022398 | jj, kk | | ESTs, Weakly similar to 2-oxoglutarate carrier [Rattus norvegicus] [R. norvegicus], solute carrier family 25 (mitochondrial carrier; adenine nucleotide translocator), member 10, solute carrier family 25 (mitochondrial carrier; oxoglutarate carrier), member 11 |
| 2213 | 25517 | NM_031010 | c, v | | ESTs, Weakly similar to arachidonate 12-lipoxygenase [Rattus norvegicus] [R. norvegicus], arachidonate 12-lipoxygenase, arachidonate 12-lipoxygenase, pseudogene 2, arachidonate 15-lipoxygenase |
| 2213 | 1845 | NM_031010 | c, v | | ESTs, Weakly similar to arachidonate 12-lipoxygenase [Rattus norvegicus] [R. norvegicus], arachidonate 12-lipoxygenase, arachidonate 12-lipoxygenase, pseudogene 2, arachidonate 15-lipoxygenase |
| 2547 | 4422 | NM_138531 | gg | | ESTs, Weakly similar to associated molecule with the SH3 domain of STAM [Homo sapiens] [H. sapiens], RIKEN cDNA 1700095N21 gene, associated molecule with the SH3 domain of STAM |
| 2084 | 19667 | NM_021690 | ii | | ESTs, Weakly similar to Cgef2-pending; cAMP-dependent Rap1 guanine-nucleotide exchange factor; cAMP-GEFII [Mus musculus] [M. musculus], Mus musculus, Similar to cAMP-regulated guanine nucleotide exchange factor I (cAMP-GEFI), clone MGC:19192 IMAGE:4236136, mRNA, complete cds, RIKEN cDNA 4921517L17 gene, Rap1 guanine-nucleotide-exchange factor directly activated by cAMP, cAMP-regulated guanine nucleotide exchange factor II, chromosome 20 open reading frame 152, expressed sequence C86120 |
| 611 | 20619 | AA945737 | d, r, aa, bb | | ESTs, Weakly similar to CXC chemokine receptor [Rattus norvegicus] [R. norvegicus], G protein-coupled receptor, chemokine (C-X-C motif), receptor 4 (fusin), chemokine (C-X-C) receptor 4 |
| 2097 | 20249 | NM_022205 | ll | | ESTs, Weakly similar to CXC chemokine receptor [Rattus norvegicus] [R. norvegicus], G protein-coupled receptor, chemokine (C-X-C motif), receptor 4 (fusin), chemokine (C-X-C) receptor 4 |
| 1223 | 6969 | AI170244 | hh | | ESTs, Weakly similar to g1-related zinc finger protein [Mus musculus] [M. musculus], Homo sapiens, clone IMAGE:3956746, mRNA, partial cds, g1-related zinc finger protein, similar to RIKEN cDNA 1300002C13 |
| 1102 | 5969 | AI102520 | b, l, m, bb, kk | | ESTs, Weakly similar to GABA(A) receptor-associated protein like 2; ganglioside expression factor 2 [Rattus norvegicus] [R. norvegicus], GABA(A) receptor-associated protein, GABA(A) receptor-associated protein like 1, GABA(A) receptor-associated protein like 2, GABA(A) receptor-associated protein-like 2, GABA(A) receptors associated protein like 3, gamma-aminobutyric acid (GABA(A)) receptor-associated protein-like 1, gamma-aminobutyric acid receptor associated protein |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 895 | 15904 | AI013971 | l, m | | ESTs, Weakly similar to L1 cell adhesion molecule [Mus musculus] [M. musculus], ESTs, Weakly similar to A41060 neural cell adhesion molecule L1 precursor [H. sapiens], ESTs, Weakly similar to S36126 neural cell adhesion molecule L1 - rat [R. norvegicus], L1 cell adhesion molecule, L1 cell adhesion molecule (hydrocephalus, stenosis of aqueduct of Sylvius 1, MASA (mental retardation, aphasia, shuffling gait and adducted thumbs) syndrome, spastic paraplegia 1), close homolog of L1, neuronal cell adhesion molecule |
| 2113 | 18221 | NM_022395 | cc, dd | | ESTs, Weakly similar to mitochondrial processing peptidase beta [Rattus norvegicus] [R. norvegicus], RIKEN cDNA 3110004O18 gene, mitochondrial processing peptidase beta, peptidase (mitochondrial processing) beta, ubiquinol-cytochrome c reductase core protein 1, ubiquinol-cytochrome c reductase core protein I |
| 2403 | 21445 | NM_053587 | a, e, y, z, ee, ff | | ESTs, Weakly similar to S100 calcium-binding protein A9 (calgranulin B); intracellular calcium-binding protein (MRP14) [Rattus norvegicus] [R. norvegicus], S100 calcium binding protein A13, S100 calcium binding protein A7 (psoriasin 1), S100 calcium binding protein A9 (calgranulin B) |
| 2106 | 18246 | NM_022300 | hh | | ESTs, Weakly similar to Ser/Arg-related nuclear matrix protein; plenty-of-prolines-101; serine/arginine repetitive matrix protein 1 [Mus musculus] [M. musculus], Mus musculus, Similar to hypothetical protein MGC13125, clone MGC:38070 IMAGE:5252666, mRNA, complete cds, brain abundant, membrane attached signal protein 1, expressed sequence AI480556, glucocorticoid-induced gene 1, serine/arginine repetitive matrix 1 |
| 2349 | 19768 | NM_031986 | f, g, cc, dd | | ESTs, Weakly similar to syntenin [Rattus norvegicus] [R. norvegicus], syndecan binding protein, syndecan binding protein (syntenin), syndecan binding protein (syntenin) 2 |
| 2436 | 20421 | NM_053821 | f, ii | | ESTs, Weakly similar to v-ral simian leukemia viral oncogene homolog B (ras related) [Rattus norvegicus] [R. norvegicus], v-ral simian leukemia viral oncogene homolog B (ras related), v-ral simian leukemia viral oncogene homolog B (ras related; GTP binding protein) |
| 187 | 7749 | AA848804 | kk | | ESTs, Weakly similar to 1607338A transcription factor BTF3a [H. sapiens], Mus musculus, basic transcription factor 3, clone MGC:6799 IMAGE:2648048, mRNA, complete cds, RIKEN cDNA 1700054E11 gene, RIKEN cDNA 5730434I03 gene, basic transcription factor 3 |
| 1562 | 2687 | AI235877 | s, t | | ESTs, Weakly similar to 2019405A upstream regulator element-binding protein [Rattus norvegicus] [R. norvegicus], Mus musculus, clone MGC:12070 IMAGE:3708271, mRNA, complete cds, RIKEN cDNA 1110018G07 gene, RIKEN cDNA 2810411E22 gene, RIKEN cDNA 4432411E13 gene, RIKEN cDNA 4930431E10 gene, expressed sequence AW212605, upstream regulatory element binding protein 1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2210 | 8815 | NM_030991 | aa, bb | | ESTs, Weakly similar to 2122252A Lasp-1 protein [*H. sapiens*], LIM and SH3 protein 1, RIKEN cDNA 1200007O21 gene |
| 2481 | 919 | NM_057125 | l, m | | ESTs, Weakly similar to 2204387A peroxisome assembly factor 2 [*Rattus norvegicus*] [*R. norvegicus*], ESTs, Weakly similar to TRANSITIONAL ENDOPLASMIC RETICULUM ATPASE [*M. musculus*], RIKEN cDNA 4833413G10 gene, expressed sequence AI195026, peroxisomal biogenesis factor 6, peroxisome biogenesis factor 1, valosin containing protein |
| 1549 | 18444 | AI234915 | ii | | ESTs, Weakly similar to A26882 pIL2 hypothetical protein - rat [*R. norvegicus*], ESTs, Weakly similar to AF191020 1 E2IG5 [*H. sapiens*], RIKEN cDNA 2310056P07 gene, RIKEN cDNA 9430073N08 gene, hypothetical protein, estradiol-induced |
| 2439 | 16099 | NM_053837 | f, r, cc, dd | | ESTs, Weakly similar to A2M1_HUMAN Clathrin coat assembly protein AP50 (Clathrin coat associated protein AP50) (Plasma membrane adaptor AP-2 50 kDa protein) (HA2 50 kDa subunit) (Clathrin assembly protein complex 2 medium chain) (AP-2 mu 2 chain) [*R. norvegicus*], adaptor protein complex AP-1, mu 2 subunit, adaptor protein complex AP-2, mu1, adaptor-related protein complex 1, mu 2 subunit, adaptor related protein complex 2, mu 1 subunit, adaptor-related protein complex AP-1, mu subunit 1, adaptor-related protein complex AP-4, mu 1, stonin 2 |
| 106 | 17997 | AA800671 | u | | ESTs, Weakly similar to A54854 Ras GTPase activating protein-related protein [*H. sapiens*] |
| 2445 | 18357 | NM_053864 | n, o | | ESTs, Weakly similar to A55190 transitional endoplasmic reticulum ATPase (EC 3.6.1.—) [validated] - rat [*R. norvegicus*], ESTs, Weakly similar to TRANSITIONAL ENDOPLASMIC RETICULUM ATPASE [*M. musculus*], Homo sapiens spermatogenesis associated factor (SPAF) mRNA, complete cds, RIKEN cDNA 4833413G10 gene, RIKEN cDNA 4933439B08 gene, expressed sequence AI195026, katanin p60 (ATPase-containing) subunit A1, nuclear VCP-like, peroxisome biogenesis factor 1, spermatogenesis associated factor, valosin containing protein, valosin-containing protein |
| 2108 | 695 | NM_022388 | u, v | | ESTs, Weakly similar to A55571 chloride conductance inducer Mat-8 [*H. sapiens*], FXYD domain-containing ion transport regulator 3, FXYD domain-containing ion transport regulator 4 |
| 2112 | 23061 | NM_022394 | s, t | | ESTs, Weakly similar to A55817 cyclin-dependent kinase p130-PITSLRE - mouse [*M. musculus*], RIKEN cDNA 2600011L02 gene, RIKEN cDNA A930036K24 gene, aldehyde dehydrogenase family 5, subfamily A1, cell division cycle 2 homolog (*S. pombe*)-like 2, expressed sequence AI255170, scaffold attachment factor B |
| 1654 | 19053 | D12770 | aa, bb | | ESTs, Weakly similar to ADT1 MOUSE ADP, ATP CARRIER PROTEIN, HEART/SKELETAL MUSCLE ISOFORM T1 [*M. musculus*], *Mus musculus*, Similar to RIKEN cDNA 1700066C05 gene, clone MGC:28125 IMAGE:3980327, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2100 | 6263 | NM_022251 | jj, kk | | mRNA, complete cds, RIKEN cDNA 1700034J06 gene, solute carrier family 25 (mitochondrial carrier, Aralar), member 12, solute carrier family 25 (mitochondrial carrier; adenine nucleotide translocator), member 4 ESTs, Weakly similar to AMPE MOUSE GLUTAMYL AMINOPEPTIDASE [*M. musculus*], aminopeptidase puromycin sensitive, glutamyl aminopeptidase, glutamyl aminopeptidase (aminopeptidase A), puromycin-sensitive aminopeptidase |
| 1575 | 15051 | AI236332 | j, k, p, q, y, z, ee, ff | | ESTs, Weakly similar to ATDA_HUMAN DIAMINE ACETYLTRANSFERASE [*H. sapiens*], RIKEN cDNA 2610016A03 gene, spermidine/spermine N1-acetyltransferase |
| 1322 | 16438 | AI176294 | cc, dd | | ESTs, Weakly similar to B Chain B, Crystal Structure Of The D1d2 Sub-Complex From The Human Snrnp Core Domain [*H. sapiens*] |
| 2519 | 19326 | NM_133419 | u, v, jj, kk | | ESTs, Weakly similar to B41182 collagen alpha 1(II) chain precursor [*M. musculus*], PUMA/JFY1 protein, RIKEN cDNA 4933407C03 gene, RIKEN cDNA 5730512J02 gene, dyskeratosis congenita 1, dyskerin |
| 2422 | 15269 | NM_053739 | d, f, g | | ESTs, Weakly similar to BCN1_MOUSE Beclin 1 (Coiled-coil myosin-like BCL2-interacting protein) [*M. musculus*], RIKEN cDNA 4921513J16 gene, beclin 1 (coiled-coil, myosin-like BCL2 interacting protein), beclin 1 (coiled-coil, myosin-like BCL2-interacting protein) |
| 2379 | 16017 | NM_053401 | o, aa | | ESTs, Weakly similar to C35826 hypothetical 13K protein A [*H. sapiens*], X-linked protein, brain expressed X-linked 2, nerve growth factor receptor (TNFRSF16) associated protein 1, reduced expression 3 |
| 2379 | 16018 | NM_053401 | b, c | | ESTs, Weakly similar to C35826 hypothetical 13K protein A [*H. sapiens*], X linked protein, brain expressed X-linked 2, nerve growth factor receptor (TNFRSF16) associated protein 1, reduced expression 3 |
| 2170 | 23215 | NM_023102 | b, l, m | | ESTs, Weakly similar to casein kinase [*M. musculus*], RIKEN cDNA 2610208K14 gene, RIKEN cDNA 3300002K07 gene, VRK3 for vaccinia related kinase 3, casein kinase 1, alpha 1, casein kinase 1, delta, casein kinase 1, gamma 2 |
| 158 | 4491 | AA818798 | w, x | | ESTs, Weakly similar to CATZ_HUMAN Cathepsin Z precursor (Cathepsin X) (Cathepsin P) [*H. sapiens*], cathepsin Z, expressed sequence AU019819 |
| 210 | 4490 | AA851184 | n, o | | ESTs, Weakly similar to CATZ_HUMAN Cathepsin Z precursor (Cathepsin X) (Cathepsin P) [*H. sapiens*], cathepsin Z, expressed sequence AU019819 |
| 619 | 20832 | AA946040 | hh | | ESTs, Weakly similar to COXG MOUSE CYTOCHROME C OXIDASE POLYPEPTIDE VIB [*M. musculus*], Homo sapiens, hypothetical gene LOC125965, clone MGC:33640 IMAGE:4827471, mRNA, complete cds |
| 2195 | 25070 | NM_024392 | r, ii | | ESTs, Weakly similar to DHB4 MOUSE ESTRADIOL 17 BETA-DEHYDROGENASE 4 [*M. musculus*], ESTs, Weakly similar to DHB4_HUMAN ESTRADIOL 17 BETA-DEHYDROGENASE 4 [*H. sapiens*], RIKEN cDNA 1110029G07 gene, RIKEN |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2413 | 857 | NM_053633 | y, z, ee, ff | | cDNA 1700010M22 gene, RIKEN cDNA 3110069K09 gene, hydroxysteroid (17-beta) dehydrogenase 4 ESTs, Weakly similar to EGR2 MOUSE EARLY GROWTH RESPONSE PROTEIN 2 [*M. musculus*], MYC-associated zinc finger protein (purine-binding transcription factor), early growth response 2, early growth response 2 (Krox-20 homolog, *Drosophila*) |
| 1689 | 17136 | J04035 | f, aa, bb | | ESTs, Weakly similar to ELS MOUSE ELASTIN PRECURSOR [*M. musculus*], RIKEN cDNA 4930554K12 gene, elastin, elastin (supravalvular aortic stenosis, Williams-Beuren syndrome) |
| 670 | 24135 | AA957736 | n, o | | ESTs, Weakly similar to FIBULIN-1, ISOFORM C PRECURSOR [*M. musculus*], Homo sapiens cDNA FLJ23816 fis, clone HSI02685, *Homo sapiens* cDNA FLJ32009 fis, clone NT2RP7009498, weakly similar to FIBULIN-1, ISOFORM A PRECURSOR, *Mus musculus* mRNA for CRTAC1-B protein (CRTAC1 gene), RIKEN cDNA 5730592L21 gene, fibulin 5 |
| 2498 | 23551 | NM_080698 | ii | | ESTs, Weakly similar to FMOD_HUMAN FIBROMODULIN PRECURSOR [*H. sapiens*], fibromodulin, fibronectin leucine rich transmembrane protein 1, fibronectin leucine rich transmembrane protein 2, fibronectin leucine rich transmembrane protein 3, hypothetical protein FLJ23447 |
| 2190 | 15622 | NM_024369 | f, g | | ESTs, Weakly similar to FRP MOUSE FOLLISTATIN-RELATED PROTEIN PRECURSOR [*M. musculus*], follistatin-like, follistatin-like 1 |
| 2190 | 15623 | NM_024369 | r | | ESTs, Weakly similar to FRP MOUSE FOLLISTATIN-RELATED PROTEIN PRECURSOR [*M. musculus*], follistatin-like, follistatin-like 1 |
| 1177 | 7122 | AI137468 | gg | | ESTs, Weakly similar to GPV_RAT Platelet glycoprotein V precursor (GPV) (CD42D) [*R. norvegicus*], Platelete glycoprotein 5, RIKEN cDNA 1300018K11 gene, RIKEN cDNA 2610528G05 gene, RIKEN cDNA 5430427N11 gene, carboxypeptidase N, polypeptide 2, 83 kD, glycoprotein 5 (platelet), glycoprotein V (platelet), hypothetical protein FLJ12568, leucine-rich alpha-2-glycoprotein |
| 2639 | 20818 | X02904 | ii | | ESTs, Weakly similar to GTP_RAT Glutathione S-transferase P (GST 7-7) (Chain 7) (GST class-pi) [*R. norvegicus*], *Mus musculus*, clone MGC:37914 IMAGE:5102505, mRNA, complete cds, glutathione S-transferase pi, glutathione S-transferase, pi 2 |
| 2048 | 18761 | NM_019250 | aa | | ESTs, Weakly similar to GUANINE NUCLEOTIDE DISSOCIATION STIMULATOR RALGDS FORM A [*M. musculus*], ESTs, Weakly similar to T12453 hypothetical protein DKFZp564D2123.1 [*H. sapiens*], RIKEN cDNA 1300003D20 gene, RIKEN cDNA 4930573C08 gene, RalGDS-like gene, ral guanine nucleotide dissociation stimulator, ral guanine nucleotide dissociation stimulator,-like 1 |
| 2573 | 9775 | NM_139334 | c | | ESTs, Weakly similar to guanine nucleotide regulatory protein [*H. sapiens*], Rho guanine nucleotide exchange factor (GEF) 5 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1752 | 1708 | NM_012581 | ii | | ESTs, Weakly similar to HOMEOBOX PROTEIN HOX-A2 [*M. musculus*], even skipped homeotic gene 2 homolog, expressed sequence AI894218, homeo box A11, homeo box A2, homeo box B2 |
| 1752 | 1709 | NM_012581 | l, m | | ESTs, Weakly similar to HOMEOBOX PROTEIN HOX-A2 [*M. musculus*], even skipped homeotic gene 2 homolog, expressed sequence AI894218, homeo box A11, homeo box A2, homeo box B2 |
| 1648 | 7602 | AJ001929 | f, aa | | ESTs, Weakly similar to I56519 taipoxin-associated calcium binding protein-49 precursor - rat [*R. norvegicus*], Homo sapiens cDNA FLJ14474 fis, clone MAMMA1001256, calumenin, reticulocalbin 1, EF-hand calcium binding domain, reticulocalbin 2, reticulocalbin 2, EF-hand calcium binding domain |
| 741 | 11745 | AB006450 | hh, jj, kk | | ESTs, Weakly similar to IM7A_RAT Mitochondrial import inner membrane translocase subunit TIM17 A [*R. norvegicus*], translocase of inner mitochondrial membrane 17 homolog A (yeast), translocase of inner mitochondrial membrane 17 homolog B (yeast), translocator of inner mitochondrial membrane 17 kDa, a |
| 2385 | 15556 | NM_053483 | kk | | ESTs, Weakly similar to IMPORTIN ALPHA-2 SUBUNIT [*M. musculus*], karyopherin (importin) alpha 2, karyopherin (importin) alpha 3, karyopherin (importin) alpha 4, karyopherin alpha 2 (RAG cohort 1, importin alpha 1), karyopherin alpha 3 (importin alpha 4), karyopherin alpha 4 (importin alpha 3), karyopherin alpha 5 (importin alpha 6) |
| 1385 | 16668 | AI178751 | ii | | ESTs, Weakly similar to JC5251 beta-galactoside alpha-2,3-sialyltransferase [*H. sapiens*], sialyltransferase, sialyltransferase 4A (beta-galactosidase alpha-2,3-sialytransferase), sialyltransferase 4B (beta-galactosidase alpha-2,3-sialytransferase), sialyltransferase 5, sialyltransferase 7 ((alpha-N-acetylneuraminyl 2,3-beta-galactosyl-1,3)-N-acetyl galactosaminde alpha-2,6-sialyltransferase) A, sialyltransferase 7 ((alpha-N-acetylneuraminyl 2,3-beta-galactosyl-1,3)-N-acetyl galactosaminde alpha-2,6-sialyltransferase) B, sialyltransferase 7D ((alpha-N-acetylneuraminyl-2,3-beta-galactosyl-1,3)-N-acetyl galactosaminide alpha-2,6-sialyltransferase) |
| 2313 | 16663 | NM_031695 | s | | ESTs, Weakly similar to JC5251 beta-galactoside alpha-2,3-sialyltransferase [*H. sapiens*], sialyltransferase, sialyltransferase 4A (beta-galactosidase alpha-2,3-sialytransferase), sialyltransferase 4B (beta-galactosidase alpha-2,3-sialytransferase), sialyltransferase 5, sialyltransferase 7 ((alpha-N-acetylneuraminyl 2,3-beta-galactosyl-1,3)-N-acetyl galactosaminde alpha-2,6-sialyltransferase) A, sialyltransferase 7 ((alpha-N-acetylneuraminyl 2,3-beta-galactosyl-1,3)-N-acetyl galactosaminde alpha-2,6-sialyltransferase) B, sialyltransferase 7D ((alpha-N-acetylneuraminyl-2,3-beta-galactosyl-1,3)-N-acetyl galactosaminide alpha-2,6-sialyltransferase) |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 171 | 6281 | AA819517 | hh | | ESTs, Weakly similar to JC5707 HYA22 protein [*H. sapiens*], hypothetical protein BC010736 |
| 1247 | 5953 | AI171231 | s, t | | ESTs, Weakly similar to JC7328 amino acid transporter A1 [*H. sapiens*], Homo sapiens clone 24674 mRNA sequence, solute carrier family 38, member 1, solute carrier family 38, member 2 |
| 1817 | 187 | NM_012903 | r | | ESTs, Weakly similar to LANP_RAT Leucine-rich acidic nuclear protein [*R. norvegicus*], acidic (leucine-rich) nuclear phosphoprotein 32 family, member A, acidic nuclear phosphoprotein 32, cerebellar ataxia 3, hypothetical gene MGC16309, small nuclear ribonucleoprotein polypeptide A' |
| 2324 | 16003 | NM_031757 | c | | ESTs, Weakly similar to MM24_MOUSE MATRIX METALLOPROTEINASE-24 PRECURSOR (MMP-24) (MEMBRANE-TYPE MATRIX METALLOPROTEINASE 5) (MT-MMP 5) (MEMBRANE-TYPE-5 MATRIX METALLOPROTEINASE) (MT5-MMP) (MMP-21) [*M. musculus*], matrix metalloproteinase 17, matrix metalloproteinase 19, matrix metalloproteinase 24, matrix metalloproteinase 24 (membrane-inserted) |
| 747 | 1097 | AF016296 | e, j, k, cc, dd, kk | | ESTs, Weakly similar to NRP1_HUMAN NEUROPILIN-1 PRECURSOR [*H. sapiens*], neuropilin, neuropilin 1, platelet derived growth factor C |
| 2416 | 1316 | NM_053656 | s, t, ii | | ESTs, Weakly similar to P2X6 MOUSE P2X PURINOCEPTOR 6 [*M. musculus*], purinergic receptor P2X, ligand-gated ion channel, 2, purinergic receptor P2X, ligand-gated ion channel, 5 |
| 2450 | 753 | NM_053897 | ee, ff, gg | | ESTs, Weakly similar to PAR3 MOUSE PROTEINASE ACTIVATED RECEPTOR 3 PRECURSOR [*M. musculus*], coagulation factor II (thrombin) receptor-like 1, coagulation factor II (thrombin) receptor-like 2 |
| 2392 | 15829 | NM_053551 | e, n, o, p, q, r, aa, bb | | ESTs, Weakly similar to PDK4_MOUSE [PYRUVATE DEHYDROGENASE [LIPOAMIDE]] KINASE ISOZYME 4, MITOCHONDRIAL PRECURSOR (PYRUVATE DEHYDROGENASE KINASE ISOFORM 4) [*M. musculus*], pyruvate dehydrogenase kinase 4, pyruvate dehydrogenase kinase, isoenzyme 4 |
| 1665 | 1356 | D83538 | u, v | | ESTs, Weakly similar to PK3G_RAT Phosphatidylinositol 3-kinase C2 domain-containing gamma polypeptide (Phosphoinositide 3-Kinase-C2-gamma) (PtdIns-3-kinase C2 gamma) (PI3K-C2gamma) [*R. norvegicus*], Homo sapiens cDNA FLJ12591 fis, clone NT2RM4001313, moderately similar to PHOSPHATIDYLINOSITOL 3-KINASE VPS34-LIKE (EC 2.7.1.137), phosphatidylinositol 3-kinase, C2 domain containing, gamma polypeptide, phosphatidylinositol 3-kinase, catalytic, alpha polypeptide, phosphatidylinositol 4-kinase, catalytic, beta polypeptide, phosphoinositide-3-kinase, class 2, gamma polypeptide |
| 2593 | 12700 | NM_152936 | h, l | | ESTs, Weakly similar to PSG1 MOUSE PROSTATIC SECRETORY GLYCOPROTEIN PRECURSOR [*M. musculus*], RIKEN cDNA 2310065D10 gene, serine protease inhibitor, Kazal type 1, serine protease inhibitor, Kazal type 3 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2264 | 239 | NM_031152 | e | | ESTs, Weakly similar to R11A_HUMAN Ras-related protein Rab-11A (RAB-11) (24KG) (YL8) [R. norvegicus], RAB11A, member RAS oncogene family, RAB11a, member RAS oncogene family, RAB25, member RAS oncogene family, expressed sequence AW496496 |
| 2241 | 20807 | NM_031106 | f, g | | ESTs, Weakly similar to R6RT37 ribosomal protein L37, cytosolic [validated] - rat [R. norvegicus], RIKEN cDNA 1500002F19 gene, RIKEN cDNA 3110005M08 gene, ribosomal protein L37 |
| 892 | 7299 | AI013911 | t | | ESTs, Weakly similar to RBM3 MOUSE PUTATIVE RNA-BINDING PROTEIN 3 [M. musculus], Mus musculus adult male tongue cDNA, RIKEN full-length enriched library, clone:2310074E15:RNA binding motif protein 3, full insert sequence, RNA binding motif protein 3, RNA binding motif protein, X chromosome, RNA binding motif protein, X chromosome retrogene, cold inducible RNA binding protein, cold inducible RNA-binding protein |
| 1462 | 9412 | AI230691 | f, g | | ESTs, Weakly similar to RL34_HUMAN 60S RIBOSOMAL PROTEIN L34 [H. sapiens], ESTs, Weakly similar to RL34_RAT 60S RIBOSOMAL PROTEIN L34 [R. norvegicus], RIKEN cDNA 1100001I22 gene, ribosomal protein L34 |
| 1282 | 23390 | AI172328 | e | | ESTs, Weakly similar to ROD_RAT Heterogeneous nuclear ribonucleoprotein D0 (hnRNP D0) (AU-rich element RNA-binding protein 1) [R. norvegicus], Mus musculus, clone MGC:36467 IMAGE:5359082, mRNA, complete cds, RIKEN cDNA 4933434H11 gene, heterogeneous nuclear ribonucleoprotein D, heterogeneous nuclear ribonucleoprotein D (AU-rich element RNA binding protein 1, 37 kD), heterogeneous nuclear ribonucleoprotein D-like, high-glycine/tyrosine protein type I E5, musashi homolog 2 (Drosophila) |
| 996 | 10070 | AI058505 | u, v | | ESTs, Weakly similar to RRM1_HUMAN PUTATIVE RIBOSOMAL RNA METHYLTRANSFERASE 1 [H. sapiens], FtsJ homolog 2 (E. coli) |
| 681 | 2211 | AA963834 | l, m | | ESTs, Weakly similar to S105_MOUSE S100 calcium-binding protein A5 (S-100D protein) [R. norvegicus], S100 calcium binding protein A5 |
| 1433 | 1473 | AI228548 | aa | | ESTs, Weakly similar to S10A MOUSE S-100 PROTEIN, ALPHA CHAIN [M. musculus], S100 calcium binding protein A1, S100 calcium binding protein A11 (calizzarin), S100 calcium binding protein P, S100Z protein, expressed sequence AI266795 |
| 2342 | 1475 | NM_031971 | a, p, q, ee, ff | | ESTs, Weakly similar to S10A MOUSE S-100 PROTEIN, ALPHA CHAIN [M. musculus], S100 calcium binding protein A1, S100 calcium binding protein A11 (calizzarin), S100 calcium binding protein P, S100Z protein, expressed sequence AI266795 |
| 391 | 11992 | AA892485 | f | | ESTs, Weakly similar to S21766 dihydrolipoamide 5-acetyltransferase (EC 2.3.1.12) - rat (fragment) [R. norvegicus], Mus musculus, clone IMAGE:3586777, mRNA, partial cds, Pyruvate dehydrogenase complex, lipoyl-containing component X; E3-binding protein, RIKEN cDNA 1600017E01 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | gene, RIKEN cDNA 4930529O08 gene, dihydrolipoamide branched chain transacylase (E2 component of branched chain keto acid dehydrogenase complex; maple syrup urine disease), dihydrolipoamide branched chain transacylase E2, pyruvate dehydrogenase complex, component X |
| 1653 | 5049 | D10655 | g, w, cc, dd, jj, kk | | ESTs, Weakly similar to S21766 dihydrolipoamide S-acetyltransferase (EC 2.3.1.12) - rat (fragment) [*R. norvegicus*], *Mus musculus*, clone IMAGE:3586777, mRNA, partial cds, Pyruvate dehydrogenase complex, lipoyl-containing component X; E3-binding protein, RIKEN cDNA 1600017E01 gene, RIKEN cDNA 4930529O08 gene, dihydrolipoamide branched chain transacylase (E2 component of branched chain keto acid dehydrogenase complex; maple syrup urine disease), dihydrolipoamide branched chain transacylase E2, pyruvate dehydrogenase complex, component X |
| 1653 | 5050 | D10655 | f, g, cc, dd | | ESTs, Weakly similar to S21766 dihydrolipoamide S-acetyltransferase (EC 2.3.1.12) - rat (fragment) [*R. norvegicus*], *Mus musculus*, clone IMAGE:3586777, mRNA, partial cds, Pyruvate dehydrogenase complex, lipoyl-containing component X; E3-binding protein, RIKEN cDNA 1600017E01 gene, RIKEN cDNA 4930529O08 gene, dihydrolipoamide branched chain transacylase (E2 component of branched chain keto acid dehydrogenase complex; maple syrup urine disease), dihydrolipoamide branched chain transacylase E2, pyruvate dehydrogenase complex, component X |
| 2225 | 15957 | NM_031050 | c, ii | | ESTs, Weakly similar to S52284 lumicon, secretory intersticial proteoglycan precursor - rat [*R. norvegicus*], dermatan sulfate proteoglycan 3, dermatan sulphate proteoglycan 3, lumican |
| 756 | 2947 | AF099093 | u, v | | ESTs, Weakly similar to S53358 ubiquitin-conjugating enzyme E2.17kB - rat [*R. norvegicus*], RIKEN cDNA 1100001F19 gene, RIKEN cDNA 1600028I17 gene, prefoldin 5, ubiquitin-conjugating enzyme E2D 3 (UBC4/5 homolog, yeast), ubiquitin-conjugating enzyme E2D 3 (homologous to yeast UBC4/5), ubiquitin-conjugating enzyme E2G 1 (UBC7 homolog, *C. elegans*) |
| 1953 | 13392 | NM_017148 | e | | ESTs, Weakly similar to S53580 cysteine-rich protein - rat [*R. norvegicus*], RIKEN cDNA 0610025L06 gene, cysteine and glycine-rich protein 1, cysteine rich protein |
| 545 | 3997 | AA925771 | ii | | ESTs, Weakly similar to T12483 hypothetical protein DKFZp564B0769.1 [*H. sapiens*], *Homo sapiens*, clone MGC:16721 IMAGE:4128659, mRNA, complete cds, KIAA1604 protein, SR rich protein |
| 59 | 18226 | AA799641 | l | | ESTs, Weakly similar to T46332 hypothetical protein DKFZp434H0413.1 [*H. sapiens*], *Homo sapiens*, clone MGC:9709 IMAGE:3850147, mRNA, complete cds, KIAA1253 protein, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | expressed sequence AW121759, expressed sequence C86123 |
| 722 | 2757 | AA997851 | bb, ll | | ESTs, Weakly similar to TGR3_HUMAN TGF-BETA RECEPTOR TYPE III PRECURSOR [*H. sapiens*], Homo sapiens cDNA FLJ33157 fis, clone UTERU2000393, endoglin |
| 902 | 3625 | AI028954 | ii | | ESTs, Weakly similar to TIE1 MOUSE TYROSINE-PROTEIN KINASE RECEPTOR TIE-1 PRECURSOR [*M. musculus*], Homo sapiens cDNA: FLJ23028 fis, clone LNG01852, highly similar to HSU08023 Human cellular proto-oncogene (c-mer) mRNA, RYK receptor-like tyrosine kinase, c-mer proto-oncogene tyrosine kinase, receptor-like tyrosine kinase, tyrosine kinase receptor 1, tyrosine kinase with immunoglobulin and epidermal growth factor homology domains |
| 1262 | 11696 | AI171774 | jj, kk | | ESTs, Weakly similar to TMOD MOUSE TROPOMODULIN [*M. musculus*], leiomodin 2 (cardiac), tropomodulin |
| 1496 | 7036 | AI231801 | n, o, cc, dd | | ESTs, Weakly similar to TRANSITIONAL ENDOPLASMIC RETICULUM ATPASE [*M. musculus*], Homo sapiens spermatogenesis associated factor (SPAF) mRNA, complete cds, RIKEN cDNA 4833413G10 gene, RIKEN cDNA 4933439B08 gene, expressed sequence AI195026, katanin p60 (ATPase-containing) subunit A1, nuclear VCP-like, peroxisome biogenesis factor 1, spermatogenesis associated factor, valosin containing protein, valosin-containing protein |
| 2470 | 17431 | NM_054006 | cc, dd | | ESTs, Weakly similar to UNR PROTEIN [*R. norvegicus*], Mus musculus, clone MGC:19174 IMAGE:4224466, mRNA, complete cds, NRAS-related gene |
| 2394 | 11843 | NM_053555 | n, o, s | | ESTs, Weakly similar to VAM5_HUMAN VESICLE-ASSOCIATED MEMBRANE PROTEIN 5 (VAMP-5) (MYOBREVIN) (HSPC191) [*H. sapiens*], vesicle-associated membrane protein 5, vesicle-associated membrane protein 5 (myobrevin) |
| 2061 | 52 | NM_019335 | d | | ESTs, Weakly similar to WEE1 MOUSE WEE1-LIKE PROTEIN KINASE [*M. musculus*], NIMA (never in mitosis gene a)-related expressed kinase 4, eukaryotic translation initiation factor 2 alpha kinase 2, protein kinase, interferon-inducible double stranded RNA dependent |
| 1844 | 24718 | NM_013003 | ii | | expressed sequence AI255394, phosphatidylethanolamine N-methyltransferase |
| 928 | 19257 | AI030775 | m | | expressed sequence AI323765, histocompatibility 2, class II antigen E alpha, major histocompatibility complex, class II, DR alpha |
| 1709 | 19255 | M15562 | c | | expressed sequence AI323765, histocompatibility 2, class II antigen E alpha, major histocompatibility complex, class II, DR alpha |
| 1709 | 19256 | M15562 | c | | expressed sequence AI323765, histocompatibility 2, class II antigen E alpha, major histocompatibility complex, class II, DR alpha |
| 1028 | 4967 | AI070179 | w, x | | expressed sequence AI324845, glia maturation factor, gamma |
| 2451 | 15706 | NM_053921 | ll | | expressed sequence AI451906, peroxisomal biogenesis factor 12 |
| 1717 | 9223 | M36151 | c | | expressed sequence AI845868, histocompatibility 2, class II antigen A, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | beta 1, major histocompatibility complex, class II, DO beta, major histocompatibility complex, class II, DQ beta 1 |
| 298 | 16419 | AA875102 | d | | expressed sequence AL022645, expressed sequence C76690, small nuclear ribonucleoprotein E, small nuclear ribonucleoprotein polypeptide E |
| 179 | 320 | AA819905 | hh | | expressed sequence AU022220, stearoyl-CoA desaturase (delta-9-desaturase), stearoyl-Coenzyme A desaturase 1, stearoyl-coenzyme A desaturase 3 |
| 128 | 11166 | AA801346 | n, o | | expressed sequence AU042020, plexin B1, plexin B2, plexin B3 |
| 2507 | 1809 | NM_130741 | l, k | | expressed sequence AW212229, lipocalin 2 (oncogene 24p3) |
| 2254 | 1816 | NM_031134 | l, m | | expressed sequence AW259572, thyroid hormone receptor, alpha (erythroblastic leukemia viral (v-erb-a) oncogene homolog, avian) |
| 360 | 16023 | AA891872 | w, x | | expressed sequence BB168308, nicotinamide nucleotide transhydrogenase |
| 1306 | 19004 | AI175875 | aa, bb | | fatty acid binding protein 5 (psoriasis-associated), fatty acid binding protein 5, epidermal |
| 1306 | 19005 | AI175875 | ii | | fatty acid binding protein 5 (psoriasis-associated), fatty acid binding protein 5, epidermal |
| 1327 | 19006 | AI176393 | aa, bb, ll | | fatty acid binding protein 5 (psoriasis-associated), fatty acid binding protein 5, epidermal |
| 2587 | 20740 | NM_145878 | d, j, k, t, bb, gg, kk, ll | | fatty acid binding protein 5 (psoriasis-associated), fatty acid binding protein 5, epidermal |
| 2004 | 24248 | NM_017332 | e, gg | | fatty acid synthase, hypothetical protein FLJ20604 |
| 2676 | 16725 | X73371 | e, jj, kk | | Fc fragment of IgG, low affinity IIb, receptor for (CD32), Fc receptor, IgG, low affinity IIb, *Mus musculus* FCRL mRNA, complete cds, expressed sequence AI528646, immunoglobulin superfamily receptor translocation associated 2 |
| 718 | 3250 | AA997765 | h, l, ll | | fibrillin 1, fibrillin 1 (Marfan syndrome), fibulin 2 |
| 585 | 21998 | AA944398 | gg | | fibulin 2 |
| 71 | 11530 | AA799773 | a, o, q, y, ee, ff, hh, jj, kk | | filamin A, alpha (actin binding protein 280) |
| 71 | 11531 | AA799773 | a, o, q, z, ff, hh, kk | | filamin A, alpha (actin binding protein 280) |
| 1651 | 20519 | C06598 | aa, bb | | FK506 binding protein 1A (12 kD), FK506 binding protein 1a (12 kDa), FK506 binding protein 2 (13 kDa), FK506 binding protein 2 (13 kD), FK506 binding protein 4 (59 kDa), FK506 binding protein 5 (51 kDa) |
| 844 | 13093 | AI012177 | h, l | | FK506 binding protein 4 (59 kD), RIKEN cDNA 4930571K23 gene |
| 1170 | 13090 | AI136977 | cc, dd | | FK506 binding protein 4 (59 kD), RIKEN cDNA 4930571K23 gene |
| 1487 | 13092 | AI231547 | jj, kk | | FK506 binding protein 4 (59 kD), RIKEN cDNA 4930571K23 gene |
| 1495 | 23165 | AI231799 | y, z | | Friedreich ataxia region gene X123 |
| 1789 | 13731 | NM_012755 | r | | FYN oncogene related to SRC, FGR, YES, Fyn proto-oncogene |
| 829 | 13296 | AI011020 | ll | | FYVE zinc finger phosphatase, *Mus musculus*, clone IMAGE:3668035, mRNA, partial cds, *Mus musculus*, clone MGC:27983 IMAGE:3596732, mRNA, complete cds, X-linked myotubular myopathy gene 1, myotubular myopathy 1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1241 | 12695 | AI170948 | q | | G protein-coupled receptor |
| 1900 | 18313 | NM_013220 | a, kk | | GA binding protein transcription factor, beta subunit 1 (53 kD), GA binding protein transcription factor, beta subunit 2 (47 kD), *Homo sapiens* cDNA FLJ32449 fis, clone SKMUS2001662, moderately similar to Oryctolagus cuniculus CARP mRNA, RIKEN cDNA 1700012M14 gene, RIKEN cDNA 4933432B13 gene, ankyrin repeat domain 2 (stretch responsive muscle), ankyrin repeat domain 5, cardiac ankyrin repeat protein, cardiac responsive adriamycin protein |
| 2081 | 25445 | NM_021654 | r | | gap junction membrane channel protein alpha 4, gap junction protein, alpha 4, 37 kD (connexin 37) |
| 912 | 7451 | AI029450 | y, z | | glutamyl-prolyl-tRNA synthetase |
| 2669 | 16780 | X62660 | c, f, g | | glutathione S-transferase A4, glutathione S-transferase, alpha 4 |
| 1232 | 11585 | AI170502 | r | | Glycogen synthase 2 (liver), *Mus musculus,* clone MGC:29379 IMAGE:5051685, mRNA, complete cds, glycogen synthase 1 (muscle), glycogen synthase 1, muscle, glycogen synthase 3, brain |
| 2063 | 22675 | NM_019358 | a, n, o, kk | | glycoprotein 38, lung type-I cell membrane-associated glycoprotein |
| 1161 | 2296 | AI112979 | w, x | | GM2 ganglioside activator protein |
| 2539 | 606 | NM_134352 | a, y, z | | GPI-anchored metastasis-associated protein homolog, plasminogen activator, urokinase receptor, urokinase plasminogen activator receptor |
| 121 | 16852 | AA801130 | h, l | | GRB2-related adaptor protein, GRB2-related adaptor protein 2, SH3 domain protein 3, Sh3 domain YSC-like 1, growth factor receptor bound protein 2, growth factor receptor-bound protein 2, monocytic adaptor |
| 2204 | 18023 | NM_030846 | b | | GRB2-related adaptor protein, GRB2-related adaptor protein 2, SH3 domain protein 3, Sh3 domain YSC-like 1, growth factor receptor bound protein 2, growth factor receptor-bound protein 2, monocytic adaptor |
| 2325 | 14184 | NM_031776 | kk | | guanine deaminase |
| 2325 | 14185 | NM_031776 | kk | | guanine deaminase |
| 307 | 15887 | AA875225 | e | | guanine nucleotide binding protein (G protein), alpha inhibiting activity polypeptide 2, guanine nucleotide binding protein, alpha inhibiting 2, guanine nucleotide binding protein, alpha inhibiting 3 |
| 307 | 15888 | AA875225 | e, gg | | guanine nucleotide binding protein (G protein), alpha inhibiting activity polypeptide 2, guanine nucleotide binding protein, alpha inhibiting 2, guanine nucleotide binding protein, alpha inhibiting 3 |
| 2221 | 15886 | NM_031035 | r, bb, ll | | guanine nucleotide binding protein (G protein), alpha inhibiting activity polypeptide 2, guanine nucleotide binding protein, alpha inhibiting 2, guanine nucleotide binding protein, alpha inhibiting 3 |
| 1178 | 18943 | AI137495 | d | | H2A histone family, member C, H2A histone family, member D, H2A histone family, member I, H2A histone family, member L, H2A histone family, member N, H2A histone family, member O, *Homo sapiens,* clone MGC:21597 IMAGE:4511035, mRNA, complete cds, *Mus musculus,* similar to H2A histone family, member O, clone MGC:36202 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | IMAGE:5055276, mRNA, complete cds, expressed sequence R75370 |
| 408 | 20065 | AA892647 | c, d, r | | H4 histone family, member D, H4 histone family, member H, H4 histone family, member I, H4 histone family, member J, H4 histone family, member K, *Mus musculus*, H4 histone family, member A, clone MGC:30488 IMAGE:4205460, mRNA, complete cds, histone 4 protein |
| 2149 | 20506 | NM_022686 | d | | H4 histone family, member D, H4 histone family, member H, H4 histone family, member I, H4 histone family, member J, H4 histone family, member K, *Mus musculus*, H4 histone family, member A, clone MGC:30488 IMAGE:4205460, mRNA, complete cds, histone 4 protein |
| 2149 | 6121 | NM_022686 | d, r | | H4 histone family, member D, H4 histone family, member H, H4 histone family, member I, H4 histone family, member J, H4 histone family, member K, *Mus musculus*, H4 histone family, member A, clone MGC:30488 IMAGE:4205460, mRNA, complete cds, histone 4 protein |
| 1285 | 2208 | AI172472 | cc, dd | | HCCA2 protein |
| 1270 | 9538 | AI172097 | l, m | | heat shock factor 1, heat shock transcription factor 1 |
| 2493 | 8820 | NM_080399 | j, k, ee, ff, jj, kk | | HIF-1 responsive RTP801, *Homo sapiens*, Similar to RIKEN cDNA 1700037B15 gene, clone MGC:9960 IMAGE:3877854, mRNA, complete cds |
| 2637 | 23282 | U90725 | hh | | high density lipoprotein binding protein (vigilin) |
| 2381 | 6712 | NM_053448 | cc, dd | | histone deacetylase 1, histone deacetylase 2, histone deacetylase 3 |
| 1471 | 8036 | AI230884 | r | | HMBA-inducible |
| 2531 | 24609 | NM_133585 | cc, dd | | *Homo sapiens* cDNA FLJ12045 fis, clone HEMBB1001957, RIKEN cDNA 1200011N24 gene, optic atrophy 1 (autosomal dominant) |
| 1321 | 12999 | AI176276 | h, l, p, q, y, z, gg | | *Homo sapiens* cDNA FLJ12570 fis, clone NT2RM4000895 |
| 835 | 3941 | AI011598 | t, kk | | *Homo sapiens* cDNA FLJ14042 fis, clone HEMBA1006038, weakly similar to LAMININ ALPHA-5 CHAIN, expressed sequence AA408762, expressed sequence AI853660, laminin, alpha 5 |
| 2556 | 17530 | NM_138877 | n, o, ii | | *Homo sapiens* cDNA FLJ14413 fis, clone HEMBA1004670, RIKEN cDNA 1500005G05 gene, cytochrome b5 reductase 1 (B5R.1), cytochrome b5 reductase b5R.2, diaphorase (NADH) (cytochrome b-5 reductase), diaphorase 1 (NADH) |
| 2556 | 17532 | NM_138877 | j, k | | *Homo sapiens* cDNA FLJ14413 fis, clone HEMBA1004670, RIKEN cDNA 1500005G05 gene, cytochrome b5 reductase 1 (B5R.1), cytochrome b5 reductase b5R.2, diaphorase (NADH) (cytochrome b-5 reductase), diaphorase 1 (NADH) |
| 2556 | 25039 | NM_138877 | ee, ff | | *Homo sapiens* cDNA FLJ14413 fis, clone HEMBA1004670, RIKEN cDNA 1500005G05 gene, cytochrome b5 reductase 1 (B5R.1), cytochrome b5 reductase b5R.2, diaphorase (NADH) (cytochrome b-5 reductase), diaphorase 1 (NADH) |
| 727 | 3353 | AA998053 | ii | | *Homo sapiens* cDNA FLJ14455 fis, clone HEMBB1001908, highly similar to Human monocytic leukaemia zinc finger protein (MOZ) mRNA, zinc finger protein 220 |
| 2404 | 20896 | NM_053592 | h, l | | *Homo sapiens* cDNA FLJ25344 fis, clone TST01087, RIKEN cDNA 5031412I06 gene |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 221 | 19159 | AA851953 | u, v | | *Homo sapiens* cDNA FLJ30862 fis, clone FEBRA2003675 |
| 2163 | 15697 | NM_022939 | ll | | *Homo sapiens* cDNA FLJ31164 fis, clone KIDNE1000104, weakly similar to SYNTAXIN 7, expressed sequence AU041521, syntaxin 12, syntaxin 16, syntaxin 7 |
| 309 | 15410 | AA875268 | jj, kk | | *Homo sapiens* cDNA FLJ31499 fis, clone NT2NE2005441, weakly similar to SPLICEOSOME ASSOCIATED PROTEIN 49 |
| 887 | 22592 | AI013740 | n, o, w, x | | *Homo sapiens* cDNA FLJ31762 fis, clone NT2RI2007754, weakly similar to INTESTINAL MEMBRANE A4 PROTEIN, hypothetical protein BC010116, hypothetical protein BC013109 |
| 2673 | 602 | X68101 | ee, ff | | *Homo sapiens* cDNA FLJ32122 fis, clone PEBLM1000144, moderately similar to Trg, KIAA1058 protein, erythroid differentiation regulator, expressed sequence AA959601, expressed sequence R75174 |
| 2571 | 22595 | NM_139253 | cc, dd | | *Homo sapiens* cDNA FLJ32237 fis, clone PLACE6004966, Human transposon-like element mRNA |
| 1240 | 21284 | AI170842 | hh | | *Homo sapiens* cDNA FLJ32449 fis, clone SKMUS2001662, moderately similar to Oryctolagus cuniculus CARP mRNA, ankyrin repeat domain 2 (stretch responsive muscle), ankyrin repeat domain 5, cardiac ankyrin repeat protein |
| 1600 | 16340 | AI638955 | hh | | *Homo sapiens* cDNA FLJ32493 fis, clone SKNSH2000051, RNA binding motif protein 9, fox-1 homolog (*C. elegans*) |
| 241 | 23340 | AA859519 | d, h, l | | *Homo sapiens* cDNA FLJ32971 fis, clone TESTI2008847 |
| 1670 | 20456 | H31144 | j, k | | *Homo sapiens* cDNA: FLJ21251 fis, clone COL01259, *Homo sapiens,* Similar to activated p21cdc42Hs kinase, clone MGC:15139 IMAGE:4302390, mRNA, complete cds |
| 898 | 15247 | AI014169 | aa, bb | | *Homo sapiens* cDNA: FLJ22783 fis, clone KAIA1993, *Homo sapiens* mRNA full length insert cDNA clone EUROIMAGE 703547, *Homo sapiens* mRNA; cDNA DKFZp434B102 (from clone DKFZp434B102), KIAA1376 protein |
| 492 | 14712 | AA900860 | ee, ff | | *Homo sapiens* mRNA for FLJ00083 protein, partial cds, RIKEN cDNA 2610312E17 gene, RIKEN cDNA 2810047L02 gene, WD repeat domain 5, WD repeat domain 5B, glutamate rich WD repeat protein GRWD, hypothetical protein FLJ11848, peroxisome biogenesis factor 7, recombination protein REC14 |
| 1594 | 3615 | AI237645 | t | | *Homo sapiens* mRNA; cDNA DKFZp434M2227 (from clone DKFZp434M2227), *Homo sapiens* prostate-specific membrane antigen PSM mRNA, exon 6 alternative splice variant, partial cds, RIKEN cDNA 2610028K12 gene, transferrin receptor, transferrin receptor (p90, CD71), transferrin receptor 2 |
| 1721 | 24844 | M58040 | u, v | | *Homo sapiens* mRNA; cDNA DKFZp434M2227 (from clone DKFZp434M2227), *Homo sapiens* prostate-specific membrane antigen PSM mRNA, exon 6 alternative splice variant, partial cds, RIKEN cDNA 2610028K12 gene, transferrin receptor, transferrin receptor (p90, CD71), transferrin receptor 2 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 513 | 4917 | AA924140 | l, m | | *Homo sapiens* mRNA; cDNA DKFZp566P2324 (from clone DKFZp566P2324), *Homo sapiens*, clone MGC:21553 IMAGE:4155396, mRNA, complete cds, KIAA0193 gene product, hypothetical protein BC002980, hypothetical protein FLJ23142 |
| 543 | 4285 | AA925708 | r, y, z, jj, kk | | *Homo sapiens* PNAS-29 mRNA, complete cds, WD repeat domain 1 |
| 2569 | 18108 | NM_139105 | a, n, o, ll | | *Homo sapiens* PP1579 mRNA, complete cds, *Mus musculus*, clone MGC:6299 IMAGE:2654341, mRNA, complete cds, expressed sequence AW546468, expressed sequence C80305, ribonuclease/angiogenin inhibitor |
| 2169 | 9286 | NM_023027 | l, m | | *Homo sapiens*, clone IMAGE:4096427, mRNA, partial cds, heterogeneous nuclear ribonucleoprotein D-like |
| 1239 | 6982 | AI170793 | kk | | *Homo sapiens*, clone IMAGE:4245141, mRNA, RIKEN cDNA 1110051A18 gene, deleted in colorectal carcinoma, myopalladin, palladin |
| 1556 | 14722 | AI235284 | gg | | *Homo sapiens*, clone IMAGE:5001663, mRNA, partial cds, antigen identified by monoclonal antibodies 12E7, F21 and O13 |
| 676 | 3953 | AA963260 | s, t | | *Homo sapiens*, clone MGC:11072 IMAGE:3688606, mRNA, complete cds, erythrocyte membrane protein band 4.1 (elliptocytosis 1, RH-linked), erythrocyte protein band 4.1-like 2 |
| 262 | 23347 | AA860015 | aa, bb | | *Homo sapiens*, clone MGC:12617 IMAGE:2964706, mRNA, complete cds, cyclin M3, cyclin M4 |
| 1488 | 19271 | AI231566 | s, t | | *Homo sapiens*, clone MGC:18164 IMAGE:4155088, mRNA, complete cds |
| 2572 | 1803 | NM_139256 | c | | *Homo sapiens*, clone MGC:19524 IMAGE:4329693, mRNA, complete cds, RIKEN cDNA 1110025H24 gene, mannosidase, alpha, class 2C, member 1 |
| 1056 | 8665 | AI071965 | ee, ff | | *Homo sapiens*, clone MGC:25063 IMAGE:4480702, mRNA, complete cds |
| 2695 | 8664 | Z75029 | y, z, ee, ff | | *Homo sapiens*, clone MGC:25063 IMAGE:4480702, mRNA, complete cds |
| 1486 | 8004 | AI231532 | r | | *Homo sapiens*, clone MGC:26599 IMAGE:4828542, mRNA, complete cds, zinc finger protein 183 (RING finger, C3HC4 type) |
| 1592 | 11375 | AI237594 | u, v | | *Homo sapiens*, clone MGC:8769 IMAGE:3860953, mRNA, complete cds |
| 2162 | 2006 | NM_022936 | aa | | *Homo sapiens*, clone MGC:9645 IMAGE:3922910, mRNA, complete cds, RIKEN cDNA 2310063B19 gene, epoxide hydrolase 2, cytoplasmic, hypothetical protein FLJ11743, hypothetical protein FLJ22408 |
| 2162 | 2008 | NM_022936 | w, x, aa, bb | | *Homo sapiens*, clone MGC:9645 IMAGE:3922910, mRNA, complete cds, RIKEN cDNA 2310063B19 gene, epoxide hydrolase 2, cytoplasmic, hypothetical protein FLJ11743, hypothetical protein FLJ22408 |
| 2144 | 20959 | NM_022598 | d, r | | *Homo sapiens*, Similar to RIKEN cDNA 4930513O09 gene, clone MGC:33185 IMAGE:5269882, mRNA, complete cds, *Mus musculus*, Similar to hypothetical protein DKFZp761J139, clone MGC:11924 IMAGE:3599595, mRNA, complete cds, RIKEN cDNA 4930513O09 gene, cellular nucleic acid binding protein, zinc finger protein 9 (a cellular retroviral nucleic acid binding protein) |
| 2144 | 20960 | NM_022598 | c, e, r | | *Homo sapiens*, Similar to RIKEN cDNA 4930513O09 gene, clone MGC:33185 IMAGE:5269882, mRNA, complete cds, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | *Mus musculus,* Similar to hypothetical protein DKFZp761J139, clone MGC:11924 IMAGE:3599595, mRNA, complete cds, RIKEN cDNA 4930513O09 gene, cellular nucleic acid binding protein, zinc finger protein 9 (a cellular retroviral nucleic acid binding protein) |
| 356 | 11966 | AA891800 | hh, jj, kk | | hypothetical protein BC008246, inorganic pyrophosphatase, pyrophosphatase (inorganic) |
| 356 | 18128 | AA891800 | n, o | | hypothetical protein BC008246, inorganic pyrophosphatase, pyrophosphatase (inorganic) |
| 123 | 21427 | AA801181 | cc, dd | | hypothetical protein DKFZp564I0422, hypothetical protein FLJ23151 |
| 2581 | 6731 | NM_145096 | hh | | hypothetical protein DKFZp667O2416, hypothetical protein FLJ20984, leukocyte receptor cluster (LRC) member 4, zinc finger, DHHC domain containing 7, zinc finger, DHHC domain containing 9 |
| 487 | 4732 | AA900343 | cc, dd | | hypothetical protein DKFZp761C169, hypothetical protein SP192 |
| 378 | 22903 | AA892250 | d | | hypothetical protein FLJ10514 |
| 1176 | 11238 | AI137410 | ee, ff | | hypothetical protein FLJ12888 |
| 716 | 21119 | AA997655 | b | | hypothetical protein FLJ14566 |
| 783 | 22801 | AI009197 | e | | hypothetical protein IMAGE3455200 |
| 430 | 3879 | AA893237 | e | | hypothetical protein MBC3205 |
| 427 | 17731 | AA893194 | c, f | | hypothetical protein MGC10974 |
| 56 | 20980 | AA799633 | l, m | | hypothetical protein MGC13016 |
| 555 | 9942 | AA942697 | d | | hypothetical protein MGC3133 |
| 535 | 23452 | AA925289 | gg | | hypothetical protein MGC8974 |
| 2200 | 17917 | NM_024488 | b, v | | hypothetical protein, MGC:8303, likely ortholog of rat CDK5 activatoe-binding protein C53 |
| 129 | 11995 | AA801352 | n, o | | immature colon carcinoma transcript 1 |
| 395 | 11994 | AA892507 | hh | | immature colon carcinoma transcript 1 |
| 178 | 18427 | AA819891 | gg | | inositol 1,4,5-triphosphate receptor, type 1, ryanodine receptor 1 (skeletal), ryanodine receptor 1, skeletal muscle |
| 1720 | 1586 | M57728 | c | | inositol polyphosphate-5-phosphatase, 72 kDa |
| 1790 | 15174 | NM_012756 | m | | insulin-like growth factor 2 receptor |
| 696 | 2492 | AA964866 | u, v | | interferon gamma receptor 2, interferon gamma receptor 2 (interferon gamma transducer 1) |
| 2430 | 9059 | NM_053783 | j, k, kk | | interferon gamma receptor, interferon gamma receptor 1 |
| 1893 | 20754 | NM_013195 | b | | interleukin 2 receptor, beta, interleukin 2 receptor, beta chain, interleukin 21 receptor |
| 1279 | 4278 | AI172304 | e | | interleukin 2 receptor, gamma (severe combined immunodeficiency), interleukin 2 receptor, gamma chain |
| 325 | 5384 | AA891041 | j, k, p, q, y, z, kk | | Jun-B oncogene, jun B proto-oncogene |
| 2090 | 20161 | NM_021836 | j, k, p, q, r | | Jun-B oncogene, jun B proto-oncogene |
| 2224 | 1731 | NM_031047 | jj, kk | | junction plakoglobin |
| 1446 | 24117 | AI229785 | cc, dd | | keratin 19, keratin complex 1, acidic, gene 19 |
| 533 | 17363 | AA925150 | ll | | KIAA0438 gene product, *Mus musculus,* clone IMAGE:3499845, mRNA, partial cds, goliath protein, hypothetical protein FLJ20552, hypothetical protein LOC51255, praja 1, praja1, RING-H2 motif containing, rotein carrying the RING-H2 sequence motif, similar to RIKEN cDNA 1300002C13, zinc finger protein 364 |
| 2543 | 7164 | NM_134406 | jj, kk | | KIAA0602 protein, hypothetical protein FLJ20748 |
| 471 | 22490 | AA899289 | d | | KIAA1049 protein |
| 879 | 22493 | AI013466 | cc, dd | | KIAA1049 protein |
| 886 | 3445 | AI013724 | e | | KIAA1052 protein, hypothetical protein FLJ13942 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 35 | 8289 | AA799494 | e | | KIAA1075 protein, hypothetical protein FLJ14950, tumor endothelial marker 6 |
| 2579 | 15761 | NM_145091 | cc, dd, jj, kk | | KIAA1348 protein, protein phosphatase 1G (formerly 2C), magnesium-dependent, gamma isoform |
| 857 | 5595 | AI012467 | u, v | | KIAA1453 protein, Mus musculus, Similar to ubiquitin specific protease 3, clone MGC:28886 IMAGE:4911201, mRNA, complete cds, RIKEN cDNA 4930511O11 gene, Vhlh-interacting deubiquitinating enzyme 1, ubiquitin specific protease 2, ubiquitin specific protease 20 |
| 1872 | 38 | NM_013114 | aa, bb | | KIAA1894 protein, pregnancy-associated plasma protein A, selectin P (granule membrane protein 140 kD, antigen CD62), selectin, platelet |
| 2421 | 13622 | NM_053713 | aa, bb, ll | | Kruppel-like factor 1 (erythroid), Kruppel-like factor 2 (lung), Kruppel-like factor 4 (gut) |
| 2421 | 22411 | NM_053713 | d, t | | Kruppel-like factor 1 (erythroid), Kruppel-like factor 2 (lung), Kruppel-like factor 4 (gut) |
| 2421 | 25379 | NM_053713 | t, ll | | Kruppel-like factor 1 (erythroid), Kruppel-like factor 2 (lung), Kruppel-like factor 4 (gut) |
| 202 | 19071 | AA850524 | k | | LBP protein 32, hypothetical protein FLJ13782, mammalian grainyhead, upstream binding protein 1 |
| 2095 | 20204 | NM_022196 | ee, ff, kk | | leukemia inhibitory factor, leukemia inhibitory factor (cholinergic differentiation factor) |
| 1507 | 409 | AI232268 | r | | low density lipoprotein receptor-related protein associated protein 1, low density lipoprotein-related protein-associated protein 1 (alpha-2-macroglobulin receptor-associated protein 1) |
| 1589 | 21653 | AI237535 | a, j, k, p, q, y, z | | LPS-induced TNF-alpha factor |
| 2624 | 21654 | U53184 | a, e, j, k, q, y, z, kk | | LPS-induced TNF-alpha factor |
| 880 | 12233 | AI013474 | y, z, ee, ff | | lung alpha/beta hydrolase 2 |
| 1022 | 8495 | AI059971 | a, t | | lymphotoxin B receptor, lymphotoxin beta receptor (TNFR superfamily, member 3) |
| 2206 | 16292 | NM_030860 | cc, dd | | MADS box transcription enhancer factor 2, polypeptide A (myocyte enhancer factor 2A), MADS box transcription enhancer factor 2, polypeptide C (myocyte enhancer factor 2C), MADS box transcription enhancer factor 2, polypeptide D (myocyte enhancer factor 2D), myocyte enhancer factor 2A, myocyte enhancer factor 2B, myocyte enhancer factor 2C, myocyte enhancer factor 2D |
| 2455 | 16654 | NM_053963 | n, o | | matrix metalloproteinase 12, matrix metalloproteinase 12 (macrophage elastase), matrix metalloproteinase 26 |
| 1561 | 14642 | AI235874 | h, l | | Microfibril-associated glycoprotein-2, expressed sequence AI893631, microfibrillar-associated protein 2 |
| 414 | 17923 | AA892843 | b | | mitochondrial ribosomal protein L24 |
| 227 | 12829 | AA858695 | gg | | mitochondrial ribosomal protein S33 |
| 1634 | 19152 | AI639387 | cc, dd | | mitochondrial ribosomal protein S6 |
| 85 | 16712 | AA800015 | e | | Mitogen activated protein kinase 12 (Zipper (leucine) protein kinase), integrin linked kinase, integrin-linked kinase, mitogen activated protein kinase kinase kinase 11, mitogen activated protein kinase kinase kinase 12, mitogen-activated protein kinase kinase kinase 12, mitogen-activated protein kinase kinase kinase 13 |
| 2518 | 16713 | NM_133409 | b | | Mitogen activated protein kinase 12 (Zipper (leucine) protein kinase), integrin linked kinase, integrin-linked kinase, mitogen activated protein kinase kinase |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | kinase 11, mitogen activated protein kinase kinase kinase 12, mitogen-activated protein kinase kinase kinase 12, mitogen-activated protein kinase kinase kinase 13 |
| 2420 | 6684 | NM_053703 | kk | | mitogen activated protein kinase kinase 6, mitogen activated protein kinase kinase 7, mitogen-activated protein kinase kinase 3, mitogen-activated protein kinase kinase 4, mitogen-activated protein kinase kinase 6, mitogen-activated protein kinase kinase 7 |
| 332 | 21928 | AA891302 | b, l, m | | mitogen-activated protein kinase kinase kinase kinase 2 |
| 1182 | 12654 | AI137864 | cc, dd | | MORF-related gene 15 |
| 1316 | 17223 | AI176140 | r | | MORF-related gene 15, RIKEN cDNA 1700060H10 gene, testis expressed gene 189 |
| 355 | 21672 | AA891789 | f, g | | MORF-related gene X |
| 2588 | 5095 | NM_147140 | u, v | | *Mus musculus* 0 day neonate head cDNA, RIKEN full-length enriched library, clone:4833446O15:solute carrier family 35 (UDP-galactose transporter), member 2, full insert sequence, *Mus musculus*, Similar to solute carrier family 35 (UDP-N-acetylglucosamine (UDP-GlcNAc) transporter), member 3, clone MGC:36317 IMAGE:5150304, mRNA, complete cds, solute carrier family 35 (CMP-sialic acid transporter), member 1 |
| 2535 | 1463 | NM_134334 | u, v, gg | | *Mus musculus* 10 day old male pancreas cDNA, RIKEN full-length enriched library, clone:1810054L16:kidney-derived aspartic protease-like protein, full insert sequence, cathepsin D, cathepsin D (lysosomal aspartyl protease) |
| 359 | 7050 | AA891824 | n, o | | *Mus musculus* 13 days embryo head cDNA, RIKEN full-length enriched library, clone:3110005M20:serine/arginine-rich protein specific kinase 2, full insert sequence, *Mus musculus* adult male lung cDNA, RIKEN full-length enriched library, clone:1200011B22:signal sequence receptor, delta, full insert sequence, serine/threonine kinase 23 |
| 2096 | 20225 | NM_022198 | b, l, m | | *Mus musculus* adult male testis cDNA, RIKEN full-length enriched library, clone:4930547K11:chloride channel 4-2, full insert sequence, chloride channel 4, chloride channel 4-2 |
| 1060 | 18198 | AI072063 | n, o | | *Mus musculus* adult male testis cDNA, RIKEN full-length enriched library, clone:4932434L04:adaptor protein complex AP-2, alpha 2 subunit, full insert sequence, adaptor protein complex AP-1, gamma 1 subunit, adaptor protein complex AP-1, gamma 2 subunit, adaptor protein complex AP-2, alpha 1 subunit, adaptor protein complex AP-2, alpha 2 subunit, adaptor-related protein complex 1, gamma 1 subunit, adaptor-related protein complex 2, alpha 2 subunit, alpha-c large chain of the protein complex AP-2 associated with clathrin |
| 284 | 22781 | AA874926 | hh | | *Mus musculus* dual specificity phosphatase T-DSP10 mRNA, complete cds, RIKEN cDNA 5930436K22 gene, protein phosphatase |
| 465 | 22783 | AA894207 | r | | *Mus musculus* dual specificity phosphatase T-DSP10 mRNA, complete cds, RIKEN cDNA 5930436K22 gene, protein phosphatase |
| 1090 | 22786 | AI101659 | gg | | *Mus musculus* dual specificity phosphatase T-DSP10 mRNA, complete cds, RIKEN cDNA 5930436K22 gene, protein phosphatase |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2367 | 20235 | NM_053302 | cc, dd | | *Mus musculus* dual specificity phosphatase T-DSP10 mRNA, complete cds, RIKEN cDNA 5930436K22 gene, protein phosphatase |
| 2406 | 21709 | NM_053596 | j, k, y, ll | | *Mus musculus* endothelin converting enzyme-2 mRNA, complete cds, endothelin converting enzyme 1, expressed sequence AW322500, mel transforming oncogene-like 1 |
| 1369 | 19184 | AI178025 | p, q, kk | | *Mus musculus* testis expressed homeobox mRNA, complete cds, RIKEN cDNA 5430405H02 gene, RIKEN cDNA 5730599O09 gene, TG interacting factor, TGF(beta)-induced transcription factor 2-like, TGFB-induced factor (TALE family homeobox), TGFB-induced factor 2 (TALE family homeobox) |
| 888 | 16584 | AI013765 | w, x | | *Mus musculus*, Arrestin, beta 2, clone MGC:6525 IMAGE:2651372, mRNA, complete cds, RIKEN cDNA 1200006I17 gene, arrestin 3, retinal, arrestin, beta 2, expressed sequence AI326910, retinal S-antigen |
| 1820 | 16581 | NM_012911 | gg | | *Mus musculus*, Arrestin, beta 2, clone MGC:6525 IMAGE:2651372, mRNA, complete cds, RIKEN cDNA 1200006I17 gene, arrestin 3, retinal, arrestin, beta 2, expressed sequence AI326910, retinal S-antigen |
| 1965 | 5676 | NM_017188 | ee, ff | | *Mus musculus*, clone IMAGE:3588380, mRNA, partial cds, unc-119 homolog (*C. elegans*), uncl19 homolog (*C. elegans*) |
| 2191 | 23488 | NM_024375 | n, o | | *Mus musculus*, clone IMAGE:4224368, mRNA, partial cds, growth differentiation factor 10 |
| 658 | 23927 | AA957007 | g | | *Mus musculus*, glutathione S-transferase, mu type 3 (Yb3), clone MGC:30483 IMAGE:4166881, mRNA, complete cds, RIKEN cDNA 0610005A07 gene, glutathione S-transferase M2 (muscle), glutathione S-transferase M5, glutathione S-transferase, mu 5, glutathione S-transferase, mu type 3 (Yb3) |
| 2265 | 20862 | NM_031154 | w, x | | *Mus musculus*, glutathione S-transferase, mu type 3 (Yb3), clone MGC:30483 IMAGE:4166881, mRNA, complete cds, RIKEN cDNA 0610005A07 gene, RIKEN cDNA 1110004G14 gene, glutathione S-transferase M2 (muscle), glutathione S-transferase M4, glutathione S-transferase M5, glutathione S-transferase, mu 5 |
| 2533 | 1728 | NM_133618 | w, x | | *Mus musculus*, Similar to Acetyl-Co A acetyltransferase 1, mitochondrial, clone MGC:39067 IMAGE:5365469, mRNA, complete cds, *Mus musculus*, Similar to hydroxyacyl-Coenzyme A dehydrogenase/3-ketoacyl-Coenzyme A thiolase/enoyl-Coenzyme A hydratase (trifunctional protein), beta subunit, clone MGC:7126 IMAGE:3158015, mRNA, complete cds, acetyl-Coenzyme A acyltransferase (peroxisomal 3-oxoacyl-Coenzyme A thiolase), hydroxyacyl-Coenzyme A dehydrogenase/3-ketoacyl-Coenzyme A thiolase/enoyl-Coenzyme A hydratase (trifunctional protein), beta subunit |
| 2432 | 25594 | NM_053799 | jj, kk, ll | | *Mus musculus*, Similar to aspartyl-tRNA synthetase, clone MGC:6719 IMAGE:3586278, mRNA, complete cds, asparaginyl-tRNA synthetase, aspartyl-tRNA synthetase, lysyl-tRNA synthetase |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 74 | 20998 | AA799803 | b, l, m | | *Mus musculus,* Similar to complement component 1, s subcomponent, clone MGC:19094 IMAGE:4196654, mRNA, complete cds, *Mus musculus,* Similar to complement component 1, s subcomponent, clone MGC:28492 IMAGE:4166254, mRNA, complete cds, complement component 1, s subcomponent, protein C |
| 2504 | 21695 | NM_130411 | c | | *Mus musculus,* Similar to coronin, actin binding protein, 2A, clone IMAGE:4984475, mRNA, partial cds, coronin, actin binding protein, 1A, coronin, actin binding protein, 1A |
| 750 | 19058 | AF054618 | ee, ff | | *Mus musculus,* Similar to cortactin isoform B, clone MGC:18474 IMAGE:3981559, mRNA, complete cds, cortactin, ems1 sequence (mammary tumor and squamous cell carcinoma-associated (p80/85 src substrate), hematopoietic cell specific Lyn substrate 1, hematopoietic cell-specific Lyn substrate 1 |
| 2417 | 3454 | NM_053662 | p, q | | *Mus musculus,* Similar to cyclin K, clone MGC:28173 IMAGE:3986609, mRNA, complete cds, Paneth cell enhanced expression, RIKEN cDNA 1810009O10 gene, cyclin L, cyclin T1, cyclin T2 |
| 2417 | 3455 | NM_053662 | p, q, gg | | *Mus musculus,* Similar to cyclin K, clone MGC:28173 IMAGE:3986609, mRNA, complete cds, Paneth cell enhanced expression, RIKEN cDNA 1810009O10 gene, cyclin L, cyclin T1, cyclin T2 |
| 2377 | 19512 | NM_053365 | ii | | *Mus musculus,* Similar to fatty acid binding protein 4, adipocyte, clone MGC:18548 IMAGE:3670866, mRNA, complete cds, fatty acid binding protein 4, adipocyte |
| 2131 | 4615 | NM_022525 | cc, dd | | *Mus musculus,* Similar to glutathione peroxidase 3 (plasma), clone MGC:19204 IMAGE:4237630, mRNA, complete cds, glutathione peroxidase 3, glutathione peroxidase 3 (plasma) |
| 21 | 22646 | AA799301 | d | | *Mus musculus,* Similar to ligatin, clone IMAGE:4982955, mRNA, partial cds, ligatin |
| 1883 | 1310 | NM_013159 | ll | | *Mus musculus,* Similar to N-arginine dibasic convertase 1, clone MGC:25477 IMAGE:4486176, mRNA, complete cds, insulin degrading enzyme, insulin-degrading enzyme |
| 1891 | 1714 | NM_013187 | a, kk | | *Mus musculus,* Similar to phospholipase C, gamma 2 (phosphatidylinositol-specific), clone IMAGE:3983937, mRNA, partial cds, cell differentiation and embryonic development, expressed sequence AI894140, phospholipase C, gamma 1 (formerly subtype 148) |
| 1175 | 9166 | AI137406 | kk | | *Mus musculus,* Similar to protein C receptor, endothelial, clone MGC:41156 IMAGE:1054063, mRNA, complete cds, protein C receptor, endothelial, protein C receptor, endothelial (EPCR) |
| 2391 | 31 | NM_053537 | b | | *Mus musculus,* Similar to solute carrier family 22 (organic anion transporter), member 7, clone MGC:18877 IMAGE:4236556, mRNA, complete cds, expressed sequence AI648912, solute carrier family 22 (organic anion transporter), member 6, solute carrier family 22 (organic anion transporter), member 7 |
| 753 | 20741 | AF084186 | s, t | | *Mus musculus,* similar to src homology three (SH3) and cysteine rich domain, clone MGC:38869 IMAGE:5361431, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | mRNA, complete cds, RIKEN cDNA 2610027H02 gene, RIKEN cDNA 2610301F02 gene, alpha-spectrin 1, erythroid, nesprin-1, spectrin, alpha, erythrocytic 1 (elliptocytosis 2), spectrin, alpha, non-erythrocytic 1 (alpha-fodrin), src homology three (SH3) and cysteine rich domain |
| 2099 | 762 | NM_022245 | h, l | | *Mus musculus,* Similar to sulfite oxidase, clone MGC:28458 IMAGE:4160277, mRNA, complete cds, RIKEN cDNA 0610009N12 gene, cytochrome b-5 |
| 2251 | 14970 | NM_031127 | a, h, l, n, o | | *Mus musculus,* Similar to sulfite oxidase, clone MGC:28458 IMAGE:4160277, mRNA, complete cds, RIKEN cDNA 1810044O22 gene, RIKEN cDNA 2810034J18 gene, sulfite oxidase |
| 1617 | 18482 | AI639151 | gg | | *Mus musculus,* Similar to thyroid hormone receptor-associated protein, 150 kDa subunit, clone MGC:37192 IMAGE:4954840, mRNA, complete cds, pinin, pinin, desmosome associated protein |
| 674 | 11500 | AA963171 | cc, dd | | Musashi homolog 1 (*Drosophila*), Musashi homolog 2 (*Drosophila*), RIKEN cDNA 4933434H11 gene, expressed sequence AA959857, heterogeneous nuclear ribonucleoprotein A/B, hypothetical protein DC50, musashi homolog 1 (*Drosophila*) |
| 116 | 10320 | AA800855 | b, l, m | | myeloid leukemia factor 2 |
| 2537 | 517 | NM_134350 | s | | myxovirus (influenza virus) resistance 1, interferon-inducible protein p78 (mouse), myxovirus (influenza virus) resistance 2 |
| 2443 | 16361 | NM_053853 | cc, dd | | N-acetyltransferase 1 (arylamine N-acetyltransferase) |
| 1139 | 18509 | AI104528 | hh | | NADH dehydrogenase (ubiquinone) 1 beta subcomplex, 6 (17 kD, B17) |
| 91 | 21065 | AA800179 | s, t | | neighbor of COX4, neighbor of Cox4 |
| 2011 | 17202 | NM_017357 | gg | | Neural visinin-like protein 1, RIKEN cDNA 4921521K07 gene, expressed sequence AI846570, hippocalcin like 4, visinin-like 1 |
| 772 | 3931 | AI008697 | n, o | | neuroligin, neuroligin 1, neuroligin 2, neuroligin 3 |
| 1332 | 22716 | AI176500 | f, g | | Nidogen (entactin), nidogen (enactin), nidogen 1 |
| 1564 | 22717 | AI235948 | g | | Nidogen (entactin), nidogen (enactin), nidogen 1 |
| 80 | 18378 | AA799888 | hh | | nuclear localization signal deleted in velocardiofacial syndrome, nuclear localization signal protein absent in velo-cardio-facial patients |
| 779 | 16652 | AI009019 | b | | nuclear receptor subfamily 2, group F, member 6 |
| 2194 | 21 | NM_024388 | w, x | | nuclear receptor subfamily 4, group A, member 1 |
| 2194 | 22 | NM_024388 | w, x | | nuclear receptor subfamily 4, group A, member 1 |
| 2382 | 4622 | NM_053463 | l, m | | nucleobindin, nucleobindin 1 |
| 2319 | 20210 | NM_031710 | u, v | | odorant receptor S1 gene, olfactory receptor 41, olfactory receptor, family 6, subfamily A, member 1 |
| 2529 | 25369 | NM_133559 | l, m | | Paired basic amino acid cleaving enzyme (furin), paired basic amino acid cleaving enzyme (furin, membrane associated receptor protein), proprotein convertase subtilisin/kexin type 3, proprotein convertase subtilisin/kexin type 4 |
| 2059 | 16330 | NM_019331 | h, l, ll | | paired basic amino acid cleaving enzyme (furin, membrane associated receptor protein), proprotein convertase subtilisin/kexin type 3, proprotein convertase subtilisin/kexin type 4 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2364 | 15867 | NM_053289 | a, h, l, w, x | | pancreatitis-associated protein |
| 1006 | 8539 | AI059175 | e | | pericentriolar material 1 |
| 2478 | 15391 | NM_057114 | d | | peroxiredoxin 1 |
| 2137 | 9240 | NM_022540 | j, k, w, x | | peroxiredoxin 3 |
| 1879 | 46 | NM_013151 | p, q | | plasminogen activator, tissue |
| 1865 | 20878 | NM_013085 | b | | plasminogen activator, urokinase |
| 1931 | 923 | NM_017076 | a, p, q, y, z, ee, ff | | poliovirus receptor, poliovirus receptor-related 1, poliovirus receptor-related 1 (herpesvirus entry mediator C; nectin), poliovirus receptor-related 2 (herpesvirus entry mediator B), poliovirus sensitivity, tumor-associated antigen 1 |
| 2273 | 18654 | NM_031358 | a, d, r, y, z, ee, ff, kk | | potassium inwardly rectifying channel, subfamily J, member 11, potassium inwardly-rectifying channel, subfamily J, member 11 |
| 2273 | 18655 | NM_031358 | d, l, m, jj, kk | | potassium inwardly rectifying channel, subfamily J, member 11, potassium inwardly-rectifying channel, subfamily J, member 11 |
| 1700 | 25816 | L23863 | n, o | | POU domain, class 2, transcription factor 3, POU transcription factor |
| 1873 | 7854 | NM_013115 | h, l | | prostaglandin F receptor, prostaglandin F receptor (FP) |
| 2326 | 4325 | NM_031784 | d | | protein inhibitor of activated STAT 1, protein inhibitor of activated STAT 3, protein inhibitor of activated STAT gamma, protein inhibitor of activated STAT3 |
| 2429 | 1016 | NM_053772 | r, gg | | protein kinase (cAMP-dependent, catalytic) inhibitor alpha, protein kinase inhibitor, alpha |
| 2087 | 20035 | NM_021754 | a, y, z | | PRP31 pre-mRNA processing factor 31 homolog (yeast), RIKEN cDNA 1500019O16 gene, nucleolar protein 5, nucleolar protein 5A (56 kD with KKE/D repeat), nucleolar protein NOP5/NOP58 |
| 2460 | 18798 | NM_053978 | h, l, n, o | | RAB11a, member RAS oncogene family, RAB28, member RAS oncogene family, expressed sequence AW496496 |
| 2016 | 20778 | NM_019124 | ll | | rabaptin 5, rabaptin-5 |
| 2490 | 11632 | NM_057212 | b | | Ras-induced senescence 1 |
| 2008 | 15037 | NM_017347 | e, r | | *Rattus norvegicus* extracellular signal-regulated kinase 7 mRNA, complete cds, mitogen activated protein kinase 3, mitogen-activated protein kinase 7 |
| 1407 | 6455 | AI179984 | aa, bb | | *Rattus norvegicus* kallistatin mRNA, complete cds, serine (or cysteine) proteinase inhibitor, clade F (alpha-2 antiplasmin, pigment epithelium derived factor), member 1, serine protease inhibitor 2 |
| 236 | 15160 | AA859346 | u, v | | ribonuclease P (38 kD) |
| 2154 | 17808 | NM_022699 | cc, dd | | ribosomal protein L30 |
| 2122 | 1867 | NM_022510 | c, kk | | ribosomal protein L4 |
| 1897 | 20864 | NM_013215 | b, l, m | | RIKEN cDNA 0610025K21 gene, aldo-keto reductase family 7, member A2 (aflatoxin aldehyde reductase) |
| 2252 | 6525 | NM_031129 | gg | | RIKEN cDNA 0610040H15 gene, RIKEN cDNA 2210409E12 gene, transcription elongation factor B (SIII), polypeptide 2 (18 kD, elongin B) |
| 591 | 14763 | AA944481 | p, q | | RIKEN cDNA 1110007F23 gene, angiopoietin 2, angiopoietin-like 3, angiopoietin-like 4, ficolin (collagen/fibrinogen domain containing lectin) 2 (hucolin), ficolin (collagen/fibrinogen domain containing) 1, ficolin B |
| 510 | 4907 | AA924091 | r | | RIKEN cDNA 1110031I02 gene, gene rich cluster, B gene, hypothetical protein FLJ22222, leprecan, leprecan 1 |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2397 | 21940 | NM_053568 | f | | RIKEN cDNA 1110033E03 gene, phosphate cytidylyltransferase 2, ethanolamine |
| 420 | 24279 | AA892919 | d | | RIKEN cDNA 1300003A17 gene, RIKEN cDNA 3222402O04 gene, expressed sequence C76800, hypothetical protein DKFZp761B2423, myeloid/lymphoid or mixed-lineage leukemia, nucleolar and coiled-body phosphoprotein 1, nucleolar and coiled-body phosphprotein 1 |
| 2160 | 24283 | NM_022869 | s, t | | RIKEN cDNA 1300003A17 gene, RIKEN cDNA 3222402O04 gene, expressed sequence C76800, hypothetical protein DKFZp761B2423, myeloid/lymphoid or mixed-lineage leukemia, nucleolar and coiled-body phosphoprotein 1, nucleolar and coiled-body phosphprotein 1 |
| 2459 | 15343 | NM_053973 | aa | | RIKEN cDNA 1300010C19 gene, RIKEN cDNA 5730543C08 gene, Ras-related GTP-binding protein, expressed sequence AI255374, small GTPase, homolog (S. cerevisiae) |
| 245 | 11635 | AA859645 | j, k, ll | | RIKEN cDNA 1300011D16 gene, attractin, testis intracellular mediator protein |
| 2128 | 4242 | NM_022521 | b, l, m | | RIKEN cDNA 1300019H02 gene, RIKEN cDNA 2900006B13 gene, ornithine aminotransferase, ornithine aminotransferase (gyrate atrophy) |
| 763 | 11368 | AI007948 | l, m | | RIKEN cDNA 1500006O09 gene, hypothetical protein FLJ23445 |
| 1342 | 10310 | AI176961 | n, o | | RIKEN cDNA 1500031N16 gene, mitochondrial ribosomal protein L12 |
| 2555 | 8468 | NM_138861 | b | | RIKEN cDNA 1600016E11 gene, mitogen regulated protein, proliferin 3, prolactin, prolactin-like protein M, proliferin, proliferin 2 |
| 134 | 1754 | AA817837 | kk | | RIKEN cDNA 1700024D23 gene, RIKEN cDNA 4731413G05 gene, potassium channel TREK-2, potassium channel, subfamily K, member 2, potassium channel, subfamily K, member 2 (TREK-1), potassium channel, subfamily K, member 5, potassium channel, subfamily K, member 5 (TASK-2) |
| 40 | 21120 | AA799526 | p, q, gg | | RIKEN cDNA 1700043E15 gene, small nuclear ribonucleoprotein D3 polypeptide (18 kD) |
| 1255 | 17529 | AI171460 | h, l | | RIKEN cDNA 1810026B04 gene, dicarbonyl/L-xylulose reductase, hydroxysteroid (17-beta) dehydrogenase 8, hypothetical protein BC014057, hypothetical protein FLJ14431, oxidoreductase UCPA |
| 1699 | 24520 | L20869 | e | | RIKEN cDNA 2010002L15 gene, pancreatitis-associated protein, regenerating islet-derived 3 gamma |
| 628 | 884 | AA946362 | ii | | RIKEN cDNA 2010006G21 gene, RIKEN cDNA 2810425K19 gene, sorting nexin 5 |
| 423 | 19124 | AA893022 | ii | | RIKEN cDNA 2310016C16 gene, RIKEN cDNA 3110050F08 gene, glutathione peroxidase 4, glutathione peroxidase 4 (phospholipid hydroperoxidase) |
| 434 | 16168 | AA893280 | a, y, z | | RIKEN cDNA 2310076L09 gene, adipose differentiation related protein, adipose differentiation-related protein |
| 665 | 12529 | AA957362 | d | | RIKEN cDNA 2410002J21 gene, activator of CREM in testis, expressed sequence AV278559, expressed sequence AW123232, four and a half LIM domains 2, paxillin, transforming growth factor beta 1 induced transcript 1, vascular Rab-GAP/TBC-containing |
| 576 | 22317 | AA943766 | j, k | | RIKEN cDNA 2410004D18 gene, RIKEN cDNA 4930485D02 gene, |

TABLE 3-continued

| SEQ ID | GLGC ID | GenBank Accession No. | Model Code | Human Homologous Known Gene Name | Human Homologous Sequence Cluster Title |
|---|---|---|---|---|---|
| | | | | | aspartylglucosaminidase, expressed sequence AW060726 |
| 2109 | 13480 | NM_022390 | l | | RIKEN cDNA 2610008L04 gene, quinoid dihydropteridine reductase |
| 2345 | 17556 | NM_031975 | j, k | | RIKEN cDNA 2610009E16 gene, parathymosin, prothymosin alpha |
| 2517 | 7700 | NM_133386 | ee, ff | | RIKEN cDNA 2610037M15 gene, sphingosine kinase 1, sphingosine kinase 2 |
| 411 | 21972 | AA892791 | ii | | RIKEN cDNA 2610103M17 gene, excision repair cross-complementing rodent repair deficiency, complementation group 1, excision repair cross-complementing rodent repair deficiency, complementation group 1 (includes overlapping antisense sequence) |
| 263 | 4222 | AA860024 | h, l, w, x | | RIKEN cDNA 2610301D06 gene, eukaryotic translation elongation factor 1 gamma |
| 871 | 16984 | AI013161 | aa, bb | | RIKEN cDNA 2610301D06 gene, eukaryotic translation elongation factor 1 gamma |
| 2006 | 16382 | NM_017343 | cc, dd | | RIKEN cDNA 2900073G15 gene, myosin regulatory light chain |
| 2607 | 21583 | S77900 | bb, kk | | RIKEN cDNA 2900073G15 gene, Rat mRNA for myosin regulatory light chain (RLC), myosin, light polypeptide, regulatory, non-sarcomeric (20 kD) |
| 827 | 18438 | AI010930 | e, r | | RIKEN cDNA 3100001N19 gene, ribosomal protein L14 |
| 1154 | 18439 | AI111877 | r | | RIKEN cDNA 3100001N19 gene, ribosomal protein L14 |
| 2166 | 18107 | NM_022949 | f, g | | RIKEN cDNA 3100001N19 gene, ribosomal protein L14 |
| 2447 | 1352 | NM_053880 | aa | | RIKEN cDNA 3200002I06 gene, dynein, cytoplasmic, intermediate chain 2, dynein, cytoplasmic, intermediate polypeptide 2, hypothetical protein MGC20486 |
| 138 | 14101 | AA817867 | ii | | RIKEN cDNA 4930425N13 gene, hexosaminidase A, hexosaminidase A (alpha polypeptide) |
| 1272 | 16293 | AI172183 | c | | RIKEN cDNA 4930441F12 gene, reticulon 1, reticulon 2, reticulon 2 (Z-band associated protein) |
| 1394 | 7213 | AI179356 | w, x | | RIKEN cDNA 4930544G11 gene, expressed sequence AI324259, ras homolog 9 (RhoC), ras homolog A2, ras homolog gene family, member C |
| 2553 | 23166 | NM_138839 | y, z, ee, ff, kk | | RIKEN cDNA 4930579A11 gene, likely ortholog of rat vacuole membrane protein 1 |
| 2389 | 18826 | NM_053523 | bb | | RIKEN cDNA 5031400M07 gene, homocysteine-inducible, endoplasmic reticulum stress-inducible, ubiquitin-like domain member 1, hypothetical protein FLJ22313 |
| 336 | 21951 | AA891535 | cc, dd | | RIKEN cDNA 5730414C17 gene, hippocampus abundant gene transcript 1, hypothetical protein DKFZp564L0864 similar to HIAT1, hypothetical protein FLJ14753 |
| 938 | 7867 | AI043695 | t | | RIKEN cDNA 5730454C12 gene, expressed sequence C79945, glutamine fructose-6-phosphate transaminase 1, glutamine fructose-6-phosphate transaminase 2, glutamane-fructose-6-phosphate transaminase 2, phosphoribosyl pyrophosphate amidotransferase |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 2622 | 20224 | U47014 | b, u, v | | RIKEN cDNA 5730592L21 gene, hypothetical protein FLJ14927, proprotein convertase subtilisin/kexin type 5, thrombospondin, thrombospondin type 1 domain |
| 288 | 17303 | AA874990 | u, v, w, x | | RIKEN cDNA 6330407G11 gene, hypothetical protein FLJ10342 |
| 2497 | 17662 | NM_080697 | cc, dd | | RIKEN cDNA 6720463E02 gene, dynein light chain 2 |
| 282 | 16082 | AA874887 | ii | | RIKEN cDNA C030018L16 gene, SMC (segregation of mitotic chromosomes 1)-like 1 (yeast), SMC (structural maintenace of chromosomes 1)-like 2 (*S. cerevisiae*), SMC (structural maintenance of chromosomes 1)-like 1 (*S. cerevisiae*), SMC1 structural maintenance of chromosomes 1-like 1 (yeast), SMC4 structural maintenance of chromosomes 4-like 1 (yeast) |
| 2454 | 16552 | NM_053961 | h, l, n, o | | RIKEN cDNA C030022K24 gene, chromosome 12 open reading frame 8, endoplasmic reticulum protein 29 |
| 2454 | 16553 | NM_053961 | h, l | | RIKEN cDNA C030022K24 gene, chromosome 12 open reading frame 8, endoplasmic reticulum protein 29 |
| 1692 | 23486 | K02816 | cc, dd | | RNA polymerase II transcriptional coactivator, activated RNA polymerase II transcription cofactor 4 |
| 1518 | 13645 | AI232694 | hh | | SEC24 related gene family, member C (*S. cerevisiae*) |
| 784 | 9150 | AI009198 | h, l | | serine/threonine kinase receptor associated protein, unr-interacting protein |
| 504 | 16976 | AA901341 | j, k | | sialyltransferase, sialyltransferase 7 ((alpha-N-acetylneuraminyl 2,3-beta-galactosyl-1,3)-N-acetyl galactosaminde alpha-2,6-sialyltransferase) B |
| 2165 | 18104 | NM_022948 | hh | | sideroflexin 1, sideroflexin 2, sideroflexin 3 |
| 589 | 21522 | AA944449 | gg | | signal recognition particle 68 kD |
| 1163 | 23428 | AI113320 | ll | | similar to arginyl-tRNA synthetase |
| 1788 | 3600 | NM_012751 | a | | solute carrier family 2 (facilitated glucose transporter), member 4 |
| 1788 | 3601 | NM_012751 | t | | solute carrier family 2 (facilitated glucose transporter), member 4 |
| 398 | 17468 | AA892545 | t | | solute carrier family 22 (organic cation transporter), member 1-like |
| 2399 | 653 | NM_053580 | aa, bb | | solute carrier family 27 (fatty acid transporter), member 1, solute carrier family 27 (fatty acid transporter), member 4 |
| 1921 | 24695 | NM_017049 | c | | solute carrier family 4 (anion exchanger), member 3, solute carrier family 4, anion exchanger, member 3 |
| 286 | 15116 | AA874928 | f | | sorting nexin 4 |
| 1585 | 11404 | AI237002 | hh | | spermidine synthase, spermine synthase |
| 2249 | 882 | NM_031123 | d | | stanniocalcin, stanniocalcin 1 |
| 2396 | 15708 | NM_053565 | p, q, y, z | | STAT induced STAT inhibitor 3, cytokine inducible SH2-containing protein 3 |
| 1437 | 15078 | AI228830 | j, k | | stearoyl-CoA desaturase (delta-9-desaturase), stearoyl-Coenzyme A desaturase 2 |
| 2339 | 15077 | NM_031841 | ii | | stearoyl-CoA desaturase (delta-9-desaturase), stearoyl-Coenzyme A desaturase 2 |
| 604 | 4207 | AA945591 | n, o, w, x | | stromal cell derived factor 2, stromal cell-derived factor 2-like 1 |
| 2150 | 20509 | NM_022689 | b, r, u, v | | synaptosomal-associated protein, 23 kD |
| 744 | 15772 | AB015645 | cc, dd | | thyrotropin releasing hormone receptor, thyrotropin releasing hormone receptor 2, thyrotropin-releasing hormone receptor |

TABLE 3-continued

| SEQ ID | GLGC ID | GenBank Accession No. | Model Code | Human Homologous Known Gene Name | Human Homologous Sequence Cluster Title |
|---|---|---|---|---|---|
| 1553 | 15004 | AI235224 | a, l, n, o, x, z, kk | | tissue inhibitor of metalloproteinase, tissue inhibitor of metalloproteinase 1 (erythroid potentiating activity, collagenase inhibitor) |
| 2435 | 15002 | NM_053819 | a, l, k, n, o, x, z, hh, kk | | tissue inhibitor of metalloproteinase, tissue inhibitor of metalloproteinase 1 (erythroid potentiating activity, collagenase inhibitor) |
| 2435 | 15003 | NM_053819 | a, l, k, n, o, x, z, hh, kk | | tissue inhibitor of metalloproteinase, tissue inhibitor of metalloproteinase 1 (erythroid potentiating activity, collagenase inhibitor) |
| 32 | 18706 | AA799471 | d | | titin-cap (telethonin) |
| 477 | 17243 | AA899894 | r | | TRAM-like protein, translocating chain-associating membrane protein |
| 981 | 6808 | AI045600 | w, x | | TRAM-like protein, translocating chain-associating membrane protein |
| 2134 | 7505 | NM_022534 | ii | | transcobalamin 2, transcobalamin II; macrocytic anemia |
| 2253 | 13929 | NM_031131 | n, o, hh | | transforming growth factor, beta 2 |
| 1887 | 21722 | NM_013174 | jj, kk | | transforming growth factor, beta 3 |
| 1887 | 21723 | NM_013174 | p, q | | transforming growth factor, beta 3 |
| 126 | 12399 | AA801307 | gg, ll | | transforming, acidic coiled-coil containing protein 1 |
| 771 | 12398 | AI008689 | s, t | | transforming, acidic coiled-coil containing protein 1 |
| 439 | 2689 | AA893515 | ll | | translocation protein 1 |
| 691 | 14342 | AA964595 | h, l, s, t | | Treacher Collins Franceschetti syndrome 1, homolog, Treacher Collins-Franceschetti syndrome 1, expressed sequence AA408847 |
| 1868 | 1521 | NM_013091 | a, s, t, ee, ff, jj, kk | | tumor necrosis factor receptor superfamily, member 12, tumor necrosis factor receptor superfamily, member 12 (translocating chain-association membrane protein), tumor necrosis factor receptor superfamily, member 1A, tumor necrosis factor receptor superfamily, member 1a, tumor necrosis factor receptor superfamily, member 22, tumor necrosis factor receptor superfamily, member 23 |
| 1337 | 3619 | AI176588 | j, k | | tumor protein p53-binding protein |
| 1101 | 2125 | AI102519 | n, o, w, x | | TYRO protein tyrosine kinase binding protein |
| 551 | 16468 | AA926137 | hh | | ubiquinol-cytochrome c reductase (6.4 kD) subunit |
| 621 | 22708 | AA946063 | u, v | | ubiquitin-like 3 |
| 2267 | 18596 | NM_031325 | u, v | | UDP-glucose dehydrogenase |
| 2267 | 18597 | NM_031325 | a, j, k, p, q, y, z, ee, ff | | UDP-glucose dehydrogenase |
| 2557 | 4594 | NM_138881 | c | | vipirin, viral hemorrhagic septicemia virus(VHSV) induced gene 1 |
| 2270 | 18539 | NM_031353 | f, g | | voltage-dependent anion channel 1 |
| 2271 | 16777 | NM_031354 | hh | | voltage-dependent anion channel 2 |

TABLE 4

| Model | code | time (hrs) |
|---|---|---|
| Adrenergic Agonist | a | various |
| Alkylating Agents | b | various |
| Adriamycin | c | 120, 168 |
| Adriamycin | d | 6, 24 |
| Amphotericin B | e | 6 |
| BI: Alternate | f | 168, 336 |
| BI: Core Tox Markers | g | 168, 336 |
| Clenbuterol: Alternate | h | 24 |
| Clenbuterol: Core Tox Markers | i | 24 |
| Clenbuterol: Alternate | j | 6 |
| Clenbuterol: Core Tox Markers | k | 6 |
| Cyclophosphamide: Alternate | l | 6, 48, 192 |
| Cyclophosphamide: Core Tox Markers | m | 6, 48, 192 |
| Epinephrine: Alternate | n | 24 |
| Epinephrine: Core Tox Markers | o | 24 |
| Epinephrine: Alternate | p | 3, 6 |
| Epinephrine: Core Tox Markers | q | 3, 6 |
| Epirubicin | r | 6, 192 |
| Hydralazine: Alternate | s | 6 |
| Hydralazine: Core Tox Markers | t | 6 |

TABLE 4-continued

| Model | code | time (hrs) |
|---|---|---|
| Ifosphamide: Alternate | u | 48, 144 |
| Ifosphamide: Core Tox Markers | v | 48, 144 |
| Isoproterenol: Alternate | w | 24 |
| Isoproterenol: Core Tox Markers | x | 24 |
| Isoproterenol: Alternate | y | 3, 6 |
| Isoproterenol: Core Tox Markers | z | 3, 6 |
| Minoxidil: Alternate | aa | 24, 360 |
| Minoxidil: Core Tox Markers | bb | 24, 360 |
| Norepinephrine: Alternate | cc | 24 |
| Norepinephrine: Core Tox Markers | dd | 24 |

TABLE 4-continued

| Model | code | time (hrs) |
|---|---|---|
| Norepinephrine: Alternate | ee | 3, 6 |
| Norepinephrine: Core Tox Markers | ff | 3, 6 |
| Phenylpropanolamine | gg | 3 |
| Phenylpropanolamine | hh | 6, 24 |
| Rosiglitazone | ii | 24 |
| General | jj | various |
| General Core Tox Markers | kk | various |
| Vasculature Agents | ll | various |

TABLE 5A

ADRENERGIC AGONIST

| SEQ ID | GLGC ID | GenBank Accession No. | LDA Score | Mean Tox | SD Tox | Mean Nontox | SD Nontox |
|---|---|---|---|---|---|---|---|
| 2435 | 15002 | NM_053819 | 93.1848 | 830.7404 | 409.6441 | 188.7073 | 133.9170 |
| 2341 | 17736 | NM_031970 | 91.1968 | 1787.7997 | 762.4182 | 584.9220 | 266.0836 |
| 2435 | 15003 | NM_053819 | 90.1662 | 733.7943 | 472.1444 | 74.9787 | 129.4779 |
| 71 | 11531 | AA799773 | 88.3378 | 1302.1848 | 707.5785 | 380.2217 | 216.8872 |
| 2341 | 17735 | NM_031970 | 88.1250 | 2908.0087 | 1147.6615 | 1047.5181 | 435.2275 |
| 2247 | 19040 | NM_031114 | 87.5598 | 428.8572 | 97.4225 | 248.9995 | 69.8694 |
| 2341 | 17734 | NM_031970 | 86.8816 | 2678.5496 | 1099.6429 | 996.2423 | 363.5236 |
| 2483 | 1892 | NM_057144 | 86.7420 | 2311.9282 | 578.1713 | 1178.1967 | 332.2920 |
| 1854 | 17401 | NM_013043 | 86.6157 | 1311.1640 | 474.9087 | 584.6204 | 187.5873 |
| 2335 | 22321 | NM_031832 | 85.6582 | 404.6838 | 160.3726 | 166.4941 | 84.1703 |
| 1607 | 10071 | AI639058 | 85.6582 | 555.2923 | 198.1929 | 256.3717 | 89.8406 |
| 312 | 15510 | AA875428 | 85.5585 | 193.2422 | 44.9524 | 283.7898 | 52.4782 |
| 253 | 14213 | AA859827 | 85.3723 | 58.2154 | 43.1912 | 4.8459 | 16.2336 |
| 2105 | 17161 | NM_022298 | 85.0532 | 587.4333 | 355.2130 | 193.6993 | 89.1473 |
| 71 | 11530 | AA799773 | 85.0000 | 721.6317 | 412.9801 | 194.6598 | 129.9371 |
| 2111 | 22499 | NM_022393 | 84.9867 | 43.9754 | 12.0409 | 20.1660 | 11.3621 |
| 2311 | 20743 | NM_031684 | 84.6011 | 110.1523 | 18.0460 | 156.2806 | 27.2337 |
| 434 | 16168 | AA893280 | 84.3085 | 322.1775 | 121.4265 | 171.7767 | 45.1771 |
| 2532 | 1271 | NM_133593 | 83.7500 | 57.0368 | 11.4631 | 80.9952 | 15.3334 |
| 2073 | 574 | NM_019905 | 83.1383 | 997.6258 | 268.7816 | 592.6405 | 136.0639 |
| 1765 | 15540 | NM_012620 | 83.0984 | 222.6751 | 196.0708 | 49.6568 | 39.2014 |
| 268 | 17217 | AA866299 | 83.0785 | 299.9600 | 61.9276 | 408.5918 | 79.0507 |
| 2086 | 19710 | NM_021744 | 82.8723 | 95.2966 | 31.4037 | 47.0879 | 21.0511 |
| 2273 | 18654 | NM_031358 | 82.8258 | 115.9148 | 55.4920 | 221.2713 | 63.0262 |
| 1818 | 7196 | NM_012904 | 82.8059 | 241.5608 | 48.6689 | 167.6215 | 40.8344 |
| 1931 | 923 | NM_017076 | 82.5665 | 80.3798 | 60.4940 | 15.2547 | 11.6656 |
| 2282 | 18389 | NM_031545 | 82.0745 | 1698.2519 | 653.3550 | 804.3228 | 432.9969 |
| 261 | 14206 | AA859994 | 82.0545 | 32.6432 | 13.0018 | 78.1153 | 56.0684 |
| 1680 | 10185 | H33426 | 81.9082 | 19.2150 | 5.2091 | 31.5730 | 10.4042 |
| 2277 | 20448 | NM_031530 | 81.5359 | 510.4135 | 424.2980 | 65.6248 | 72.1860 |
| 1603 | 23781 | AI639012 | 81.3098 | 74.7232 | 26.9707 | 38.5429 | 15.2727 |
| 2539 | 606 | NM_134352 | 81.2566 | 22.0283 | 48.8072 | −43.9928 | 28.7447 |
| 2346 | 17601 | NM_031976 | 81.1968 | 148.6699 | 25.4993 | 203.0924 | 39.3452 |
| 1866 | 357 | NM_013086 | 81.1636 | 75.3102 | 54.7364 | 23.9249 | 12.6806 |
| 417 | 18888 | AA892860 | 81.1303 | 18.1279 | 6.8135 | 30.9872 | 11.1700 |
| 972 | 20983 | AI044900 | 81.0904 | 336.6510 | 76.3729 | 482.8464 | 107.7815 |
| 2277 | 20449 | NM_031530 | 81.0040 | 704.6277 | 547.1217 | 85.9070 | 122.7912 |
| 2395 | 4327 | NM_053563 | 80.9375 | 138.6356 | 37.5198 | 90.1494 | 26.2950 |
| 2293 | 5496 | NM_031589 | 80.9309 | 50.8946 | 12.7471 | 68.9254 | 13.4656 |
| 2484 | 19481 | NM_057153 | 80.9309 | 75.3548 | 23.3920 | 131.9767 | 42.0273 |
| 1827 | 1977 | NM_012930 | 80.8910 | 384.3716 | 104.5183 | 557.5178 | 106.1212 |
| 1944 | 21663 | NM_017126 | 80.7912 | 1000.0403 | 524.6985 | 361.5352 | 120.1430 |
| 1970 | 13940 | NM_017212 | 80.6316 | 46.2156 | 17.8341 | 85.3171 | 35.6900 |
| 2251 | 14970 | NM_031127 | 80.5386 | 52.0507 | 17.0768 | 81.4804 | 20.0985 |
| 348 | 23058 | AA891733 | 80.3258 | 181.5442 | 53.5652 | 285.5204 | 70.9465 |
| 2005 | 355 | NM_017334 | 80.0266 | 80.9323 | 65.3081 | 7.7442 | 23.5498 |
| 2542 | 1530 | NM_134397 | 80.0066 | 140.4712 | 33.2319 | 194.9259 | 41.2104 |
| 2267 | 18597 | NM_031325 | 79.8670 | 286.4668 | 206.7383 | 88.5584 | 38.8586 |
| 1821 | 24431 | NM_012912 | 79.8670 | 278.2754 | 246.5034 | 69.8804 | 50.4931 |
| 410 | 12118 | AA892775 | 79.8338 | 1249.9245 | 697.4559 | 522.6811 | 245.1043 |
| 2063 | 22675 | NM_019358 | 79.8005 | 75.4184 | 38.8554 | 29.4800 | 18.4798 |
| 1900 | 18313 | NM_013220 | 79.7872 | 4005.3077 | 732.8548 | 2783.7654 | 675.7277 |
| 1868 | 1521 | NM_013091 | 79.7141 | 126.0733 | 53.5310 | 66.7321 | 32.2172 |
| 76 | 11422 | AA799812 | 79.7074 | 75.0346 | 25.4253 | 114.0781 | 31.3287 |
| 2624 | 21654 | U53184 | 79.4415 | 409.2411 | 195.2531 | 198.1299 | 56.8823 |

TABLE 5A-continued

ADRENERGIC AGONIST

| SEQ ID | GLGC ID | GenBank Accession No. | LDA Score | Mean Tox | SD Tox | Mean Nontox | SD Nontox |
|---|---|---|---|---|---|---|---|
| 1759 | 2629 | NM_012603 | 79.2819 | 75.4973 | 57.4256 | 19.6594 | 9.4997 |
| 2044 | 17908 | NM_019242 | 79.2819 | 148.8453 | 100.0555 | 40.8903 | 23.3252 |
| 2187 | 15349 | NM_024356 | 79.1622 | 20.5876 | 11.5202 | 5.2367 | 7.4734 |
| 23 | 18396 | AA799330 | 79.1622 | 99.0622 | 52.0676 | 40.7672 | 29.0087 |
| 1228 | 5297 | AI170379 | 79.1223 | 438.7151 | 230.7097 | 198.4258 | 74.3391 |
| 1746 | 23868 | NM_012551 | 79.0691 | 696.3200 | 544.8244 | 201.9544 | 193.6116 |
| 380 | 18190 | AA892280 | 78.9960 | 93.7200 | 27.0359 | 143.9221 | 34.9959 |
| 92 | 4832 | AA800190 | 78.9761 | 590.5971 | 146.1748 | 886.5180 | 205.8155 |
| 1960 | 20919 | NM_017172 | 78.9561 | 416.6138 | 85.0507 | 297.7708 | 87.8226 |
| 415 | 17590 | AA892851 | 78.9162 | 74.0367 | 21.4162 | 47.6340 | 15.3868 |
| 2528 | 244 | NM_133551 | 78.9096 | 177.7682 | 130.8882 | 59.6868 | 32.3470 |
| 1759 | 2628 | NM_012603 | 78.8564 | 44.9283 | 33.5423 | 9.0629 | 12.4309 |
| 2276 | 12580 | NM_031514 | 78.7566 | 32.9518 | 9.7960 | 19.1548 | 9.1576 |
| 2364 | 15867 | NM_053289 | 78.7035 | 81.2703 | 45.4669 | 38.1658 | 53.4934 |
| 2168 | 3337 | NM_022961 | 78.6104 | 39.5081 | 9.7943 | 56.9440 | 15.7051 |
| 2398 | 19252 | NM_053576 | 78.5572 | 466.7698 | 45.7445 | 567.3424 | 97.1485 |
| 2601 | 3244 | S63519 | 78.4774 | 129.7236 | 33.9837 | 177.7022 | 32.5983 |
| 1402 | 16081 | AI179610 | 78.3777 | 202.8438 | 112.5844 | 84.0263 | 61.5599 |
| 1656 | 15281 | D13623 | 78.2779 | 170.8618 | 35.8977 | 121.2837 | 28.7917 |
| 2629 | 1715 | U72660 | 78.2114 | 150.0634 | 26.4880 | 111.5965 | 27.4725 |
| 1896 | 20856 | NM_013200 | 78.1582 | 823.1658 | 173.6071 | 1104.4375 | 180.6417 |
| 2054 | 10016 | NM_019289 | 78.0984 | 310.8434 | 90.6794 | 198.7584 | 58.3868 |
| 2687 | 12978 | X96437 | 78.0918 | 240.0713 | 187.0521 | 72.7926 | 27.1008 |
| 322 | 2846 | AA875639 | 78.0585 | 41.5447 | 12.8468 | 63.7379 | 19.4552 |
| 2378 | 622 | NM_053369 | 77.9189 | 27.3665 | 7.5757 | 45.8306 | 19.1215 |
| 1746 | 23869 | NM_012551 | 77.7726 | 161.8403 | 143.4543 | 38.7388 | 52.5181 |
| 1896 | 20855 | NM_013200 | 77.7527 | 539.5765 | 102.8442 | 705.3220 | 119.7929 |
| 1833 | 223 | NM_012945 | 77.6662 | 84.7102 | 79.8305 | 11.2148 | 19.4940 |
| 2403 | 21445 | NM_053587 | 77.5798 | 58.4069 | 47.4152 | 9.3169 | 20.3055 |
| 1419 | 1377 | AI227715 | 77.5798 | 37.4036 | 11.7847 | 58.0973 | 19.4413 |
| 1891 | 1714 | NM_013187 | 77.5598 | 128.4936 | 26.6958 | 176.9989 | 41.1240 |
| 76 | 11423 | AA799812 | 77.5266 | 126.9625 | 37.6497 | 205.5892 | 65.9685 |
| 2569 | 18108 | NM_139105 | 77.4934 | 201.3502 | 36.4083 | 156.6728 | 22.5172 |
| 1937 | 2150 | NM_017097 | 77.4601 | 120.5581 | 20.2371 | 153.8331 | 33.2591 |
| 1835 | 2555 | NM_012967 | 77.4202 | 78.3837 | 37.8776 | 45.1706 | 21.4351 |
| 2005 | 356 | NM_017334 | 77.4003 | 153.3145 | 116.5924 | 37.9370 | 35.8682 |
| 108 | 23368 | AA800678 | 77.3803 | 286.7193 | 78.0081 | 410.2601 | 90.1102 |
| 2688 | 19279 | Y00350 | 77.3604 | 145.1303 | 22.8084 | 175.9706 | 22.2452 |
| 1589 | 21653 | AI237535 | 77.3138 | 193.7593 | 75.5197 | 114.0782 | 37.2720 |
| 889 | 21950 | AI013861 | 77.2074 | 635.8636 | 108.3591 | 771.6337 | 137.9339 |
| 2342 | 1475 | NM_031971 | 77.1676 | 987.8538 | 1118.1009 | 79.7411 | 129.4689 |
| 2278 | 3292 | NM_031531 | 77.1343 | 46.3794 | 53.4058 | −2.2895 | 28.6104 |
| 1944 | 21662 | NM_017126 | 77.1210 | 25.1074 | 18.0661 | 3.2638 | 10.9879 |
| 1619 | 15379 | AI639162 | 77.1011 | 69.7288 | 26.6900 | 110.1162 | 36.4938 |
| 1788 | 3600 | NM_012751 | 77.0811 | 351.9825 | 98.1033 | 482.5987 | 117.8029 |
| 849 | 6606 | AI012308 | 91.6955 | 4153.5723 | 1137.7211 | 1800.9361 | 632.4547 |
| 1553 | 15004 | AI235224 | 88.8697 | 1169.7455 | 600.2896 | 309.0121 | 203.5315 |
| 847 | 21796 | AI012221 | 88.5705 | 502.8636 | 147.4609 | 261.0573 | 79.3455 |
| 1326 | 3014 | AI176362 | 88.4508 | 112.1745 | 49.0365 | 253.1593 | 72.1640 |
| 495 | 23038 | AA900881 | 88.0718 | 147.1772 | 93.5964 | 16.7866 | 121.6543 |
| 926 | 7665 | AI030668 | 87.2407 | 420.9228 | 92.5245 | 273.5120 | 63.9044 |
| 525 | 23123 | AA924794 | 87.0080 | 558.1320 | 184.4459 | 312.7660 | 81.1612 |
| 1181 | 7414 | AI137586 | 86.6356 | 428.8101 | 97.8829 | 296.5660 | 52.2979 |
| 826 | 11684 | AI010917 | 86.5160 | 100.3609 | 43.7081 | 193.3221 | 50.5289 |
| 1380 | 22197 | AI178527 | 86.3497 | 246.4543 | 83.2983 | 114.9586 | 42.9903 |
| 678 | 24246 | AA963703 | 86.2832 | 406.3073 | 78.4021 | 269.3370 | 65.8177 |
| 579 | 22378 | AA944212 | 86.1237 | 156.7941 | 51.2980 | 274.8932 | 59.2517 |
| 1284 | 24209 | AI172423 | 85.1263 | 84.9209 | 55.8163 | 0.6268 | 38.9410 |
| 958 | 5461 | AI044338 | 85.0731 | 227.7101 | 79.5985 | 115.4327 | 36.2758 |
| 781 | 21632 | AI009167 | 84.7340 | 486.9037 | 172.5911 | 193.9329 | 83.9131 |
| 1193 | 18206 | AI145282 | 84.4415 | 298.2611 | 43.6493 | 219.0292 | 50.4482 |
| 668 | 3669 | AA957535 | 84.3152 | 54.9250 | 16.7575 | 26.5427 | 16.7630 |
| 832 | 24022 | AI011474 | 84.0691 | 60.1513 | 17.4583 | 103.0718 | 26.3162 |
| 646 | 17540 | AA955914 | 83.8830 | 614.5749 | 238.0756 | 340.9067 | 100.1111 |
| 739 | 12664 | AA999110 | 83.5705 | 53.1247 | 29.4909 | 114.3550 | 32.5444 |
| 1400 | 15042 | AI179422 | 83.5638 | 125.6087 | 59.0746 | 41.6963 | 32.6660 |
| 997 | 10072 | AI058507 | 83.4574 | 256.6850 | 119.5995 | 103.8417 | 62.8821 |
| 795 | 16154 | AI009661 | 83.4043 | 161.8671 | 82.4309 | 73.5311 | 71.2638 |
| 1027 | 2742 | AI070173 | 83.1782 | −100.5665 | 101.5237 | 59.4249 | 79.4204 |
| 1554 | 6632 | AI235277 | 82.8191 | 210.1464 | 58.6494 | 121.7572 | 39.1467 |
| 1248 | 22432 | AI171263 | 82.7992 | 212.3237 | 57.3487 | 121.2644 | 31.8172 |
| 1039 | 18598 | AI070775 | 82.5864 | 101.0807 | 72.7916 | −0.8437 | 35.2601 |
| 694 | 2459 | AA964755 | 82.5665 | 1207.7704 | 889.6888 | 93.8630 | 160.0823 |

TABLE 5A-continued

ADRENERGIC AGONIST

| SEQ ID | GLGC ID | GenBank Accession No. | LDA Score | Mean Tox | SD Tox | Mean Nontox | SD Nontox |
|---|---|---|---|---|---|---|---|
| 120 | 12086 | AA801116 | 82.4934 | 37.5563 | 11.7940 | 58.1680 | 16.2987 |
| 132 | 23725 | AA817816 | 82.4867 | 326.7101 | 61.7201 | 218.5422 | 62.4451 |
| 1021 | 8494 | AI059968 | 82.4535 | 619.4279 | 83.5414 | 459.5236 | 98.6579 |
| 683 | 2301 | AA964206 | 82.4402 | 75.4272 | 15.8549 | 116.2465 | 30.8618 |
| 1546 | 23964 | AI234748 | 82.3072 | 142.6538 | 32.3372 | 84.4648 | 29.8075 |
| 1264 | 4420 | AI171916 | 82.2407 | 310.0578 | 85.6928 | 450.6251 | 91.3693 |
| 1022 | 8495 | AI059971 | 82.2207 | 177.6911 | 31.6153 | 130.5767 | 28.8121 |
| 1540 | 14494 | AI234222 | 82.1875 | 172.9672 | 31.0657 | 227.6112 | 36.8642 |
| 223 | 15283 | AA858548 | 82.0213 | 405.2720 | 78.5347 | 303.0143 | 67.4546 |
| 908 | 9317 | AI029174 | 82.0146 | 500.5706 | 75.1872 | 682.2943 | 145.5965 |
| 1249 | 11426 | AI171305 | 81.9947 | 337.2493 | 90.1085 | 553.0815 | 151.4891 |
| 2197 | 13634 | NM_024403 | 81.8750 | 1369.2711 | 485.0771 | 806.0391 | 179.8525 |
| 626 | 19387 | AA946275 | 81.8617 | 536.2792 | 140.6484 | 364.3634 | 84.4545 |
| 667 | 24051 | AA957452 | 81.8152 | 94.5799 | 22.7796 | 145.6245 | 33.8169 |
| 1299 | 13460 | AI175375 | 81.7753 | 218.7623 | 66.2870 | 337.3528 | 64.6869 |
| 1492 | 6412 | AI231787 | 81.7686 | 13.4985 | 5.4822 | 27.2459 | 12.3818 |
| 1076 | 9611 | AI073040 | 81.6223 | 12.2893 | 25.4226 | 57.7584 | 32.7127 |
| 1308 | 4074 | AI175990 | 81.5891 | 7.4619 | 29.5408 | 64.5731 | 43.9488 |
| 1068 | 6548 | AI072658 | 81.5226 | 375.7787 | 105.0735 | 210.2905 | 78.2200 |
| 1427 | 12946 | AI228291 | 81.5093 | 148.1603 | 34.5002 | 220.6648 | 40.7063 |
| 2087 | 20035 | NM_021754 | 81.5027 | 346.7378 | 149.5983 | 164.0392 | 57.3486 |
| 1120 | 3905 | AI103403 | 81.4960 | 170.3486 | 48.0159 | 90.3576 | 60.5419 |
| 1207 | 12979 | AI169177 | 81.4827 | 966.0172 | 724.9628 | 294.8817 | 100.1571 |
| 798 | 22545 | AI009747 | 81.4827 | 128.2348 | 54.8824 | 203.6431 | 60.8249 |
| 1218 | 21660 | AI169751 | 81.4561 | 2382.4932 | 487.4179 | 1592.8149 | 514.8672 |
| 1463 | 18529 | AI230716 | 81.4362 | 447.6552 | 91.3266 | 285.9677 | 71.7319 |
| 497 | 22666 | AA900974 | 81.3963 | 182.6728 | 89.9086 | 675.6578 | 31.7036 |
| 2212 | 21166 | NM_031005 | 81.3963 | 531.8921 | 175.0606 | 305.9588 | 75.1422 |
| 2266 | 15277 | NM_031237 | 81.3497 | 1029.9606 | 170.9360 | 793.9735 | 149.6945 |
| 687 | 18830 | AA964496 | 81.3431 | 5708.1764 | 1748.0224 | 3626.8283 | 865.9063 |
| 1434 | 16053 | AI228596 | 81.2699 | 351.6101 | 280.9336 | 111.1993 | 59.6347 |
| 1034 | 8938 | AI070590 | 81.1769 | 21.3583 | 23.4652 | 73.0730 | 34.1501 |
| 1500 | 22591 | AI231827 | 81.0904 | 50.7375 | 12.5625 | 74.8265 | 17.9028 |
| 1221 | 21185 | AI170056 | 81.0904 | 441.0886 | 76.5297 | 604.5507 | 148.1893 |
| 1354 | 21785 | AI177312 | 81.0439 | 163.0715 | 48.9946 | 93.7917 | 30.5701 |

TABLE 5B

ALKYLATING AGENTS

| SEQ ID | GLGC ID | GenBank Accession No. | LDA Score | Mean Tox | SD Tox | Mean Nontox | SD Nontox |
|---|---|---|---|---|---|---|---|
| 2356 | 25468 | NM_033234 | 84.1196 | 2299.0124 | 2917.1199 | 6144.3127 | 2425.3955 |
| 2096 | 20225 | NM_022198 | 84.0526 | 30.0414 | 12.5776 | 97.4470 | 57.3253 |
| 2228 | 25600 | NM_031077 | 83.8852 | 47.2206 | 7.9918 | 70.5631 | 19.5326 |
| 2356 | 25469 | NM_033234 | 83.6459 | 1791.5476 | 2180.0380 | 4544.7412 | 1788.2424 |
| 2105 | 17160 | NM_022298 | 83.2440 | 2068.9455 | 214.1597 | 1697.7590 | 423.3836 |
| 1869 | 1684 | NM_013096 | 83.1196 | 2947.0329 | 3556.7192 | 6788.5893 | 2953.7997 |
| 454 | 4565 | AA893994 | 82.6651 | 24.4325 | 9.4147 | 43.6687 | 14.1960 |
| 116 | 10320 | AA800855 | 82.3493 | 47.9014 | 12.0588 | 80.4636 | 26.6369 |
| 366 | 4474 | AA891969 | 82.3397 | 73.5205 | 23.9619 | 38.7337 | 27.3163 |
| 2027 | 20440 | NM_019166 | 81.9522 | 23.8482 | 22.9362 | 51.6998 | 18.9559 |
| 1753 | 20313 | NM_012585 | 81.6890 | 11.6843 | 11.8859 | 29.5962 | 10.7195 |
| 2018 | 455 | NM_019131 | 81.6029 | 3635.2910 | 906.2374 | 5012.3749 | 1060.9043 |
| 2098 | 20450 | NM_022239 | 81.5694 | 48.8815 | 13.0695 | 73.0041 | 22.3154 |
| 276 | 309 | AA866460 | 81.4976 | 588.1575 | 79.2127 | 476.1954 | 81.2001 |
| 2171 | 8269 | NM_023103 | 81.4211 | 15.6709 | 4.3619 | 21.9461 | 9.5169 |
| 292 | 15573 | AA875023 | 81.3493 | 84.8163 | 10.9516 | 105.8035 | 18.1005 |
| 1798 | 16947 | NM_012793 | 81.2010 | 53.0476 | 11.7092 | 76.8846 | 21.9556 |
| 24 | 15083 | AA799396 | 81.1914 | 34.2199 | 13.4606 | 68.3728 | 27.2558 |
| 2599 | 25496 | S59893 | 81.1292 | 204.2343 | 26.9706 | 157.0878 | 37.2108 |
| 2598 | 25495 | S59892 | 81.1292 | 178.3991 | 19.0513 | 140.0664 | 33.9639 |
| 1928 | 6654 | NM_017068 | 81.0574 | 57.3908 | 16.9442 | 32.3728 | 13.5276 |
| 436 | 22355 | AA893338 | 81.0431 | 18.9000 | 5.0085 | 32.1376 | 12.8167 |
| 2660 | 25705 | X59375 | 80.8900 | 543.7746 | 141.5809 | 357.5528 | 114.8227 |
| 101 | 24228 | AA800318 | 80.8804 | 279.7133 | 119.0250 | 157.8901 | 45.9909 |
| 1693 | 381 | L00124 | 80.7368 | 19.6870 | 6.7439 | 29.2547 | 10.7027 |
| 2117 | 24643 | NM_022400 | 80.6029 | 169.1690 | 56.3307 | 68.4159 | 74.1271 |
| 456 | 22583 | AA894009 | 80.5598 | 18.3818 | 5.5890 | 24.0195 | 5.7511 |

TABLE 5B-continued

ALKYLATING AGENTS

| SEQ ID | GLGC ID | GenBank Accession No. | LDA Score | Mean Tox | SD Tox | Mean Nontox | SD Nontox |
|---|---|---|---|---|---|---|---|
| 2482 | 2413 | NM_057141 | 80.5072 | 745.6790 | 62.8685 | 623.5517 | 103.7641 |
| 2230 | 4684 | NM_031083 | 80.4880 | 87.7172 | 15.7335 | 55.6888 | 21.8841 |
| 386 | 2832 | AA892388 | 80.2967 | 123.6875 | 17.2399 | 151.2548 | 23.9115 |
| 266 | 15846 | AA866250 | 80.2440 | 33.1607 | 19.0091 | 68.4972 | 33.9424 |
| 1676 | 26039 | H31982 | 80.1818 | 57.8518 | 11.0042 | 75.8213 | 15.2461 |
| 2619 | 298 | U25282 | 80.0431 | 37.0221 | 12.7922 | 59.1687 | 23.4624 |
| 2469 | 1108 | NM_054005 | 80.0239 | 18.0748 | 7.6995 | 33.1729 | 11.8817 |
| 1618 | 20073 | AI639152 | 80.0144 | 7.9412 | 16.4752 | 40.4131 | 19.1797 |
| 1800 | 10248 | NM_012797 | 79.9282 | 376.3496 | 53.6001 | 306.4258 | 85.4251 |
| 2189 | 767 | NM_024365 | 79.8565 | 4.3235 | 13.7955 | 23.0547 | 15.9343 |
| 2002 | 1894 | NM_017320 | 79.7847 | 295.3987 | 119.1209 | 147.5070 | 73.9222 |
| 314 | 18864 | AA875470 | 79.7799 | 132.5974 | 18.7576 | 166.8307 | 35.1741 |
| 240 | 13595 | AA859508 | 79.7703 | 76.1675 | 12.9824 | 97.0513 | 18.1780 |
| 2056 | 15056 | NM_019291 | 79.7273 | 6.2067 | 6.1665 | 22.2468 | 15.6667 |
| 2449 | 385 | NM_053885 | 79.6986 | 19.5439 | 15.0876 | 46.3407 | 22.6844 |
| 2275 | 17427 | NM_031510 | 79.5837 | 318.0867 | 65.6813 | 220.1336 | 64.8948 |
| 2015 | 20536 | NM_019122 | 79.5837 | 37.0290 | 24.7335 | 11.5981 | 22.3424 |
| 1885 | 200 | NM_013161 | 79.5598 | 55.6074 | 13.1527 | 79.4381 | 22.5161 |
| 464 | 24473 | AA894200 | 79.4450 | 147.2555 | 34.7970 | 207.7485 | 46.3524 |
| 1405 | 18895 | AI179916 | 79.4450 | 120.9271 | 21.8233 | 163.6937 | 34.7664 |
| 1894 | 16448 | NM_013197 | 79.3828 | 96.2256 | 119.9279 | 285.0267 | 130.8231 |
| 2438 | 17154 | NM_053835 | 79.3636 | 1193.0218 | 321.9846 | 854.9913 | 204.4564 |
| 1899 | 20732 | NM_013217 | 79.2440 | 13.7055 | 5.1709 | 23.4555 | 9.0599 |
| 379 | 9073 | AA892273 | 79.0670 | 39.3991 | 11.2447 | 21.7348 | 14.0843 |
| 414 | 17923 | AA892843 | 79.0335 | 75.8414 | 12.2287 | 104.9544 | 26.5959 |
| 2613 | 25572 | U02534 | 78.9809 | 23.5730 | 9.4696 | 38.3420 | 12.8307 |
| 2562 | 18867 | NM_138900 | 78.9234 | 375.0387 | 219.8318 | 178.0682 | 58.9122 |
| 74 | 20998 | AA799803 | 78.7751 | 470.2145 | 161.5664 | 278.2811 | 80.1195 |
| 2069 | 18032 | NM_019380 | 78.7703 | 43.4114 | 22.1110 | 89.4354 | 44.4752 |
| 215 | 16934 | AA851403 | 78.7512 | 59.1653 | 16.5814 | 34.9678 | 17.9845 |
| 441 | 22150 | AA893607 | 78.7416 | 217.3971 | 42.1239 | 150.5825 | 44.2886 |
| 1897 | 20864 | NM_013215 | 78.7177 | 9.1197 | 8.3097 | 24.8080 | 14.9622 |
| 2622 | 20224 | U47014 | 78.6555 | 25.7235 | 11.4037 | 54.8352 | 23.4610 |
| 2294 | 14543 | NM_031596 | 78.6459 | 41.7789 | 18.8904 | 4.6710 | 27.2678 |
| 332 | 21928 | AA891302 | 78.6029 | 26.2219 | 9.3320 | 40.2590 | 12.3799 |
| 2121 | 8587 | NM_022505 | 78.6029 | 21.3555 | 10.7080 | 42.0994 | 16.8253 |
| 2683 | 25752 | X89694 | 78.5837 | 25.6894 | 42.8635 | −49.0965 | 50.2743 |
| 1946 | 167 | NM_017131 | 78.5598 | 385.7359 | 146.7072 | 589.7799 | 173.8485 |
| 2350 | 20554 | NM_031987 | 78.5598 | 37.0486 | 18.4306 | 76.2388 | 36.7772 |
| 2170 | 23215 | NM_023102 | 78.5072 | 76.8105 | 11.1928 | 100.4547 | 26.8897 |
| 2379 | 16018 | NM_053401 | 78.4354 | 258.9146 | 45.4960 | 201.5170 | 58.2273 |
| 274 | 15990 | AA866439 | 78.3493 | 87.3962 | 18.5131 | 117.5183 | 26.5665 |
| 833 | 15917 | AI011498 | 78.3397 | 70.4733 | 26.2187 | 18.9494 | 42.6290 |
| 2274 | 25525 | NM_031509 | 78.1722 | 124.7945 | 36.3359 | 78.6745 | 47.6384 |
| 2687 | 25770 | X96437 | 78.0144 | 91.4328 | 51.3572 | 161.4990 | 59.9291 |
| 33 | 23294 | AA799472 | 77.9378 | 125.3066 | 16.9407 | 158.0675 | 35.6768 |
| 2638 | 25659 | U95157 | 77.8852 | 37.2458 | 13.2464 | 90.6507 | 61.2556 |
| 2434 | 25262 | NM_053814 | 77.8756 | 29.1337 | 6.8117 | 42.6468 | 14.5241 |
| 1912 | 21013 | NM_017014 | 77.8038 | 232.9595 | 46.2884 | 183.4911 | 49.0195 |
| 2685 | 25765 | X89706 | 77.8038 | 39.7965 | 17.4557 | 66.0129 | 19.3064 |
| 2312 | 8844 | NM_031690 | 77.7799 | 27.1377 | 10.8488 | 55.1368 | 26.7064 |
| 1893 | 20754 | NM_013195 | 77.6986 | 52.0605 | 10.6921 | 71.2943 | 15.0357 |
| 1919 | 24597 | NM_017040 | 77.6794 | 622.3761 | 105.4979 | 480.5779 | 107.3116 |
| 2692 | 25790 | Z21935 | 77.6459 | 39.4384 | 14.4912 | 59.6624 | 16.2379 |
| 1967 | 20779 | NM_017201 | 77.6459 | 160.1499 | 17.6749 | 123.7358 | 27.7988 |
| 751 | 2881 | AF056034 | 77.6029 | 297.0551 | 79.9493 | 399.1987 | 92.4773 |
| 1602 | 17214 | AI639008 | 77.5646 | 144.7695 | 33.6226 | 105.3812 | 24.3444 |
| 2150 | 20509 | NM_022689 | 77.5072 | 23.2482 | 6.0971 | 36.1861 | 15.1089 |
| 2128 | 4242 | NM_022521 | 77.4163 | 323.5089 | 80.1901 | 238.1027 | 64.1769 |
| 1613 | 13882 | AI639120 | 77.4019 | 757.9745 | 193.5464 | 1049.9153 | 293.9675 |
| 2046 | 11218 | NM_019247 | 77.3828 | 66.3258 | 39.0734 | 128.6068 | 49.1323 |
| 1690 | 20549 | K01701 | 77.3589 | 33.1582 | 11.8610 | 50.5349 | 19.7998 |
| 2204 | 18023 | NM_030846 | 77.3493 | 45.3195 | 12.0265 | 64.6300 | 17.5364 |
| 2391 | 31 | NM_053537 | 77.2344 | 59.3374 | 11.7844 | 78.8431 | 21.6135 |
| 757 | 25232 | AF110508 | 77.1388 | 19.7318 | 7.8509 | 34.4586 | 15.7297 |
| 2580 | 1948 | NM_145092 | 77.1100 | 136.4836 | 36.7570 | 81.9549 | 42.8659 |
| 2412 | 15777 | NM_053630 | 77.0861 | 20.3161 | 7.1718 | 35.9811 | 18.4974 |
| 1862 | 13283 | NM_013078 | 77.0335 | 13.0325 | 4.6449 | 21.3358 | 9.3227 |
| 2174 | 17226 | NM_024131 | 76.9952 | 252.0797 | 52.3846 | 189.5066 | 46.2914 |
| 1865 | 20878 | NM_013085 | 76.9904 | 28.4037 | 7.4850 | 39.7258 | 15.8441 |
| 2240 | 22205 | NM_031105 | 76.9713 | 889.7006 | 90.5304 | 762.5673 | 130.2308 |
| 1647 | 25235 | AJ001290 | 76.9282 | 21.8555 | 3.4653 | 28.8335 | 9.5388 |
| 2269 | 4235 | NM_031330 | 76.8995 | 407.8426 | 55.6413 | 323.2472 | 67.5158 |
| 2018 | 461 | NM_019131 | 88.3684 | 58.8866 | 10.7413 | 100.2864 | 30.1009 |

TABLE 5B-continued

ALKYLATING AGENTS

| SEQ ID | GLGC ID | GenBank Accession No. | LDA Score | Mean Tox | SD Tox | Mean Nontox | SD Nontox |
|---|---|---|---|---|---|---|---|
| 1036 | 10453 | AI070697 | 86.5072 | 54.6916 | 28.6474 | 133.6145 | 48.4319 |
| 517 | 23096 | AA924352 | 86.4976 | 305.3999 | 77.1263 | 103.2969 | 113.9204 |
| 1102 | 5969 | AI102520 | 86.0335 | 582.3748 | 81.2828 | 425.0370 | 122.6622 |
| 25 | 15084 | AA799397 | 85.6651 | 82.7205 | 49.8587 | 198.7021 | 77.1236 |
| 630 | 22771 | AA946432 | 85.6651 | 543.5028 | 64.0967 | 384.5877 | 92.2999 |
| 1403 | 3094 | AI179700 | 85.4641 | 39.5089 | 13.9797 | 87.5210 | 51.0282 |
| 1414 | 3352 | AI180334 | 85.1818 | 686.1273 | 133.8193 | 444.0767 | 130.1732 |
| 796 | 19358 | AI009675 | 85.0670 | 749.4440 | 1002.3084 | 2499.7431 | 927.5420 |
| 234 | 6458 | AA859319 | 84.5694 | 10.2135 | 8.2076 | 34.5288 | 21.5597 |
| 1465 | 9171 | AI230747 | 84.4641 | 83.4184 | 21.1652 | 125.7671 | 37.2977 |
| 2356 | 17832 | NM_033234 | 84.3828 | 1873.7747 | 2756.4346 | 5678.4901 | 2278.9559 |
| 1406 | 1687 | AI179971 | 84.3301 | 1518.0092 | 2149.3647 | 4500.8610 | 1744.4746 |
| 2127 | 4151 | NM_022518 | 84.0957 | 398.7729 | 74.0807 | 605.7236 | 162.8110 |
| 1869 | 1689 | NM_013096 | 83.7512 | 3534.9897 | 4805.9317 | 9151.5643 | 3989.7268 |
| 162 | 6092 | AA818897 | 83.5694 | 14.9530 | 7.8629 | 27.7916 | 11.2114 |
| 1054 | 8712 | AI071935 | 83.2871 | 76.7061 | 30.7397 | 9.5956 | 49.1484 |
| 228 | 13802 | AA858853 | 83.1914 | 86.8262 | 20.4133 | 140.1087 | 38.4801 |
| 2193 | 2813 | NM_024386 | 83.0335 | 345.9580 | 80.9262 | 230.5143 | 104.4164 |
| 1011 | 8291 | AI059313 | 82.6124 | 29.9570 | 8.6052 | 52.6233 | 17.7459 |
| 1413 | 17089 | AI180281 | 82.5502 | 1436.7260 | 238.9832 | 1082.6013 | 400.2614 |
| 734 | 3781 | AA998375 | 82.4976 | −3.7295 | 24.1581 | 30.8117 | 26.0212 |
| 901 | 12805 | AI028870 | 82.4641 | 64.5057 | 23.9316 | 11.2774 | 53.4721 |
| 1459 | 19944 | AI230479 | 82.3589 | 124.7257 | 31.3315 | 230.2468 | 82.9797 |
| 779 | 16652 | AI009019 | 82.3493 | 80.1161 | 33.8281 | 126.1162 | 39.8916 |
| 1104 | 11563 | AI102560 | 82.3301 | 207.7992 | 49.7971 | 115.4617 | 54.5596 |
| 1382 | 14530 | AI178738 | 82.1196 | 98.2636 | 21.6303 | 68.0352 | 19.1958 |
| 1032 | 21364 | AI070392 | 82.0861 | 95.9159 | 78.2647 | 264.3087 | 122.6829 |
| 985 | 16335 | AI045744 | 82.0574 | 72.0214 | 170.4047 | 269.4336 | 133.2956 |
| 988 | 5913 | AI045929 | 81.9713 | 41.5357 | 16.7042 | 77.0752 | 24.0146 |
| 14 | 6917 | AA012709 | 81.9522 | 207.1085 | 70.5504 | 107.6603 | 60.9658 |
| 1569 | 14594 | AI236152 | 81.8469 | 23.9145 | 32.6840 | −21.2989 | 26.1810 |
| 1055 | 9788 | AI071958 | 81.8230 | 122.9006 | 46.7684 | 207.8074 | 64.5521 |
| 1388 | 23043 | AI178968 | 81.7799 | 122.6782 | 21.5207 | 172.4627 | 44.1924 |
| 702 | 2880 | AA996658 | 81.6746 | 37.0159 | 14.8125 | 61.6067 | 21.7007 |
| 1416 | 14337 | AI180414 | 81.6651 | 239.9225 | 32.1748 | 308.3251 | 50.5088 |
| 976 | 5726 | AI045194 | 81.4545 | 59.7409 | 16.5892 | 92.9327 | 28.6776 |
| 1360 | 9521 | AI177706 | 81.3493 | 65.8090 | 13.5422 | 92.0760 | 22.2797 |
| 1559 | 8440 | AI235611 | 81.3301 | 156.6240 | 30.9800 | 104.9144 | 36.1090 |
| 655 | 17495 | AA956733 | 81.3206 | 544.9712 | 92.4873 | 375.0940 | 90.9501 |
| 834 | 7060 | AI011547 | 81.3206 | 383.8079 | 117.4177 | 296.2564 | 75.5050 |
| 716 | 21119 | AA997655 | 81.2967 | 191.4324 | 26.9123 | 239.7644 | 45.3520 |
| 2329 | 1182 | NM_031790 | 81.2871 | 70.2302 | 18.8770 | 107.7135 | 26.2306 |
| 894 | 15786 | AI013924 | 81.2775 | 149.8647 | 38.0848 | 88.9610 | 41.4774 |
| 731 | 6789 | AA998207 | 81.2584 | 636.6515 | 175.1664 | 462.0210 | 85.3071 |
| 645 | 6658 | AA955857 | 81.1818 | 90.9486 | 22.1946 | 135.2010 | 31.2399 |
| 198 | 8515 | AA849917 | 81.1722 | 284.2977 | 162.9443 | 519.0955 | 137.7033 |
| 1525 | 11561 | AI233182 | 81.1100 | 101.8620 | 27.5891 | 64.7334 | 22.7099 |
| 1057 | 9801 | AI072019 | 81.0957 | 127.8069 | 29.6080 | 206.6474 | 71.1527 |
| 1016 | 8356 | AI059543 | 81.0335 | 126.3052 | 28.1786 | 178.4201 | 42.6519 |
| 181 | 17614 | AA848306 | 81.0239 | 114.4329 | 43.6818 | 184.2400 | 51.7067 |
| 1869 | 1685 | NM_013096 | 81.0144 | 8546.8465 | 11550.1541 | 16297.7927 | 9670.1461 |
| 1061 | 9186 | AI072088 | 80.9809 | 20.6067 | 24.7195 | 53.3468 | 31.2583 |
| 664 | 24012 | AA957335 | 80.9426 | 1380.0285 | 367.9359 | 922.5454 | 231.8686 |
| 1358 | 24129 | AI177590 | 80.8660 | 97.4502 | 24.3140 | 148.3880 | 38.5966 |
| 2200 | 17917 | NM_024488 | 80.8565 | 49.7315 | 112.7341 | −210.2743 | 164.0051 |
| 1431 | 17892 | AI228438 | 80.8230 | 133.1790 | 82.8102 | 500.4147 | 308.6848 |
| 853 | 23385 | AI012380 | 80.8230 | 34.8506 | 19.6899 | 67.4320 | 26.9774 |
| 682 | 2214 | AA963838 | 80.8134 | 23.1353 | 15.6220 | 48.1076 | 19.1854 |
| 2490 | 11632 | NM_057212 | 80.7703 | 245.8868 | 52.8498 | 339.3667 | 77.4808 |
| 1452 | 13887 | AI230156 | 80.7608 | 42.0020 | 14.9669 | 76.6187 | 25.7957 |
| 2518 | 16713 | NM_133409 | 80.7512 | 245.9244 | 52.1236 | 336.8610 | 64.0700 |
| 680 | 6276 | AA963767 | 80.7512 | 36.0211 | 47.9516 | 103.7553 | 45.6000 |
| 1073 | 9409 | AI072841 | 80.7273 | 32.7671 | 11.1490 | 55.0538 | 23.5680 |
| 2192 | 11628 | NM_024383 | 80.7081 | 203.6646 | 44.9926 | 304.7981 | 79.1293 |
| 2555 | 8468 | NM_138861 | 80.6124 | 152.0274 | 44.8297 | 257.8287 | 84.3043 |
| 817 | 18691 | AI010605 | 80.6124 | 2396.4705 | 628.0103 | 3968.4435 | 1196.6683 |
| 1362 | 6334 | AI177765 | 80.4880 | 366.9402 | 55.6784 | 300.3871 | 52.9436 |
| 571 | 21990 | AA943524 | 80.4450 | 97.6227 | 50.6873 | 16.0942 | 66.0429 |
| 990 | 3319 | AI045989 | 80.3923 | 16.8291 | 13.8402 | 35.5651 | 15.6556 |

TABLE 5C

ADRIAMYCIN
Timepoints(s): 120, 168 hrs

| SEQ ID | GLGC ID | GenBank Accession No. | LDA Score | Mean Tox | SD Tox | Mean Nontox | SD Nontox |
|---|---|---|---|---|---|---|---|
| 408 | 20065 | AA892647 | 99.2723 | 183.8997 | 70.9952 | 27.0773 | 23.5970 |
| 2356 | 17829 | NM_033234 | 99.0125 | 165.7909 | 131.6683 | 4421.0631 | 1923.2910 |
| 2356 | 25468 | NM_033234 | 98.9085 | 36.6577 | 64.2024 | 6119.8636 | 2438.1822 |
| 2356 | 25469 | NM_033234 | 98.9085 | 63.2684 | 50.1188 | 4528.3633 | 1796.1027 |
| 1869 | 1684 | NM_013096 | 98.7526 | 89.0179 | 122.2818 | 6770.3787 | 2960.1914 |
| 334 | 21938 | AA891439 | 98.7006 | 231.2675 | 91.7444 | 72.0647 | 24.0884 |
| 1709 | 19255 | M15562 | 98.4927 | 44.9176 | 24.3850 | 228.8471 | 100.5140 |
| 1709 | 19256 | M15562 | 98.2328 | 117.1460 | 52.0641 | 416.7285 | 142.5050 |
| 1979 | 20482 | NM_017240 | 98.0769 | 5168.1262 | 986.3126 | 1597.9097 | 904.7746 |
| 84 | 18883 | AA799992 | 97.6611 | 158.0252 | 29.5322 | 67.9355 | 25.7012 |
| 2030 | 1174 | NM_019184 | 97.5052 | 29.3875 | 14.7446 | −49.4517 | 23.3909 |
| 1389 | 18907 | AI178971 | 97.4532 | 17.1561 | 12.0112 | 446.2084 | 255.5783 |
| 1894 | 16448 | NM_013197 | 97.4532 | 49.2018 | 12.3050 | 283.1604 | 132.0897 |
| 1860 | 16924 | NM_013069 | 97.4532 | 14.3123 | 39.7356 | 227.5564 | 105.7147 |
| 2557 | 4594 | NM_138881 | 97.1933 | 20.8843 | 8.3975 | 87.7948 | 53.1804 |
| 1837 | 956 | NM_012976 | 96.8295 | 56.2043 | 24.1425 | 221.5609 | 95.7116 |
| 84 | 18881 | AA799992 | 96.5696 | 42.5293 | 9.7059 | 18.4425 | 7.7913 |
| 1659 | 16610 | D28557 | 96.5177 | 441.4807 | 35.9444 | 757.8194 | 180.8820 |
| 2174 | 17227 | NM_024131 | 96.4657 | 617.3444 | 94.1237 | 374.3329 | 70.7076 |
| 61 | 17760 | AA799663 | 96.1538 | 497.1910 | 48.6205 | 303.5142 | 78.3806 |
| 2056 | 15056 | NM_019291 | 94.9584 | 0.6888 | 2.5754 | 22.1041 | 15.6263 |
| 2685 | 25765 | X89706 | 94.2308 | 30.6901 | 6.3798 | 65.7805 | 19.4180 |
| 2521 | 24775 | NM_133511 | 94.1268 | 4.3639 | 8.9454 | 40.0668 | 20.4915 |
| 1720 | 1586 | M57728 | 93.9709 | 153.0619 | 16.0525 | 102.3870 | 23.5273 |
| 1717 | 9223 | M36151 | 93.9709 | −2.5494 | 13.2241 | 59.7208 | 46.1898 |
| 1763 | 24506 | NM_012614 | 93.4511 | 20.7437 | 16.1857 | 93.1557 | 47.7833 |
| 1683 | 4418 | H33656 | 93.2952 | 31.9637 | 4.3417 | 34.4959 | 29.6694 |
| 2039 | 2079 | NM_019220 | 93.1393 | 1233.9396 | 75.7770 | 1579.3870 | 253.4903 |
| 1779 | 20888 | NM_012716 | 92.8794 | 745.0763 | 70.1047 | 490.91188 | 132.2520 |
| 2261 | 21623 | NM_031144 | 92.8794 | 1333.2177 | 151.5873 | 1989.0003 | 390.5994 |
| 43 | 17599 | AA799539 | 92.8170 | 301.5754 | 145.1718 | 67.4111 | 46.5538 |
| 2065 | 23225 | NM_019360 | 92.7235 | 12.3479 | 5.7285 | 90.0362 | 220.5098 |
| 2213 | 25517 | NM_031010 | 92.7235 | 38.8209 | 17.6003 | 164.9523 | 104.4392 |
| 2174 | 17226 | NM_024131 | 92.6611 | 359.4217 | 64.3602 | 189.1713 | 43.8908 |
| 2642 | 14966 | X07551 | 92.4636 | −29.1245 | 18.8958 | 40.2943 | 45.7010 |
| 392 | 1522 | AA892486 | 92.2557 | 308.6408 | 59.6964 | 163.1935 | 73.1540 |
| 256 | 22773 | AA859885 | 92.0998 | 255.7841 | 74.9933 | 460.0795 | 111.7997 |
| 1929 | 11152 | NM_017073 | 92.0894 | 557.2671 | 220.7868 | 211.5257 | 80.2627 |
| 1860 | 16925 | NM_013069 | 91.9335 | 512.6284 | 202.3815 | 979.1897 | 171.7185 |
| 476 | 23778 | AA899854 | 91.4761 | 23.6922 | 6.0522 | 57.9147 | 31.2877 |
| 1806 | 17541 | NM_012844 | 91.2578 | 198.5566 | 46.9188 | 81.2000 | 50.4977 |
| 2379 | 16018 | NM_053401 | 91.0499 | 323.8912 | 34.7586 | 201.5575 | 57.4594 |
| 1618 | 20073 | AI639152 | 90.6861 | 0.9459 | 5.7273 | 40.0808 | 19.4090 |
| 1681 | 4405 | H33472 | 90.4366 | 15.8925 | 3.3639 | 25.0584 | 13.1488 |
| 1921 | 24695 | NM_017049 | 90.3742 | 453.4644 | 75.2141 | 299.0488 | 61.7532 |
| 1860 | 25676 | NM_013069 | 90.2287 | 59.5410 | 41.7671 | 167.6913 | 66.3227 |
| 2222 | 17727 | NM_031043 | 89.9064 | 577.4152 | 53.1830 | 411.9085 | 74.7992 |
| 2438 | 18065 | NM_053835 | 89.8545 | 116.8633 | 24.0688 | 63.5006 | 21.4720 |
| 1691 | 14968 | K02815 | 89.8025 | 96.0389 | 40.7561 | 255.4619 | 81.4502 |
| 1823 | 6108 | NM_012915 | 89.6985 | 752.4260 | 142.3411 | 469.9789 | 105.7585 |
| 2504 | 21695 | NM_130411 | 89.4491 | −9.1950 | 9.6046 | 35.1283 | 73.3789 |
| 1836 | 22435 | NM_012974 | 89.3867 | 1158.4434 | 173.1666 | 735.9354 | 180.2532 |
| 61 | 17759 | AA799663 | 89.2827 | 149.5568 | 14.5193 | 84.5285 | 36.3592 |
| 2203 | 21746 | NM_030828 | 89.2308 | 816.6727 | 103.5026 | 513.3917 | 123.9903 |
| 2492 | 10498 | NM_078617 | 89.1892 | 1497.8929 | 48.1531 | 1378.3258 | 276.5810 |
| 2674 | 16426 | X70369 | 89.0229 | 634.7232 | 367.7003 | 1682.6068 | 491.6851 |
| 1770 | 16217 | NM_012656 | 88.9293 | 1472.9648 | 370.2267 | 2337.2435 | 632.6166 |
| 2263 | 1291 | NM_031149 | 88.8669 | 392.3356 | 52.9019 | 255.6265 | 54.9647 |
| 427 | 17731 | AA893194 | 88.8150 | 170.2621 | 34.1005 | 85.8118 | 43.3807 |
| 2672 | 436 | X67877 | 88.7734 | 78.5997 | 6.2549 | 58.2561 | 17.3686 |
| 2687 | 25770 | X96437 | 88.7630 | 52.9155 | 31.2005 | 161.0254 | 59.8719 |
| 460 | 9388 | AA894173 | 88.5551 | 36.0405 | 19.5702 | −58.0892 | 46.8516 |
| 2122 | 1867 | NM_022510 | 88.4615 | 780.5661 | 39.6208 | 651.7755 | 124.5667 |
| 327 | 19646 | AA891054 | 88.3576 | 75.7858 | 16.9079 | 149.3923 | 60.3960 |
| 2669 | 16780 | X62660 | 88.3472 | 111.7912 | 19.0973 | 70.4368 | 20.0443 |
| 1860 | 16926 | NM_013069 | 88.1913 | 597.8380 | 183.1247 | 1064.0928 | 211.8961 |
| 1918 | 3203 | NM_017039 | 88.0873 | 490.6298 | 67.5512 | 351.1566 | 73.4231 |
| 244 | 16228 | AA859643 | 88.0873 | 1.8880 | 13.9521 | 45.7859 | 27.5614 |
| 2601 | 3244 | S63519 | 88.0353 | 236.9812 | 39.9570 | 175.4901 | 33.1031 |
| 2213 | 1845 | NM_031010 | 87.9418 | −35.4912 | 18.1201 | 50.3417 | 75.5274 |
| 2353 | 12299 | NM_032416 | 87.8690 | 789.9328 | 138.4112 | 431.7056 | 111.2095 |
| 2189 | 767 | NM_024365 | 87.8274 | −4.0207 | 11.9887 | 22.9078 | 15.9351 |
| 1756 | 4450 | NM_012592 | 87.8274 | 653.2107 | 95.7838 | 463.9743 | 94.0993 |

TABLE 5C-continued

ADRIAMYCIN
Timepoints(s): 120, 168 hrs

| SEQ ID | GLGC ID | GenBank Accession No. | LDA Score | Mean Tox | SD Tox | Mean Nontox | SD Nontox |
|---|---|---|---|---|---|---|---|
| 2696 | 15570 | Z78279 | 87.8274 | 250.1856 | 112.2506 | 625.2026 | 205.6496 |
| 47 | 20971 | AA799576 | 87.6819 | 114.4825 | 5.4332 | 92.3298 | 20.5939 |
| 326 | 17057 | AA891049 | 87.5780 | 76.2930 | 6.5559 | 58.1030 | 16.5216 |
| 1599 | 9501 | AI638949 | 87.5676 | 161.4916 | 20.5486 | 118.3188 | 23.2574 |
| 1688 | 17285 | J02827 | 87.4636 | 337.5447 | 23.6994 | 238.4030 | 68.7203 |
| 2696 | 15569 | Z78279 | 87.3597 | 138.4769 | 81.8986 | 454.1432 | 185.9486 |
| 2077 | 20816 | NM_021261 | 87.3077 | 405.3420 | 105.9939 | 780.2926 | 230.1953 |
| 1882 | 3430 | NM_013156 | 87.2973 | 214.2634 | 88.1351 | 106.9822 | 26.1705 |
| 2144 | 20960 | NM_022598 | 87.2661 | 664.9480 | 46.3234 | 520.9765 | 116.5653 |
| 1938 | 15517 | NM_017099 | 87.2141 | 44.6913 | 7.7999 | 69.8491 | 20.3743 |
| 2247 | 19040 | NM_031114 | 87.1622 | 172.6411 | 24.4019 | 255.7760 | 77.7245 |
| 1621 | 5159 | AI639185 | 87.0998 | 318.5259 | 70.6302 | 172.3592 | 76.4086 |
| 269 | 17742 | AA866302 | 86.9854 | 30.4573 | 23.9803 | −4.7075 | 9.8579 |
| 1882 | 3431 | NM_013156 | 86.9335 | 1176.3691 | 361.7949 | 617.0483 | 144.4116 |
| 1876 | 16649 | NM_013132 | 86.8919 | 357.9935 | 33.4191 | 258.8069 | 55.7162 |
| 2562 | 18867 | NM_138900 | 86.8295 | 384.3156 | 106.1680 | 180.4287 | 69.4099 |
| 99 | 4130 | AA800298 | 86.7360 | 105.3641 | 54.5557 | 243.3050 | 74.1218 |
| 2652 | 16716 | X53054 | 86.6944 | 158.3732 | 16.1545 | 219.5175 | 55.3518 |
| 1908 | 24354 | NM_016998 | 86.6944 | 29.2853 | 4.1889 | 14.8199 | 15.0056 |
| 2572 | 1803 | NM_139256 | 86.5800 | 197.6202 | 27.0128 | 148.6496 | 26.7689 |
| 2225 | 15957 | NM_031050 | 86.5281 | 176.1742 | 109.7266 | 367.4182 | 101.7904 |
| 1741 | 16520 | NM_012532 | 86.5177 | 86.0059 | 29.0386 | 42.2329 | 18.0939 |
| 375 | 11384 | AA892149 | 86.4865 | 46.1577 | 5.5310 | 33.2389 | 10.9879 |
| 2256 | 15052 | NM_031136 | 86.4345 | 2047.1863 | 228.9277 | 2747.7425 | 646.9050 |
| 1961 | 17301 | NM_017173 | 86.3721 | 207.3871 | 108.1265 | 504.5765 | 154.1255 |
| 2664 | 25716 | X61295 | 86.3306 | 423.6299 | 94.7456 | 813.2816 | 361.4851 |
| 2067 | 1323 | NM_019371 | 86.3202 | 326.3527 | 54.9693 | 182.5352 | 77.4476 |
| 1406 | 1687 | AI179971 | 98.8565 | 82.8701 | 42.5093 | 4478.5712 | 1762.4439 |
| 1869 | 1689 | NM_013096 | 98.8565 | 83.5162 | 88.7163 | 9117.3811 | 4011.1269 |
| 159 | 6073 | AA818818 | 98.8046 | −23.4120 | 6.7898 | 63.8808 | 46.0409 |
| 2356 | 17832 | NM_033234 | 98.7526 | 35.6451 | 35.6118 | 5650.1374 | 2300.8816 |
| 1869 | 26150 | NM_013096 | 98.7526 | 5.8999 | 46.3755 | 3017.0252 | 1982.7759 |
| 796 | 19358 | AI009675 | 98.4407 | 128.9540 | 60.4569 | 2484.3599 | 939.6377 |
| 1869 | 1685 | NM_013096 | 98.3888 | 241.5861 | 165.9362 | 16287.4406 | 9692.8631 |
| 1979 | 3780 | NM_017240 | 98.3888 | 2187.1981 | 696.9890 | 308.2735 | 265.9432 |
| 1869 | 1688 | NM_013096 | 97.9730 | 143.6612 | 153.4284 | 9096.8112 | 5251.4573 |
| 689 | 2142 | AA964526 | 97.8690 | 114.9472 | 27.2867 | −4.6144 | 40.7838 |
| 680 | 6276 | AA963767 | 97.5572 | −1.8410 | 8.4152 | 103.3040 | 45.7359 |
| 2146 | 21206 | NM_022606 | 97.5052 | 111.3423 | 20.6905 | −8.2238 | 44.4836 |
| 122 | 23115 | AA801165 | 97.5052 | 275.7943 | 51.5085 | 131.3923 | 55.0440 |
| 1373 | 6059 | AI178245 | 97.0894 | 56.1530 | 14.9334 | 129.2172 | 34.0351 |
| 1406 | 1686 | AI179971 | 96.7775 | −356.6447 | 90.3239 | 51.4239 | 168.8423 |
| 514 | 4930 | AA924251 | 96.6736 | 606.4752 | 64.1424 | 358.1455 | 95.2190 |
| 1336 | 5507 | AI176584 | 96.2058 | 480.9383 | 116.1597 | 1109.3895 | 300.9933 |
| 823 | 17761 | AI010662 | 96.1538 | 748.3425 | 80.4399 | 452.8424 | 114.6100 |
| 1187 | 11372 | AI137995 | 96.0499 | 90.7225 | 34.9830 | 263.2703 | 80.0173 |
| 188 | 14604 | AA848828 | 95.5821 | 298.7850 | 52.7556 | 584.8230 | 153.8914 |
| 2574 | 12450 | NM_139337 | 95.4782 | 471.8425 | 103.1775 | 924.4552 | 227.0174 |
| 1045 | 11017 | AI071222 | 95.2183 | 16.6967 | 16.2266 | 104.8072 | 46.8270 |
| 1166 | 10780 | AI136555 | 95.1663 | 345.7198 | 67.6483 | 191.4259 | 56.3170 |
| 839 | 17830 | AI011943 | 94.9064 | −7.6949 | 5.1508 | 49.0813 | 42.5974 |
| 1110 | 11724 | AI102812 | 94.7505 | 26.0631 | 12.0626 | 109.3173 | 47.9814 |
| 961 | 6997 | AI044539 | 94.5426 | 79.2642 | 30.2114 | 188.0745 | 56.7248 |
| 822 | 11227 | AI010660 | 94.3347 | 832.7849 | 40.8394 | 1173.5756 | 267.1579 |
| 1126 | 17762 | AI103854 | 94.2308 | 730.4753 | 71.4551 | 508.3838 | 106.3994 |
| 1257 | 17220 | AI171521 | 94.0748 | 224.2669 | 20.5587 | 372.5064 | 93.4378 |
| 1272 | 16293 | AI172183 | 94.0229 | 108.0721 | 31.6073 | 217.9964 | 58.4308 |
| 1379 | 8445 | AI178394 | 93.9189 | 35.5784 | 7.9567 | 9.0655 | 16.5974 |
| 1588 | 3368 | AI237331 | 93.8669 | 48.2527 | 7.5780 | 24.8418 | 19.4550 |
| 1396 | 12011 | AI179380 | 93.8150 | 489.1382 | 31.7598 | 655.5020 | 104.9197 |
| 1570 | 18513 | AI236175 | 93.7110 | 124.8409 | 46.0884 | 285.5847 | 99.4405 |
| 1498 | 13116 | AI231812 | 93.5031 | 291.3307 | 20.1486 | 223.3274 | 37.7300 |
| 1458 | 14257 | AI230460 | 93.4511 | 101.8823 | 52.7822 | 279.1938 | 98.7108 |
| 1351 | 12582 | AI177183 | 93.3992 | −3.6689 | 8.4496 | 44.9685 | 27.3215 |
| 1169 | 13082 | AI136848 | 93.2432 | 24.9612 | 6.3814 | −9.3904 | 26.1971 |
| 1453 | 18528 | AI230284 | 93.1913 | 173.4085 | 49.5727 | 439.3200 | 173.2623 |
| 1347 | 2852 | AI177059 | 92.7755 | 166.4303 | 85.8937 | 432.7807 | 134.9900 |
| 736 | 2782 | AA998565 | 92.7235 | 99.1453 | 22.4863 | 55.6580 | 44.3586 |
| 1416 | 14337 | AI180414 | 92.6195 | 227.2382 | 17.8487 | 307.6037 | 50.7651 |
| 2513 | 4049 | NM_133298 | 92.5676 | 96.1146 | 31.5224 | 43.6756 | 131.4153 |
| 1424 | 19474 | AI227961 | 92.5676 | 186.0493 | 45.7526 | 453.9572 | 169.6835 |
| 1074 | 10930 | AI072900 | 92.5156 | 93.0461 | 14.7709 | 39.4755 | 35.8064 |
| 660 | 23957 | AA957123 | 92.4012 | 332.6110 | 76.8212 | 115.7446 | 64.8693 |

TABLE 5C-continued

ADRIAMYCIN
Timepoints(s): 120, 168 hrs

| SEQ ID | GLGC ID | GenBank Accession No. | LDA Score | Mean Tox | SD Tox | Mean Nontox | SD Nontox |
|---|---|---|---|---|---|---|---|
| 2509 | 20738 | NM_131907 | 92.0998 | 232.8163 | 27.7875 | 315.7514 | 54.1323 |
| 2573 | 9775 | NM_139334 | 91.9854 | 328.5683 | 66.0503 | 179.1884 | 43.0925 |
| 2324 | 16003 | NM_031757 | 91.9439 | 302.8644 | 33.7938 | 207.5909 | 56.7946 |
| 1096 | 3085 | AI102046 | 91.8919 | 219.8210 | 26.6963 | 161.9272 | 32.8118 |
| 1344 | 7292 | AI176995 | 91.8919 | 67.0870 | 15.6586 | 120.4053 | 31.0428 |
| 1510 | 4716 | AI232313 | 91.7775 | 218.7680 | 47.3553 | 124.6232 | 29.1857 |
| 177 | 9451 | AA819788 | 91.7360 | 22.7486 | 6.1882 | 61.4203 | 32.6047 |
| 721 | 3269 | AA997800 | 91.7360 | 36.0455 | 11.6086 | 93.1567 | 41.7681 |
| 509 | 17644 | AA924036 | 91.5281 | 323.3049 | 35.6007 | 455.3627 | 88.8272 |
| 1490 | 23012 | AI231724 | 91.5177 | 241.8912 | 70.0074 | 115.5417 | 37.4214 |
| 1566 | 14861 | AI236045 | 91.4761 | 52.0096 | 7.7895 | 33.9505 | 11.2329 |
| 645 | 6658 | AA955857 | 91.3202 | 82.5245 | 17.0202 | 134.7365 | 31.4251 |
| 967 | 5322 | AI044801 | 91.3098 | 30.7770 | 13.0747 | −10.0923 | 19.8566 |

TABLE 5D

ADRIAMYCIN
Timepoint(s): 6, 24 hrs

| SEQ ID | GLGC ID | GenBank Accession No. | LDA Score | Mean Tox | SD Tox | Mean Nontox | SD Nontox |
|---|---|---|---|---|---|---|---|
| 631 | 643 | AA946439 | 99.3243 | 216.9566 | 142.7145 | 17.6023 | 11.4535 |
| 1641 | 20082 | AI639488 | 98.9085 | 165.2679 | 36.6385 | 64.8118 | 22.9240 |
| 1924 | 910 | NM_017059 | 98.5967 | 81.2270 | 30.1697 | 25.0230 | 9.4725 |
| 1806 | 17541 | NM_012844 | 98.4927 | 338.5557 | 77.7199 | 79.7447 | 44.3402 |
| 2328 | 1169 | NM_031789 | 98.3368 | 84.6623 | 6.2572 | 48.6961 | 12.1453 |
| 2149 | 20506 | NM_022686 | 98.3368 | 44.8637 | 10.3246 | 19.9840 | 6.1565 |
| 1924 | 912 | NM_017059 | 98.2328 | 606.8919 | 57.5386 | 379.7166 | 61.7792 |
| 2660 | 25705 | X59375 | 98.1809 | 969.4127 | 177.3847 | 355.4504 | 100.2820 |
| 2328 | 1170 | NM_031789 | 98.1289 | 129.9053 | 7.4611 | 74.3075 | 19.9617 |
| 2309 | 18403 | NM_031677 | 96.3098 | 1700.8952 | 143.8684 | 2752.9468 | 558.3881 |
| 422 | 15956 | AA892942 | 96.2578 | 90.6138 | 10.4705 | 51.1452 | 16.3615 |
| 2508 | 1503 | NM_130746 | 96.1019 | 103.7368 | 15.6676 | 54.6586 | 18.6767 |
| 337 | 19238 | AA891542 | 95.8420 | 110.7431 | 13.8001 | 196.2968 | 48.1984 |
| 2273 | 18654 | NM_031358 | 95.0104 | 72.0700 | 35.6079 | 219.3176 | 64.0544 |
| 2292 | 24219 | NM_031579 | 94.0748 | 416.8151 | 49.1940 | 295.3830 | 84.8118 |
| 1767 | 1841 | NM_012637 | 93.5551 | 106.7482 | 12.8901 | 60.8845 | 27.6218 |
| 2274 | 634 | NM_031509 | 93.0249 | 361.5323 | 117.1735 | 93.8808 | 48.1614 |
| 1956 | 21975 | NM_017154 | 92.9834 | 259.5442 | 22.8223 | 180.7023 | 79.8230 |
| 1924 | 911 | NM_017059 | 92.6611 | 37.9401 | 28.6107 | −19.3470 | 24.2912 |
| 2603 | 18647 | S69316 | 92.6195 | 249.5819 | 17.4494 | 173.6777 | 54.1203 |
| 1684 | 16714 | H33660 | 92.4532 | 30.4504 | 6.9013 | 12.1320 | 5.3544 |
| 32 | 18706 | AA799471 | 91.9439 | 415.0758 | 123.4227 | 1163.5138 | 504.9233 |
| 2326 | 4325 | NM_031784 | 91.9335 | 63.3989 | 14.4718 | 28.7876 | 11.2487 |
| 1978 | 1497 | NM_017239 | 91.6840 | 1644.8464 | 189.9219 | 2685.9776 | 946.5933 |
| 242 | 15150 | AA859562 | 91.5800 | 95.3715 | 15.0073 | 154.5278 | 39.0994 |
| 272 | 11865 | AA866383 | 91.1123 | 35.8316 | 6.2345 | 64.6226 | 19.4464 |
| 2587 | 20740 | NM_145878 | 90.8940 | 804.7740 | 146.0843 | 447.8767 | 140.3697 |
| 308 | 15402 | AA875261 | 90.8524 | 242.9727 | 21.7656 | 331.3109 | 61.9613 |
| 2177 | 20801 | NM_024148 | 90.6861 | 126.2442 | 20.7386 | 78.0618 | 18.0951 |
| 1928 | 6653 | NM_017068 | 90.6445 | 185.4673 | 19.4279 | 131.5378 | 35.2556 |
| 2182 | 4504 | NM_024159 | 90.3222 | 304.6935 | 83.1008 | 164.7594 | 52.9684 |
| 2061 | 52 | NM_019335 | 90.2703 | 121.3335 | 27.1611 | 73.6168 | 21.2811 |
| 2323 | 20724 | NM_031753 | 90.1767 | 30.8177 | 4.7813 | 17.2729 | 11.3466 |
| 60 | 20982 | AA799657 | 89.8545 | 117.2682 | 31.4452 | 222.4598 | 50.1804 |
| 302 | 11857 | AA875132 | 89.3971 | 43.7652 | 10.1433 | 97.7911 | 43.8492 |
| 267 | 15884 | AA866276 | 89.3451 | 500.6086 | 60.3145 | 724.0523 | 187.8326 |
| 21 | 22646 | AA799301 | 89.3347 | 112.1522 | 19.2104 | 68.7152 | 17.3910 |
| 2478 | 15391 | NM_057114 | 88.8669 | 575.7964 | 61.0521 | 383.9391 | 91.6424 |
| 2091 | 20177 | NM_021867 | 88.5135 | 13.6744 | 10.3461 | 42.3135 | 19.1616 |
| 2260 | 1638 | NM_031143 | 88.3576 | 110.5316 | 10.5506 | 153.0325 | 50.0039 |
| 2665 | 21657 | X61381 | 88.2432 | 1364.8628 | 180.0082 | 951.9256 | 227.3234 |
| 1778 | 322 | NM_012715 | 88.1809 | 59.4921 | 26.4817 | 18.7707 | 10.4430 |
| 2634 | 4477 | U77829 | 88.1393 | 27.0503 | 7.0810 | 14.4620 | 5.9998 |
| 2274 | 635 | NM_031509 | 87.8170 | 278.4199 | 126.0403 | 92.7541 | 36.8862 |
| 2426 | 7927 | NM_053765 | 87.7859 | 88.2266 | 7.6636 | 64.7494 | 21.2123 |
| 2422 | 15269 | NM_053739 | 87.6715 | 296.3984 | 14.3654 | 233.6963 | 46.3899 |
| 1726 | 5733 | M81855 | 87.6611 | 30.5929 | 18.7185 | −0.0338 | 6.7457 |

TABLE 5D-continued

ADRIAMYCIN
Timepoint(s): 6, 24 hrs

| SEQ ID | GLGC ID | GenBank Accession No. | LDA Score | Mean Tox | SD Tox | Mean Nontox | SD Nontox |
|---|---|---|---|---|---|---|---|
| 2273 | 18655 | NM_031358 | 87.6195 | 58.6545 | 32.8191 | 156.4812 | 62.5568 |
| 2147 | 17661 | NM_022674 | 87.5156 | 277.5417 | 36.7459 | 189.1638 | 49.1745 |
| 1979 | 20483 | NM_017240 | 87.4636 | 2157.1056 | 652.1908 | 4036.7914 | 1012.8776 |
| 1902 | 1396 | NM_013222 | 87.1414 | 37.6173 | 2.6511 | 20.5672 | 6.2547 |
| 2088 | 17936 | NM_021766 | 87.0998 | 45.0405 | 7.1106 | 28.8256 | 10.6275 |
| 378 | 22903 | AA892250 | 86.8919 | 249.5228 | 16.6708 | 198.1381 | 29.6702 |
| 2609 | 25550 | S79213 | 86.8295 | 218.7412 | 65.5518 | 118.0982 | 28.0744 |
| 17 | 25104 | AA685903 | 86.7464 | 173.3228 | 24.8995 | 174.3623 | 91.0804 |
| 2491 | 15707 | NM_058208 | 86.7464 | 19.1016 | 5.2982 | 45.7955 | 24.2428 |
| 447 | 9084 | AA893717 | 86.6944 | 24.0231 | 5.9793 | 42.6019 | 15.6389 |
| 2144 | 20959 | NM_022598 | 86.6944 | 293.4018 | 28.9076 | 219.0742 | 62.2940 |
| 2277 | 20448 | NM_031530 | 86.6320 | 149.8320 | 70.9074 | 79.5449 | 131.0411 |
| 2485 | 15460 | NM_057191 | 86.5904 | 105.8124 | 11.3399 | 103.1174 | 74.2204 |
| 611 | 20619 | AA945737 | 86.5904 | 8.7819 | 3.4581 | 22.1526 | 13.3341 |
| 420 | 24279 | AA892919 | 86.5800 | 24.9137 | 15.3730 | −8.8212 | 19.5805 |
| 2269 | 4235 | NM_031330 | 86.4761 | 440.9827 | 50.9818 | 323.9580 | 67.5564 |
| 2462 | 15642 | NM_053985 | 86.4657 | 471.4492 | 90.6235 | 261.8865 | 66.5316 |
| 1672 | 6499 | H31625 | 86.0603 | 26.4101 | 18.4710 | 67.7942 | 25.1315 |
| 1978 | 1498 | NM_017239 | 85.9667 | 1828.3416 | 477.9028 | 3037.1137 | 1026.7384 |
| 1620 | 25907 | AI639167 | 85.8940 | 34.7316 | 14.8217 | 7.2962 | 10.2408 |
| 1770 | 16221 | NM_012656 | 85.8628 | 389.3234 | 99.4201 | 749.3613 | 303.1582 |
| 751 | 2881 | AF056034 | 85.8524 | 248.3743 | 36.6335 | 398.4306 | 92.5954 |
| 2282 | 18389 | NM_031545 | 85.8004 | 214.1060 | 148.3985 | 840.1938 | 467.3910 |
| 1335 | 16518 | AI176546 | 85.7484 | 1047.5740 | 127.2169 | 770.9344 | 277.9102 |
| 1761 | 1298 | NM_012610 | 85.6549 | 45.8414 | 7.7269 | 25.8116 | 21.4468 |
| 1867 | 8899 | NM_013087 | 85.6445 | 1148.2060 | 114.5846 | 885.3715 | 149.8441 |
| 2534 | 14995 | NM_133624 | 85.6029 | 21.5158 | 5.3712 | 11.3393 | 16.3173 |
| 241 | 23340 | AA859519 | 85.5925 | 180.8155 | 58.3779 | 246.6393 | 47.2515 |
| 755 | 18731 | AF093139 | 85.4886 | 224.1048 | 21.9383 | 168.9408 | 32.7527 |
| 1947 | 20916 | NM_017132 | 85.4782 | 71.4310 | 19.9888 | 39.3071 | 14.0772 |
| 2591 | 1760 | NM_147211 | 85.2807 | 119.4358 | 30.8964 | 183.4883 | 42.1376 |
| 2473 | 25290 | NM_057100 | 85.2703 | 689.4077 | 164.7814 | 387.2016 | 107.0111 |
| 2616 | 25589 | U21718 | 85.1871 | 331.9741 | 32.5161 | 255.7043 | 60.6365 |
| 298 | 16419 | AA875102 | 85.1767 | 371.6173 | 29.5948 | 297.6059 | 53.4572 |
| 1631 | 20461 | AI639350 | 85.1351 | 55.1955 | 13.7311 | 86.3242 | 45.4222 |
| 45 | 11353 | AA799569 | 85.1247 | 63.3792 | 10.8105 | 45.6297 | 14.4738 |
| 2419 | 16123 | NM_053698 | 85.0104 | 202.3612 | 59.3562 | 104.8820 | 47.3069 |
| 1656 | 15281 | D13623 | 84.9688 | 166.7673 | 28.0582 | 122.4601 | 30.0519 |
| 1784 | 25650 | NM_012736 | 84.8233 | 21.1735 | 8.8572 | 46.3942 | 26.6247 |
| 2617 | 22196 | U21719 | 84.7609 | 70.2694 | 7.7501 | 49.8076 | 17.7310 |
| 2255 | 13358 | NM_031135 | 84.7089 | 39.8028 | 10.2977 | 24.4382 | 10.4002 |
| 115 | 17658 | AA800853 | 84.5530 | 71.5205 | 14.8852 | 41.0076 | 20.4000 |
| 1819 | 1834 | NM_012905 | 84.5530 | 8.8770 | 2.9883 | 21.1344 | 12.8485 |
| 1644 | 19864 | AI639510 | 84.4387 | 38.7348 | 8.4642 | 19.6016 | 10.4356 |
| 2499 | 363 | NM_080780 | 84.3451 | 21.1611 | 19.4238 | 45.2277 | 20.3060 |
| 2249 | 882 | NM_031123 | 84.3347 | 58.0744 | 19.1515 | 21.1244 | 14.8712 |
| 1658 | 17264 | D25233 | 84.2931 | 40.0066 | 5.1747 | 27.0710 | 8.2749 |
| 370 | 13420 | AA892042 | 84.2516 | 539.8793 | 61.9590 | 449.4794 | 101.2766 |
| 2107 | 11454 | NM_022381 | 84.1788 | 346.1348 | 92.1226 | 208.8677 | 61.9861 |
| 79 | 21007 | AA799861 | 84.1788 | 241.3877 | 56.8287 | 110.2139 | 87.7943 |
| 2656 | 1037 | X57523 | 84.1268 | 43.2151 | 15.4363 | 13.8391 | 18.6849 |
| 2421 | 22411 | NM_053713 | 84.0748 | 165.2394 | 47.3941 | 91.9562 | 36.9579 |
| 408 | 20065 | AA892647 | 84.0644 | 190.9918 | 130.8571 | 27.0036 | 20.4934 |
| 1551 | 14718 | AI235210 | 99.5842 | 230.6674 | 92.5533 | 24.3979 | 17.5884 |
| 1040 | 10345 | AI071049 | 99.4802 | 785.7281 | 263.4749 | 109.0319 | 43.9117 |
| 201 | 21353 | AA850247 | 99.3763 | 619.7295 | 135.9931 | 249.8067 | 54.2198 |
| 975 | 5689 | AI045075 | 98.8565 | 92.1895 | 15.8960 | 15.2510 | 19.4734 |
| 1338 | 18525 | AI176792 | 98.8046 | 247.4470 | 76.1870 | 83.6691 | 20.9258 |
| 1148 | 21361 | AI105161 | 98.6486 | 147.2292 | 11.1460 | 77.8154 | 20.5116 |
| 1231 | 18744 | AI170407 | 98.3368 | 233.1903 | 38.2309 | 108.4112 | 28.0388 |
| 1222 | 21254 | AI170059 | 98.3368 | 328.6679 | 54.1566 | 620.6906 | 122.0782 |
| 469 | 4107 | AA899109 | 98.2848 | 287.3556 | 71.3956 | 108.7256 | 67.6220 |
| 486 | 4730 | AA900326 | 97.8170 | 550.6699 | 113.3865 | 1080.5117 | 209.6997 |
| 890 | 12802 | AI013865 | 97.6091 | 282.1259 | 49.2121 | 144.4730 | 34.5800 |
| 848 | 3932 | AI012271 | 97.3493 | 225.9943 | 24.7725 | 399.0604 | 84.6947 |
| 1136 | 2856 | AI104349 | 97.2973 | 711.0095 | 112.6609 | 1241.6349 | 244.2494 |
| 909 | 12662 | AI029179 | 96.7775 | 23.0931 | 8.1247 | 86.0459 | 31.0034 |
| 516 | 12346 | AA924346 | 95.3222 | 110.3221 | 20.4632 | 683.4106 | 437.6173 |
| 1334 | 15959 | AI176540 | 95.2183 | 130.9661 | 43.3624 | 284.5307 | 67.5813 |
| 573 | 22261 | AA943573 | 94.7505 | 78.6864 | 10.2432 | 41.9082 | 16.7031 |
| 1151 | 15197 | AI105444 | 94.5426 | 183.6678 | 36.5280 | 312.3558 | 63.2669 |
| 707 | 8786 | AA996993 | 94.2308 | 364.1967 | 47.0109 | 261.2237 | 46.3004 |

TABLE 5D-continued

ADRIAMYCIN
Timepoint(s): 6, 24 hrs

| SEQ ID | GLGC ID | GenBank Accession No. | LDA Score | Mean Tox | SD Tox | Mean Nontox | SD Nontox |
|---|---|---|---|---|---|---|---|
| 953 | 5430 | AI044253 | 93.7526 | 95.4299 | 30.6522 | 23.1385 | 11.6235 |
| 197 | 21275 | AA849796 | 93.7526 | 588.1090 | 149.1494 | 280.4007 | 62.0459 |
| 140 | 6550 | AA817947 | 93.6071 | 282.7144 | 36.3233 | 453.0715 | 99.9325 |
| 1048 | 9649 | AI071429 | 93.2952 | 22.8734 | 10.8883 | 73.5961 | 32.9098 |
| 163 | 19729 | AA818910 | 93.0769 | 294.7338 | 58.5447 | 104.6943 | 58.8170 |
| 471 | 22490 | AA899289 | 93.0353 | 562.3828 | 33.0440 | 440.7810 | 76.6241 |
| 1569 | 14594 | AI236152 | 93.0249 | 62.1960 | 25.5700 | −21.1329 | 25.8521 |
| 1258 | 11761 | AI171526 | 92.9314 | 90.0729 | 18.6131 | 158.6863 | 40.7323 |
| 1484 | 13966 | AI231421 | 92.8794 | 153.8149 | 18.0076 | 104.6423 | 27.4724 |
| 1375 | 3740 | AI178277 | 92.5156 | 255.3806 | 20.7166 | 183.4331 | 40.9137 |
| 843 | 2341 | AI012144 | 92.4636 | 360.3613 | 21.4285 | 257.4395 | 68.5038 |
| 673 | 23831 | AA963094 | 92.4116 | 333.1632 | 29.7634 | 244.7664 | 55.8627 |
| 592 | 2661 | AA944493 | 92.4116 | 45.7200 | 21.1768 | −68.4445 | 135.4444 |
| 2334 | 2655 | NM_031821 | 92.2973 | 399.7943 | 115.7514 | 177.9087 | 66.9156 |
| 2457 | 6357 | NM_053969 | 92.2037 | 380.5703 | 17.8610 | 308.6225 | 44.8102 |
| 1186 | 14524 | AI137974 | 92.1933 | 160.2642 | 37.6385 | 74.1406 | 22.8551 |
| 557 | 6039 | AA942716 | 92.1414 | 880.5708 | 128.2510 | 563.6415 | 89.7156 |
| 505 | 4866 | AA901350 | 92.0894 | 353.6625 | 66.7457 | 186.8359 | 112.6854 |
| 786 | 7524 | AI009350 | 91.9854 | 867.7427 | 119.4344 | 559.3273 | 92.3745 |
| 715 | 3242 | AA997596 | 91.8919 | 149.1652 | 21.1623 | 252.5094 | 83.0593 |
| 1037 | 8980 | AI070710 | 91.7775 | 93.2571 | 24.9282 | 44.7612 | 14.5846 |
| 2149 | 6121 | NM_022686 | 91.7256 | 32.3956 | 10.0648 | 11.1461 | 8.1731 |
| 1506 | 14028 | AI232184 | 91.6216 | 274.8718 | 46.6289 | 122.5672 | 55.7250 |
| 979 | 16752 | AI045475 | 91.5281 | 26.0467 | 17.7967 | 108.3065 | 52.2097 |
| 2462 | 15645 | NM_053985 | 91.4137 | 897.7752 | 238.9347 | 459.8227 | 155.6830 |
| 664 | 24012 | AA957335 | 91.3098 | 1729.6850 | 410.6969 | 924.6174 | 229.0811 |
| 758 | 21757 | AI007656 | 91.1642 | 75.1816 | 6.6705 | 54.0852 | 17.9561 |
| 1345 | 16493 | AI177049 | 91.1123 | 149.5420 | 28.0005 | 224.4010 | 49.8893 |
| 914 | 18885 | AI029827 | 91.0603 | 147.5520 | 8.9873 | 117.6945 | 23.2465 |
| 1212 | 14525 | AI169512 | 90.9459 | 35.2680 | 6.0949 | 13.2939 | 9.0161 |
| 119 | 11901 | AA801058 | 90.8004 | 321.5218 | 26.4281 | 200.4564 | 94.9507 |
| 878 | 23444 | AI013448 | 90.8004 | 380.3160 | 32.3748 | 290.4801 | 51.9021 |
| 665 | 12529 | AA957362 | 90.8004 | 178.6648 | 13.5051 | 263.5560 | 77.6532 |
| 1070 | 9380 | AI072738 | 90.7900 | 28.9561 | 34.5402 | 181.8779 | 73.5947 |
| 1410 | 19828 | AI180087 | 90.7380 | 146.9447 | 22.3959 | 81.0911 | 27.0328 |
| 860 | 17489 | AI012566 | 90.6445 | 1017.3793 | 54.3100 | 1260.2779 | 224.7209 |
| 1563 | 4770 | AI235915 | 90.5925 | 190.6164 | 6.5190 | 172.1854 | 45.3478 |
| 1135 | 15416 | AI104340 | 90.5821 | 100.5402 | 25.4513 | 50.1430 | 23.0422 |
| 555 | 9942 | AA942697 | 90.5821 | 520.4679 | 58.6501 | 329.0809 | 80.4027 |
| 875 | 6758 | AI013394 | 90.4262 | 40.7626 | 12.4545 | 15.5272 | 11.1309 |
| 1043 | 9579 | AI071174 | 90.2703 | 73.0852 | 12.2775 | 30.0760 | 21.5387 |
| 731 | 6789 | AA998207 | 90.2183 | 690.1254 | 114.6606 | 463.6435 | 88.8137 |
| 1315 | 6686 | AI176130 | 90.1663 | 202.7423 | 35.4602 | 335.5334 | 59.0684 |
| 1178 | 18943 | AI137495 | 90.1143 | 248.4443 | 46.8046 | 150.0480 | 42.4641 |
| 1000 | 8110 | AI058665 | 89.9584 | 73.2159 | 13.8912 | 39.5861 | 15.8997 |
| 1273 | 6974 | AI172263 | 89.8649 | 439.9621 | 60.1488 | 672.7254 | 169.4559 |
| 1501 | 15173 | AI231846 | 89.8129 | 154.5984 | 25.7401 | 248.0312 | 62.7376 |

TABLE 5E

AMPHOTERICIN B
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 2499 | 363 | NM_080780 | 98.5522 | 95.3786 | 8.9412 | 44.7195 | 20.1520 |
| 73 | 13683 | AA799788 | 98.3971 | 113.7606 | 8.9316 | 196.8831 | 38.0878 |
| 1956 | 21975 | NM_017154 | 98.3454 | 394.7340 | 25.6138 | 180.4109 | 78.5368 |
| 2185 | 17765 | NM_024351 | 98.2937 | 2324.0066 | 177.5669 | 1391.8410 | 280.3635 |
| 26 | 6581 | AA799412 | 98.1386 | 52.0932 | 2.3469 | 87.0805 | 18.9598 |
| 2392 | 15829 | NM_053551 | 97.7766 | 364.9374 | 112.7083 | 49.3079 | 69.6881 |
| 349 | 17255 | AA891734 | 97.4147 | 112.8144 | 25.0925 | 50.9973 | 17.6989 |
| 2185 | 17764 | NM_024351 | 97.2596 | 3113.5854 | 275.4642 | 1942.2845 | 392.7246 |
| 1874 | 2005 | NM_013127 | 97.2596 | 101.5426 | 20.2833 | 40.1465 | 17.5466 |
| 15 | 25098 | AA108277 | 97.0010 | 59.0112 | 12.7713 | 15.8721 | 17.7194 |
| 2403 | 21445 | NM_053587 | 96.7942 | 83.5574 | 22.0419 | 10.5575 | 22.8185 |
| 1707 | 1466 | M14050 | 96.5357 | 801.7236 | 189.5122 | 447.2700 | 108.9977 |
| 2437 | 16173 | NM_053822 | 96.4840 | 71.5274 | 24.0334 | 13.4328 | 26.3857 |

TABLE 5E-continued

AMPHOTERICIN B
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 1699 | 24520 | L20869 | 96.4840 | 146.3410 | 37.4706 | 51.0250 | 39.2486 |
| 584 | 20795 | AA944397 | 96.3289 | 240.0478 | 37.8245 | 112.2033 | 63.6121 |
| 442 | 4541 | AA893612 | 96.0703 | 256.8396 | 28.7640 | 444.4358 | 105.5209 |
| 2561 | 1168 | NM_138898 | 96.0186 | 24.4684 | 6.3814 | 6.1080 | 6.5377 |
| 2370 | 1063 | NM_053328 | 95.9152 | 61.3382 | 11.7391 | 22.6010 | 13.9335 |
| 307 | 15888 | AA875225 | 95.8118 | 545.6914 | 33.0164 | 791.2888 | 146.0130 |
| 2676 | 16725 | X73371 | 95.5016 | 26.3318 | 3.1236 | 14.6195 | 8.6242 |
| 2542 | 1530 | NM_134397 | 95.2947 | 134.4930 | 4.7830 | 193.4364 | 41.9915 |
| 6 | 1808 | AI014135 | 95.0879 | 260.5106 | 50.7959 | 95.4451 | 156.3507 |
| 2479 | 23307 | NM_057119 | 94.9845 | 105.8904 | 5.7454 | 68.7553 | 19.9460 |
| 353 | 18269 | AA891769 | 94.8811 | 186.7768 | 10.2046 | 265.5162 | 47.3855 |
| 2008 | 15037 | NM_017347 | 94.8811 | 88.3486 | 75.2186 | 250.9847 | 68.1165 |
| 1797 | 18135 | NM_012791 | 94.7260 | 205.3204 | 27.7518 | 138.8598 | 28.3593 |
| 2235 | 12638 | NM_031099 | 94.7260 | 52.7372 | 4.9146 | 31.4438 | 13.4629 |
| 2371 | 14927 | NM_053330 | 94.7260 | 86.6624 | 5.9265 | 58.9483 | 26.4175 |
| 92 | 4832 | AA800190 | 94.6743 | 622.8410 | 30.7624 | 878.0888 | 210.5414 |
| 2603 | 18647 | S69316 | 94.6225 | 299.1670 | 48.9037 | 173.8138 | 53.7113 |
| 2359 | 12364 | NM_033351 | 94.3123 | 88.0436 | 10.9307 | 150.4199 | 39.8522 |
| 60 | 20982 | AA799657 | 94.2606 | 128.8742 | 22.8767 | 221.8559 | 50.8029 |
| 1698 | 6963 | L18889 | 94.2089 | 284.6574 | 21.5556 | 177.3548 | 55.0450 |
| 1858 | 14997 | NM_013059 | 94.0538 | 532.5096 | 26.2041 | 745.6824 | 155.8938 |
| 2007 | 17782 | NM_017344 | 94.0021 | 212.7698 | 5.1155 | 262.7259 | 45.9986 |
| 68 | 4133 | AA799762 | 93.9504 | 69.4434 | 7.0420 | 103.9600 | 20.9691 |
| 2286 | 18316 | NM_031561 | 93.8469 | 1812.8340 | 67.9489 | 1337.5132 | 363.5887 |
| 2140 | 21076 | NM_022584 | 93.8469 | 126.1870 | 2.2627 | 122.7885 | 28.6879 |
| 1777 | 4003 | NM_012708 | 93.7435 | 156.9270 | 23.7070 | 105.5632 | 36.6164 |
| 1936 | 10888 | NM_017094 | 93.7435 | 72.2890 | 4.9749 | 52.5194 | 31.1627 |
| 85 | 16712 | AA800015 | 93.6401 | 270.7052 | 24.4385 | 378.4982 | 64.2954 |
| 340 | 11949 | AA891580 | 93.6401 | 47.0104 | 2.6055 | 32.8307 | 10.4141 |
| 1779 | 20889 | NM_012716 | 93.5884 | 446.4512 | 48.3340 | 289.2922 | 81.5171 |
| 1730 | 25470 | M95791 | 93.4850 | 145.7756 | 6.8738 | 103.1022 | 50.4424 |
| 2563 | 11840 | NM_138911 | 93.4333 | 99.4078 | 18.4037 | 67.5322 | 17.1482 |
| 31 | 18160 | AA799448 | 93.2782 | 1544.5864 | 208.8434 | 2365.1941 | 472.0023 |
| 2286 | 18315 | NM_031561 | 93.1748 | 1659.1842 | 92.4979 | 1137.8314 | 341.4328 |
| 2248 | 23568 | NM_031122 | 93.1231 | 56.3398 | 3.6719 | 39.6928 | 10.9466 |
| 35 | 8289 | AA799494 | 93.0714 | 54.4228 | 6.8826 | 100.8121 | 37.8497 |
| 390 | 9254 | AA892470 | 93.0714 | 192.8216 | 8.2676 | 252.4518 | 48.2105 |
| 2585 | 22972 | NM_145778 | 93.0196 | 73.0742 | 1.3045 | 61.4735 | 15.6494 |
| 294 | 16319 | AA875047 | 92.9679 | 51.1142 | 16.3777 | 22.3746 | 14.1136 |
| 1898 | 23362 | NM_013216 | 92.9679 | 426.0204 | 17.3942 | 343.4339 | 62.4496 |
| 2359 | 12365 | NM_033351 | 92.9162 | 290.6726 | 24.7316 | 415.2956 | 75.0078 |
| 2004 | 24248 | NM_017332 | 92.8645 | 44.7288 | 2.5973 | 84.7763 | 130.0657 |
| 2520 | 10660 | NM_133423 | 92.8128 | 103.7266 | 10.7389 | 68.1244 | 17.6433 |
| 385 | 3474 | AA892378 | 92.8128 | 412.6048 | 20.7951 | 562.5296 | 105.3201 |
| 430 | 3879 | AA893237 | 92.7611 | 62.0656 | 33.4228 | 143.3410 | 47.3596 |
| 1880 | 21683 | NM_013154 | 92.7611 | 71.7498 | 9.5771 | 49.1710 | 36.4277 |
| 2479 | 23310 | NM_057119 | 92.7611 | 111.5548 | 6.3510 | 79.1597 | 28.4913 |
| 39 | 16942 | AA799520 | 92.7611 | 1147.5794 | 59.7372 | 1474.2555 | 240.6343 |
| 2342 | 8661 | NM_031971 | 92.7094 | 46.7326 | 22.0667 | 12.0085 | 69.6966 |
| 1318 | 6782 | AI176170 | 92.7094 | 532.9708 | 37.1082 | 386.4038 | 89.6160 |
| 1399 | 15438 | AI179399 | 92.7094 | 243.1736 | 4.7951 | 237.9922 | 63.3389 |
| 1779 | 20888 | NM_012716 | 92.6577 | 761.7078 | 90.3406 | 492.1469 | 133.0403 |
| 307 | 15887 | AA875225 | 92.3992 | 445.4306 | 32.0721 | 735.9139 | 265.1712 |
| 1638 | 25997 | AI639452 | 92.3475 | 35.7280 | 2.7572 | 21.6537 | 9.8626 |
| 103 | 6892 | AA800551 | 92.2958 | 109.7348 | 24.9276 | 68.1920 | 36.0660 |
| 1679 | 16524 | H33219 | 92.1406 | 26.0014 | 0.6163 | 24.0262 | 6.6033 |
| 2126 | 162 | NM_022516 | 91.9338 | 72.0436 | 6.2772 | 42.2120 | 23.7190 |
| 2380 | 14621 | NM_053437 | 91.9338 | 133.9782 | 5.3673 | 169.1670 | 37.0095 |
| 385 | 3473 | AA892378 | 91.9338 | 110.2048 | 7.6062 | 151.5009 | 31.2498 |
| 1204 | 21523 | AI169104 | 91.8821 | 84.9384 | 49.7825 | 190.7646 | 64.7551 |
| 341 | 11950 | AA891595 | 91.7270 | 76.9350 | 19.8714 | 36.5774 | 18.9318 |
| 342 | 4447 | AA891596 | 91.7270 | 41.4458 | 5.2281 | 22.4024 | 11.6597 |
| 1628 | 17083 | AI639255 | 91.7270 | 64.1218 | 2.3053 | 68.1787 | 24.9963 |
| 1423 | 22845 | AI227887 | 91.7270 | 656.6956 | 10.3788 | 665.3096 | 137.0397 |
| 2444 | 1571 | NM_053857 | 91.6753 | 220.1688 | 11.2160 | 172.4479 | 54.2278 |
| 1797 | 24113 | NM_012791 | 91.5719 | 31.8484 | 9.3282 | 10.0764 | 12.6795 |
| 2442 | 1011 | NM_053851 | 91.5719 | 24.4862 | 1.0211 | 20.7041 | 10.9071 |
| 1702 | 13682 | L38482 | 91.5202 | 151.1948 | 22.7722 | 289.9873 | 111.5601 |
| 2114 | 23705 | NM_022396 | 91.5202 | 195.9970 | 10.0343 | 265.2100 | 68.8168 |
| 1946 | 167 | NM_017131 | 91.4685 | 926.7020 | 100.1165 | 583.3957 | 174.4638 |
| 7 | 14981 | AI103396 | 91.4685 | 6611.0257 | 235.5070 | 6602.9446 | 2802.3734 |
| 2144 | 20960 | NM_022598 | 91.4168 | 695.7130 | 40.8447 | 521.5618 | 116.5608 |
| 2264 | 239 | NM_031152 | 91.4168 | 196.8380 | 5.6170 | 165.2513 | 98.8622 |

TABLE 5E-continued

AMPHOTERICIN B
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 1792 | 17257 | NM_012766 | 91.3650 | 237.8380 | 26.6343 | 365.0675 | 115.5430 |
| 2260 | 1638 | NM_031143 | 91.3650 | 97.1086 | 11.0557 | 152.8822 | 49.9046 |
| 1677 | 6980 | H33001 | 91.3133 | 86.7840 | 16.2914 | 148.3850 | 43.1784 |
| 747 | 1097 | AF016296 | 91.3133 | 189.8588 | 26.8178 | 303.5643 | 100.0578 |
| 2365 | 1311 | NM_053291 | 91.3133 | 50.1778 | 2.7926 | 34.6061 | 14.6630 |
| 1979 | 20484 | NM_017240 | 91.2616 | 6292.0150 | 199.9022 | 6403.6069 | 2308.2101 |
| 17 | 25104 | AA685903 | 91.2099 | 346.4496 | 54.9456 | 173.4618 | 89.9549 |
| 2624 | 21654 | U53184 | 91.2099 | 244.6286 | 15.9412 | 204.8756 | 76.0734 |
| 1697 | 25371 | L17077 | 91.2099 | 100.7812 | 3.4622 | 93.1960 | 36.5943 |
| 1640 | 22763 | AI639474 | 91.1582 | 65.3412 | 9.0858 | 40.9351 | 12.9578 |
| 1791 | 18068 | NM_012762 | 91.1582 | 104.6786 | 6.5163 | 83.3030 | 14.9982 |
| 1953 | 13392 | NM_017148 | 91.0548 | 152.4578 | 10.2255 | 201.4157 | 39.0008 |
| 2138 | 9541 | NM_022542 | 91.0548 | 488.1294 | 15.4711 | 403.9521 | 109.5222 |
| 55 | 18333 | AA799614 | 90.9514 | 173.1502 | 14.7010 | 228.8726 | 46.5199 |
| 472 | 4636 | AA899491 | 99.3795 | 467.8500 | 242.2832 | 131.1787 | 56.8828 |
| 633 | 22042 | AA946476 | 98.9659 | 339.3684 | 75.1597 | 100.0167 | 61.0272 |
| 1339 | 21740 | AI176810 | 98.0352 | 456.0868 | 33.4311 | 276.7652 | 87.8126 |
| 1279 | 4278 | AI172304 | 98.0352 | 88.0498 | 8.5371 | 42.2011 | 20.3576 |
| 1280 | 11702 | AI172305 | 97.8800 | 341.7226 | 106.4546 | 133.7083 | 46.9314 |
| 970 | 5615 | AI044861 | 97.8283 | 106.7826 | 21.8574 | 38.5771 | 17.6661 |
| 825 | 24089 | AI010865 | 97.7249 | 637.6374 | 199.6779 | 214.0869 | 97.2781 |
| 1227 | 2729 | AI170363 | 97.6215 | 217.5804 | 28.4467 | 480.5092 | 152.3810 |
| 534 | 18271 | AA925267 | 97.4664 | 1192.3508 | 147.8088 | 425.4314 | 237.7902 |
| 20 | 18272 | AA799294 | 97.3113 | 311.4518 | 36.7572 | 111.1531 | 64.3494 |
| 1251 | 14117 | AI171350 | 97.3113 | 797.5784 | 46.3252 | 1161.1975 | 224.4091 |
| 1155 | 2539 | AI111960 | 97.1562 | 117.4486 | 21.7002 | 20.8249 | 28.9708 |
| 2317 | 24081 | NM_031708 | 97.0527 | −62.7924 | 31.5162 | 90.4001 | 56.9056 |
| 2390 | 14380 | NM_053536 | 96.9493 | 504.6868 | 7.6012 | 390.4853 | 119.3580 |
| 526 | 5030 | AA924802 | 96.8976 | 82.5804 | 8.5740 | 42.2192 | 16.3994 |
| 1261 | 2795 | AI171655 | 96.6391 | 298.0746 | 45.1563 | 168.7500 | 44.6439 |
| 1089 | 6640 | AI101500 | 96.4323 | 305.9566 | 6.6347 | 226.6775 | 61.7066 |
| 135 | 1802 | AA817841 | 96.3806 | 236.6206 | 22.6923 | 153.6587 | 39.9967 |
| 710 | 3003 | AA997330 | 96.2771 | 246.2542 | 50.4901 | 71.2325 | 64.2714 |
| 872 | 1332 | AI013222 | 96.1220 | 228.1560 | 31.2654 | 429.7260 | 110.6224 |
| 559 | 23005 | AA942770 | 96.0703 | 175.9890 | 33.8935 | 95.2413 | 68.9262 |
| 1168 | 13080 | AI136842 | 95.7084 | 85.6216 | 26.0184 | 15.9478 | 28.1747 |
| 1085 | 4027 | AI101330 | 95.7084 | 48.1146 | 7.9320 | 93.0816 | 38.4976 |
| 1282 | 23390 | AI172328 | 95.6050 | 470.7924 | 49.6561 | 330.5827 | 66.6283 |
| 137 | 1998 | AA817864 | 95.6050 | 76.4118 | 10.4035 | 39.4215 | 33.8250 |
| 1105 | 22487 | AI102578 | 95.5533 | 44.6356 | 7.2312 | 20.8012 | 10.6784 |
| 759 | 9976 | AI007744 | 95.4498 | 382.7352 | 36.1940 | 643.5721 | 171.4413 |
| 650 | 23409 | AA956294 | 95.2430 | 313.2406 | 29.4152 | 662.0116 | 240.1169 |
| 1104 | 11563 | AI102560 | 95.0879 | 265.1508 | 85.7612 | 116.7885 | 54.9933 |
| 204 | 19545 | AA850735 | 95.0879 | 299.6418 | 25.9007 | 186.3541 | 56.9413 |
| 886 | 3445 | AI013724 | 95.0362 | 60.3296 | 5.0442 | 105.8003 | 33.8827 |
| 219 | 19136 | AA851788 | 94.9845 | 296.3566 | 7.5037 | 198.4383 | 69.3125 |
| 2197 | 13633 | NM_024403 | 94.9328 | 481.7274 | 37.8149 | 343.6374 | 114.7507 |
| 217 | 21713 | AA851637 | 94.8811 | 557.4628 | 59.8614 | 871.3903 | 177.2559 |
| 1266 | 22239 | AI171982 | 94.7777 | 519.4526 | 7.8441 | 468.5614 | 146.5563 |
| 1509 | 14031 | AI232295 | 94.7777 | 32.1638 | 4.9841 | 17.2851 | 14.4646 |
| 220 | 12187 | AA851820 | 94.7777 | 107.6768 | 8.7988 | 43.0391 | 42.0097 |
| 983 | 2662 | AI045686 | 94.7260 | 35.5306 | 2.4043 | 58.1739 | 31.4068 |
| 856 | 22651 | AI012434 | 94.6743 | 1021.8184 | 82.2183 | 718.8303 | 160.0003 |
| 836 | 4350 | AI011644 | 94.6743 | 189.4486 | 40.1721 | 454.7927 | 165.5004 |
| 2418 | 2063 | NM_053682 | 94.5708 | 259.2196 | 24.3214 | 180.7968 | 39.3014 |
| 602 | 22283 | AA945172 | 94.5708 | 232.8566 | 51.7414 | 116.3481 | 45.1469 |
| 819 | 23857 | AI010616 | 94.4157 | 85.9380 | 1.3338 | 86.3077 | 26.8114 |
| 783 | 22801 | AI009197 | 94.4157 | 412.0660 | 27.0817 | 581.3531 | 107.7824 |
| 641 | 12928 | AA955564 | 94.3640 | 639.0730 | 34.3105 | 870.5713 | 154.9074 |
| 127 | 16388 | AA801310 | 94.2606 | 78.9200 | 3.6489 | 54.1389 | 35.0319 |
| 1006 | 8539 | AI059175 | 94.1572 | 33.9334 | 5.6627 | 71.6343 | 28.8032 |
| 481 | 18890 | AA899964 | 94.1055 | 511.3890 | 58.1729 | 834.1214 | 206.9359 |
| 1412 | 5482 | AI180252 | 94.0538 | 152.1414 | 16.7076 | 261.6230 | 74.9412 |
| 523 | 18891 | AA924598 | 94.0538 | 190.5174 | 36.4661 | 330.1107 | 82.2822 |
| 907 | 12387 | AI029051 | 94.0021 | 137.1570 | 27.5767 | 72.2882 | 27.0901 |
| 530 | 168 | AA924985 | 94.0021 | 3581.2472 | 233.5294 | 2629.7285 | 522.3154 |
| 1398 | 13029 | AI179391 | 93.8987 | 349.4770 | 49.3092 | 202.0514 | 85.9922 |
| 916 | 10658 | AI030028 | 93.8987 | 550.8180 | 120.3156 | 1363.6323 | 875.3128 |
| 1111 | 18916 | AI102819 | 93.7435 | 450.5048 | 105.1152 | 245.5299 | 86.3405 |
| 131 | 18796 | AA817761 | 93.7435 | 32.7492 | 3.3795 | 9.1513 | 22.1154 |
| 711 | 21942 | AA997341 | 93.7435 | 2122.6678 | 364.4996 | 1379.6582 | 346.2585 |

TABLE 5E-continued

AMPHOTERICIN B
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 827 | 18438 | AI010930 | 93.7435 | 706.7616 | 60.4604 | 471.0373 | 122.2648 |
| 569 | 22218 | AA943409 | 93.6401 | 59.8046 | 9.9566 | 114.3250 | 40.0403 |

TABLE 5F

BI
Timepoint(s): 168, 336 hrs

| SEQ ID | GLGC ID | GenBank Accession No. | LDA Score | Mean Tox | SD Tox | Mean Nontox | SD Nontox |
|---|---|---|---|---|---|---|---|
| 2422 | 15269 | NM_053739 | 99.1192 | 143.8120 | 5.7662 | 234.9980 | 46.1245 |
| 1711 | 16427 | M21354 | 98.9119 | 293.9709 | 76.0378 | 1283.4863 | 347.5147 |
| 2696 | 15570 | Z78279 | 98.7047 | 177.3863 | 33.8858 | 624.5648 | 205.6038 |
| 1485 | 15572 | AI231472 | 98.6528 | 258.6041 | 46.1393 | 1039.6946 | 421.1834 |
| 1655 | 18018 | D12771 | 98.3938 | 570.0360 | 50.5394 | 915.5382 | 131.1932 |
| 1739 | 4467 | NM_012529 | 98.2383 | 316.5336 | 74.2216 | 868.8061 | 273.1092 |
| 2029 | 17063 | NM_019170 | 97.9793 | 190.2210 | 73.2469 | 62.1965 | 24.2742 |
| 2486 | 15409 | NM_057197 | 97.8756 | 1357.7633 | 248.1126 | 526.2359 | 158.9371 |
| 1356 | 14989 | AI177366 | 97.8756 | 425.8114 | 34.0340 | 731.4218 | 156.3189 |
| 93 | 16420 | AA800191 | 97.8238 | 217.8023 | 16.7923 | 328.5433 | 49.3070 |
| 2025 | 6451 | NM_019153 | 97.8238 | 71.3897 | 11.3390 | 161.7444 | 46.7828 |
| 2029 | 17064 | NM_019170 | 97.7202 | 130.5931 | 54.8801 | 44.3384 | 18.6413 |
| 1740 | 11115 | NM_012531 | 97.4093 | 72.2707 | 15.0501 | 0.3074 | 22.2583 |
| 2647 | 19244 | X15013 | 97.3057 | 2814.2426 | 322.2026 | 1805.7654 | 295.1347 |
| 267 | 15884 | AA866276 | 97.2539 | 422.5439 | 22.9208 | 23.9240 | 187.2425 |
| 2486 | 15408 | NM_057197 | 97.2021 | 525.5060 | 96.4312 | 264.8164 | 76.4260 |
| 2120 | 4259 | NM_022504 | 96.9430 | 1589.8659 | 190.8676 | 1025.3792 | 173.3154 |
| 2669 | 16780 | X62660 | 96.8912 | 132.2681 | 14.2080 | 70.4168 | 19.8154 |
| 2241 | 20807 | NM_031106 | 96.8912 | 2241.1979 | 298.0859 | 1305.3610 | 278.8448 |
| 2671 | 20844 | X65228 | 96.8912 | 2864.5389 | 435.1075 | 1576.0314 | 350.9617 |
| 105 | 4843 | AA800651 | 96.7876 | 291.0541 | 19.8623 | 433.1671 | 72.7306 |
| 2472 | 23250 | NM_057097 | 96.6839 | 183.6347 | 12.5762 | 249.1065 | 35.0313 |
| 41 | 17688 | AA799531 | 96.5285 | 104.5840 | 4.9652 | 153.8945 | 29.2358 |
| 1781 | 25563 | NM_012732 | 96.4767 | 290.8960 | 20.1097 | 451.4426 | 96.7035 |
| 448 | 22731 | AA893743 | 96.4249 | 346.8796 | 16.1784 | 509.2853 | 93.2138 |
| 2647 | 25679 | X15013 | 96.4249 | 2129.1789 | 260.7942 | 1410.0568 | 268.2938 |
| 49 | 17712 | AA799598 | 96.4249 | 1109.7723 | 136.2022 | 1728.1144 | 289.9941 |
| 2166 | 18107 | NM_022949 | 96.1658 | 702.3460 | 107.3752 | 412.5137 | 101.4433 |
| 413 | 7148 | AA892842 | 96.1658 | 200.7584 | 19.5780 | 307.2611 | 61.5694 |
| 1599 | 9501 | AI638949 | 96.1140 | 184.4760 | 22.5023 | 118.2863 | 22.9688 |
| 2035 | 18573 | NM_019201 | 96.1140 | 240.8931 | 12.9388 | 340.8501 | 59.9261 |
| 2057 | 17507 | NM_019299 | 96.1140 | 231.2563 | 37.7161 | 440.2135 | 233.0538 |
| 2067 | 1324 | NM_019371 | 96.0622 | 330.9949 | 70.2060 | 605.9855 | 116.1673 |
| 2269 | 4235 | NM_031330 | 96.0622 | 201.4274 | 20.5710 | 326.0595 | 67.8226 |
| 2152 | 17729 | NM_022697 | 95.9585 | 1997.6343 | 242.8843 | 1321.3071 | 222.1143 |
| 2190 | 15622 | NM_024369 | 95.9585 | 70.8847 | 27.2907 | 222.8664 | 74.5699 |
| 1941 | 20745 | NM_017113 | 95.8031 | 238.6544 | 25.7200 | 358.9398 | 58.0826 |
| 1871 | 23709 | NM_013113 | 95.8031 | 800.6951 | 103.7246 | 1254.5985 | 283.8660 |
| 1740 | 11116 | NM_012531 | 95.5959 | 183.2179 | 22.4486 | 36.4703 | 57.4160 |
| 2315 | 16204 | NM_031706 | 95.5959 | 1805.7873 | 167.8985 | 1271.9758 | 199.9240 |
| 2125 | 2697 | NM_022515 | 95.5440 | 3434.9464 | 560.8371 | 2244.3433 | 399.1160 |
| 2614 | 15462 | U06230 | 95.5440 | 35.9110 | 6.6465 | 75.7932 | 21.5556 |
| 2316 | 18054 | NM_031707 | 95.4922 | 65.8467 | 8.7215 | 126.5834 | 31.3531 |
| 75 | 14504 | AA799804 | 95.4922 | 281.8043 | 46.7470 | 529.6716 | 116.9672 |
| 1705 | 20630 | M13100 | 95.4922 | 726.8354 | 195.8009 | 344.2470 | 142.6618 |
| 19 | 19222 | AA799279 | 95.3886 | 743.1596 | 63.3540 | 1114.0604 | 186.0991 |
| 1961 | 17301 | NM_017173 | 95.2850 | 210.4029 | 40.2492 | 503.6307 | 155.1346 |
| 2349 | 19768 | NM_031986 | 95.2850 | 565.7791 | 47.6790 | 797.6082 | 121.6587 |
| 355 | 21672 | AA891789 | 95.2332 | 216.0100 | 29.2689 | 375.5837 | 81.6117 |
| 2645 | 20810 | X14181 | 95.2332 | 3040.8551 | 331.0841 | 2016.2404 | 403.9704 |
| 1653 | 5050 | D10655 | 95.2332 | 272.5644 | 48.9227 | 517.4997 | 119.5573 |
| 2270 | 18539 | NM_031353 | 95.2332 | 282.9924 | 41.5679 | 560.5237 | 195.9350 |
| 384 | 15492 | AA892376 | 95.0777 | 198.7870 | 14.7025 | 318.2605 | 69.2163 |
| 2148 | 24564 | NM_022676 | 95.0777 | 128.0414 | 14.8501 | 183.3015 | 21.4082 |
| 239 | 23142 | AA859479 | 94.9741 | 38.8103 | 15.7196 | 17.5146 | 8.7629 |
| 1904 | 18305 | NM_013226 | 94.9223 | 3321.3837 | 543.0109 | 2110.6323 | 457.9468 |
| 1725 | 10744 | M64780 | 94.8187 | 76.7056 | 11.9271 | 179.7331 | 57.0739 |
| 429 | 4243 | AA893217 | 94.8187 | 51.3371 | 7.6677 | 93.8936 | 27.3483 |
| 2436 | 20421 | NM_053821 | 94.7668 | 55.9446 | 5.1641 | 86.7888 | 18.2928 |

TABLE 5F-continued

BI
Timepoint(s): 168, 336 hrs

| SEQ ID | GLGC ID | GenBank Accession No. | LDA Score | Mean Tox | SD Tox | Mean Nontox | SD Nontox |
|---|---|---|---|---|---|---|---|
| 1813 | 17306 | NM_012876 | 94.7150 | 7304.2837 | 1238.4613 | 4648.0647 | 1089.5899 |
| 1706 | 25399 | M13101 | 94.7150 | 506.0113 | 135.7842 | 216.0530 | 114.9393 |
| 1659 | 16610 | D28557 | 94.7150 | 427.9930 | 57.2292 | 756.9338 | 181.2608 |
| 1795 | 450 | NM_012786 | 94.6114 | 5628.8407 | 997.6780 | 3736.9132 | 767.6875 |
| 427 | 17731 | AA893194 | 94.5596 | 167.9773 | 24.2283 | 86.0909 | 43.6820 |
| 407 | 4517 | AA892642 | 94.5078 | 33.0951 | 3.7148 | 65.2515 | 21.2361 |
| 754 | 21957 | AF087437 | 94.4560 | 172.8843 | 14.1950 | 243.8138 | 43.1393 |
| 376 | 20917 | AA892238 | 94.4041 | 69.7076 | 13.0813 | 127.3824 | 31.0256 |
| 286 | 15116 | AA874928 | 94.3523 | 50.5716 | 5.5540 | 82.9210 | 19.4452 |
| 72 | 6425 | AA799784 | 94.3005 | 102.3871 | 19.7933 | 171.8848 | 36.8257 |
| 412 | 11997 | AA892828 | 94.0415 | 414.8107 | 87.2466 | 678.7777 | 122.3944 |
| 361 | 19319 | AA891937 | 94.0415 | 65.5060 | 4.3582 | 93.1397 | 20.9083 |
| 1689 | 17136 | J04035 | 93.9896 | 98.7824 | 42.6359 | 523.0232 | 369.9840 |
| 391 | 11992 | AA892485 | 93.8860 | 141.6666 | 19.0249 | 254.9445 | 70.6907 |
| 2446 | 11405 | NM_053866 | 93.8860 | 28.9459 | 2.4888 | 44.7777 | 10.6440 |
| 1648 | 7602 | AJ001929 | 93.7306 | 367.7629 | 42.0093 | 527.9297 | 87.0690 |
| 1843 | 24263 | NM_012999 | 93.6269 | 0.6497 | 12.9179 | 46.8636 | 23.7843 |
| 88 | 11352 | AA800036 | 93.5233 | 195.3599 | 21.5531 | 302.1285 | 63.2262 |
| 2327 | 16178 | NM_031785 | 93.4715 | 208.3697 | 21.0391 | 295.5385 | 48.8193 |
| 2232 | 15202 | NM_031093 | 93.4197 | 1737.1439 | 249.5668 | 1014.0869 | 354.9850 |
| 2300 | 14957 | NM_031622 | 93.4197 | 61.9469 | 12.0382 | 110.9589 | 25.2231 |
| 2179 | 17517 | NM_024151 | 93.3679 | 177.5686 | 26.8054 | 285.1725 | 56.4452 |
| 1867 | 8899 | NM_013087 | 93.3161 | 607.7543 | 71.7051 | 890.1090 | 150.3611 |
| 2037 | 18569 | NM_019212 | 93.3161 | 639.0183 | 226.0855 | 1610.4958 | 609.7234 |
| 2141 | 21063 | NM_022585 | 93.2642 | 80.9499 | 13.0064 | 139.6931 | 42.6657 |
| 2686 | 18031 | X94551 | 93.1606 | 211.9716 | 31.3364 | 388.4117 | 96.7759 |
| 13 | 25120 | A03913 | 93.1088 | 39.7119 | 10.6457 | 78.4173 | 20.9471 |
| 1889 | 1314 | NM_013181 | 93.1088 | 444.5903 | 54.8862 | 660.5187 | 118.3773 |
| 2397 | 21940 | NM_053568 | 93.0570 | 63.2817 | 8.9608 | 115.0101 | 32.7113 |
| 2237 | 23854 | NM_031101 | 93.0052 | 1073.0710 | 186.4309 | 708.7255 | 172.2717 |
| 2105 | 17158 | NM_022298 | 93.0052 | 434.7516 | 56.7880 | 746.7869 | 209.7555 |
| 440 | 22891 | AA893581 | 92.9534 | 93.1706 | 5.2413 | 112.8740 | 28.6200 |
| 2045 | 21108 | NM_019243 | 92.9534 | 4.3739 | 4.9960 | 26.9621 | 13.4671 |
| 2297 | 11296 | NM_031606 | 92.9016 | 22.9944 | 8.0878 | 47.6528 | 13.3005 |
| 2439 | 16099 | NM_053837 | 92.9016 | 324.4046 | 32.7306 | 430.8522 | 62.0822 |
| 468 | 3910 | AA894345 | 92.9016 | 94.1221 | 12.6656 | 145.7204 | 35.2619 |
| 2376 | 25184 | NM_053356 | 92.8497 | 6.6997 | 8.9605 | 37.3945 | 16.6925 |
| 1744 | 1762 | NM_012543 | 92.8497 | 48.8919 | 10.4947 | 61.6225 | 74.3424 |
| 2662 | 17176 | X60212 | 92.7979 | 4333.4994 | 629.4033 | 2685.8048 | 801.1528 |
| 1926 | 1942 | NM_017061 | 92.7979 | 4.4739 | 4.1363 | 45.8718 | 33.3684 |
| 1657 | 25041 | D14014 | 92.7461 | 79.9310 | 17.4453 | 154.7853 | 45.1670 |
| 233 | 6158 | AA859284 | 99.0155 | 148.6926 | 39.9027 | 709.5511 | 245.4852 |
| 1332 | 22716 | AI176500 | 98.9119 | 36.5181 | 8.5602 | 173.9637 | 67.4242 |
| 1310 | 2046 | AI176004 | 97.9275 | 47.7550 | 10.7271 | 138.1307 | 44.9137 |
| 1314 | 4585 | AI176121 | 97.8238 | 2159.8191 | 200.3457 | 1318.4097 | 247.8512 |
| 222 | 15260 | AA858518 | 97.8238 | 656.9087 | 60.8892 | 376.9953 | 93.6401 |
| 941 | 18915 | AI043798 | 97.8238 | 398.7401 | 70.5634 | 954.6520 | 267.1831 |
| 824 | 6984 | AI010848 | 97.7202 | 500.2131 | 65.2292 | 216.7627 | 79.0802 |
| 1462 | 9412 | AI230691 | 97.4611 | 169.6379 | 42.7022 | 46.2183 | 51.4983 |
| 1587 | 18151 | AI237212 | 97.3057 | 559.5641 | 76.8065 | 329.0736 | 68.4657 |
| 1130 | 26213 | AI104113 | 96.9948 | 1580.0974 | 522.2003 | 577.7325 | 256.1040 |
| 2376 | 6154 | NM_053356 | 96.9948 | 319.6549 | 207.7988 | 1576.8974 | 653.0310 |
| 643 | 5111 | AA955729 | 96.9948 | 136.3579 | 16.9041 | 365.5307 | 127.5558 |
| 775 | 18125 | AI008787 | 96.9948 | 189.1237 | 21.4034 | 301.4020 | 62.3747 |
| 1397 | 19783 | AI179388 | 96.8912 | 989.0276 | 159.3433 | 599.8644 | 106.5752 |
| 2376 | 6157 | NM_053356 | 96.8912 | 842.2940 | 210.1032 | 2306.7073 | 831.1001 |
| 1466 | 22387 | AI230753 | 96.7358 | 1315.2459 | 88.4913 | 912.7375 | 160.7472 |
| 1593 | 18854 | AI237636 | 96.5803 | 71.1124 | 18.6730 | 192.2503 | 50.5585 |

TABLE 5G

BI--Core Tox Markers
Timepoint(s): 168, 336 hrs

| SEQ ID | GLGC ID | GenBank Accession No. | LDA Score | Mean Tox | SD Tox | Mean Nontox | SD Nontox |
|---|---|---|---|---|---|---|---|
| 2631 | 25632 | U75405 | 99.3264 | 332.5001 | 83.9413 | 1452.4351 | 453.8814 |
| 1713 | 15571 | M27207 | 99.3264 | 344.0104 | 78.5418 | 1439.4661 | 471.6357 |

TABLE 5G-continued

BI--Core Tox Markers
Timepoint(s): 168, 336 hrs

| SEQ ID | GLGC ID | GenBank Accession No. | LDA Score | Mean Tox | SD Tox | Mean Nontox | SD Nontox |
|---|---|---|---|---|---|---|---|
| 252 | 22385 | AA859805 | 99.2746 | 26.5514 | 7.3273 | 150.1247 | 70.4763 |
| 2422 | 15269 | NM_053739 | 99.1192 | 143.8120 | 5.7662 | 234.9980 | 46.1245 |
| 1711 | 16427 | M21354 | 98.9119 | 293.9709 | 76.0378 | 1283.4863 | 347.5147 |
| 2 | 6153 | AA875531 | 98.9119 | 150.6609 | 30.1435 | 624.8155 | 220.2539 |
| 2674 | 16426 | X70369 | 98.8601 | 445.4373 | 127.9431 | 1680.7222 | 492.3771 |
| 2696 | 15569 | Z78279 | 98.8601 | 79.5913 | 23.8286 | 453.5891 | 185.8575 |
| 2696 | 15570 | Z78279 | 98.7047 | 177.3863 | 33.8858 | 624.5648 | 205.6038 |
| 1399 | 15438 | AI179399 | 98.7047 | 78.9779 | 17.4427 | 239.1726 | 61.9151 |
| 1485 | 15572 | AI231472 | 98.6528 | 258.6041 | 46.1393 | 1039.6946 | 421.1834 |
| 2465 | 17739 | NM_053995 | 98.6528 | 15.4303 | 9.4566 | 103.6351 | 45.2012 |
| 99 | 4130 | AA800298 | 98.4974 | 61.2480 | 21.2773 | 243.1962 | 73.8824 |
| 1655 | 18018 | D12771 | 98.3938 | 570.0360 | 50.5394 | 915.5382 | 131.1932 |
| 1979 | 20482 | NM_017240 | 98.2383 | 6403.8013 | 1409.8117 | 1600.0454 | 881.6389 |
| 1739 | 4467 | NM_012529 | 98.2383 | 316.5336 | 74.2216 | 868.8061 | 273.1092 |
| 2482 | 2413 | NM_057141 | 98.0829 | 393.6166 | 25.8964 | 628.0039 | 103.0437 |
| 2029 | 17063 | NM_019170 | 97.9793 | 190.2210 | 73.2469 | 62.1965 | 24.2742 |
| 2646 | 18541 | X14671 | 97.9275 | 2922.2450 | 346.1391 | 1704.9167 | 296.4814 |
| 2659 | 25702 | X58465 | 97.9275 | 1261.0071 | 209.6912 | 715.4030 | 124.5918 |
| 2486 | 15409 | NM_057197 | 97.8756 | 1357.7633 | 248.1126 | 526.2359 | 158.9371 |
| 1356 | 14989 | AI177366 | 97.8756 | 425.8114 | 34.0340 | 731.4218 | 156.3189 |
| 93 | 16420 | AA800191 | 97.8238 | 217.8023 | 16.7923 | 328.5433 | 49.3070 |
| 111 | 8137 | AA800749 | 97.8238 | 168.5100 | 14.2689 | 307.4580 | 67.1326 |
| 2025 | 6451 | NM_019153 | 97.8238 | 71.3897 | 11.3390 | 161.7444 | 46.7828 |
| 1739 | 4468 | NM_012529 | 97.8238 | 87.6101 | 25.7620 | 262.8633 | 84.0179 |
| 2029 | 17064 | NM_019170 | 97.7202 | 130.5931 | 54.8801 | 44.3384 | 18.6413 |
| 1695 | 25354 | L13025 | 97.7202 | 20.4040 | 4.4352 | −11.0156 | 14.5137 |
| 1653 | 5049 | D10655 | 97.6166 | 363.0054 | 70.0509 | 739.1010 | 168.4697 |
| 1716 | 26030 | M34331 | 97.5648 | 2307.6020 | 329.0437 | 1120.6411 | 311.6302 |
| 2239 | 16938 | NM_031103 | 97.4611 | 3439.4409 | 525.2792 | 2017.9291 | 347.7134 |
| 41 | 17687 | AA799531 | 97.4093 | 47.6730 | 4.3707 | 86.8021 | 19.2858 |
| 2235 | 12639 | NM_031099 | 97.4093 | 2790.0180 | 354.1100 | 1711.9500 | 272.3493 |
| 1740 | 11115 | NM_012531 | 97.4093 | 72.2707 | 15.0501 | 0.3074 | 22.2583 |
| 2654 | 25691 | X53504 | 97.3057 | 1740.7939 | 305.2158 | 1038.8671 | 189.4342 |
| 2647 | 19244 | X15013 | 97.3057 | 2814.2426 | 322.2026 | 1805.7654 | 295.1347 |
| 267 | 15884 | AA866276 | 97.2539 | 422.5439 | 22.9208 | 723.9240 | 187.2425 |
| 2318 | 16918 | NM_031709 | 97.2539 | 3050.6176 | 559.0742 | 1652.1325 | 378.1626 |
| 1955 | 16953 | NM_017151 | 97.2539 | 2207.6737 | 341.0509 | 1297.4032 | 254.3387 |
| 2486 | 15408 | NM_057197 | 97.2021 | 525.5060 | 96.4312 | 264.8164 | 76.4260 |
| 2492 | 10498 | NM_078617 | 97.2021 | 2408.9659 | 311.0810 | 1372.0887 | 260.9108 |
| 2236 | 20812 | NM_031100 | 97.2021 | 2893.6953 | 338.0681 | 1737.4178 | 310.0129 |
| 404 | 15876 | AA892582 | 97.0984 | 2416.0907 | 321.7240 | 1512.9364 | 235.4590 |
| 2654 | 18606 | X53504 | 97.0466 | 1476.4840 | 266.8140 | 819.8315 | 169.2263 |
| 2643 | 25671 | X07686 | 96.9430 | 324.9419 | 104.2810 | 107.2333 | 60.3073 |
| 2658 | 1861 | X58200 | 96.9430 | 3369.4430 | 364.8138 | 2174.7458 | 408.7371 |
| 2120 | 4259 | NM_022504 | 96.9430 | 1589.8659 | 190.8676 | 1025.3792 | 173.3154 |
| 2669 | 16780 | X62660 | 96.8912 | 132.2681 | 14.2080 | 70.4168 | 19.8154 |
| 2241 | 20807 | NM_031106 | 96.8912 | 2241.1979 | 298.0859 | 1305.3610 | 278.8448 |
| 2029 | 17066 | NM_019170 | 96.8912 | 215.0906 | 53.7980 | 99.7993 | 31.2393 |
| 2671 | 20844 | X65228 | 96.8912 | 2864.5389 | 435.1075 | 1576.0314 | 350.9617 |
| 2664 | 25716 | X61295 | 96.8394 | 2028.4791 | 531.6447 | 800.4289 | 345.3637 |
| 98 | 600 | AA800222 | 96.8394 | 213.4506 | 13.3187 | 328.3785 | 62.6328 |
| 105 | 4843 | AA800651 | 96.7876 | 291.0541 | 19.8623 | 433.1671 | 72.7306 |
| 2659 | 10109 | X58465 | 96.7876 | 2069.1210 | 324.8451 | 1261.4348 | 218.7584 |
| 114 | 2386 | AA800844 | 96.7358 | 80.5583 | 28.6494 | 347.3349 | 170.1627 |
| 2472 | 23250 | NM_057097 | 96.6839 | 183.6347 | 12.5762 | 249.1065 | 35.0313 |
| 2566 | 17204 | NM_139099 | 96.6321 | 6358.7441 | 945.0776 | 3624.5860 | 854.3594 |
| 438 | 18542 | AA893493 | 96.6321 | 3140.0374 | 530.3402 | 1708.6288 | 425.3914 |
| 41 | 17688 | AA799531 | 96.5285 | 104.5840 | 4.9652 | 153.8945 | 29.2358 |
| 2635 | 25647 | U83119 | 96.5285 | 650.2900 | 186.4918 | 245.2281 | 126.6846 |
| 2655 | 20617 | X53581 | 96.5285 | 637.2713 | 207.0703 | 247.7263 | 121.2902 |
| 2143 | 20925 | NM_022594 | 96.4767 | 2342.9944 | 432.2362 | 1295.9411 | 323.2822 |
| 1843 | 24264 | NM_012999 | 96.4767 | 104.7866 | 21.8573 | 225.9280 | 54.9011 |
| 1781 | 25563 | NM_012732 | 96.4767 | 290.8960 | 20.1097 | 451.4426 | 96.7035 |
| 448 | 22731 | AA893743 | 96.4249 | 346.8796 | 16.1784 | 509.2853 | 93.2138 |
| 2647 | 25679 | X15013 | 96.4249 | 2129.1789 | 260.7942 | 1410.0568 | 268.2938 |
| 49 | 17712 | AA799598 | 96.4249 | 1109.7723 | 136.2022 | 1728.1144 | 289.9941 |
| 1903 | 815 | NM_013224 | 96.3731 | 2569.5176 | 392.7349 | 1481.5505 | 341.7463 |
| 2566 | 17203 | NM_139099 | 96.2176 | 4186.3824 | 491.1366 | 2494.9794 | 708.9406 |
| 2166 | 18107 | NM_022949 | 96.1658 | 702.3460 | 107.3752 | 412.5137 | 101.4433 |
| 413 | 7148 | AA892842 | 96.1658 | 200.7584 | 19.5780 | 307.2611 | 61.5694 |
| 1599 | 9501 | AI638949 | 96.1140 | 184.4760 | 22.5023 | 118.2863 | 22.9688 |
| 2035 | 18573 | NM_019201 | 96.1140 | 240.8931 | 12.9388 | 340.8501 | 59.9261 |

TABLE 5G-continued

BI--Core Tox Markers
Timepoint(s): 168, 336 hrs

| SEQ ID | GLGC ID | GenBank Accession No. | LDA Score | Mean Tox | SD Tox | Mean Nontox | SD Nontox |
|---|---|---|---|---|---|---|---|
| 2057 | 17507 | NM_019299 | 96.1140 | 231.2563 | 37.7161 | 440.2135 | 233.0538 |
| 2067 | 1324 | NM_019371 | 96.0622 | 330.9949 | 70.2060 | 605.9855 | 116.1673 |
| 2269 | 4235 | NM_031330 | 96.0622 | 201.4274 | 20.5710 | 326.0595 | 67.8226 |
| 2152 | 17729 | NM_022697 | 95.9585 | 1997.6343 | 242.8843 | 1321.3071 | 222.1143 |
| 2190 | 15622 | NM_024369 | 95.9585 | 70.8847 | 27.2907 | 222.8664 | 74.5699 |
| 1813 | 17305 | NM_012876 | 95.9585 | 7999.9451 | 1186.2557 | 4595.7351 | 1347.7841 |
| 2243 | 10878 | NM_031110 | 95.9067 | 2431.5641 | 292.1642 | 1628.2188 | 275.3474 |
| 1799 | 961 | NM_012796 | 95.9067 | 198.4494 | 29.5912 | 108.3837 | 57.2710 |
| 1941 | 20745 | NM_017113 | 95.8031 | 238.6544 | 25.7200 | 358.9398 | 58.0826 |
| 1871 | 23709 | NM_013113 | 95.8031 | 800.6951 | 103.7246 | 1254.5985 | 283.8660 |
| 1740 | 11116 | NM_012531 | 95.5959 | 183.2179 | 22.4486 | 36.4703 | 57.4160 |
| 2315 | 16204 | NM_031706 | 95.5959 | 1805.7873 | 167.8985 | 1271.9758 | 199.9240 |
| 2125 | 2697 | NM_022515 | 95.5440 | 3434.9464 | 560.8371 | 2244.3433 | 399.1160 |
| 2614 | 15462 | U06230 | 95.5440 | 35.9110 | 6.6465 | 75.7932 | 21.5556 |
| 2316 | 18054 | NM_031707 | 95.4922 | 65.8467 | 8.7215 | 126.5834 | 31.3531 |
| 1652 | 18686 | D00729 | 95.4922 | 1443.8354 | 186.2988 | 905.4019 | 225.7265 |
| 75 | 14504 | AA799804 | 95.4922 | 281.8043 | 46.7470 | 529.6716 | 116.9672 |
| 1705 | 20630 | M13100 | 95.4922 | 726.8354 | 195.8009 | 344.2470 | 142.6618 |
| 1781 | 16613 | NM_012732 | 95.4922 | 39.2830 | 12.2343 | 95.9704 | 27.5393 |
| 19 | 19222 | AA799279 | 95.3886 | 743.1596 | 63.3540 | 1114.0604 | 186.0991 |
| 1961 | 17301 | NM_017173 | 95.2850 | 210.4029 | 40.2492 | 503.6307 | 155.1346 |
| 2349 | 19768 | NM_031986 | 95.2850 | 565.7791 | 47.6790 | 797.6082 | 121.6587 |
| 355 | 21672 | AA891789 | 95.2332 | 216.0100 | 29.2689 | 375.5837 | 81.6117 |
| 2645 | 20810 | X14181 | 95.2332 | 3040.8551 | 331.0841 | 2016.2404 | 403.9704 |
| 1653 | 5050 | D10655 | 95.2332 | 272.5644 | 48.9227 | 517.4997 | 119.5573 |
| 2270 | 18539 | NM_031353 | 95.2332 | 282.9924 | 41.5679 | 560.5237 | 195.9350 |
| 233 | 6158 | AA859284 | 99.0155 | 148.6926 | 39.9027 | 709.5511 | 245.4852 |
| 2376 | 6155 | NM_053356 | 98.9119 | 839.7963 | 183.1871 | 2774.3626 | 698.1220 |
| 1332 | 22716 | AI176500 | 98.9119 | 36.5181 | 8.5602 | 173.9637 | 67.4242 |
| 556 | 16909 | AA942704 | 98.9119 | 497.3220 | 47.7755 | 280.6717 | 73.6400 |
| 2376 | 6156 | NM_053356 | 98.7047 | 178.0871 | 39.9577 | 654.5772 | 199.8355 |
| 965 | 5596 | AI044747 | 98.7047 | 48.9820 | 5.3339 | 146.3433 | 50.3921 |
| 1347 | 2852 | AI177059 | 98.6010 | 135.1614 | 25.3872 | 432.1795 | 135.3618 |
| 1390 | 17358 | AI179147 | 98.3938 | 3310.9373 | 322.5242 | 1747.5259 | 419.0780 |
| 1479 | 24072 | AI231093 | 98.3420 | 58.5759 | 11.6797 | 18.3395 | 10.2706 |
| 1979 | 3780 | NM_017240 | 98.2902 | 1800.6897 | 455.8818 | 316.9184 | 306.7920 |
| 1504 | 19094 | AI232021 | 98.0311 | 3011.3891 | 403.2544 | 1729.2848 | 310.2172 |
| 522 | 24310 | AA924578 | 98.0311 | 86.8350 | 30.7300 | 309.9478 | 93.2590 |
| 658 | 23927 | AA957007 | 97.9793 | 472.3723 | 134.9741 | 110.8209 | 89.1579 |
| 1310 | 2046 | AI176004 | 97.9275 | 47.7550 | 10.7271 | 138.1307 | 44.9137 |
| 1314 | 4585 | AI176121 | 97.8238 | 2159.8191 | 200.3457 | 1318.4097 | 247.8512 |
| 222 | 15260 | AA858518 | 97.8238 | 656.9087 | 60.8892 | 376.9953 | 93.6401 |
| 941 | 18915 | AI043798 | 97.8238 | 398.7401 | 70.5634 | 954.6520 | 267.1831 |
| 824 | 6984 | AI010848 | 97.7202 | 500.2131 | 65.2292 | 216.7627 | 79.0802 |
| 1188 | 13161 | AI138093 | 97.5648 | 5.6410 | 12.7952 | 143.5556 | 64.4179 |
| 606 | 24521 | AA945636 | 97.5648 | 11366.8939 | 2042.0096 | 5437.9333 | 1388.7504 |
| 803 | 26133 | AI009950 | 97.5130 | 651.9266 | 291.6274 | 185.0980 | 106.2449 |
| 1462 | 9412 | AI230691 | 97.4611 | 169.6379 | 42.7022 | 46.2183 | 51.4983 |
| 2407 | 2103 | NM_053597 | 97.4093 | 4941.1484 | 817.8208 | 2596.4749 | 595.6015 |
| 1185 | 23687 | AI137958 | 97.3057 | 7377.1766 | 1444.2335 | 3148.1445 | 977.5333 |
| 1587 | 18151 | AI237212 | 97.3057 | 559.5641 | 76.8065 | 329.0736 | 68.4657 |
| 1144 | 6205 | AI104907 | 97.2021 | 277.4434 | 24.5348 | 437.3203 | 83.2028 |
| 788 | 10820 | AI009411 | 97.1503 | 3615.7761 | 669.0368 | 1860.5891 | 450.3442 |
| 1130 | 26213 | AI104113 | 96.9948 | 1580.0974 | 522.2003 | 577.7325 | 256.1040 |
| 2376 | 6154 | NM_053356 | 96.9948 | 319.6549 | 207.7988 | 1576.8974 | 653.0310 |
| 643 | 5111 | AA955729 | 96.9948 | 136.3579 | 16.9041 | 365.5307 | 127.5558 |
| 775 | 18125 | AI008787 | 96.9948 | 189.1237 | 21.4034 | 301.4020 | 62.3747 |
| 1564 | 22717 | AI235948 | 96.9430 | 213.9299 | 65.0869 | 656.9763 | 184.0001 |
| 811 | 3271 | AI010303 | 96.9430 | 281.7454 | 23.0722 | 472.8696 | 88.7627 |
| 1397 | 19783 | AI179388 | 96.8912 | 989.0276 | 159.3433 | 599.8644 | 106.5752 |
| 2376 | 6157 | NM_053356 | 96.8912 | 842.2940 | 210.1032 | 2306.7073 | 831.1001 |
| 1277 | 24268 | AI172281 | 96.7876 | 48.9863 | 15.7598 | 152.4360 | 46.6498 |
| 1050 | 22930 | AI071578 | 96.7876 | 65.0423 | 24.9483 | 332.5378 | 143.1938 |
| 1080 | 10971 | AI073212 | 96.7358 | 89.8383 | 19.1440 | 42.0165 | 15.5461 |
| 1466 | 22387 | AI230753 | 96.7358 | 1315.2459 | 88.4913 | 912.7375 | 160.7472 |
| 2438 | 17155 | NM_053835 | 96.5803 | 1013.4049 | 154.9830 | 552.1988 | 158.2252 |
| 1593 | 18854 | AI237636 | 96.5803 | 71.1124 | 18.6730 | 192.2503 | 50.5585 |

TABLE 5H

CLENBUTEROL
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2364 | 15867 | NM_053289 | 99.1736 | 401.2945 | 167.6115 | 38.0902 | 47.6847 |
| 1814 | 23651 | NM_012881 | 98.8120 | 194.9143 | 58.0033 | 43.9816 | 160.6078 |
| 77 | 21000 | AA799816 | 98.3988 | 10.9638 | 0.2819 | 22.8672 | 19.9926 |
| 1969 | 24859 | NM_017206 | 97.9855 | 102.9063 | 22.0298 | 22.8379 | 19.8724 |
| 53 | 16696 | AA799607 | 97.7273 | 197.2963 | 8.1224 | 302.8795 | 59.3996 |
| 1629 | 17215 | AI639268 | 97.6756 | 86.5150 | 6.6657 | 168.1356 | 43.5737 |
| 1746 | 23868 | NM_012551 | 97.6756 | 67.3360 | 8.0151 | 218.8534 | 231.6084 |
| 1330 | 15191 | AI176456 | 97.5723 | 517.4620 | 128.7504 | 183.9005 | 563.8396 |
| 2276 | 12580 | NM_031514 | 97.5207 | 33.8560 | 1.6003 | 19.5502 | 9.4737 |
| 1764 | 20589 | NM_012618 | 97.4690 | 490.8580 | 164.2942 | 148.3860 | 88.2875 |
| 1932 | 1523 | NM_017079 | 97.2624 | 149.7348 | 3.2732 | 212.0033 | 52.0601 |
| 1925 | 19549 | NM_017060 | 97.2107 | 5.7080 | 2.5474 | 42.7500 | 22.3031 |
| 2318 | 16918 | NM_031709 | 97.1591 | 2852.3920 | 322.0410 | 1657.2857 | 390.3238 |
| 2335 | 22321 | NM_031832 | 97.1074 | 391.6135 | 39.1905 | 173.4379 | 96.5339 |
| 412 | 11997 | AA892828 | 97.1074 | 460.1595 | 17.7043 | 677.7722 | 123.6360 |
| 2073 | 574 | NM_019905 | 96.8492 | 972.5473 | 57.9899 | 604.4586 | 158.0302 |
| 2340 | 25802 | NM_031969 | 96.7975 | 954.9178 | 117.8821 | 599.8418 | 153.6054 |
| 2584 | 15640 | NM_145775 | 96.7459 | 287.6770 | 20.3299 | 141.2940 | 60.3599 |
| 2584 | 15641 | NM_145775 | 96.6426 | 379.4980 | 27.4243 | 173.5264 | 86.4782 |
| 2487 | 18122 | NM_057208 | 96.4876 | 81.8923 | 21.0338 | 18.9802 | 40.6070 |
| 972 | 20983 | AI044900 | 96.4360 | 332.2185 | 11.0218 | 478.6360 | 109.8306 |
| 2247 | 19040 | NM_031114 | 96.3843 | 413.5660 | 26.6772 | 254.2652 | 77.2862 |
| 1608 | 17383 | AI639060 | 96.3843 | 88.0838 | 27.3070 | 10.2342 | 30.9053 |
| 1966 | 9124 | NM_017199 | 96.3326 | 336.2755 | 42.6549 | 213.0618 | 41.8746 |
| 263 | 4222 | AA860024 | 96.1777 | 1250.4435 | 53.0154 | 980.8498 | 131.6958 |
| 1949 | 24886 | NM_017138 | 96.1260 | 2331.6990 | 152.3483 | 1651.3200 | 275.6352 |
| 424 | 14360 | AA893043 | 96.0744 | 36.1613 | 0.5510 | 44.3514 | 21.3431 |
| 2460 | 18798 | NM_053978 | 96.0744 | 95.4560 | 5.1882 | 138.5010 | 28.2251 |
| 2119 | 8212 | NM_022500 | 95.9194 | 614.5205 | 13.5571 | 494.4720 | 131.8211 |
| 2099 | 762 | NM_022245 | 95.7645 | 152.8628 | 1.6805 | 139.5041 | 37.1730 |
| 889 | 21950 | AI013861 | 95.7645 | 561.8000 | 19.6699 | 768.0125 | 138.7978 |
| 255 | 22739 | AA859877 | 95.6612 | 268.0643 | 10.2046 | 360.3747 | 61.7718 |
| 1884 | 3465 | NM_013160 | 95.5579 | 58.9048 | 9.0152 | 111.0300 | 28.1320 |
| 2211 | 1991 | NM_030995 | 95.5062 | 224.6573 | 17.4598 | 136.2908 | 59.3718 |
| 2590 | 90 | NM_147210 | 95.4029 | 107.5228 | 3.0356 | 86.4029 | 43.9802 |
| 445 | 4544 | AA893664 | 95.3512 | 107.7215 | 6.2954 | 178.6031 | 50.1877 |
| 2306 | 17448 | NM_031668 | 95.3512 | −9.6045 | 2.7934 | 21.3649 | 22.5631 |
| 84 | 18881 | AA799992 | 95.3512 | 31.2700 | 2.8162 | 18.6383 | 8.1524 |
| 2245 | 25458 | NM_031112 | 95.2996 | 110.9095 | 33.1610 | 41.1543 | 67.0274 |
| 2295 | 19341 | NM_031603 | 95.2479 | 43.4835 | 1.7363 | 66.3774 | 21.9607 |
| 1949 | 24885 | NM_017138 | 95.1963 | 1835.8660 | 223.0581 | 1171.0566 | 257.6347 |
| 2232 | 15201 | NM_031093 | 95.1963 | 3447.9930 | 458.2868 | 2274.6547 | 448.0018 |
| 2242 | 16847 | NM_031109 | 95.1446 | 1621.7053 | 248.3307 | 1115.3956 | 189.9822 |
| 2238 | 20462 | NM_031102 | 95.1446 | 1536.0618 | 362.5987 | 1030.1922 | 185.5571 |
| 2186 | 20933 | NM_024353 | 95.0930 | 140.2160 | 5.3279 | 183.7717 | 499.2990 |
| 2227 | 11849 | NM_031065 | 95.0930 | 1348.1815 | 101.5179 | 940.8007 | 195.9938 |
| 1873 | 7854 | NM_013115 | 95.0413 | 34.1235 | 1.8506 | 26.2060 | 24.5871 |
| 2092 | 243 | NM_021989 | 94.9897 | 913.7335 | 133.1663 | 620.8041 | 113.0845 |
| 2059 | 16330 | NM_019331 | 94.9897 | 208.1708 | 4.2219 | 172.8530 | 33.5156 |
| 2340 | 19190 | NM_031969 | 94.9380 | 801.4863 | 75.5527 | 497.5050 | 140.9583 |
| 1957 | 17105 | NM_017160 | 94.9380 | 2202.6573 | 193.9224 | 1532.7357 | 345.1211 |
| 1916 | 14247 | NM_017031 | 94.9380 | 28.7498 | 0.7245 | 25.4779 | 13.2337 |
| 461 | 16434 | AA894174 | 94.8864 | 379.5328 | 21.2458 | 567.2230 | 119.8399 |
| 2404 | 20896 | NM_053592 | 94.8864 | 72.1373 | 6.2647 | 118.7357 | 34.0297 |
| 1602 | 17214 | AI639008 | 94.8864 | 63.4888 | 7.5354 | 106.4495 | 25.1572 |
| 290 | 16215 | AA874999 | 94.8347 | 316.8333 | 41.2945 | 212.9282 | 44.6649 |
| 310 | 15440 | AA875316 | 94.8347 | 24.4390 | 0.5360 | 30.9137 | 9.3853 |
| 241 | 23340 | AA859519 | 94.8347 | 317.6923 | 10.8281 | 245.6657 | 47.6778 |
| 2158 | 202 | NM_022863 | 94.7831 | 28.1825 | 1.2809 | 42.2180 | 14.8548 |
| 1903 | 815 | NM_013224 | 94.7314 | 2351.3360 | 351.2531 | 1485.8238 | 349.8904 |
| 121 | 16852 | AA801130 | 94.7314 | 202.9568 | 4.4363 | 255.8691 | 49.6336 |
| 2458 | 15135 | NM_053971 | 94.6798 | 1485.1895 | 200.7632 | 995.1288 | 219.0055 |
| 1746 | 23869 | NM_012551 | 94.6798 | 6.7505 | 3.2502 | 42.9405 | 61.7863 |
| 2333 | 15840 | NM_031817 | 94.6798 | 15.1773 | 4.6253 | 37.7956 | 12.3562 |
| 1915 | 17807 | NM_017025 | 94.6798 | 3050.4535 | 95.1550 | 2477.4667 | 409.9463 |
| 331 | 21917 | AA891220 | 94.6281 | 86.9305 | 4.6467 | 137.4482 | 40.1744 |
| 2012 | 20417 | NM_017359 | 94.6281 | 171.0010 | 5.7342 | 236.4262 | 62.6471 |
| 2657 | 15106 | X57529 | 94.5764 | 3986.4233 | 554.1719 | 2605.0488 | 527.2574 |
| 1842 | 19393 | NM_012998 | 94.5248 | 392.8538 | 28.4966 | 276.7454 | 55.0084 |
| 1904 | 18305 | NM_013226 | 94.5248 | 3108.5365 | 254.2765 | 2115.2642 | 466.0092 |
| 1626 | 20614 | AI639246 | 94.4731 | 33.2960 | 0.8997 | 17.2533 | 215.0029 |
| 2355 | 19148 | NM_033096 | 94.4731 | 162.5390 | 12.0865 | 241.5954 | 48.0514 |

TABLE 5H-continued

CLENBUTEROL
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2236 | 20812 | NM_031100 | 94.4215 | 2524.2418 | 310.7088 | 1742.5280 | 321.4198 |
| 345 | 11387 | AA891677 | 94.4215 | 24.3165 | 8.4346 | 60.1168 | 18.5151 |
| 1944 | 21663 | NM_017126 | 94.3698 | 535.2730 | 120.9507 | 381.9249 | 189.0689 |
| 1682 | 4407 | H33528 | 94.3182 | 44.3680 | 4.4238 | 77.2069 | 21.9306 |
| 2454 | 16553 | NM_053961 | 94.2149 | 138.8333 | 7.2284 | 89.3026 | 43.4774 |
| 1980 | 17563 | NM_017245 | 94.1632 | 2528.9760 | 243.6174 | 1831.8476 | 310.8510 |
| 1957 | 17104 | NM_017160 | 94.1116 | 888.3135 | 96.7579 | 619.6440 | 131.6469 |
| 2458 | 15136 | NM_053971 | 94.1116 | 1550.7555 | 126.5704 | 1071.5638 | 272.9769 |
| 2658 | 5667 | X58200 | 94.0599 | 1565.0848 | 155.3555 | 1149.7767 | 190.5336 |
| 2593 | 12700 | NM_152936 | 94.0599 | 15.2875 | 1.2689 | 26.5546 | 20.7245 |
| 1352 | 7163 | AI177256 | 94.0083 | 308.1465 | 6.2251 | 370.5876 | 101.8306 |
| 2116 | 24536 | NM_022399 | 94.0083 | 1336.5868 | 76.3393 | 998.3660 | 188.7130 |
| 2135 | 8097 | NM_022536 | 94.0083 | 725.6370 | 40.6999 | 490.8906 | 133.8125 |
| 2454 | 16552 | NM_053961 | 93.9566 | 71.9468 | 10.6071 | 39.0058 | 18.9272 |
| 1770 | 16220 | NM_012656 | 93.8533 | 3225.4738 | 485.8578 | 1864.4315 | 643.9048 |
| 1603 | 23781 | AI639012 | 93.8533 | 63.4873 | 5.8225 | 39.6359 | 17.0077 |
| 2093 | 17100 | NM_022179 | 93.8533 | 1816.9928 | 108.1590 | 1309.9654 | 296.8518 |
| 90 | 13568 | AA800169 | 93.8533 | 75.5443 | 6.1284 | 113.8145 | 27.0108 |
| 2251 | 14970 | NM_031127 | 93.8017 | 41.7940 | 4.8105 | 80.6715 | 20.5675 |
| 1734 | 583 | NM_012505 | 93.8017 | 87.3378 | 18.3387 | 171.2200 | 61.4637 |
| 6 | 19372 | AI014135 | 93.7500 | 182.6410 | 60.6879 | 72.6182 | 72.3788 |
| 2288 | 546 | NM_031573 | 93.7500 | 137.4413 | 19.6260 | 230.4553 | 50.8993 |
| 82 | 21027 | AA799964 | 93.7500 | 97.0588 | 7.6188 | 154.9087 | 44.8005 |
| 2653 | 20427 | X53378 | 93.6983 | 1679.2218 | 278.6166 | 1200.9108 | 217.2295 |
| 1964 | 1488 | NM_017182 | 93.5950 | 102.2283 | 1.1813 | 98.9079 | 21.2632 |
| 452 | 3446 | AA893970 | 93.5950 | 19.6823 | 2.4857 | 35.2313 | 11.3942 |
| 2666 | 15875 | X62145 | 93.5434 | 2132.7075 | 125.5746 | 1566.0871 | 298.0037 |
| 1680 | 10185 | H33426 | 93.5434 | 10.2845 | 14.2827 | 31.2524 | 10.4128 |
| 1159 | 22744 | AI112512 | 99.2252 | 26.3855 | 0.9038 | 56.3983 | 16.8105 |
| 532 | 23173 | AA925057 | 98.9669 | 3285.0910 | 237.6414 | 1561.3912 | 460.0075 |
| 193 | 18909 | AA849426 | 98.7603 | 937.3875 | 51.1807 | 1658.6110 | 377.4156 |
| 718 | 3250 | AA997765 | 98.7603 | 932.5275 | 75.0879 | 436.9967 | 155.0918 |
| 2338 | 10269 | NM_031838 | 98.6054 | 2964.3253 | 73.6783 | 1983.5484 | 405.8705 |
| 1341 | 16917 | AI176951 | 98.6054 | 796.6000 | 92.3903 | 1493.2819 | 318.9380 |
| 2386 | 16394 | NM_053485 | 98.4504 | 1993.7018 | 204.4622 | 777.8052 | 287.2109 |
| 1528 | 5228 | AI233311 | 98.3988 | 264.5018 | 87.2998 | 16.9613 | 42.9061 |
| 784 | 9150 | AI009198 | 98.3988 | 425.9990 | 11.6271 | 625.5024 | 106.3371 |
| 1440 | 13826 | AI229304 | 98.3471 | 959.6915 | 29.5016 | 1391.9748 | 237.8672 |
| 2513 | 4049 | NM_133298 | 98.3471 | 232.0925 | 71.2955 | 43.4387 | 130.5291 |
| 2340 | 19195 | NM_031969 | 98.2955 | 2867.3528 | 237.4438 | 1646.6852 | 385.3403 |
| 182 | 23521 | AA848407 | 98.2438 | 15.8948 | 10.1974 | 85.5762 | 34.5074 |
| 2513 | 4048 | NM_133298 | 98.2438 | 112.3103 | 34.8237 | 18.8858 | 77.2543 |
| 691 | 14342 | AA964595 | 98.1921 | 169.8480 | 19.1182 | 82.8344 | 27.6432 |
| 2340 | 19191 | NM_031969 | 98.1921 | 1912.4983 | 226.5763 | 912.4426 | 269.2696 |
| 213 | 21465 | AA851273 | 98.1405 | 398.0138 | 5.2214 | 282.1062 | 96.4138 |
| 1 | 19424 | AA850922 | 98.0888 | 22852.8073 | 1223.8235 | 10347.0804 | 4848.3980 |
| 1038 | 21195 | AI070726 | 97.9855 | 85.3645 | 2.0547 | 136.0304 | 39.9561 |
| 2205 | 21509 | NM_030847 | 97.9855 | 851.4765 | 90.0193 | 444.9262 | 134.9011 |
| 1288 | 13070 | AI172569 | 97.8822 | 20.3425 | 6.5792 | 92.7588 | 36.1270 |
| 2513 | 19456 | NM_133298 | 97.7789 | 53.7898 | 13.3891 | 3.0805 | 36.1093 |
| 859 | 14431 | AI012516 | 97.6240 | −11.4243 | 13.8465 | 45.8984 | 18.3298 |
| 1302 | 18507 | AI175551 | 97.5723 | 890.7598 | 54.0094 | 510.0488 | 133.8710 |
| 553 | 894 | AA926305 | 97.5723 | 488.7110 | 71.4370 | 212.9295 | 78.5750 |
| 538 | 5132 | AA925342 | 97.5723 | 753.3963 | 27.3536 | 1123.9945 | 230.3786 |
| 587 | 15476 | AA944426 | 97.5723 | 534.1638 | 108.0037 | 302.1699 | 75.7980 |
| 945 | 6766 | AI043914 | 97.5207 | 442.2773 | 30.2284 | 190.8744 | 119.2936 |
| 647 | 14327 | AA956111 | 97.5207 | 92.8413 | 18.2257 | −22.9178 | 40.5514 |
| 1091 | 13267 | AI101847 | 97.3140 | 33.1610 | 4.2081 | 90.1076 | 35.5488 |
| 708 | 3132 | AA997191 | 97.3140 | 423.2630 | 66.3606 | 207.8763 | 67.9326 |
| 793 | 895 | AI009614 | 97.2107 | 190.0450 | 68.7690 | 60.1332 | 32.1107 |
| 2433 | 15615 | NM_053800 | 97.1591 | 3745.5935 | 141.6091 | 2517.3568 | 580.3879 |
| 1441 | 13831 | AI229354 | 97.1074 | 66.2998 | 1.5392 | 65.2944 | 48.3849 |
| 1295 | 3982 | AI175100 | 97.0558 | 99.4585 | 33.3773 | 267.5928 | 71.6883 |
| 528 | 20953 | AA924926 | 97.0558 | 541.4905 | 37.0747 | 839.0732 | 146.8665 |
| 1230 | 16916 | AI170406 | 97.0041 | 436.7440 | 92.2636 | 892.1272 | 212.8023 |
| 2244 | 19162 | NM_031111 | 97.0041 | 4861.1903 | 641.2854 | 2851.0457 | 564.9066 |
| 844 | 13093 | AI012177 | 97.0041 | 753.5148 | 47.9504 | 1161.0444 | 236.7827 |
| 1561 | 14642 | AI235874 | 96.9525 | 488.6555 | 82.0127 | 189.7023 | 97.4228 |
| 1284 | 24209 | AI172423 | 96.9008 | 100.0273 | 24.0329 | 3.0026 | 41.9427 |
| 27 | 20042 | AA799420 | 96.9008 | 983.4830 | 271.6577 | 438.3391 | 252.0171 |
| 935 | 7844 | AI031058 | 96.9008 | 50.6993 | 11.6162 | 147.1081 | 55.0968 |
| 1366 | 15315 | AI177911 | 96.7459 | 4371.5658 | 256.4395 | 2784.8724 | 703.2430 |

TABLE 5H-continued

CLENBUTEROL
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 1071 | 10919 | AI072744 | 96.7459 | 2680.9605 | 730.9256 | 842.5857 | 660.8402 |
| 2458 | 22183 | NM_053971 | 96.7459 | 3676.6128 | 291.7861 | 2288.9363 | 582.5234 |
| 2595 | 4834 | NM_153821 | 96.7459 | 96.4443 | 2.4637 | 49.5111 | 45.2846 |
| 1255 | 17529 | AI171460 | 96.6942 | 47.9468 | 3.0703 | 91.7341 | 28.0182 |
| 2256 | 19359 | NM_031136 | 96.6942 | 3751.8920 | 348.1457 | 1991.9891 | 550.4905 |
| 207 | 21761 | AA850872 | 96.6942 | 239.5320 | 14.7073 | 398.1517 | 99.5533 |
| 1125 | 15942 | AI103738 | 96.6426 | 187.9785 | 17.0105 | 335.3510 | 75.9353 |
| 1527 | 15107 | AI233220 | 96.5909 | 3902.3560 | 4964.6238 | 5563.0289 | 2417.1411 |
| 1095 | 11598 | AI102007 | 96.5393 | 32.8070 | 32.3996 | 191.2678 | 68.0074 |
| 124 | 22318 | AA801187 | 96.4876 | 81.2843 | 29.3126 | 222.9738 | 79.4138 |
| 1321 | 12999 | AI176276 | 96.4360 | 438.6615 | 39.1895 | 337.9044 | 309.5522 |
| 788 | 10820 | AI009411 | 96.4360 | 3053.7868 | 269.0123 | 1868.3510 | 470.1964 |
| 606 | 24521 | AA945636 | 96.4360 | 9943.4675 | 1630.5121 | 5462.1901 | 1452.6442 |
| 5 | 22030 | AI011177 | 96.3326 | 22085.9835 | 2981.2204 | 11062.6238 | 4208.6729 |
| 785 | 3755 | AI009208 | 96.3326 | 46.9560 | 17.4174 | 122.4291 | 39.8654 |
| 1499 | 21189 | AI231822 | 96.2810 | 1111.8165 | 148.7927 | 734.5168 | 132.8529 |
| 151 | 8728 | AA818615 | 96.2810 | 77.5193 | 13.7142 | 132.7466 | 23.6850 |
| 507 | 4893 | AA923996 | 96.2810 | 25.3940 | 44.0374 | 18.0604 | 11.8525 |
| 553 | 893 | AA926305 | 96.2810 | 378.1673 | 73.8535 | 182.9926 | 66.3423 |
| 2371 | 14929 | NM_053330 | 96.2293 | 944.6818 | 123.9670 | 573.7854 | 134.7102 |
| 515 | 22914 | AA924335 | 96.2293 | 1737.1080 | 63.7535 | 2437.6827 | 483.1667 |
| 1557 | 896 | AI235313 | 96.1777 | 49.6703 | 13.3825 | 7.9432 | 16.0018 |

TABLE 5I

Clenbuterol--Core Tox Markers
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2507 | 1809 | NM_130741 | 99.5868 | 378.3500 | 90.6707 | 25.8207 | 73.5816 |
| 2364 | 15867 | NM_053289 | 99.1736 | 401.2945 | 167.6115 | 38.0902 | 47.6847 |
| 1855 | 11113 | NM_013046 | 99.1219 | 87.7850 | 7.5655 | 36.0548 | 19.4047 |
| 1814 | 23651 | NM_012881 | 98.8120 | 194.9143 | 58.0033 | 43.9816 | 160.6078 |
| 77 | 21000 | AA799816 | 98.3988 | 10.9638 | 0.2819 | 22.8672 | 19.9926 |
| 1969 | 24859 | NM_017206 | 97.9855 | 102.9063 | 22.0298 | 22.8379 | 19.8724 |
| 2435 | 15003 | NM_053819 | 97.7273 | 833.1818 | 204.8023 | 93.6247 | 186.9025 |
| 53 | 16696 | AA799607 | 97.7273 | 197.2963 | 8.1224 | 302.8795 | 59.3996 |
| 1629 | 17215 | AI639268 | 97.6756 | 86.5150 | 6.6657 | 168.1356 | 43.5737 |
| 1746 | 23868 | NM_012551 | 97.6756 | 67.3360 | 8.0151 | 218.8534 | 231.6084 |
| 1330 | 15191 | AI176456 | 97.5723 | 517.4620 | 128.7504 | 183.9005 | 563.8396 |
| 2276 | 12580 | NM_031514 | 97.5207 | 33.8560 | 1.6003 | 19.5502 | 9.4737 |
| 1764 | 20589 | NM_012618 | 97.4690 | 490.8580 | 164.2942 | 148.3860 | 88.2875 |
| 2435 | 15002 | NM_053819 | 97.4174 | 846.2003 | 185.8784 | 207.2146 | 184.9231 |
| 1932 | 1523 | NM_017079 | 97.2624 | 149.7348 | 3.2732 | 212.0033 | 52.0601 |
| 1925 | 19549 | NM_017060 | 97.2107 | 5.7080 | 2.5474 | 42.7500 | 22.3031 |
| 2318 | 16918 | NM_031709 | 97.1591 | 2852.3920 | 322.0410 | 1657.2857 | 390.3238 |
| 2335 | 22321 | NM_031832 | 97.1074 | 391.6135 | 39.1905 | 173.4379 | 96.5339 |
| 412 | 11997 | AA892828 | 97.1074 | 460.1595 | 17.7043 | 677.7722 | 123.6360 |
| 2073 | 574 | NM_019905 | 96.8492 | 972.5473 | 57.9899 | 604.4586 | 158.0302 |
| 2340 | 25802 | NM_031969 | 96.7975 | 954.9178 | 117.8821 | 599.8418 | 153.6054 |
| 2584 | 15640 | NM_145775 | 96.7459 | 287.6770 | 20.3299 | 141.2940 | 60.3599 |
| 2584 | 15641 | NM_145775 | 96.6426 | 379.4980 | 27.4243 | 173.5264 | 86.4782 |
| 2341 | 17736 | NM_031970 | 96.6426 | 1148.7220 | 124.6063 | 622.3568 | 364.0063 |
| 2487 | 18122 | NM_057208 | 96.4876 | 81.8923 | 21.0338 | 18.9802 | 40.6070 |
| 972 | 20983 | AI044900 | 96.4360 | 332.2185 | 11.0218 | 478.6360 | 109.8306 |
| 2247 | 19040 | NM_031114 | 96.3843 | 413.5660 | 26.6772 | 254.2652 | 77.2862 |
| 1608 | 17383 | AI639060 | 96.3843 | 88.0838 | 27.3070 | 10.2342 | 30.9053 |
| 1966 | 9124 | NM_017199 | 96.3326 | 336.2755 | 42.6549 | 213.0618 | 41.8746 |
| 263 | 4222 | AA860024 | 96.1777 | 1250.4435 | 53.0154 | 980.8498 | 131.6958 |
| 1949 | 24886 | NM_017138 | 96.1260 | 2331.6990 | 152.3483 | 1651.3200 | 275.6352 |
| 424 | 14360 | AA893043 | 96.0744 | 36.1613 | 0.5510 | 44.3514 | 21.3431 |
| 2460 | 18798 | NM_053978 | 96.0744 | 94.4560 | 5.1882 | 138.5010 | 28.2251 |
| 2119 | 8212 | NM_022500 | 95.9194 | 614.5205 | 13.5571 | 494.4720 | 131.8211 |
| 2099 | 762 | NM_022245 | 95.7645 | 152.8628 | 1.6805 | 139.5041 | 37.1730 |
| 889 | 21950 | AI013861 | 95.7645 | 561.8000 | 19.6699 | 768.0125 | 138.7978 |
| 255 | 22739 | AA859877 | 95.6612 | 268.0643 | 10.2046 | 360.3747 | 61.7718 |
| 1884 | 3465 | NM_013160 | 95.5579 | 58.9048 | 9.0152 | 111.0300 | 28.1320 |

TABLE 5I-continued

Clenbuterol--Core Tox Markers
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2211 | 1991 | NM_030995 | 95.5062 | 224.6573 | 17.4598 | 136.2908 | 59.3718 |
| 455 | 23731 | AA894004 | 95.4545 | 257.6383 | 25.4512 | 159.8238 | 45.0087 |
| 2590 | 90 | NM_147210 | 95.4029 | 107.5228 | 3.0356 | 86.4029 | 43.9802 |
| 445 | 4544 | AA893664 | 95.3512 | 107.7215 | 6.2954 | 178.6031 | 50.1877 |
| 2306 | 17448 | NM_031668 | 95.3512 | −9.6045 | 2.7934 | 21.3649 | 22.5631 |
| 84 | 18881 | AA799992 | 95.3512 | 31.2700 | 2.8162 | 18.6383 | 8.1524 |
| 2245 | 25458 | NM_031112 | 95.2996 | 110.9095 | 33.1610 | 41.1543 | 67.0274 |
| 2295 | 19341 | NM_031603 | 95.2479 | 43.4835 | 1.7363 | 66.3774 | 21.9607 |
| 1949 | 24885 | NM_017138 | 95.1963 | 1835.8660 | 223.0581 | 1171.0566 | 257.6347 |
| 2232 | 15201 | NM_031093 | 95.1963 | 3447.9930 | 458.2868 | 2274.6547 | 448.0018 |
| 2242 | 16847 | NM_031109 | 95.1446 | 1621.7053 | 248.3307 | 1115.3956 | 189.9822 |
| 2238 | 20462 | NM_031102 | 95.1446 | 1536.0618 | 362.5987 | 1030.1922 | 185.5571 |
| 2186 | 20933 | NM_024353 | 95.0930 | 140.2160 | 5.3279 | 183.7717 | 499.2990 |
| 2227 | 11849 | NM_031065 | 95.0930 | 1348.1815 | 101.5179 | 940.8007 | 195.9938 |
| 2109 | 13480 | NM_022390 | 95.0413 | 108.5698 | 6.5557 | 161.7956 | 39.9240 |
| 1873 | 7854 | NM_013115 | 95.0413 | 34.1235 | 1.8506 | 26.2060 | 24.5871 |
| 2092 | 243 | NM_021989 | 94.9897 | 913.7335 | 133.1663 | 620.8041 | 113.0845 |
| 2059 | 16330 | NM_019331 | 94.9897 | 208.1708 | 4.2219 | 172.8530 | 33.5156 |
| 2340 | 19190 | NM_031969 | 94.9380 | 801.4863 | 75.5527 | 497.5050 | 140.9583 |
| 1957 | 17105 | NM_017160 | 94.9380 | 2202.6573 | 193.9224 | 1532.7357 | 345.1211 |
| 1916 | 14247 | NM_017031 | 94.9380 | 28.7498 | 0.7245 | 25.4779 | 13.2337 |
| 461 | 16434 | AA894174 | 94.8864 | 379.5328 | 21.2458 | 567.2230 | 119.8399 |
| 2404 | 20896 | NM_053592 | 94.8864 | 72.1373 | 6.2647 | 118.7357 | 34.0297 |
| 1602 | 17214 | AI639008 | 94.8864 | 63.4888 | 7.5354 | 106.4495 | 25.1572 |
| 290 | 16215 | AA874999 | 94.8347 | 316.8333 | 41.2945 | 212.9282 | 44.6649 |
| 310 | 15440 | AA875316 | 94.8347 | 24.4390 | 0.5360 | 30.9137 | 9.3853 |
| 241 | 23340 | AA859519 | 94.8347 | 317.6923 | 10.8281 | 245.6657 | 47.6778 |
| 2158 | 202 | NM_022863 | 94.7831 | 28.1825 | 1.2809 | 42.2180 | 14.8548 |
| 1903 | 815 | NM_013224 | 94.7314 | 2351.3360 | 351.2531 | 1485.8238 | 349.8904 |
| 121 | 16852 | AA801130 | 94.7314 | 202.9568 | 4.4363 | 255.8691 | 49.6336 |
| 2458 | 15135 | NM_053971 | 94.6798 | 1485.1895 | 200.7632 | 995.1288 | 219.0055 |
| 1746 | 23869 | NM_012551 | 94.6798 | 6.7505 | 3.2502 | 42.9405 | 61.7863 |
| 2333 | 15840 | NM_031817 | 94.6798 | 15.1773 | 4.6253 | 37.7956 | 12.3562 |
| 1915 | 17807 | NM_017025 | 94.6798 | 3050.4535 | 95.1550 | 2477.4667 | 409.9463 |
| 331 | 21917 | AA891220 | 94.6281 | 86.9305 | 4.6467 | 137.4482 | 40.1744 |
| 2012 | 20417 | NM_017359 | 94.6281 | 171.0010 | 5.7342 | 236.4262 | 62.6471 |
| 2657 | 15106 | X57529 | 94.5764 | 3986.4233 | 554.1719 | 2605.0488 | 527.2574 |
| 1842 | 19393 | NM_012998 | 94.5248 | 392.8538 | 28.4966 | 276.7454 | 55.0084 |
| 1904 | 18305 | NM_013226 | 94.5248 | 3108.5365 | 254.2765 | 2115.2642 | 466.0092 |
| 1626 | 20614 | AI639246 | 94.4731 | 33.2960 | 0.8997 | 17.2533 | 215.0029 |
| 2355 | 19148 | NM_033096 | 94.4731 | 162.5390 | 12.0865 | 241.5954 | 48.0514 |
| 2236 | 20812 | NM_031100 | 94.4215 | 2524.2418 | 310.7088 | 1742.5280 | 321.4198 |
| 345 | 11387 | AA891677 | 94.4215 | 24.3165 | 8.4346 | 60.1168 | 18.5151 |
| 1944 | 21663 | NM_017126 | 94.3698 | 535.2730 | 120.9507 | 381.9249 | 189.0689 |
| 1682 | 4407 | H33528 | 94.3182 | 44.3680 | 4.4238 | 77.2069 | 21.9306 |
| 2454 | 16553 | NM_053961 | 94.2149 | 138.8333 | 7.2284 | 89.3026 | 43.4774 |
| 1980 | 17563 | NM_017245 | 94.1632 | 2528.9760 | 243.6174 | 1831.8476 | 310.8510 |
| 1957 | 17104 | NM_017160 | 94.1116 | 888.3135 | 96.7579 | 619.6440 | 131.6469 |
| 2651 | 20872 | X51707 | 94.1116 | 1900.1203 | 134.8184 | 1375.7230 | 300.8359 |
| 2458 | 15136 | NM_053971 | 94.1116 | 1550.7555 | 126.5704 | 1071.5638 | 272.9769 |
| 2658 | 5667 | X58200 | 94.0599 | 1565.0848 | 155.3555 | 1149.7767 | 190.5336 |
| 2593 | 12700 | NM_152936 | 94.0599 | 15.2875 | 1.2689 | 26.5546 | 20.7245 |
| 1352 | 7163 | AI177256 | 94.0083 | 308.1465 | 6.2251 | 370.5876 | 101.8306 |
| 2116 | 24536 | NM_022399 | 94.0083 | 1336.5868 | 76.3393 | 998.3660 | 188.7130 |
| 2135 | 8097 | NM_022536 | 94.0083 | 725.6370 | 40.6999 | 490.8906 | 133.8125 |
| 2454 | 16552 | NM_053961 | 93.9566 | 71.9468 | 10.6071 | 39.0058 | 18.9272 |
| 1770 | 16220 | NM_012656 | 93.8533 | 3225.4738 | 485.8578 | 1864.4315 | 643.9048 |
| 1603 | 23781 | AI639012 | 93.8533 | 63.4873 | 5.8225 | 39.6359 | 17.0077 |
| 2093 | 17100 | NM_022179 | 93.8533 | 1816.9928 | 108.1590 | 1309.9654 | 296.8518 |
| 90 | 13568 | AA800169 | 93.8533 | 75.5443 | 6.1284 | 113.8145 | 27.0108 |
| 2251 | 14970 | NM_031127 | 93.8017 | 41.7940 | 4.8105 | 80.6715 | 20.5675 |
| 1734 | 583 | NM_012505 | 93.8017 | 87.3378 | 18.3387 | 171.2200 | 61.4637 |
| 1159 | 22744 | AI112512 | 99.2252 | 26.3855 | 0.9038 | 56.3983 | 16.8105 |
| 532 | 23173 | AA925057 | 98.9669 | 3285.0910 | 237.6414 | 1561.3912 | 460.0075 |
| 1420 | 23015 | AI227724 | 98.7603 | 133.8138 | 5.4560 | 77.9200 | 22.1910 |
| 193 | 18909 | AA849426 | 98.7603 | 937.3875 | 51.1807 | 1658.6110 | 377.4156 |
| 718 | 3250 | AA997765 | 98.7603 | 932.5275 | 75.0879 | 436.9967 | 155.0918 |
| 2338 | 10269 | NM_031838 | 98.6054 | 2964.3253 | 73.6783 | 1983.5484 | 405.8705 |
| 1341 | 16917 | AI176951 | 98.6054 | 796.6000 | 92.3903 | 1493.2819 | 318.9380 |
| 1553 | 15004 | AI235224 | 98.4504 | 1686.5413 | 198.8730 | 331.7738 | 260.3911 |
| 2386 | 16394 | NM_053485 | 98.4504 | 1993.7018 | 204.4622 | 777.8052 | 287.2109 |
| 1528 | 5228 | AI233311 | 98.3988 | 264.5018 | 87.2998 | 16.9613 | 42.9061 |
| 784 | 9150 | AI009198 | 98.3988 | 425.9990 | 11.6271 | 625.5024 | 106.3371 |

TABLE 5I-continued

Clenbuterol--Core Tox Markers
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 1440 | 13826 | AI229304 | 98.3471 | 959.6915 | 29.5016 | 1391.9748 | 237.8672 |
| 2513 | 4049 | NM_133298 | 98.3471 | 232.0925 | 71.2955 | 43.4387 | 130.5291 |
| 2340 | 19195 | NM_031969 | 98.2955 | 2867.3528 | 237.4438 | 1646.6852 | 385.3403 |
| 182 | 23521 | AA848407 | 98.2438 | 15.8948 | 10.1974 | 85.5762 | 34.5074 |
| 2513 | 4048 | NM_133298 | 98.2438 | 112.3103 | 34.8237 | 18.8858 | 77.2543 |
| 691 | 14342 | AA964595 | 98.1921 | 169.8480 | 19.1182 | 82.8344 | 27.6432 |
| 2340 | 19191 | NM_031969 | 98.1921 | 1912.4983 | 226.5763 | 912.4426 | 269.2696 |
| 213 | 21465 | AA851273 | 98.1405 | 398.0138 | 5.2214 | 282.1062 | 96.4138 |
| 1 | 19424 | AA850922 | 98.0888 | 22852.8073 | 1223.8235 | 1034.0804 | 4848.3980 |
| 547 | 5227 | AA925924 | 98.0888 | 386.4903 | 69.7187 | 152.5409 | 48.8669 |
| 1162 | 4969 | AI113008 | 98.0372 | 178.1593 | 143.2056 | −19.0442 | 46.4550 |
| 1038 | 21195 | AI070726 | 97.9855 | 85.3645 | 2.0547 | 136.0304 | 39.9561 |
| 2205 | 21509 | NM_030847 | 97.9855 | 851.4765 | 90.0193 | 444.9262 | 134.9011 |
| 1288 | 13070 | AI172569 | 97.8822 | 20.3425 | 6.5792 | 92.7588 | 36.1270 |
| 2513 | 19456 | NM_133298 | 97.7789 | 53.7898 | 13.3891 | 3.0805 | 36.1093 |
| 859 | 14431 | AI012516 | 97.6240 | −11.4243 | 13.8465 | 45.8984 | 18.3298 |
| 1302 | 18507 | AI175551 | 97.5723 | 890.7598 | 54.0094 | 510.0488 | 133.8710 |
| 553 | 894 | AA926305 | 97.5723 | 488.7110 | 71.4370 | 212.9295 | 78.5750 |
| 538 | 5132 | AA925342 | 97.5723 | 753.3963 | 27.3536 | 1123.9945 | 230.3786 |
| 587 | 15476 | AA944426 | 97.5723 | 534.1638 | 108.0037 | 302.1699 | 75.7980 |
| 945 | 6766 | AI043914 | 97.5207 | 442.2773 | 30.2284 | 190.8744 | 119.2936 |
| 647 | 14327 | AA956111 | 97.5207 | 92.8413 | 18.2257 | −22.9178 | 40.5514 |
| 1091 | 13267 | AI101847 | 97.3140 | 33.1610 | 4.2081 | 90.1076 | 35.5488 |
| 708 | 3132 | AA997191 | 97.3140 | 423.2630 | 66.3606 | 207.8763 | 67.9326 |
| 793 | 895 | AI009614 | 97.2107 | 190.0450 | 68.7690 | 60.1332 | 32.1107 |
| 2433 | 15615 | NM_053800 | 97.1591 | 3745.5935 | 141.6091 | 2517.3568 | 580.3879 |
| 1441 | 13831 | AI229354 | 97.1074 | 66.2998 | 1.5392 | 65.2944 | 48.3849 |
| 1295 | 3982 | AI175100 | 97.0558 | 99.4585 | 33.3773 | 267.5928 | 71.6883 |
| 528 | 20953 | AA924926 | 97.0558 | 541.4905 | 37.0747 | 839.0732 | 146.8665 |
| 1230 | 16916 | AI170406 | 97.0041 | 436.7440 | 92.2636 | 892.1272 | 212.8023 |
| 2244 | 19162 | NM_031111 | 97.0041 | 4861.1903 | 641.2854 | 2851.0457 | 564.9066 |
| 844 | 13093 | AI012177 | 97.0041 | 753.5148 | 47.9504 | 1161.0444 | 236.7827 |
| 1561 | 14642 | AI235874 | 96.9525 | 488.6555 | 82.0127 | 189.7023 | 97.4228 |
| 1284 | 24209 | AI172423 | 96.9008 | 100.0273 | 24.0329 | 3.0026 | 41.9427 |
| 27 | 20042 | AA799420 | 96.9008 | 983.4830 | 271.6577 | 438.3391 | 252.0171 |
| 935 | 7844 | AI031058 | 96.9008 | 50.6993 | 11.6162 | 147.1081 | 55.0968 |
| 1366 | 15315 | AI177911 | 96.7459 | 4371.5658 | 256.4395 | 2784.8724 | 703.2430 |
| 1071 | 10919 | AI072744 | 96.7459 | 2680.9605 | 730.9256 | 842.5857 | 660.8402 |
| 2458 | 22183 | NM_053971 | 96.7459 | 3676.6128 | 291.7861 | 2288.9363 | 582.5234 |
| 2595 | 4834 | NM_153821 | 96.7459 | 96.4443 | 2.4637 | 49.5111 | 45.2846 |
| 1255 | 17529 | AI171460 | 96.6942 | 147.9468 | 3.0703 | 91.7341 | 28.0182 |
| 2256 | 19359 | NM_031136 | 96.6942 | 3751.8920 | 348.1457 | 1991.9891 | 550.4905 |
| 207 | 21761 | AA850872 | 96.6942 | 239.5320 | 14.7073 | 398.1517 | 99.5533 |
| 1125 | 15942 | AI103738 | 96.6426 | 187.9785 | 17.0105 | 335.3510 | 75.9353 |
| 1527 | 15107 | AI233220 | 96.5909 | 3902.3560 | 4964.6238 | 5563.0289 | 2417.1411 |
| 1095 | 11598 | AI102007 | 96.5393 | 32.8070 | 32.3996 | 191.2678 | 68.0074 |
| 145 | 6015 | AA818158 | 96.4876 | 56.6675 | 17.6759 | 123.6439 | 33.7718 |
| 124 | 22318 | AA801187 | 96.4876 | 81.2843 | 29.3126 | 222.9738 | 79.4138 |
| 1321 | 12999 | AI176276 | 96.4360 | 438.6615 | 39.1895 | 337.9044 | 309.5522 |
| 788 | 10820 | AI009411 | 96.4360 | 3053.7868 | 269.0123 | 1868.3510 | 470.1964 |
| 606 | 24521 | AA945636 | 96.4360 | 9943.4675 | 1630.5121 | 5462.1901 | 1452.6442 |
| 5 | 22030 | AI011177 | 96.3326 | 22085.9835 | 2981.2204 | 11062.6238 | 4208.6729 |
| 785 | 3755 | AI009208 | 96.3326 | 46.9560 | 17.4174 | 122.4291 | 39.8654 |
| 1499 | 21189 | AI231822 | 96.2810 | 1111.8165 | 148.7927 | 734.5168 | 132.8529 |
| 151 | 8728 | AA818615 | 96.2810 | 77.5193 | 13.7142 | 132.7466 | 23.6850 |
| 507 | 4893 | AA923996 | 96.2810 | 25.3940 | 44.0374 | 18.0604 | 11.8525 |
| 553 | 893 | AA926305 | 96.2810 | 378.1673 | 73.8535 | 182.9926 | 66.3423 |
| 2371 | 14929 | NM_053330 | 96.2293 | 944.6818 | 123.9670 | 573.7854 | 134.7102 |
| 515 | 22914 | AA924335 | 96.2293 | 1737.1080 | 63.7535 | 2437.6827 | 483.1667 |
| 1557 | 896 | AI235313 | 96.1777 | 49.6703 | 13.3825 | 7.9432 | 16.0018 |

TABLE 5J

CLENBUTEROL
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 1330 | 15191 | AI176456 | 100.0000 | 4848.8693 | 52.4545 | 170.8348 | 500.4770 |
| 2558 | 945 | NM_138882 | 99.9484 | 134.3437 | 6.0542 | −12.6304 | 30.0697 |
| 2587 | 20740 | NM_145878 | 99.8452 | 1340.9600 | 37.6412 | 448.7949 | 136.3810 |
| 1664 | 21147 | D63772 | 99.6388 | 41.2293 | 0.3146 | 18.0479 | 11.2102 |
| 1782 | 23806 | NM_012733 | 99.5356 | 13.5270 | 2.1598 | 60.1184 | 25.4038 |
| 2243 | 10878 | NM_031110 | 99.4840 | 1562.5993 | 0.6741 | 1634.2253 | 283.9885 |
| 2550 | 15190 | NM_138826 | 99.3808 | 3461.6643 | 487.6477 | 233.6376 | 289.1438 |
| 2550 | 15189 | NM_138826 | 99.3808 | 3694.3787 | 503.1788 | 329.6283 | 310.6204 |
| 1755 | 24716 | NM_012589 | 99.3808 | 72.2240 | 15.4827 | −7.4551 | 11.1158 |
| 104 | 13930 | AA800613 | 99.3292 | 413.1923 | 21.7059 | 110.7163 | 65.7014 |
| 108 | 23368 | AA800678 | 99.3292 | 218.4663 | 5.4029 | 406.7741 | 91.9227 |
| 1759 | 2629 | NM_012603 | 99.2776 | 55.7473 | 2.8928 | 21.3916 | 17.0047 |
| 2350 | 20555 | NM_031987 | 99.2776 | 11.0847 | 0.4816 | 27.9069 | 10.1556 |
| 2114 | 23705 | NM_022396 | 99.1744 | 97.8843 | 16.9478 | 265.3709 | 68.2915 |
| 2511 | 25730 | NM_133290 | 99.1228 | 399.7273 | 10.3185 | 224.2822 | 72.9452 |
| 1802 | 15032 | NM_012816 | 99.1228 | 31.6433 | 0.0984 | 38.3319 | 10.0770 |
| 2406 | 21709 | NM_053596 | 99.0712 | 543.6700 | 42.4038 | 253.3641 | 57.3564 |
| 2358 | 23715 | NM_033237 | 99.0712 | 94.8683 | 16.8393 | 9.9387 | 25.1145 |
| 2052 | 20734 | NM_019283 | 99.0196 | 339.2357 | 52.4888 | 94.2550 | 46.1601 |
| 2052 | 20735 | NM_019283 | 98.9680 | 365.3143 | 51.6737 | 101.7314 | 46.4986 |
| 2070 | 2453 | NM_019385 | 98.9164 | 30.1920 | 0.5191 | 53.0373 | 29.6950 |
| 2624 | 21654 | U53184 | 98.8648 | 572.4030 | 49.6785 | 203.9429 | 73.2109 |
| 1787 | 8829 | NM_012749 | 98.8648 | 505.2817 | 40.4494 | 267.9187 | 70.0353 |
| 1670 | 20456 | H31144 | 98.8132 | 3.9490 | 0.1578 | 22.3578 | 32.7458 |
| 2278 | 3292 | NM_031531 | 98.8132 | 223.3543 | 132.5781 | −1.3809 | 27.7261 |
| 1959 | 20702 | NM_017166 | 98.8132 | 48.1140 | 6.8500 | 149.9956 | 64.9653 |
| 2411 | 1228 | NM_053625 | 98.7616 | 134.1093 | 1.0635 | 192.5306 | 40.0635 |
| 1831 | 190 | NM_012940 | 98.7616 | 64.3393 | 8.8634 | −4.6305 | 25.2465 |
| 2526 | 1824 | NM_133545 | 98.7100 | 54.2170 | 5.5644 | 112.5691 | 25.7844 |
| 2378 | 622 | NM_053369 | 98.6584 | 17.4750 | 0.5633 | 45.3087 | 19.1055 |
| 245 | 11635 | AA859645 | 98.6584 | 69.4783 | 5.2594 | 135.5475 | 28.8584 |
| 1800 | 10248 | NM_012797 | 98.6584 | 421.4460 | 3.2657 | 307.6573 | 85.3529 |
| 1914 | 6598 | NM_017020 | 98.6584 | 65.9897 | 8.8529 | 23.0423 | 10.4630 |
| 2086 | 19710 | NM_021744 | 98.6584 | 89.4057 | 2.6970 | 48.5489 | 23.0344 |
| 468 | 3910 | AA894345 | 98.6068 | 118.1183 | 0.3407 | 145.4331 | 35.4410 |
| 268 | 17217 | AA866299 | 98.6068 | 257.0393 | 5.0020 | 405.4736 | 80.5839 |
| 1880 | 21682 | NM_013154 | 98.5552 | 184.9510 | 96.4663 | −9.7676 | 54.3813 |
| 2005 | 355 | NM_017334 | 98.5036 | 94.2290 | 12.0303 | 9.8934 | 28.6974 |
| 293 | 16312 | AA875032 | 98.4520 | 285.0370 | 77.1088 | 67.3643 | 35.2005 |
| 415 | 17590 | AA892851 | 98.4520 | 90.5147 | 4.1203 | 48.3731 | 16.1590 |
| 1828 | 18695 | NM_012931 | 98.4520 | 217.4283 | 76.3852 | 35.0061 | 39.0491 |
| 1853 | 733 | NM_013040 | 98.4004 | 61.5817 | 0.4070 | 84.3478 | 27.7086 |
| 2276 | 12580 | NM_031514 | 98.4004 | 62.9820 | 11.9219 | 19.4747 | 9.1851 |
| 1649 | 20127 | AJ011116 | 98.2972 | 93.0660 | 7.5880 | 30.6760 | 20.9299 |
| 2145 | 21115 | NM_022602 | 98.2972 | 231.9090 | 10.3353 | 102.9476 | 53.5277 |
| 2410 | 13005 | NM_053623 | 98.2972 | 39.8907 | 4.6011 | 18.4472 | 7.3766 |
| 278 | 16029 | AA874803 | 98.2972 | 81.3597 | 27.8106 | 13.8859 | 19.1912 |
| 2687 | 12978 | X96437 | 98.2972 | 174.3473 | 30.0006 | 78.0023 | 51.9326 |
| 2005 | 356 | NM_017334 | 98.2456 | 165.1347 | 24.9797 | 41.3534 | 45.3902 |
| 2684 | 25761 | X89702 | 98.2456 | 27.2957 | 0.9103 | 10.3706 | 13.3401 |
| 2267 | 18597 | NM_031325 | 98.1940 | 278.9343 | 56.3348 | 94.5047 | 63.0400 |
| 63 | 14250 | AA799729 | 98.1940 | 352.4563 | 54.8318 | 145.1721 | 51.5631 |
| 749 | 23044 | AF034218 | 98.1940 | 475.3620 | 72.5360 | 227.0935 | 51.1801 |
| 2345 | 17556 | NM_031975 | 98.1424 | 447.2547 | 4.5099 | 418.5919 | 269.8707 |
| 1589 | 21653 | AI237535 | 98.0908 | 271.2960 | 36.0854 | 116.2228 | 40.6966 |
| 403 | 4512 | AA892578 | 98.0908 | 136.4383 | 56.5763 | 23.1132 | 27.3790 |
| 278 | 16030 | AA874803 | 98.0908 | 46.1457 | 31.5041 | −6.3851 | 16.6583 |
| 2556 | 17532 | NM_138877 | 97.9876 | 166.7917 | 5.1276 | 264.8779 | 55.6876 |
| 2090 | 20161 | NM_021836 | 97.9360 | 1231.1267 | 105.1007 | 36.2762 | 39.2601 |
| 1866 | 357 | NM_013086 | 97.9360 | 85.4477 | 19.1172 | 25.4313 | 18.0127 |
| 400 | 11203 | AA892554 | 97.9360 | 94.6200 | 7.3173 | 50.3291 | 16.1130 |
| 2032 | 24019 | NM_019186 | 97.9360 | 104.0047 | 17.2367 | 27.0516 | 25.4071 |
| 1626 | 20614 | AI639246 | 97.8844 | 42.7467 | 1.2769 | 17.2406 | 214.8896 |
| 2528 | 244 | NM_133551 | 97.8844 | 196.2470 | 29.2619 | 63.1635 | 44.1915 |
| 2551 | 16249 | NM_138827 | 97.8844 | 42.3113 | 4.1646 | −4.0842 | 48.6353 |
| 1880 | 21683 | NM_013154 | 97.8328 | 271.7527 | 92.8744 | 48.5984 | 33.9935 |
| 2665 | 21657 | X61381 | 97.7812 | 1448.9427 | 42.7862 | 954.6483 | 229.3213 |
| 1769 | 9423 | NM_012649 | 97.7812 | 477.6037 | 161.5233 | 167.2220 | 78.0601 |
| 1882 | 25567 | NM_013156 | 97.7812 | 138.8263 | 11.4355 | 67.6319 | 35.7175 |
| 2289 | 1921 | NM_031576 | 97.7812 | 181.9453 | 43.7093 | 81.4987 | 23.2311 |
| 405 | 19085 | AA892598 | 97.7296 | 103.0713 | 12.4950 | 52.2006 | 14.0771 |
| 325 | 5384 | AA891041 | 97.7296 | 329.6763 | 123.8702 | 42.1950 | 55.7465 |
| 1772 | 16197 | NM_012663 | 97.7296 | 160.0660 | 0.8063 | 161.5913 | 52.3362 |

TABLE 5J-continued

CLENBUTEROL
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 1828 | 18694 | NM_012931 | 97.7296 | 85.3757 | 71.6381 | −7.2428 | 25.7180 |
| 2 | 6153 | AA875531 | 97.6780 | 184.3700 | 32.7761 | 622.7538 | 222.1150 |
| 2363 | 25072 | NM_052807 | 97.6780 | 25.2017 | 6.0933 | −6.1292 | 14.8911 |
| 467 | 17336 | AA894297 | 97.6780 | 38.8513 | 6.0298 | 15.6028 | 7.6997 |
| 1956 | 21975 | NM_017154 | 97.6264 | 509.6623 | 141.1960 | 180.4975 | 77.5763 |
| 2058 | 24674 | NM_019328 | 97.6264 | 39.2367 | 0.4022 | 33.2995 | 26.8241 |
| 747 | 1097 | AF016296 | 97.6264 | 113.2633 | 13.0527 | 303.5668 | 99.7399 |
| 2538 | 17337 | NM_134351 | 97.6264 | 274.9593 | 43.2507 | 141.9581 | 42.9696 |
| 2527 | 11483 | NM_133546 | 97.5748 | 255.8617 | 50.3113 | 99.1670 | 43.7596 |
| 2187 | 15353 | NM_024356 | 97.5748 | 54.9167 | 15.7750 | 19.2374 | 16.8658 |
| 1737 | 2736 | NM_012519 | 97.5748 | 211.0247 | 16.5303 | 358.5069 | 62.9998 |
| 2584 | 15640 | NM_145775 | 97.5232 | 143.6827 | 1.3775 | 141.8909 | 61.0655 |
| 1219 | 804 | AI169756 | 97.5232 | 135.3840 | 26.7548 | 52.3425 | 29.2084 |
| 1961 | 17301 | NM_017173 | 97.5232 | 148.7857 | 39.6259 | 502.6110 | 155.5782 |
| 2696 | 15570 | Z78279 | 97.5232 | 193.2387 | 49.8258 | 622.6698 | 207.2827 |
| 2234 | 1295 | NM_031097 | 97.5232 | 27.4813 | 7.8249 | 75.2102 | 19.2171 |
| 405 | 19086 | AA892598 | 97.4716 | 157.9933 | 20.0631 | 75.1020 | 28.1408 |
| 115 | 17658 | AA800853 | 97.4716 | 4.3310 | 3.7428 | 41.4360 | 20.5048 |
| 1985 | 15301 | NM_017259 | 97.4200 | 275.7437 | 37.4354 | 100.2767 | 84.4844 |
| 2670 | 25090 | X63594 | 97.3684 | 441.3950 | 92.2155 | 140.5463 | 81.4944 |
| 2137 | 9240 | NM_022540 | 97.3684 | 933.6183 | 14.9587 | 1170.9649 | 183.3070 |
| 4 | 1804 | AI007824 | 97.3684 | 8526.9873 | 141.8813 | 6460.4813 | 2181.5948 |
| 2461 | 15468 | NM_053982 | 97.3168 | 1408.7463 | 8.4715 | 1311.6313 | 222.0564 |
| 65 | 18349 | AA799744 | 97.2652 | 386.7867 | 121.1182 | 174.8812 | 62.5378 |
| 1609 | 25883 | AI639076 | 97.2136 | 4776.3063 | 68.5880 | 3422.5719 | 915.0306 |
| 2373 | 1609 | NM_053338 | 97.2136 | 1613.7737 | 301.0304 | 872.2018 | 288.7875 |
| 1941 | 20746 | NM_017113 | 97.2136 | 272.4527 | 22.3631 | 492.5344 | 121.2973 |
| 1082 | 15192 | AI101099 | 99.9484 | 245.0187 | 6.7325 | 70.9741 | 40.1911 |
| 1203 | 18472 | AI168975 | 99.8968 | 261.000 | 4.7005 | 67.1399 | 41.9499 |
| 2400 | 3049 | NM_053582 | 99.8968 | 1215.6133 | 12.3725 | 248.1956 | 126.6890 |
| 1305 | 15984 | AI175777 | 99.8452 | 492.0337 | 8.2519 | 247.8687 | 57.6010 |
| 1437 | 15078 | AI228830 | 99.8452 | 83.0913 | 1.8675 | 206.5969 | 127.3381 |
| 2582 | 6988 | NM_145677 | 99.7420 | 148.1523 | 21.8467 | 12.9282 | 79.2454 |
| 851 | 24200 | AI012356 | 99.7420 | 1831.3610 | 51.0588 | 650.5468 | 193.2024 |
| 800 | 6844 | AI009770 | 99.7420 | −15.2123 | 3.7916 | 158.4966 | 89.8726 |
| 2082 | 23424 | NM_021680 | 99.6388 | 495.8370 | 8.8821 | 309.6446 | 63.2709 |
| 1401 | 13619 | AI179464 | 99.6388 | 260.5140 | 8.2960 | 135.0774 | 46.7347 |
| 1211 | 13240 | AI169311 | 99.5872 | 384.1850 | 26.2196 | 46.0984 | 41.1069 |
| 1349 | 5943 | AI177105 | 99.5872 | 2.5757 | 7.2305 | 117.6422 | 43.8729 |
| 231 | 14209 | AA858955 | 99.5872 | 95.2830 | 0.6904 | 186.1088 | 61.0930 |
| 966 | 2348 | AI044794 | 99.5872 | 235.1720 | 0.4753 | 280.7291 | 97.6111 |
| 1320 | 22765 | AI176265 | 99.5356 | 111.5053 | 3.6676 | 22.9075 | 22.6912 |
| 500 | 11467 | AA901069 | 99.5356 | 216.0630 | 2.1991 | 139.6584 | 38.0034 |
| 861 | 23025 | AI012621 | 99.4840 | −14.1163 | 0.4311 | 27.1357 | 41.4489 |
| 634 | 23471 | AA955162 | 99.4840 | 283.3903 | 14.5924 | 77.3412 | 35.0796 |
| 580 | 22381 | AA944216 | 99.4840 | 175.8840 | 6.3195 | 103.3030 | 23.7487 |
| 597 | 22081 | AA944818 | 99.4840 | 94.4403 | 6.8233 | 229.1844 | 47.7646 |
| 1142 | 4626 | AI104744 | 99.4324 | 91.5253 | 4.1731 | 27.8457 | 26.4231 |
| 235 | 15157 | AA859343 | 99.4324 | 39.1553 | 0.2282 | 65.6418 | 20.2172 |
| 1301 | 13353 | AI175508 | 99.3808 | 116.6127 | 5.6815 | 200.6327 | 32.2702 |
| 2430 | 9059 | NM_053783 | 99.3808 | 636.5220 | 39.1324 | 271.8312 | 79.8237 |
| 760 | 4018 | AI007770 | 99.3808 | 27.1503 | 4.5802 | −11.2888 | 10.8308 |
| 1547 | 22152 | AI234822 | 99.3292 | 57.3433 | 2.7280 | −0.2891 | 20.2076 |
| 899 | 7315 | AI028831 | 99.3292 | 214.7143 | 34.5163 | 10.0917 | 25.3182 |
| 1575 | 15051 | AI236332 | 99.2776 | 615.7103 | 141.6182 | 119.3141 | 105.8113 |
| 973 | 5675 | AI045026 | 99.2776 | 1314.5897 | 174.2619 | 156.1069 | 123.3530 |
| 1294 | 2331 | AI175045 | 99.2260 | 1230.4933 | 59.9098 | 389.0874 | 358.2674 |
| 1512 | 11873 | AI232326 | 99.2260 | 964.7597 | 160.1007 | 147.0140 | 109.6199 |
| 1281 | 13266 | AI172326 | 99.2260 | 349.0043 | 67.6682 | 94.0862 | 43.1564 |
| 608 | 11871 | AA945679 | 99.2260 | 3316.3687 | 720.1954 | 43.1452 | 326.8880 |
| 2400 | 3050 | NM_053582 | 99.1744 | 615.6347 | 84.2415 | 87.5598 | 59.6096 |
| 802 | 2605 | AI009843 | 99.1744 | 36.3433 | 10.6257 | 302.2771 | 139.0916 |
| 1339 | 21740 | AI176810 | 99.1228 | 697.6160 | 38.4674 | 276.3875 | 85.5203 |
| 1539 | 6532 | AI234105 | 99.1228 | 933.6980 | 54.8957 | 449.2898 | 126.9559 |
| 1497 | 12435 | AI231810 | 99.1228 | 116.6823 | 3.7442 | 229.7496 | 48.2511 |
| 1337 | 3619 | AI176588 | 99.1228 | 46.3957 | 0.1635 | 57.9467 | 16.1863 |
| 495 | 23038 | AA900881 | 99.1228 | 155.3643 | 13.0636 | 20.6635 | 122.9799 |
| 1227 | 2729 | AI170363 | 99.0712 | 193.8313 | 10.9173 | 480.0400 | 152.5689 |
| 2554 | 9796 | NM_138847 | 99.0712 | 48.0417 | 4.7084 | 6.8524 | 13.4118 |
| 651 | 5210 | AA956550 | 99.0712 | 52.3533 | 1.8222 | 96.2220 | 21.6672 |
| 1408 | 15892 | AI179988 | 99.0196 | 334.6830 | 40.5811 | 58.3685 | 50.3007 |
| 1426 | 6715 | AI228284 | 99.0196 | 96.9987 | 8.6659 | 42.9113 | 17.2734 |
| 1400 | 15042 | AI179422 | 99.0196 | 147.0083 | 7.5527 | 44.1413 | 36.5945 |

TABLE 5J-continued

CLENBUTEROL
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 169 | 9083 | AA819332 | 99.0196 | 118.1750 | 6.7094 | 251.4949 | 62.4067 |
| 900 | 16631 | AI028856 | 99.0196 | 599.9867 | 112.2449 | 64.6549 | 72.3076 |
| 504 | 16976 | AA901341 | 99.0196 | 630.3390 | 110.0159 | 244.6155 | 67.7554 |
| 496 | 4797 | AA900967 | 98.9680 | 239.9153 | 2.9022 | 150.0514 | 44.9756 |
| 1391 | 8477 | AI179167 | 98.9164 | 1373.4903 | 73.9002 | 595.5884 | 183.3453 |
| 1203 | 18473 | AI168975 | 98.9164 | 502.5353 | 39.9997 | 204.2286 | 69.6891 |
| 1146 | 24375 | AI104979 | 98.9164 | 168.6763 | 3.3642 | 109.8936 | 32.6563 |
| 714 | 3207 | AA997466 | 98.9164 | −77.1093 | 28.2336 | 241.8528 | 97.3643 |
| 2197 | 13634 | NM_024403 | 98.8648 | 1647.6060 | 76.4982 | 822.0337 | 216.6497 |
| 1685 | 15374 | H34186 | 98.8648 | 179.9300 | 10.9265 | 101.8803 | 26.4536 |
| 618 | 22697 | AA945996 | 98.8648 | 76.7463 | 14.9592 | 408.5599 | 156.2251 |
| 782 | 21596 | AI009168 | 98.8648 | 886.3967 | 192.5967 | 312.3243 | 85.2827 |
| 1197 | 23631 | AI145650 | 98.8132 | 475.8523 | 20.6543 | 247.4404 | 91.2200 |
| 2516 | 657 | NM_133380 | 98.8132 | 630.2727 | 103.1035 | 224.5298 | 57.1698 |
| 1114 | 10659 | AI103059 | 98.7616 | 384.3923 | 15.9078 | 156.3555 | 73.8458 |
| 1080 | 10971 | AI073212 | 98.7100 | 110.4397 | 11.4396 | 42.1501 | 15.6427 |
| 1153 | 4479 | AI111599 | 98.7100 | 495.3427 | 80.8484 | 160.3289 | 83.4252 |
| 1454 | 2372 | AI230373 | 98.7100 | 18.7610 | 0.4810 | 43.1912 | 19.0817 |
| 2493 | 8820 | NM_080399 | 98.7100 | 139.3167 | 15.6944 | 399.3163 | 123.0551 |
| 576 | 22317 | AA943766 | 98.7100 | 75.9110 | 17.8196 | 190.4315 | 45.8238 |

TABLE 5K

Clenbuterol—Core Tox Markers
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 1330 | 15191 | AI176456 | 100.0000 | 4848.8693 | 52.4545 | 170.8348 | 500.4770 |
| 2558 | 945 | NM_138882 | 99.9484 | 134.3437 | 6.0542 | −12.6304 | 30.0697 |
| 2587 | 20740 | NM_145878 | 99.8452 | 1340.9600 | 37.6412 | 448.7949 | 136.3810 |
| 1664 | 21147 | D63772 | 99.6388 | 41.2293 | 0.3146 | 18.0479 | 11.2102 |
| 1782 | 23806 | NM_012733 | 99.5356 | 13.5270 | 2.1598 | 60.1184 | 25.4038 |
| 2243 | 10878 | NM_031110 | 99.4840 | 1562.5993 | 0.6741 | 1634.2253 | 283.9885 |
| 2550 | 15190 | NM_138826 | 99.3808 | 3461.6643 | 487.6477 | 233.6376 | 289.1438 |
| 2550 | 15189 | NM_138826 | 99.3808 | 3694.3787 | 503.1788 | 329.6283 | 310.6204 |
| 1755 | 24716 | NM_012589 | 99.3808 | 72.2240 | 15.4827 | −7.4551 | 11.1158 |
| 104 | 13930 | AA800613 | 99.3292 | 413.1923 | 21.7059 | 110.7163 | 65.7014 |
| 108 | 23368 | AA800678 | 99.3292 | 218.4663 | 5.4029 | 406.7741 | 91.9227 |
| 1759 | 2629 | NM_012603 | 99.2776 | 55.7473 | 2.8928 | 21.3916 | 17.0047 |
| 2350 | 20555 | NM_031987 | 99.2776 | 11.0847 | 0.4816 | 27.9069 | 10.1556 |
| 1855 | 11113 | NM_013046 | 99.1744 | 174.2973 | 52.1552 | 35.8404 | 17.9581 |
| 2114 | 23705 | NM_022396 | 99.1744 | 97.8843 | 16.9478 | 265.3709 | 68.2915 |
| 2511 | 25730 | NM_133290 | 99.1228 | 399.7273 | 10.3185 | 224.2822 | 72.9452 |
| 1802 | 15032 | NM_012816 | 99.1228 | 31.6433 | 0.0984 | 38.3319 | 10.0770 |
| 2507 | 1809 | NM_130741 | 99.1228 | 180.1930 | 66.3027 | 26.7980 | 76.5754 |
| 2406 | 21709 | NM_053596 | 99.0712 | 543.6700 | 42.4038 | 253.3641 | 57.3564 |
| 2358 | 23715 | NM_033237 | 99.0712 | 94.8683 | 16.8393 | 9.9387 | 25.1145 |
| 2052 | 20734 | NM_019283 | 99.0196 | 339.2357 | 52.4888 | 94.2550 | 46.1601 |
| 1855 | 11114 | NM_013046 | 98.9680 | 362.1807 | 141.4201 | 30.5894 | 32.3749 |
| 2052 | 20735 | NM_019283 | 98.9680 | 365.3143 | 51.6737 | 101.7314 | 46.4986 |
| 2070 | 2453 | NM_019385 | 98.9164 | 30.1920 | 0.5191 | 53.0373 | 29.6950 |
| 2624 | 21654 | U53184 | 98.8648 | 572.4030 | 49.6785 | 203.9429 | 73.2109 |
| 1787 | 8829 | NM_012749 | 98.8648 | 505.2817 | 40.4494 | 267.9187 | 70.0353 |
| 1670 | 20456 | H31144 | 98.8132 | 3.9490 | 0.1578 | 22.3578 | 32.7458 |
| 2278 | 3292 | NM_031531 | 98.8132 | 223.2543 | 132.5781 | −1.3809 | 27.7261 |
| 1959 | 20702 | NM_017166 | 98.8132 | 48.1140 | 6.8500 | 149.9956 | 64.9653 |
| 2411 | 1228 | NM_053625 | 98.7616 | 134.1093 | 1.0635 | 192.5306 | 40.0635 |
| 1831 | 190 | NM_012940 | 98.7616 | 64.3393 | 8.8634 | −4.6305 | 25.2465 |
| 2526 | 1824 | NM_133545 | 98.7100 | 54.2170 | 5.5644 | 112.5691 | 25.7844 |
| 2378 | 622 | NM_053369 | 98.6584 | 17.4750 | 0.5633 | 45.3087 | 19.1055 |
| 245 | 11635 | AA859645 | 98.6584 | 69.4783 | 5.2594 | 135.5475 | 28.8584 |
| 1800 | 10248 | NM_012797 | 98.6584 | 421.4460 | 3.2657 | 307.6573 | 85.3529 |
| 1914 | 6598 | NM_017020 | 98.6584 | 65.9897 | 8.8529 | 23.0423 | 10.4630 |
| 2086 | 19710 | NM_021744 | 98.6584 | 89.4057 | 2.6970 | 48.5489 | 23.0344 |
| 468 | 3910 | AA894345 | 98.6068 | 118.1183 | 0.3407 | 145.4331 | 35.4410 |
| 268 | 17217 | AA866299 | 98.6068 | 257.0393 | 5.0020 | 405.4736 | 80.5839 |
| 1880 | 21682 | NM_013154 | 98.5552 | 184.9510 | 96.4663 | −9.7676 | 54.3813 |
| 2005 | 355 | NM_017334 | 98.5036 | 94.2290 | 12.0303 | 9.8934 | 28.6974 |

TABLE 5K-continued

Clenbuterol--Core Tox Markers
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 293 | 16312 | AA875032 | 98.4520 | 285.0370 | 77.1088 | 67.3643 | 35.2005 |
| 415 | 17590 | AA892851 | 98.4520 | 90.5147 | 4.1203 | 48.3731 | 16.1590 |
| 1828 | 18695 | NM_012931 | 98.4520 | 217.4283 | 76.3852 | 35.0061 | 39.0491 |
| 1853 | 733 | NM_013040 | 98.4004 | 61.5817 | 0.4070 | 84.3478 | 27.7086 |
| 2276 | 12580 | NM_031514 | 98.4004 | 62.9820 | 11.9219 | 19.4747 | 9.1851 |
| 1649 | 20127 | AJ011116 | 98.2972 | 93.0660 | 7.5880 | 30.6760 | 20.9299 |
| 2145 | 21115 | NM_022602 | 98.2972 | 231.9090 | 10.3353 | 102.9476 | 53.5277 |
| 2410 | 13005 | NM_053623 | 98.2972 | 39.8907 | 4.6011 | 18.4472 | 7.3766 |
| 278 | 16029 | AA874803 | 98.2972 | 81.3597 | 27.8106 | 13.8859 | 19.1912 |
| 2687 | 12978 | X96437 | 98.2972 | 174.3473 | 30.0006 | 78.0023 | 51.9326 |
| 2005 | 356 | NM_017334 | 98.2456 | 165.1347 | 274.9797 | 41.3534 | 45.3902 |
| 2684 | 25761 | X89702 | 98.2456 | 27.2957 | 0.9103 | 10.3706 | 13.3401 |
| 2267 | 18597 | NM_031325 | 98.1940 | 278.9343 | 56.3348 | 94.5047 | 63.0400 |
| 63 | 14250 | AA799729 | 98.1940 | 352.4563 | 54.8318 | 145.1721 | 51.5631 |
| 749 | 23044 | AF034218 | 98.1940 | 475.3620 | 72.5360 | 227.0935 | 51.1801 |
| 2345 | 17556 | NM_031975 | 98.1424 | 447.2547 | 4.5099 | 418.5919 | 269.8707 |
| 1589 | 21653 | AI237535 | 98.0908 | 271.2960 | 36.0854 | 116.2228 | 40.6966 |
| 403 | 4512 | AA892578 | 98.0908 | 136.4383 | 56.5763 | 23.1132 | 27.3790 |
| 278 | 16030 | AA874803 | 98.0908 | 46.1457 | 31.5041 | −6.3851 | 16.6583 |
| 2556 | 17532 | NM_138877 | 97.9876 | 166.7917 | 5.1276 | 264.8779 | 55.6876 |
| 2090 | 20161 | NM_021836 | 97.9360 | 231.1267 | 105.1007 | 36.2762 | 39.2601 |
| 1866 | 357 | NM_013086 | 97.9360 | 85.4477 | 19.1172 | 25.4313 | 18.0127 |
| 400 | 11203 | AA892554 | 97.9360 | 94.6200 | 7.3173 | 50.3291 | 16.1130 |
| 2032 | 24019 | NM_019186 | 97.9360 | 104.0047 | 17.2367 | 27.0516 | 25.4071 |
| 1626 | 20614 | AI639246 | 97.8844 | 42.7467 | 1.2769 | 17.2406 | 214.8896 |
| 2528 | 244 | NM_133551 | 97.8844 | 196.2470 | 29.2619 | 63.1635 | 44.1915 |
| 1637 | 10097 | AI639425 | 97.8844 | 71.4007 | 3.2167 | 118.9075 | 22.9977 |
| 2551 | 16249 | NM_138827 | 97.8844 | 42.3113 | 4.1646 | −4.0842 | 48.6353 |
| 1880 | 21683 | NM_013154 | 97.8328 | 271.7527 | 92.8744 | 48.5984 | 33.9935 |
| 2665 | 21657 | X61381 | 97.7812 | 1448.9427 | 42.7862 | 954.6483 | 229.3213 |
| 1769 | 9423 | NM_012649 | 97.7812 | 477.6037 | 161.5233 | 167.2220 | 78.0601 |
| 1882 | 25567 | NM_013156 | 97.7812 | 138.8263 | 11.4355 | 67.6319 | 35.7175 |
| 2289 | 1921 | NM_031576 | 97.7812 | 181.9453 | 43.7093 | 81.4987 | 23.2311 |
| 405 | 19085 | AA892598 | 97.7296 | 103.0713 | 12.4950 | 52.2006 | 14.0771 |
| 325 | 5384 | AA891041 | 97.7296 | 329.6763 | 123.8702 | 42.1950 | 55.7465 |
| 1772 | 16197 | NM_012663 | 97.7296 | 160.0660 | 0.8063 | 161.5913 | 52.3362 |
| 1828 | 18694 | NM_012931 | 97.7296 | 85.3757 | 71.6381 | −7.2428 | 25.7180 |
| 2 | 6153 | AA875531 | 97.6780 | 184.3700 | 32.7761 | 622.7538 | 222.1150 |
| 2363 | 25072 | NM_052807 | 97.6780 | 25.2017 | 6.0933 | −6.1292 | 14.8911 |
| 467 | 17336 | AA894297 | 97.6780 | 38.8513 | 6.0298 | 15.6028 | 7.6997 |
| 1956 | 21975 | NM_017154 | 97.6264 | 509.6623 | 141.1960 | 180.4975 | 77.5763 |
| 2058 | 24674 | NM_019328 | 97.6264 | 39.2367 | 0.4022 | 33.2995 | 26.8241 |
| 747 | 1097 | AF016296 | 97.6264 | 113.2633 | 13.0527 | 303.5668 | 99.7399 |
| 2538 | 17337 | NM_134351 | 97.6264 | 274.9593 | 43.2507 | 141.9581 | 42.9696 |
| 2527 | 11483 | NM_133546 | 97.5748 | 255.8617 | 50.3113 | 99.1670 | 43.7596 |
| 2187 | 15353 | NM_024356 | 97.5748 | 54.9167 | 15.7750 | 19.2374 | 16.8658 |
| 1737 | 2736 | NM_012519 | 97.5748 | 211.0247 | 16.5303 | 358.5069 | 62.9998 |
| 2584 | 15640 | NM_145775 | 97.5232 | 143.6827 | 1.3775 | 141.8909 | 61.0655 |
| 1219 | 804 | AI169756 | 97.5232 | 135.3840 | 26.7548 | 52.3425 | 29.2084 |
| 1961 | 17301 | NM_017173 | 97.5232 | 148.7857 | 39.6259 | 502.6110 | 155.5782 |
| 2696 | 15570 | Z78279 | 97.5232 | 193.2387 | 49.8258 | 622.6698 | 207.2827 |
| 2234 | 1295 | NM_031097 | 97.5232 | 27.4813 | 7.8224 | 75.2102 | 19.2171 |
| 2435 | 15003 | NM_053819 | 97.4716 | 763.7743 | 241.5009 | 94.6028 | 189.1382 |
| 405 | 19086 | AA892598 | 97.4716 | 157.9933 | 20.0631 | 75.1020 | 28.1408 |
| 115 | 17658 | AA800853 | 97.4716 | 4.3310 | 3.7428 | 41.4360 | 20.5048 |
| 1985 | 15301 | NM_017259 | 97.4200 | 275.7437 | 37.4354 | 100.2767 | 84.4844 |
| 2435 | 15002 | NM_053819 | 97.3684 | 872.2577 | 263.0266 | 207.7934 | 185.5842 |
| 2670 | 25090 | X63594 | 97.3684 | 441.3950 | 92.2155 | 140.5463 | 81.4944 |
| 2137 | 9240 | NM_022540 | 97.3684 | 933.6183 | 14.9587 | 1170.9649 | 183.3070 |
| 1082 | 15192 | AI101099 | 99.9484 | 245.0187 | 6.7325 | 70.9741 | 40.1911 |
| 1203 | 18472 | AI168975 | 99.8968 | 261.0007 | 4.7005 | 67.1399 | 41.9499 |
| 2400 | 3049 | NM_053582 | 99.8968 | 1215.6133 | 12.3725 | 248.1956 | 126.6890 |
| 1305 | 15984 | AI175777 | 99.8452 | 492.0337 | 8.2519 | 247.8687 | 57.6010 |
| 1437 | 15078 | AI228830 | 99.8452 | 83.0913 | 1.8675 | 206.5969 | 127.3381 |
| 2582 | 6988 | NM_145677 | 99.7420 | 148.1523 | 21.8467 | 12.9282 | 79.2454 |
| 851 | 24200 | AI012356 | 99.7420 | 1831.3610 | 51.0588 | 650.5468 | 193.2024 |
| 800 | 6844 | AI009770 | 99.7420 | −15.2123 | 3.7916 | 158.4966 | 89.8726 |
| 2082 | 23424 | NM_021680 | 99.6388 | 495.8370 | 8.8821 | 309.6446 | 63.2709 |
| 1401 | 13619 | AI179464 | 99.6388 | 260.5140 | 8.2960 | 135.0774 | 46.7347 |
| 1211 | 13240 | AI169311 | 99.5872 | 384.1850 | 26.2196 | 46.0984 | 41.1069 |
| 1349 | 5943 | AI177105 | 99.5872 | 2.5757 | 7.2305 | 117.6422 | 43.8729 |
| 231 | 14209 | AA858955 | 99.5872 | 95.2830 | 0.6904 | 186.1088 | 61.0930 |
| 966 | 2348 | AI044794 | 99.5872 | 235.1720 | 0.4753 | 280.7291 | 97.6111 |

TABLE 5K-continued

Clenbuterol--Core Tox Markers
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 1320 | 22765 | AI176265 | 99.5356 | 111.5053 | 3.6676 | 22.9075 | 22.6912 |
| 500 | 11467 | AA901069 | 99.5356 | 216.0630 | 2.1991 | 139.6584 | 38.0034 |
| 861 | 23025 | AI012621 | 99.4840 | −14.1163 | 0.4311 | 27.1357 | 41.4489 |
| 634 | 23471 | AA955162 | 99.4840 | 283.3903 | 14.5924 | 77.3412 | 35.0796 |
| 580 | 22381 | AA944216 | 99.4840 | 175.8840 | 6.3195 | 103.3030 | 23.7487 |
| 597 | 22081 | AA944818 | 99.4840 | 94.4403 | 6.8233 | 229.1844 | 47.7646 |
| 1142 | 4626 | AI104744 | 99.4324 | 91.5253 | 4.1731 | 27.8457 | 26.4231 |
| 235 | 15157 | AA859343 | 99.4324 | 39.1553 | 0.2282 | 65.6418 | 20.2172 |
| 1301 | 13353 | AI175508 | 99.3808 | 116.6127 | 5.6815 | 200.6327 | 32.2702 |
| 2430 | 9059 | NM_053783 | 99.3808 | 636.5220 | 39.1324 | 271.8312 | 79.8237 |
| 760 | 4018 | AI007770 | 99.3808 | 27.1503 | 4.5802 | −11.2888 | 10.8308 |
| 1547 | 22152 | AI234822 | 99.3292 | 57.3433 | 2.7280 | −0.2891 | 20.2076 |
| 899 | 7315 | AI028831 | 99.3292 | 214.7143 | 34.5163 | 10.0917 | 25.3182 |
| 1575 | 15051 | AI236332 | 99.2776 | 615.7103 | 141.6182 | 119.3141 | 105.8113 |
| 973 | 5675 | AI045026 | 99.2776 | 1314.5897 | 174.2619 | 156.0669 | 123.3530 |
| 1294 | 2331 | AI175045 | 99.2260 | 1230.4933 | 59.9098 | 389.0874 | 358.2674 |
| 1512 | 11873 | AI232326 | 99.2260 | 964.7597 | 160.1007 | 147.0140 | 109.6199 |
| 1281 | 13266 | AI172326 | 99.2260 | 349.0043 | 67.6682 | 94.0862 | 43.1564 |
| 608 | 11871 | AA945679 | 99.2260 | 3316.3687 | 720.1954 | 43.1452 | 326.8880 |
| 2400 | 3050 | NM_053582 | 99.1744 | 615.6347 | 84.2415 | 87.5598 | 59.6096 |
| 802 | 2605 | AI009843 | 99.1744 | 36.3433 | 10.6257 | 302.2771 | 139.0916 |
| 1339 | 21740 | AI176810 | 99.1228 | 697.6160 | 38.4674 | 276.3875 | 85.5203 |
| 1539 | 6532 | AI234105 | 99.1228 | 933.6980 | 54.8957 | 449.2898 | 126.9559 |
| 1497 | 12435 | AI231810 | 99.1228 | 116.6823 | 3.7442 | 229.7496 | 48.2511 |
| 1337 | 3619 | AI176588 | 99.1228 | 46.3957 | 0.1635 | 57.9467 | 16.1863 |
| 495 | 23038 | AA900881 | 99.1228 | 155.3643 | 13.0636 | 20.6635 | 122.9799 |
| 1227 | 2729 | AI170363 | 99.0712 | 193.8313 | 10.9173 | 480.0400 | 152.5689 |
| 2554 | 9796 | NM_138847 | 99.0712 | 48.0417 | 4.7084 | 6.8524 | 13.4118 |
| 651 | 5210 | AA956550 | 99.0712 | 52.3533 | 1.8222 | 96.2220 | 21.6672 |
| 982 | 10020 | AI045632 | 99.0712 | 290.1433 | 29.1231 | 117.2104 | 99.4120 |
| 1408 | 15892 | AI179988 | 99.0196 | 334.6830 | 40.5811 | 58.3685 | 50.3007 |
| 1426 | 6715 | AI228284 | 99.0196 | 96.9987 | 8.6659 | 42.9113 | 17.2734 |
| 1400 | 15042 | AI179422 | 99.0196 | 147.0083 | 7.5527 | 44.1413 | 36.5945 |
| 169 | 9083 | AA819332 | 99.0196 | 118.1750 | 6.7094 | 251.4949 | 62.4067 |
| 900 | 16631 | AI028856 | 99.0196 | 599.9867 | 112.2449 | 64.6549 | 72.3076 |
| 504 | 16976 | AA901341 | 99.0196 | 630.3390 | 110.0159 | 244.6155 | 67.7554 |
| 496 | 4797 | AA900967 | 98.9680 | 239.9153 | 2.9022 | 150.0514 | 44.9756 |
| 1391 | 8477 | AI179167 | 98.9164 | 1373.4903 | 73.9002 | 595.5884 | 183.3453 |
| 1203 | 18473 | AI168975 | 98.9164 | 502.5353 | 39.9997 | 204.2286 | 69.6891 |
| 1146 | 24375 | AI104979 | 98.9164 | 168.6763 | 3.3642 | 109.8936 | 32.6563 |
| 202 | 19071 | AA850524 | 98.9164 | 175.4793 | 5.4536 | 67.1093 | 38.8081 |
| 714 | 3207 | AA997466 | 98.9164 | −77.1093 | 28.2336 | 241.8528 | 97.3643 |
| 2197 | 13634 | NM_024403 | 98.8648 | 1647.6060 | 76.4982 | 822.0337 | 216.6497 |
| 1162 | 4969 | AI113008 | 98.8648 | 206.4873 | 38.0144 | −18.9284 | 47.1111 |
| 1685 | 15374 | H34186 | 98.8648 | 179.9300 | 10.9265 | 101.8803 | 26.4536 |
| 618 | 22697 | AA945996 | 98.8648 | 76.7463 | 14.9592 | 408.5599 | 156.2251 |
| 782 | 21596 | AI009168 | 98.8648 | 886.3967 | 192.5967 | 312.3243 | 85.2827 |
| 1197 | 23631 | AI145650 | 98.8132 | 475.8523 | 20.6543 | 247.4404 | 91.2200 |
| 2516 | 657 | NM_133380 | 98.8132 | 630.2727 | 103.1035 | 224.5298 | 57.1698 |
| 1114 | 10659 | AI103059 | 98.7616 | 384.3923 | 15.9078 | 156.3555 | 73.8458 |
| 1080 | 10971 | AI073212 | 98.7100 | 110.4397 | 11.4396 | 42.1501 | 15.6427 |
| 1153 | 4479 | AI111599 | 98.7100 | 495.3427 | 80.8484 | 160.3289 | 83.4252 |
| 1454 | 2372 | AI230373 | 98.7100 | 18.7610 | 0.4810 | 43.1912 | 19.0817 |
| 2493 | 8820 | NM_080399 | 98.7100 | 139.3167 | 15.6944 | 399.3163 | 123.0551 |
| 576 | 22317 | AA943766 | 98.7100 | 75.9110 | 17.8196 | 190.4315 | 45.8238 |

TABLE 5L

CYCLOPHOSPHAMIDE
Timepoint(s): 6, 48, 192 hrs

| SEQ ID | GLGC ID | GenBank Accession No. | LDA Score | Mean Tox | SD Tox | Mean Nontox | SD Nontox |
|---|---|---|---|---|---|---|---|
| 116 | 10320 | AA800855 | 89.7810 | 42.8029 | 11.5542 | 80.2271 | 26.6350 |
| 2683 | 25752 | X89694 | 89.4281 | 45.8312 | 32.3077 | −48.6677 | 50.3680 |
| 454 | 4565 | AA893994 | 88.9990 | 22.3941 | 7.4914 | 43.5158 | 14.2550 |
| 352 | 6535 | AA891746 | 88.9067 | 326.4850 | 26.2854 | 443.6589 | 71.1219 |
| 366 | 4474 | AA891969 | 88.1246 | 83.1301 | 16.8788 | 38.9299 | 27.3714 |
| 1882 | 3430 | NM_013156 | 87.9803 | 166.8932 | 45.6262 | 107.2888 | 28.3774 |

TABLE 5L-continued

CYCLOPHOSPHAMIDE
Timepoint(s): 6, 48, 192 hrs

| SEQ ID | GLGC ID | GenBank Accession No. | LDA Score | Mean Tox | SD Tox | Mean Nontox | SD Nontox |
|---|---|---|---|---|---|---|---|
| 2105 | 17160 | NM_022298 | 87.2263 | 2103.6017 | 246.2741 | 1700.7727 | 422.7708 |
| 2228 | 25600 | NM_031077 | 86.6528 | 46.2684 | 8.1829 | 70.3570 | 19.5693 |
| 2690 | 25777 | Y08355 | 86.4964 | 318.4775 | 67.4468 | 233.5822 | 144.3214 |
| 2269 | 4235 | NM_031330 | 86.2998 | 418.5075 | 36.8917 | 323.8966 | 67.8761 |
| 2068 | 20298 | NM_019374 | 86.0632 | −209.7280 | 224.0546 | 75.5678 | 98.8103 |
| 1714 | 25438 | M32757 | 85.7263 | 36.9592 | 16.6537 | 71.6885 | 22.8019 |
| 2170 | 23215 | NM_023102 | 85.7143 | 73.2627 | 9.3638 | 100.2808 | 26.8456 |
| 1724 | 17130 | M62992 | 85.5178 | 157.2409 | 27.1432 | 121.4634 | 27.8730 |
| 377 | 17350 | AA892240 | 85.3092 | 33.7344 | 14.9914 | 70.3727 | 23.6117 |
| 2020 | 16227 | NM_019137 | 85.2691 | −8.5485 | 40.6641 | 57.0384 | 38.3097 |
| 2128 | 4242 | NM_022521 | 85.2170 | 354.5961 | 76.3555 | 238.4828 | 64.2738 |
| 2619 | 298 | U25282 | 84.9322 | 39.3249 | 7.5073 | 58.9297 | 23.5384 |
| 1270 | 9538 | AI172097 | 84.4870 | 139.5897 | 45.3819 | 246.1349 | 56.4678 |
| 2612 | 25075 | U01347 | 84.4229 | −55.1296 | 123.6013 | 126.3349 | 124.4803 |
| 1981 | 17501 | NM_017248 | 84.1101 | 47.8965 | 10.5383 | 30.7274 | 16.7063 |
| 332 | 21928 | AA891302 | 84.0058 | 24.0430 | 8.7688 | 40.1568 | 12.3982 |
| 292 | 15573 | AA875023 | 84.0058 | 85.2547 | 7.1748 | 105.6006 | 18.1901 |
| 2217 | 485 | NM_031017 | 83.9416 | 26.1465 | 4.0048 | 30.0318 | 14.0485 |
| 2027 | 20440 | NM_019166 | 83.8213 | 15.0142 | 24.2204 | 51.5582 | 18.9648 |
| 2066 | 18819 | NM_019367 | 83.5365 | 9.6234 | 18.9771 | 47.3364 | 25.9806 |
| 2130 | 4601 | NM_022524 | 83.5085 | 124.2250 | 54.2512 | 64.3827 | 25.3876 |
| 1647 | 25235 | AJ001290 | 83.4202 | 21.0332 | 3.1490 | 28.7791 | 9.5164 |
| 2254 | 1816 | NM_031134 | 83.3801 | 63.6727 | 11.0712 | 36.9095 | 24.3261 |
| 1859 | 21287 | NM_013065 | 83.2478 | 663.9862 | 249.7618 | 437.6605 | 113.2092 |
| 266 | 15846 | AA866250 | 83.1716 | 28.2028 | 18.3707 | 68.2328 | 33.9342 |
| 1836 | 22434 | NM_012974 | 83.0553 | 75.1141 | 22.1786 | 158.0193 | 85.7508 |
| 2226 | 21182 | NM_031054 | 83.0392 | 446.7158 | 113.3050 | 273.5515 | 73.8746 |
| 1356 | 14989 | AI177366 | 82.9871 | 1065.5044 | 242.9779 | 724.6623 | 151.5867 |
| 2002 | 1894 | NM_017320 | 82.8828 | 323.7673 | 130.9377 | 148.5104 | 74.7605 |
| 1832 | 20928 | NM_012941 | 82.8587 | 4.8148 | 9.5444 | 22.6804 | 14.0144 |
| 1897 | 20864 | NM_013215 | 82.7545 | 7.0454 | 5.2635 | 24.6889 | 14.9762 |
| 2328 | 1170 | NM_031789 | 82.5580 | 99.0908 | 23.3225 | 74.5513 | 20.4279 |
| 2230 | 4684 | NM_031083 | 82.4537 | 90.8723 | 14.6729 | 55.9466 | 21.9963 |
| 2175 | 1879 | NM_024138 | 82.2211 | 52.2070 | 12.8776 | 70.6751 | 19.1321 |
| 1722 | 24662 | M59786 | 82.1810 | 160.5178 | 9.0516 | 177.7223 | 40.3160 |
| 2219 | 16210 | NM_031026 | 81.9082 | 344.3033 | 25.2730 | 309.6258 | 80.6548 |
| 1752 | 1709 | NM_012581 | 81.9082 | 42.6635 | 6.6617 | 60.1366 | 32.4778 |
| 1727 | 21882 | M83740 | 81.7639 | 67.8985 | 9.4656 | 96.4214 | 28.1915 |
| 1950 | 492 | NM_017140 | 81.7478 | 521.8128 | 359.0693 | 200.5845 | 132.3089 |
| 249 | 21440 | AA859719 | 81.6596 | 69.1262 | 6.7560 | 58.8514 | 29.7861 |
| 1919 | 24597 | NM_017040 | 81.6315 | 664.7450 | 113.9138 | 481.3343 | 107.1911 |
| 2382 | 4622 | NM_053463 | 81.5673 | 744.0142 | 80.0984 | 594.7047 | 97.8738 |
| 2107 | 11454 | NM_022381 | 81.5152 | 295.1553 | 62.6632 | 209.1293 | 63.0907 |
| 2675 | 25737 | X70667 | 81.4911 | 20.6926 | 7.4353 | 33.0323 | 16.0955 |
| 1955 | 16955 | NM_017151 | 81.3829 | 917.9139 | 347.0575 | 528.0292 | 172.1319 |
| 2598 | 25495 | S59892 | 81.3588 | 179.2540 | 16.6020 | 140.4145 | 34.0588 |
| 2350 | 20554 | NM_031987 | 81.3468 | 30.1092 | 19.3862 | 75.9650 | 36.7275 |
| 354 | 9905 | AA891774 | 81.2665 | 3.2448 | 32.2360 | 42.2181 | 22.7696 |
| 259 | 18468 | AA859966 | 81.2665 | 57.1878 | 30.4622 | 95.0510 | 27.8996 |
| 1675 | 4362 | H31842 | 81.0981 | 31.5221 | 34.1067 | 35.6249 | 20.7827 |
| 1980 | 17561 | NM_017245 | 81.0219 | 181.7411 | 42.6801 | 286.7749 | 138.0625 |
| 2529 | 25369 | NM_133559 | 81.0219 | 18.4957 | 4.2567 | 26.8936 | 11.1197 |
| 2098 | 20450 | NM_022239 | 80.9818 | 46.5020 | 15.8107 | 72.8100 | 22.3093 |
| 291 | 16241 | AA875019 | 80.9818 | 29.5792 | 3.7244 | 39.2193 | 9.5723 |
| 2481 | 919 | NM_057125 | 80.9176 | −8.1594 | 16.5029 | 28.3589 | 38.3582 |
| 456 | 22583 | AA894009 | 80.8254 | 17.6804 | 3.1824 | 23.9761 | 5.7883 |
| 1885 | 200 | NM_013161 | 80.8254 | 55.7341 | 11.1492 | 79.2127 | 22.5790 |
| 2096 | 20225 | NM_022198 | 80.7732 | 32.5332 | 10.4836 | 96.7807 | 57.4815 |
| 2469 | 1108 | NM_054005 | 80.7331 | 16.5236 | 7.6479 | 33.0522 | 11.9111 |
| 7 | 14980 | AI103396 | 80.7211 | 30.2779 | 12.3506 | 13.1152 | 14.7570 |
| 2279 | 1005 | NM_031537 | 80.7211 | 48.6211 | 8.6610 | 32.9766 | 20.1841 |
| 348 | 23058 | AA891733 | 80.6569 | 216.2758 | 48.4577 | 282.9896 | 72.7094 |
| 1748 | 619 | NM_012565 | 80.5126 | 28.8201 | 3.2076 | 36.6183 | 8.6739 |
| 1693 | 381 | L00124 | 80.4083 | 17.2289 | 7.4306 | 29.1982 | 10.6731 |
| 1967 | 20779 | NM_017201 | 80.3160 | 165.3218 | 17.5305 | 124.0075 | 27.8463 |
| 2257 | 15485 | NM_031137 | 80.2759 | 30.7244 | 11.8598 | 14.1573 | 10.2435 |
| 2580 | 1948 | NM_145092 | 80.2639 | 135.8238 | 30.4102 | 82.4756 | 43.2075 |
| 95 | 21069 | AA800200 | 80.2519 | 35.4449 | 5.3390 | 49.5922 | 14.2142 |
| 1981 | 17502 | NM_017248 | 80.2238 | 285.0915 | 63.2148 | 193.0939 | 56.4031 |
| 74 | 20998 | AA799803 | 80.1315 | 524.4325 | 181.7060 | 279.3474 | 80.8708 |
| 2015 | 20536 | NM_019122 | 80.1195 | 38.3231 | 31.6941 | 11.8192 | 22.3703 |
| 1905 | 17972 | NM_016989 | 80.1075 | 27.8115 | 11.5342 | 42.8828 | 11.8088 |
| 1405 | 18895 | AI179916 | 80.0032 | 114.9495 | 22.6815 | 163.3734 | 34.7994 |

TABLE 5L-continued

CYCLOPHOSPHAMIDE
Timepoint(s): 6, 48, 192 hrs

| SEQ ID | GLGC ID | GenBank Accession No. | LDA Score | Mean Tox | SD Tox | Mean Nontox | SD Nontox |
|---|---|---|---|---|---|---|---|
| 1870 | 19949 | NM_013106 | 79.9751 | 131.3377 | 28.7340 | 82.5089 | 20.9379 |
| 1704 | 17086 | M13011 | 79.9390 | 157.1793 | 28.2946 | 209.2537 | 48.6931 |
| 1801 | 20246 | NM_012807 | 79.9230 | 4.4057 | 29.0201 | 46.5865 | 21.6320 |
| 1924 | 912 | NM_017059 | 79.8709 | 514.3985 | 115.6418 | 380.2598 | 63.1228 |
| 1852 | 17174 | NM_013030 | 79.8187 | 88.9931 | 34.3390 | 44.8814 | 24.0878 |
| 2599 | 25496 | S59893 | 79.7425 | 201.9165 | 22.2101 | 157.5616 | 37.4827 |
| 441 | 22150 | AA893607 | 79.6503 | 224.3901 | 48.0786 | 151.1148 | 44.5119 |
| 2638 | 25659 | U95157 | 79.6142 | 38.9102 | 12.7519 | 90.1269 | 61.2185 |
| 1625 | 20021 | AI639214 | 79.5981 | 21.5031 | 62.2867 | −68.4464 | 58.7235 |
| 2129 | 4412 | NM_022523 | 79.5861 | 505.8172 | 57.5353 | 391.7156 | 81.3105 |
| 56 | 20980 | AA799633 | 79.5741 | 34.7882 | 6.1143 | 49.3264 | 15.3112 |
| 2069 | 18032 | NM_019380 | 79.5219 | 44.1663 | 19.4651 | 88.9932 | 44.5654 |
| 1991 | 15142 | NM_017278 | 79.4417 | 29.8871 | 10.2390 | 14.9828 | 11.7599 |
| 2273 | 18655 | NM_031358 | 79.4016 | 48.4742 | 105.6019 | 156.9252 | 61.1346 |
| 2171 | 8269 | NM_023103 | 79.3134 | 15.1508 | 3.8355 | 21.8943 | 9.4989 |
| 2486 | 15408 | NM_057197 | 79.3014 | 201.3526 | 31.1048 | 267.5795 | 79.7365 |
| 59 | 18226 | AA799641 | 79.2733 | 347.2062 | 41.3967 | 285.8516 | 55.2318 |
| 2660 | 25705 | X59375 | 79.2452 | 529.9615 | 172.6778 | 359.4869 | 116.2552 |
| 2014 | 1581 | NM_017365 | 79.2211 | 370.1620 | 43.9235 | 296.6924 | 61.2129 |
| 2164 | 18098 | NM_022947 | 79.1570 | 43.4105 | 10.6774 | 58.5767 | 15.2037 |
| 1732 | 23698 | NM_012489 | 79.1570 | 22.5660 | 4.4851 | 36.6734 | 12.7716 |
| 1971 | 19928 | NM_017220 | 95.5162 | 925.7691 | 133.5806 | 455.9207 | 201.3601 |
| 228 | 13802 | AA858853 | 90.0417 | 82.1183 | 15.6432 | 139.6727 | 38.6296 |
| 736 | 2782 | AA998565 | 89.6767 | 90.1382 | 18.5820 | 55.6441 | 44.4733 |
| 1104 | 11563 | AI102560 | 89.2717 | 223.4953 | 52.2880 | 116.1155 | 54.8260 |
| 1847 | 23545 | NM_013013 | 88.9067 | 5945.0338 | 1280.6033 | 3900.7723 | 1027.4567 |
| 963 | 5553 | AI044632 | 88.6861 | 24.6978 | 17.7864 | 86.3451 | 83.0760 |
| 1102 | 5969 | AI102520 | 87.8118 | 600.5945 | 76.7185 | 426.2666 | 122.9818 |
| 2018 | 461 | NM_019131 | 87.4870 | 59.9835 | 10.9837 | 99.8830 | 30.2609 |
| 925 | 7715 | AI030599 | 87.3827 | 19.2980 | 5.1869 | 33.8221 | 11.9180 |
| 2169 | 9286 | NM_023027 | 87.3306 | 222.8223 | 32.2374 | 310.6062 | 67.9793 |
| 630 | 22771 | AA946432 | 87.2904 | 559.0163 | 58.8088 | 385.8688 | 93.0129 |
| 475 | 2559 | AA899828 | 87.1220 | 284.6615 | 53.9835 | 411.3248 | 89.1976 |
| 662 | 19283 | AA957259 | 87.0699 | 265.8252 | 85.8404 | 429.5856 | 125.7037 |
| 894 | 15786 | AI013924 | 86.8733 | 156.4094 | 30.5506 | 89.4438 | 41.8035 |
| 1003 | 19093 | AI058869 | 86.2878 | 83.5065 | 38.2466 | 188.3403 | 83.9028 |
| 950 | 5378 | AI044112 | 86.1835 | 320.8532 | 19.9846 | 373.9869 | 86.1896 |
| 901 | 12805 | AI028870 | 86.0792 | 77.2402 | 22.4623 | 11.6043 | 53.3344 |
| 1017 | 7970 | AI059549 | 85.9349 | 104.6198 | 20.6103 | 152.3275 | 31.0565 |
| 2127 | 4151 | NM_022518 | 85.9228 | 391.9504 | 84.6875 | 603.8739 | 163.2447 |
| 763 | 11368 | AI007948 | 85.7383 | 60.7732 | 29.7627 | 12.0356 | 24.9961 |
| 653 | 23840 | AA956689 | 85.6862 | 89.0182 | 59.5736 | −30.0771 | 58.9398 |
| 1792 | 17261 | NM_012766 | 85.6220 | 766.4824 | 84.1296 | 575.6093 | 138.9607 |
| 1030 | 17796 | AI070214 | 85.5057 | 76.7958 | 16.8909 | 147.3081 | 60.3874 |
| 1403 | 3094 | AI179700 | 85.4135 | 39.5858 | 11.4552 | 87.0693 | 51.0256 |
| 1593 | 18854 | AI237636 | 85.2972 | 164.8416 | 20.7067 | 191.7377 | 51.6309 |
| 692 | 19145 | AA964613 | 85.2691 | 475.8288 | 65.8220 | 361.1610 | 60.9836 |
| 1324 | 13511 | AI176331 | 85.1528 | 210.4325 | 25.4688 | 155.3516 | 35.9170 |
| 681 | 2211 | AA963834 | 85.0485 | −13.4862 | 33.9645 | 51.7761 | 39.4487 |
| 643 | 5111 | AA955729 | 84.9844 | 240.8116 | 43.9451 | 365.5485 | 128.5405 |
| 1200 | 11337 | AI145968 | 84.8801 | 41.2845 | 12.0828 | 65.7655 | 19.9522 |
| 1413 | 17089 | AI180281 | 84.8400 | 1402.3132 | 189.5788 | 1086.3912 | 401.2285 |
| 656 | 16543 | AA956758 | 84.7999 | 53.5725 | 22.0423 | 97.1162 | 25.0521 |
| 1062 | 5740 | AI072092 | 84.7237 | 44.1492 | 12.5690 | 74.0108 | 26.5389 |
| 780 | 23337 | AI009096 | 84.7076 | 508.7272 | 176.7436 | 279.0357 | 100.2738 |
| 868 | 3191 | AI013075 | 84.6836 | 229.4547 | 29.9839 | 161.5617 | 44.6216 |
| 546 | 23464 | AA925876 | 84.6435 | 259.7548 | 64.2746 | 161.8276 | 51.8224 |
| 2329 | 1182 | NM_031790 | 84.6314 | 69.0456 | 16.7101 | 107.3778 | 26.4151 |
| 962 | 9876 | AI044553 | 84.2665 | 41.0540 | 22.0838 | 93.3784 | 36.4615 |
| 2576 | 12804 | NM_144740 | 84.2143 | 29.3941 | 16.9388 | 62.1187 | 24.9069 |
| 480 | 17355 | AA899959 | 84.1622 | 539.2781 | 108.7013 | 762.9939 | 169.7132 |
| 1122 | 4873 | AI103531 | 83.9256 | 727.1948 | 252.9898 | 441.5460 | 110.5566 |
| 704 | 17492 | AA996832 | 83.8895 | 532.6638 | 131.2774 | 802.8211 | 236.1699 |
| 25 | 15084 | AA799397 | 83.7571 | 67.0725 | 57.5538 | 197.8258 | 77.3188 |
| 593 | 22438 | AA944498 | 83.7451 | −10.9127 | 12.3748 | 23.1043 | 29.0729 |
| 1142 | 4626 | AI104744 | 83.6007 | 70.5967 | 26.6423 | 27.4654 | 26.1604 |
| 1416 | 14337 | AI180414 | 83.5365 | 236.3598 | 30.3950 | 307.7315 | 50.7455 |
| 995 | 8627 | AI058453 | 83.4323 | 19.7490 | 10.6688 | 39.2932 | 14.3428 |
| 521 | 4975 | AA924571 | 83.3280 | 66.2334 | 15.4385 | 105.7459 | 29.5074 |
| 234 | 6458 | AA859319 | 83.2758 | 13.9457 | 5.6771 | 34.2500 | 21.6628 |
| 620 | 18337 | AA946046 | 83.2758 | 423.4050 | 86.0876 | 592.1076 | 120.7567 |
| 482 | 11268 | AA899969 | 83.2117 | 103.1452 | 22.8648 | 146.3976 | 40.9740 |
| 895 | 15904 | AI013971 | 83.1716 | 297.8010 | 53.1909 | 427.0825 | 92.9293 |

TABLE 5L-continued

CYCLOPHOSPHAMIDE
Timepoint(s): 6, 48, 192 hrs

| SEQ ID | GLGC ID | GenBank Accession No. | LDA Score | Mean Tox | SD Tox | Mean Nontox | SD Nontox |
|---|---|---|---|---|---|---|---|
| 529 | 22911 | AA924943 | 83.1595 | 113.0401 | 27.8182 | 171.0561 | 61.5415 |
| 863 | 7044 | AI012641 | 83.1435 | 1676.3148 | 416.2079 | 1293.0095 | 246.6518 |
| 990 | 3319 | AI045989 | 83.0793 | 14.5687 | 17.0282 | 35.4199 | 15.6659 |
| 1184 | 12356 | AI137931 | 83.0152 | 57.0170 | 13.5032 | 99.2891 | 36.0694 |
| 946 | 7961 | AI044042 | 83.0152 | 21.9158 | 13.8782 | 46.4652 | 17.6986 |
| 804 | 18680 | AI010084 | 83.0152 | 117.5713 | 17.4993 | 164.6098 | 39.7749 |
| 1574 | 18610 | AI236307 | 82.9630 | 469.9288 | 62.6292 | 375.7056 | 74.7646 |
| 812 | 15924 | AI010312 | 82.9229 | 40.8472 | 37.0034 | 98.2426 | 37.6253 |
| 645 | 6658 | AA955857 | 82.9109 | 93.6829 | 22.9474 | 134.7486 | 31.5014 |
| 513 | 4917 | AA924140 | 82.9109 | 14.4837 | 15.2375 | 61.1111 | 36.2076 |

TABLE 5M

Cyclophosphamide
Core Tx Markers
Timepoint(s): 6, 48, 192 hrs

| SEQ ID | GLGC ID | GenBank Accession No. | LDA Score | Mean Tox | SD Tox | Mean Nontox | SD Nontox |
|---|---|---|---|---|---|---|---|
| 116 | 10320 | AA800855 | 89.7810 | 42.8029 | 11.5542 | 80.2271 | 26.6350 |
| 2683 | 25752 | X896944 | 89.4281 | 45.8312 | 32.3077 | −48.6677 | 50.3680 |
| 454 | 4565 | AA893994 | 88.9990 | 22.3941 | 7.4914 | 43.5158 | 14.2550 |
| 352 | 6535 | AA891746 | 88.9067 | 326.4850 | 26.2854 | 443.6589 | 71.1219 |
| 366 | 4474 | AA891969 | 88.1246 | 183.1301 | 16.8788 | 38.9299 | 27.3714 |
| 1882 | 3430 | NM_0131561 | 87.9803 | 166.8932 | 45.6262 | 107.2888 | 28.3774 |
| 2105 | 17160 | NM_022298 | 87.2263 | 2103.6017 | 246.2741 | 1700.7727 | 422.7708 |
| 2228 | 25600 | NM_031077 | 86.6528 | 46.2684 | 8.1829 | 70.3570 | 19.5693 |
| 2690 | 25777 | Y08355 | 86.4964 | 318.4775 | 67.4468 | 233.5822 | 144.3214 |
| 2269 | 4235 | NM_031330 | 86.2998 | 418.5075 | 36.8917 | 323.8966 | 67.8761 |
| 2068 | 20298 | NM_019374 | 86.0632 | −209.7280 | 224.0546 | 75.5678 | 98.8103 |
| 1714 | 25438 | M32757 | 85.7263 | 36.9592 | 16.6537 | 71.6885 | 22.8019 |
| 2170 | 23215 | NM_023102 | 85.7143 | 73.2627 | 9.3638 | 100.2808 | 26.8456 |
| 1724 | 17130 | M62992 | 85.5178 | 157.2409 | 27.1432 | 121.4634 | 27.8730 |
| 101 | 24228 | AA800318 | 85.4897 | 327.6269 | 131.5678 | 158.3839 | 46.2452 |
| 377 | 17350 | AA892240 | 85.3092 | 33.7344 | 14.9914 | 70.3727 | 23.6117 |
| 2020 | 16227 | NM_019137 | 85.2691 | −8.5485 | 40.6641 | 57.0384 | 38.3097 |
| 2128 | 4242 | NM_022521 | 85.2170 | 354.5961 | 76.3555 | 238.4828 | 64.2738 |
| 2619 | 298 | U25282 | 84.9322 | 39.3249 | 7.5073 | 58.9297 | 23.5384 |
| 426 | 22423 | AA893164 | 84.4991 | 191.4260 | 97.7415 | 85.1822 | 50.7684 |
| 1270 | 9538 | AI172097 | 84.4870 | 139.5897 | 45.3819 | 246.1349 | 56.4678 |
| 2612 | 25075 | U01347 | 84.4229 | −55.1296 | 123.6013 | 126.3349 | 124.4803 |
| 1981 | 17501 | NM_017248 | 84.1101 | 47.8965 | 10.5383 | 30.7274 | 16.7063 |
| 332 | 21928 | AA891302 | 84.0058 | 24.0430 | 8.7688 | 40.1568 | 12.3982 |
| 292 | 15573 | AA875023 | 84.0058 | 85.2547 | 7.1748 | 105.6006 | 18.1901 |
| 2217 | 485 | NM_031017 | 83.9416 | 26.1465 | 4.0048 | 30.0318 | 14.0485 |
| 2027 | 20440 | NM_019166 | 83.8213 | 15.0142 | 24.2204 | 51.5582 | 18.9648 |
| 2066 | 18819 | NM_019367 | 83.5365 | 9.6234 | 18.9771 | 47.3364 | 25.9806 |
| 2130 | 4601 | NM_022524 | 83.5085 | 124.2250 | 54.2512 | 64.3827 | 25.3876 |
| 1647 | 25235 | AJ001290 | 83.4202 | 21.0332 | 3.1490 | 28.7791 | 9.5164 |
| 2254 | 1816 | NM_031134 | 83.3801 | 63.6727 | 11.0712 | 36.9095 | 24.3261 |
| 1859 | 21287 | NM_013065 | 83.2478 | 663.9862 | 249.7618 | 437.6605 | 113.2092 |
| 266 | 15846 | AA866250 | 83.1716 | 28.2028 | 18.3707 | 68.2328 | 33.9342 |
| 1836 | 22434 | NM_012974 | 83.0553 | 75.1141 | 22.1786 | 158.0193 | 85.7508 |
| 2226 | 21182 | NM_031054 | 83.0392 | 446.7158 | 113.3050 | 273.5515 | 73.8746 |
| 1356 | 14989 | AI177366 | 82.9871 | 1065.5044 | 242.9779 | 724.6623 | 151.5867 |
| 2002 | 1894 | NM_017320 | 82.8828 | 323.7673 | 130.9377 | 148.5104 | 74.7605 |
| 1832 | 20928 | NM_012941 | 82.8587 | 4.8148 | 9.5444 | 22.6804 | 14.0144 |
| 1897 | 20864 | NM_013215 | 82.7545 | 7.0454 | 5.2635 | 24.6889 | 14.9762 |
| 2328 | 1170 | NM_031789 | 82.5580 | 99.0908 | 23.3225 | 74.5513 | 20.4279 |
| 2230 | 4684 | NM_031083 | 82.4537 | 90.8723 | 14.6729 | 55.9466 | 21.9963 |
| 2175 | 1879 | NM_024138 | 82.2211 | 52.2070 | 12.8776 | 70.6751 | 19.1321 |
| 1722 | 24662 | M59786 | 82.1810 | 160.5178 | 9.0516 | 177.7223 | 40.3160 |
| 2219 | 16210 | NM_031026 | 81.9082 | 344.3033 | 25.2730 | 309.6258 | 80.6548 |
| 1752 | 1709 | NM_012581 | 81.9082 | 42.6635 | 6.6617 | 60.1366 | 32.4778 |
| 1727 | 21882 | M83740 | 81.7639 | 67.8985 | 9.4656 | 96.4214 | 28.1915 |
| 1950 | 492 | NM_017140 | 81.7478 | 521.8128 | 359.0693 | 200.5845 | 132.3089 |
| 249 | 21440 | AA859719 | 81.6596 | 69.1262 | 6.7560 | 58.8514 | 29.7861 |
| 1919 | 24597 | NM_017040 | 81.6315 | 664.7450 | 113.9138 | 481.3343 | 107.1911 |
| 2382 | 4622 | NM_053463 | 81.5673 | 744.0142 | 80.0984 | 594.7047 | 97.8738 |

TABLE 5M-continued

Cyclophosphamide
Core Tx Markers
Timepoint(s): 6, 48, 192 hrs

| SEQ ID | GLGC ID | GenBank Accession No. | LDA Score | Mean Tox | SD Tox | Mean Nontox | SD Nontox |
|---|---|---|---|---|---|---|---|
| 2107 | 11454 | NM_022381 | 81.5152 | 295.1553 | 62.6632 | 209.1293 | 63.0907 |
| 2675 | 25737 | X70667 | 81.4911 | 20.6926 | 7.4353 | 33.0323 | 16.0955 |
| 1955 | 16955 | NM_017151 | 81.3829 | 917.9139 | 347.0575 | 528.0292 | 172.1319 |
| 2598 | 25495 | S59892 | 81.3588 | 179.2540 | 16.6020 | 140.4145 | 34.0588 |
| 2350 | 20554 | NM_031987 | 81.3468 | 30.1092 | 19.3862 | 75.9650 | 36.7275 |
| 354 | 9905 | AA891774 | 81.2665 | 3.2448 | 32.2360 | 42.2181 | 22.7696 |
| 259 | 18468 | AA859966 | 81.2665 | 57.1878 | 30.4622 | 95.0510 | 27.8996 |
| 1675 | 4362 | H31842 | 81.0981 | 31.5221 | 34.1067 | 35.6249 | 20.7827 |
| 1980 | 17561 | NM_017245 | 81.0219 | 181.7411 | 42.6801 | 286.7749 | 138.0625 |
| 2529 | 25369 | NM_133559 | 81.0219 | 18.4957 | 4.2567 | 26.8936 | 11.1197 |
| 2098 | 20450 | NM_022239 | 80.9818 | 46.5020 | 15.8107 | 72.8100 | 22.3093 |
| 291 | 16241 | AA875019 | 80.9818 | 29.5792 | 3.7244 | 39.2193 | 9.5723 |
| 2481 | 919 | NM_057125 | 80.9176 | −8.1594 | 16.5029 | 28.3589 | 38.3582 |
| 456 | 22583 | AA894009 | 80.8254 | 17.6804 | 3.1824 | 23.9761 | 5.7883 |
| 1885 | 200 | NM_013161 | 80.8254 | 55.7341 | 11.1492 | 79.2127 | 22.5790 |
| 2096 | 20225 | NM_022198 | 80.7732 | 32.5332 | 10.4836 | 96.7807 | 57.4815 |
| 2469 | 1108 | NM_054005 | 80.7331 | 16.5236 | 7.6479 | 33.0522 | 11.9111 |
| 7 | 14980 | AI103396 | 80.7211 | 30.2779 | 12.3506 | 13.1152 | 14.7570 |
| 2279 | 1005 | NM_031537 | 80.7211 | 48.6211 | 8.6610 | 32.9766 | 20.1841 |
| 1860 | 25676 | NM_013069 | 80.6810 | 75.3428 | 70.7945 | 167.8154 | 66.1244 |
| 348 | 23058 | AA891733 | 80.6569 | 216.2758 | 48.4577 | 282.9896 | 72.7094 |
| 1748 | 619 | NM_012565 | 80.5126 | 28.8201 | 3.2076 | 36.6183 | 8.6739 |
| 1693 | 381 | L00124 | 80.4083 | 17.2289 | 7.4306 | 29.1982 | 10.6731 |
| 1967 | 20779 | NM_017201 | 80.3160 | 165.3218 | 17.5305 | 124.0075 | 27.8463 |
| 2257 | 15485 | NM_031137 | 80.2759 | 30.7244 | 11.8598 | 14.1573 | 10.2435 |
| 2580 | 1948 | NM_145092 | 80.2639 | 135.8238 | 30.4102 | 82.4756 | 43.2075 |
| 95 | 21069 | AA800200 | 80.2519 | 35.4449 | 5.3390 | 49.5922 | 14.2142 |
| 1981 | 17502 | NM_017248 | 80.2238 | 285.0915 | 63.2148 | 193.0939 | 56.4031 |
| 1790 | 15174 | NM_012756 | 80.1837 | 257.3659 | 99.4323 | 167.1174 | 50.4460 |
| 74 | 20998 | AA799803 | 80.1315 | 524.4325 | 181.7060 | 279.3474 | 80.8708 |
| 2015 | 20536 | NM_019122 | 80.1195 | 38.3231 | 31.6941 | 11.8192 | 22.3703 |
| 1905 | 17972 | NM_016989 | 80.1075 | 27.8115 | 11.5342 | 42.8828 | 11.8088 |
| 1405 | 18895 | AI179916 | 80.0032 | 114.9495 | 22.6815 | 163.3734 | 34.7994 |
| 1870 | 19949 | NM_013106 | 79.9751 | 131.3377 | 28.7340 | 82.5089 | 20.9379 |
| 1704 | 17086 | M13011 | 79.9390 | 157.1793 | 28.2946 | 209.2537 | 48.6931 |
| 1801 | 20246 | NM_012807 | 79.9230 | 4.4057 | 29.0201 | 46.5865 | 21.6320 |
| 2665 | 21657 | X61381 | 79.8709 | 1487.1038 | 441.9326 | 948.9767 | 218.1292 |
| 1924 | 912 | NM_017059 | 79.8709 | 514.3985 | 115.6418 | 380.2598 | 63.1228 |
| 1852 | 17174 | NM_013030 | 79.8187 | 88.9931 | 34.3390 | 44.8814 | 24.0878 |
| 2599 | 25496 | S59893 | 79.7425 | 201.9165 | 22.2101 | 157.5616 | 37.4827 |
| 441 | 22150 | AA893607 | 79.6503 | 224.3901 | 48.0786 | 151.1148 | 44.5119 |
| 2638 | 25659 | U95157 | 79.6142 | 38.9102 | 12.7519 | 90.1269 | 61.2185 |
| 1625 | 20021 | AI639214 | 79.5981 | 21.5031 | 62.2867 | −68.4464 | 58.7235 |
| 2129 | 4412 | NM_022523 | 79.5861 | 505.8172 | 57.5353 | 391.7156 | 81.3105 |
| 56 | 20980 | AA799633 | 79.5741 | 34.7882 | 6.1143 | 49.3264 | 15.3112 |
| 2069 | 18032 | NM_019380 | 79.5219 | 44.1663 | 19.4651 | 88.9932 | 44.5654 |
| 1991 | 15142 | NM_017278 | 79.4417 | 29.9871 | 10.2390 | 14.9828 | 11.7599 |
| 2273 | 18655 | NM_031358 | 79.4016 | 48.4742 | 105.6019 | 156.9252 | 61.1346 |
| 2171 | 8269 | NM_023103 | 79.3134 | 15.1508 | 3.8355 | 21.8943 | 9.4989 |
| 2486 | 15408 | NM_057197 | 79.3014 | 201.3526 | 31.1048 | 267.5795 | 79.7365 |
| 1971 | 19928 | NM_017220 | 95.5162 | 925.7691 | 133.5806 | 455.9207 | 201.3601 |
| 228 | 13802 | AA858853 | 90.0417 | 82.1183 | 15.6432 | 139.6725 | 38.6296 |
| 736 | 2782 | AA998565 | 89.6767 | 90.1382 | 18.5820 | 55.6441 | 44.4733 |
| 1104 | 11563 | AI102560 | 89.2717 | 223.4953 | 52.2880 | 116.1155 | 54.8260 |
| 1847 | 23545 | NM_013013 | 88.9067 | 5945.0338 | 1280.6033 | 3900.7723 | 1027.4567 |
| 963 | 5553 | AI044632 | 88.6861 | 24.6978 | 17.7864 | 86.3451 | 83.0760 |
| 1102 | 5969 | AI102520 | 87.8118 | 600.5945 | 76.7185 | 426.2666 | 122.9818 |
| 2018 | 461 | NM_019131 | 87.4870 | 59.9835 | 10.9837 | 99.8830 | 30.2609 |
| 925 | 7715 | AI030599 | 87.3827 | 19.2980 | 5.1869 | 33.8221 | 11.9180 |
| 2169 | 9286 | NM_023027 | 87.3306 | 222.8223 | 32.2374 | 310.6062 | 67.9793 |
| 630 | 22771 | AA946432 | 87.2904 | 559.0163 | 58.8088 | 385.8688 | 93.0129 |
| 475 | 2559 | AA899828 | 87.1220 | 284.6615 | 53.9835 | 411.3248 | 89.1976 |
| 662 | 19283 | AA957259 | 87.0699 | 265.8252 | 85.8404 | 429.5856 | 125.7037 |
| 894 | 15786 | AI013924 | 86.8733 | 156.4094 | 30.5506 | 89.4438 | 41.8035 |
| 1003 | 19093 | AI058869 | 86.2878 | 83.5065 | 38.2466 | 188.3403 | 83.9028 |
| 950 | 5378 | AI044112 | 86.1835 | 320.8532 | 19.9846 | 373.9869 | 86.1896 |
| 901 | 12805 | AI028870 | 86.0792 | 77.2402 | 22.4623 | 11.6043 | 53.3344 |
| 1017 | 7970 | AI059549 | 85.9349 | 104.6198 | 20.6103 | 152.3275 | 31.0565 |
| 2127 | 4151 | NM_022518 | 85.9228 | 391.9504 | 84.6875 | 603.8739 | 163.2447 |
| 763 | 11368 | AI007948 | 85.7383 | 60.7732 | 29.7627 | 12.0356 | 24.9961 |
| 653 | 23840 | AA956689 | 85.6862 | 89.0182 | 59.5736 | −30.0771 | 58.9398 |
| 1792 | 17261 | NM_012766 | 85.6220 | 766.4824 | 84.1296 | 575.6093 | 138.9607 |

TABLE 5M-continued

Cyclophosphamide
Core Tx Markers
Timepoint(s): 6, 48, 192 hrs

| SEQ ID | GLGC ID | GenBank Accession No. | LDA Score | Mean Tox | SD Tox | Mean Nontox | SD Nontox |
|---|---|---|---|---|---|---|---|
| 1030 | 17796 | AI070214 | 85.5057 | 76.7958 | 16.8909 | 147.3081 | 60.3874 |
| 1403 | 3094 | AI179700 | 85.4135 | 39.5858 | 11.4552 | 87.0693 | 51.0256 |
| 1593 | 18854 | AI237636 | 85.2972 | 164.8416 | 20.7067 | 191.7377 | 51.6309 |
| 692 | 19145 | AA964613 | 85.2691 | 475.8288 | 65.8220 | 361.1610 | 60.9836 |
| 1324 | 13511 | AI176331 | 85.1528 | 210.4325 | 25.4688 | 155.3516 | 35.9170 |
| 681 | 2211 | AA963834 | 85.0485 | −13.4862 | 33.9645 | 51.7761 | 39.4487 |
| 643 | 5111 | AA955729 | 84.9844 | 240.8116 | 43.9451 | 365.5485 | 128.5405 |
| 1200 | 11337 | AI145968 | 84.8801 | 41.2845 | 12.0828 | 65.7655 | 19.9522 |
| 1413 | 17089 | AI180281 | 84.8400 | 1402.3132 | 189.5788 | 1086.3912 | 401.2285 |
| 656 | 16543 | AA956758 | 84.7999 | 53.5725 | 22.0423 | 97.1162 | 25.0521 |
| 1062 | 5740 | AI072092 | 84.7237 | 44.1492 | 12.5690 | 74.0108 | 26.5389 |
| 780 | 23337 | AI009096 | 84.7076 | 508.7272 | 176.7436 | 279.0357 | 100.2738 |
| 868 | 3191 | AI013075 | 84.6836 | 229.4547 | 29.9839 | 161.5617 | 44.6216 |
| 546 | 23464 | AA925876 | 84.6435 | 259.7548 | 64.2746 | 161.8276 | 51.8224 |
| 2329 | 1182 | NM_031790 | 84.6314 | 69.0456 | 16.7101 | 107.3778 | 26.4151 |
| 962 | 9876 | AI044553 | 84.2665 | 41.0540 | 22.0838 | 93.3784 | 36.4615 |
| 2576 | 12804 | NM_144740 | 84.2143 | 29.3941 | 16.9388 | 62.1187 | 24.9069 |
| 480 | 17355 | AA899959 | 84.1622 | 539.2781 | 108.7013 | 762.9939 | 169.7132 |
| 1122 | 4873 | AI103531 | 83.9256 | 727.1948 | 252.9898 | 441.5460 | 110.5566 |
| 704 | 17492 | AA996832 | 83.8895 | 532.6638 | 131.2774 | 802.8211 | 236.1699 |
| 25 | 15084 | AA799397 | 83.7571 | 67.0725 | 57.5538 | 197.8258 | 77.3188 |
| 593 | 22438 | AA944498 | 83.7451 | −10.9127 | 12.3748 | 23.1043 | 29.0729 |
| 1142 | 4626 | AI104744 | 83.6007 | 70.5967 | 26.6423 | 27.4654 | 26.1604 |
| 1416 | 14337 | AI180414 | 83.5365 | 236.3598 | 30.3950 | 307.7315 | 50.7455 |
| 928 | 19257 | AI030775 | 83.5085 | 21.1983 | 35.8030 | −27.3921 | 31.3944 |
| 995 | 8627 | AI058453 | 83.4323 | 19.7490 | 10.6688 | 39.2932 | 14.3428 |
| 521 | 4975 | AA924571 | 83.3280 | 66.2334 | 15.4385 | 105.7459 | 29.5074 |
| 234 | 6458 | AA859319 | 83.2758 | 13.9457 | 5.6771 | 34.2500 | 21.6628 |
| 620 | 18337 | AA946046 | 83.2758 | 423.4050 | 86.0876 | 592.1076 | 120.7567 |
| 482 | 11268 | AA899969 | 83.2117 | 103.1452 | 22.8648 | 146.3976 | 40.9740 |
| 895 | 15904 | AI013971 | 83.1716 | 297.8010 | 53.1909 | 427.0825 | 92.9293 |
| 529 | 22911 | AA924943 | 83.1595 | 113.0401 | 27.8182 | 171.0561 | 61.5415 |
| 863 | 7044 | AI012641 | 83.1435 | 1676.3148 | 416.2079 | 1293.0095 | 246.6518 |
| 990 | 3319 | AI045989 | 83.0793 | 14.5687 | 17.0282 | 35.4199 | 15.6659 |
| 1184 | 12356 | AI137931 | 83.0152 | 57.0170 | 13.5032 | 99.2891 | 36.0694 |
| 946 | 7961 | AI044042 | 83.0152 | 21.9158 | 13.8782 | 46.4652 | 17.6986 |
| 804 | 18680 | AI010084 | 83.0152 | 117.5713 | 17.4993 | 164.6098 | 39.7749 |
| 1574 | 18610 | AI236307 | 82.9630 | 469.9288 | 62.6292 | 375.7056 | 74.7646 |
| 812 | 15924 | AI010312 | 82.9229 | 40.8472 | 37.0034 | 98.2426 | 37.6253 |
| 645 | 6658 | AA955857 | 82.9109 | 93.6829 | 22.9474 | 134.7486 | 31.5014 |
| 513 | 4917 | AA924140 | 82.9109 | 14.4837 | 15.2375 | 61.1111 | 36.2076 |

TABLE 5N

EPINEPHRINE
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 742 | 21666 | AB012214 | 99.2776 | 26.5160 | 0.5537 | 6.1908 | 11.8188 |
| 1814 | 23651 | NM_012881 | 99.1744 | 1189.0270 | 603.8436 | 41.0596 | 145.0774 |
| 2028 | 7486 | NM_019169 | 99.1744 | 38.6977 | 0.5324 | 87.5030 | 51.1809 |
| 356 | 18128 | AA891800 | 99.1228 | 97.7840 | 0.8931 | 136.4916 | 26.0286 |
| 2280 | 16049 | NM_031541 | 98.8132 | 62.2973 | 0.9762 | 88.2642 | 88.2297 |
| 297 | 16416 | AA875098 | 98.7100 | 84.5417 | 18.0022 | 38.6044 | 12.6402 |
| 2139 | 12422 | NM_022546 | 98.6068 | 128.8727 | 4.6111 | 79.9457 | 18.8585 |
| 1760 | 25450 | NM_012609 | 98.5552 | 71.5753 | 0.5908 | 100.0363 | 33.8216 |
| 1764 | 20589 | NM_012618 | 98.5036 | 705.7920 | 156.4907 | 148.0740 | 85.6816 |
| 1907 | 24869 | NM_016992 | 98.5036 | 89.4850 | 1.5779 | 155.9979 | 43.2849 |
| 1359 | 17570 | AI177683 | 98.4004 | 219.0427 | 0.6782 | 209.9197 | 61.7961 |
| 2251 | 14970 | NM_031127 | 98.3488 | 36.4547 | 1.8231 | 80.6479 | 20.5629 |
| 2394 | 11843 | NM_053555 | 98.2456 | 125.3780 | 14.4234 | 73.8868 | 16.2415 |
| 2092 | 243 | NM_021989 | 98.0908 | 792.8837 | 10.8311 | 621.4805 | 114.4201 |
| 1988 | 20913 | NM_017272 | 97.8844 | 106.9910 | 1.1868 | 152.4929 | 40.5650 |
| 1511 | 14034 | AI232321 | 97.8844 | 80.2733 | 0.2583 | 84.1934 | 19.2986 |
| 2467 | 25249 | NM_054001 | 97.8844 | 81.8490 | 0.6821 | 101.0746 | 26.2928 |
| 458 | 15913 | AA894092 | 97.7812 | 137.9433 | 40.1589 | 32.5121 | 22.2242 |
| 1860 | 16925 | NM_013069 | 97.7812 | 642.3187 | 46.1746 | 975.4178 | 177.5760 |

TABLE 5N-continued

EPINEPHRINE
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 1646 | 23219 | AJ000347 | 97.7812 | 0.1467 | 1.3517 | 21.5528 | 23.5072 |
| 2017 | 20318 | NM_019127 | 97.6780 | 14.1007 | 0.2911 | 21.6317 | 7.7240 |
| 320 | 15629 | AA875629 | 97.6780 | 44.0570 | 0.9964 | 60.2613 | 30.0527 |
| 2191 | 23488 | NM_024375 | 97.6264 | 34.2253 | 0.4176 | 42.8957 | 13.0247 |
| 2000 | 16844 | NM_017311 | 97.5748 | 2836.0520 | 13.2871 | 2828.8884 | 913.5317 |
| 84 | 18883 | AA799992 | 97.5748 | 163.1527 | 30.6395 | 68.5704 | 26.7822 |
| 84 | 18881 | AA799992 | 97.5232 | 45.3147 | 6.3140 | 18.6079 | 8.0491 |
| 1855 | 11114 | NM_013046 | 97.5232 | 59.7723 | 5.9778 | 31.5257 | 37.7707 |
| 2435 | 15003 | NM_053819 | 97.4200 | 785.0383 | 382.0336 | 94.5369 | 188.4213 |
| 2043 | 15503 | NM_019237 | 97.4200 | 215.3473 | 5.8073 | 143.6030 | 39.6125 |
| 2569 | 18108 | NM_139105 | 97.4200 | 250.3110 | 33.9669 | 157.8583 | 23.8601 |
| 2435 | 15002 | NM_053819 | 97.3684 | 937.6463 | 311.9264 | 207.5909 | 184.6641 |
| 2556 | 17530 | NM_138877 | 97.3684 | 153.7763 | 8.8256 | 95.0549 | 23.6960 |
| 2482 | 2413 | NM_057141 | 97.3684 | 737.1813 | 3.4232 | 625.9727 | 104.5680 |
| 1942 | 1375 | NM_017122 | 97.3684 | 87.1750 | 0.8159 | 105.0913 | 34.0323 |
| 1878 | 786 | NM_013148 | 97.3684 | 20.8183 | 0.4460 | 31.8745 | 11.5904 |
| 265 | 13974 | AA860030 | 97.3168 | 1001.5317 | 187.6777 | 538.4064 | 143.4835 |
| 2458 | 15135 | NM_053971 | 97.3168 | 1805.3227 | 222.7124 | 994.6434 | 216.5505 |
| 290 | 16215 | AA874999 | 97.3168 | 381.4167 | 68.5701 | 212.8355 | 44.1031 |
| 2123 | 2109 | NM_022511 | 97.3168 | 1133.9577 | 65.7596 | 757.7591 | 158.9157 |
| 2003 | 24533 | NM_017328 | 97.2652 | 121.7623 | 23.9496 | 272.2374 | 84.4221 |
| 2455 | 16654 | NM_053963 | 97.2136 | 22.0607 | 9.5395 | 6.3900 | 7.7609 |
| 2667 | 13646 | X62166 | 97.1620 | 1122.2877 | 163.9331 | 577.3346 | 154.8930 |
| 2392 | 15829 | NM_053551 | 97.1104 | 11.2407 | 0.4962 | 51.0544 | 73.5249 |
| 2628 | 25629 | U70270 | 97.1104 | 61.8770 | 0.9283 | 86.5926 | 34.0593 |
| 1932 | 1523 | NM_017079 | 97.1104 | 123.1260 | 12.9143 | 212.0214 | 51.9488 |
| 2214 | 15682 | NM_031011 | 97.0588 | 76.4617 | 1.9705 | 118.7850 | 33.9263 |
| 1907 | 24868 | NM_016992 | 97.0588 | 118.4540 | 0.4151 | 26.0513 | 12.4125 |
| 1649 | 20127 | AJ011116 | 97.0588 | 40.1933 | 0.6384 | 30.8397 | 21.2116 |
| 2423 | 13369 | NM_053742 | 97.0588 | 247.8743 | 1.7131 | 281.5172 | 59.2644 |
| 258 | 22940 | AA859922 | 97.0588 | 84.3060 | 1.6831 | 70.4649 | 20.4728 |
| 1776 | 503 | NM_012704 | 97.0072 | 46.9083 | 0.9373 | 63.6186 | 17.8034 |
| 1603 | 23781 | AI639012 | 97.0072 | 91.4017 | 25.3615 | 39.5741 | 16.7864 |
| 2335 | 22321 | NM_031832 | 96.9556 | 507.3317 | 93.8041 | 173.3048 | 95.6395 |
| 311 | 15446 | AA875327 | 96.9556 | 404.0587 | 6.9877 | 304.1873 | 73.1145 |
| 1629 | 17215 | AI639268 | 96.9040 | 83.5970 | 10.4867 | 168.0604 | 43.6118 |
| 2460 | 18798 | NM_053978 | 96.8524 | 107.5180 | 1.3541 | 138.4193 | 28.2947 |
| 2035 | 18572 | NM_019201 | 96.8524 | 908.0947 | 3.9575 | 1003.6540 | 145.8404 |
| 1956 | 21975 | NM_017154 | 96.8524 | 257.9910 | 7.7455 | 181.2767 | 79.8482 |
| 1639 | 20032 | AI639466 | 96.8008 | 17.5237 | 1.7078 | 43.4604 | 15.2240 |
| 1615 | 25899 | AI639136 | 96.7492 | 15.5163 | 0.2316 | 20.5485 | 7.1895 |
| 455 | 23731 | AA894004 | 96.7492 | 263.6543 | 18.5718 | 159.9061 | 45.0677 |
| 1748 | 619 | NM_012565 | 96.7492 | 22.4083 | 1.7778 | 36.5577 | 8.6468 |
| 2183 | 20770 | NM_024160 | 96.6976 | 156.8697 | 23.4808 | 56.2296 | 41.2374 |
| 225 | 1801 | AA858636 | 96.6976 | 120.4320 | 15.6344 | 76.8255 | 18.7138 |
| 2116 | 24536 | NM_022399 | 96.6976 | 1355.7977 | 41.0844 | 998.6555 | 188.8572 |
| 2054 | 10015 | NM_019289 | 96.6460 | 420.5977 | 68.7205 | 217.8729 | 63.7868 |
| 1696 | 25359 | L13202 | 96.5944 | 33.1293 | 0.4272 | 43.7954 | 14.7516 |
| 1857 | 15253 | NM_013058 | 96.5944 | 237.1250 | 24.9522 | 108.3637 | 47.0250 |
| 2227 | 11849 | NM_031065 | 96.5944 | 1458.8320 | 107.8285 | 940.8786 | 195.5401 |
| 1612 | 12400 | AI639107 | 96.5428 | 48.3297 | 12.2020 | 24.2917 | 8.7001 |
| 2454 | 16552 | NM_053961 | 96.4912 | 92.8854 | 24.4873 | 38.9750 | 18.7740 |
| 2445 | 18357 | NM_053864 | 96.4912 | 323.6223 | 3.3133 | 319.9372 | 82.7828 |
| 313 | 15513 | AA875431 | 96.4912 | 166.9317 | 2.7130 | 189.9391 | 42.3197 |
| 2316 | 18054 | NM_031707 | 96.4396 | 83.6250 | 2.1335 | 126.2777 | 31.6272 |
| 359 | 7050 | AA891824 | 96.4396 | 67.4593 | 1.1035 | 60.3158 | 24.3089 |
| 2063 | 22675 | NM_019358 | 96.3880 | 87.7107 | 18.4663 | 30.8168 | 20.8898 |
| 330 | 24814 | AA891209 | 96.3880 | 125.6697 | 30.0655 | 71.9543 | 16.4597 |
| 1736 | 20518 | NM_012518 | 96.3364 | 175.7517 | 3.1089 | 226.4270 | 41.2545 |
| 1809 | 13151 | NM_012862 | 96.3364 | 3338.0793 | 190.6440 | 2187.6161 | 569.2195 |
| 1700 | 25816 | L23863 | 96.2848 | 17.6030 | 0.4452 | 25.6224 | 8.5933 |
| 1611 | 22555 | AI639103 | 96.2332 | 29.4340 | 3.0467 | 12.0415 | 8.1039 |
| 2022 | 5622 | NM_019143 | 96.2332 | 406.5067 | 100.2078 | 206.3462 | 60.9271 |
| 1770 | 16218 | NM_012656 | 96.2332 | 1127.6243 | 21.3959 | 845.7607 | 365.8797 |
| 1933 | 22552 | NM_017087 | 96.1816 | 715.1360 | 22.1595 | 452.2379 | 173.4372 |
| 2395 | 4327 | NM_053563 | 96.1816 | 157.7943 | 47.5454 | 91.5411 | 27.7979 |
| 2132 | 6100 | NM_022531 | 96.1816 | 3273.6163 | 299.3398 | 2108.3253 | 503.6042 |
| 2107 | 11454 | NM_022381 | 96.1816 | 286.6305 | 5.8844 | 210.0435 | 63.7797 |
| 2355 | 25529 | NM_033096 | 96.1300 | 38.6000 | 0.7893 | 38.3339 | 74.3495 |
| 1804 | 2853 | NM_012838 | 96.0784 | 150.4390 | 47.4404 | 80.3220 | 24.7315 |
| 1786 | 343 | NM_012747 | 96.0784 | 58.3073 | 4.3074 | 53.2117 | 43.8789 |
| 1785 | 1478 | NM_012744 | 96.0268 | 23.1500 | 0.6358 | 37.8936 | 24.9431 |
| 1974 | 18148 | NM_017226 | 96.0268 | 59.9527 | 2.7085 | 98.7423 | 29.3865 |

TABLE 5N-continued

EPINEPHRINE
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 1830 | 487 | NM_012937 | 95.9752 | 28.8640 | 0.7488 | 41.7508 | 11.9850 |
| 2215 | 1540 | NM_031012 | 95.9752 | 50.0801 | 14.4963 | 16.6814 | 13.4567 |
| 1950 | 492 | NM_017140 | 95.9236 | 118.3757 | 2.8412 | 205.1486 | 142.3625 |
| 2608 | 25547 | S78556 | 95.9236 | 191.8723 | 8.0536 | 356.1624 | 129.2161 |
| 410 | 12118 | AA892775 | 95.9236 | 1192.9273 | 298.6520 | 544.6224 | 298.7975 |
| 2259 | 15185 | NM_031140 | 95.9236 | 1429.2477 | 152.1055 | 931.2553 | 186.7858 |
| 2561 | 1168 | NM_138898 | 95.9236 | 21.1347 | 3.0824 | 6.1562 | 6.6213 |
| 2083 | 19661 | NM_021686 | 95.8720 | 6.7690 | 1.0521 | 28.3817 | 15.5908 |
| 1133 | 3527 | AI104278 | 99.8452 | 12.9287 | 0.0487 | 24.7505 | 21.0113 |
| 772 | 3931 | AI008697 | 99.4324 | 107.6857 | 0.2150 | 127.5319 | 30.5123 |
| 1496 | 7036 | AI231801 | 99.2776 | 101.0093 | 0.1155 | 113.8784 | 21.4829 |
| 623 | 12324 | AA946203 | 99.1228 | 35.7033 | 6.6789 | −35.6344 | 38.6620 |
| 1172 | 13717 | AI137131 | 99.0712 | 74.7137 | 0.9743 | 112.0620 | 23.7583 |
| 2205 | 21509 | NM_030847 | 98.9164 | 787.7937 | 27.5886 | 445.5429 | 136.0931 |
| 670 | 24135 | AA957736 | 98.9164 | 380.8940 | 1.7808 | 259.5384 | 91.8464 |
| 1555 | 11644 | AI235282 | 98.8648 | 510.5817 | 20.1340 | 224.8430 | 82.1521 |
| 200 | 22026 | AA850060 | 98.8132 | 3518.2023 | 8.7712 | 3305.1771 | 1100.9499 |
| 128 | 11166 | AA801346 | 98.7616 | 228.4097 | 13.3451 | 124.5399 | 35.4118 |
| 818 | 3211 | AI010612 | 98.7100 | 136.1203 | 47.1696 | 6.0020 | 17.2314 |
| 2513 | 4049 | NM_133298 | 98.6584 | 757.4380 | 272.8084 | 42.0070 | 124.2871 |
| 2513 | 4048 | NM_133298 | 98.6584 | 331.6660 | 154.6004 | 18.3030 | 75.1596 |
| 1467 | 24270 | AI230758 | 98.5552 | 238.9863 | 2.3146 | 170.0291 | 58.4029 |
| 887 | 22592 | AI013740 | 98.5552 | 836.2727 | 287.0068 | 201.6477 | 133.2668 |
| 639 | 23326 | AA955415 | 98.5036 | 111.8597 | 0.4384 | 126.6552 | 27.4519 |
| 1268 | 1506 | AI172051 | 98.4520 | 336.9553 | 11.6236 | 239.0523 | 37.0479 |
| 712 | 3165 | AA997386 | 98.4004 | 33.5920 | 0.3715 | 30.7942 | 25.0551 |
| 1957 | 17106 | NM_017160 | 98.2972 | 49.6850 | 0.6158 | 75.5109 | 26.2033 |
| 1442 | 23435 | AI229502 | 98.2972 | 27.0300 | 1.9148 | −34.1479 | 49.1359 |
| 2253 | 13929 | NM_031131 | 98.2456 | 331.9700 | 89.3004 | 110.4635 | 47.9681 |
| 1079 | 10970 | AI073207 | 98.2456 | 42.4007 | 1.1561 | 84.6732 | 32.6599 |
| 1246 | 21771 | AI171209 | 98.2456 | 1064.0957 | 7.2340 | 920.3425 | 230.4271 |
| 2305 | 16062 | NM_031646 | 98.2456 | 1259.5520 | 34.4070 | 841.6006 | 186.6852 |
| 604 | 4207 | AA945591 | 98.2456 | 291.3373 | 74.6083 | 122.4612 | 41.6400 |
| 2103 | 23511 | NM_022294 | 98.1940 | 124.6603 | 2.0103 | 76.6181 | 30.8712 |
| 1469 | 13915 | AI230826 | 98.1424 | 61.3407 | 0.3722 | 68.1771 | 16.9576 |
| 777 | 3832 | AI008985 | 98.1424 | 57.6423 | 0.5583 | 78.0201 | 35.2295 |
| 1243 | 13702 | AI171064 | 97.9876 | 24.4990 | 0.7311 | 49.7110 | 21.5412 |
| 553 | 894 | AA926305 | 97.9876 | 409.7137 | 21.2847 | 213.4587 | 79.8531 |
| 1162 | 4969 | AI113008 | 97.9360 | 113.4747 | 56.9545 | −18.6405 | 48.1540 |
| 1542 | 2765 | AI234283 | 97.8844 | 165.9460 | 2.0674 | 115.4260 | 33.7180 |
| 1528 | 5228 | AI233311 | 97.8844 | 172.1703 | 63.8689 | 17.5026 | 45.0830 |
| 1317 | 18581 | AI176160 | 97.8844 | 309.6860 | 8.9991 | 224.5213 | 58.7700 |
| 1101 | 2125 | AI102519 | 97.8328 | 458.4750 | 239.1954 | 110.1359 | 89.7111 |
| 1377 | 5760 | AI178361 | 97.8328 | 166.8853 | 2.3547 | 125.9282 | 28.0269 |
| 1342 | 10310 | AI176961 | 97.8328 | 468.2403 | 34.3944 | 773.8072 | 151.8248 |
| 1015 | 8347 | AI059519 | 97.8328 | 125.8373 | 71.4582 | 33.1032 | 24.2624 |
| 175 | 16971 | AA819691 | 97.7296 | 604.9870 | 2.2495 | 625.9080 | 110.1953 |
| 1001 | 10096 | AI058772 | 97.7296 | 45.2850 | 0.7088 | 67.9757 | 27.8152 |
| 210 | 4490 | AA851184 | 97.7296 | 350.7433 | 99.1027 | 71.4423 | 77.3708 |
| 1553 | 15004 | AI235224 | 97.6780 | 1513.7483 | 676.9818 | 333.7069 | 264.8772 |
| 1086 | 11634 | AI101338 | 97.6780 | 63.2070 | 1.0015 | 104.1398 | 33.6241 |
| 849 | 6606 | AI012308 | 97.6780 | 4957.6607 | 591.8675 | 1868.8558 | 759.0889 |
| 541 | 14945 | AA925364 | 97.6780 | 201.9357 | 4.8148 | 312.2025 | 284.6709 |
| 703 | 19396 | AA996740 | 97.6780 | 77.0060 | 0.5804 | 64.5836 | 22.0189 |
| 1059 | 9808 | AI072050 | 97.6264 | 21.9317 | 0.2473 | 28.2164 | 12.7466 |
| 1579 | 9546 | AI236520 | 97.6264 | 248.0543 | 3.4682 | 348.8435 | 71.5539 |
| 1297 | 21252 | AI175328 | 97.6264 | 21.4473 | 0.3102 | 27.0436 | 17.6819 |
| 149 | 8058 | AA818475 | 97.6264 | 502.7917 | 51.4777 | 316.4540 | 55.8216 |
| 518 | 4945 | AA924415 | 97.6264 | 48.4333 | 2.8325 | 114.2217 | 62.8329 |
| 825 | 24089 | AI010865 | 97.6264 | 383.9677 | 11.7182 | 215.7464 | 102.1879 |
| 841 | 2531 | AI011991 | 97.5748 | 232.7287 | 19.4053 | 128.3824 | 43.7997 |
| 1530 | 4475 | AI233374 | 97.5232 | 121.5643 | 1.2526 | 98.1603 | 24.6261 |
| 165 | 6098 | AA818935 | 97.5232 | 62.4710 | 5.0207 | 104.3365 | 21.8370 |
| 666 | 24040 | AA957422 | 97.5232 | 858.5613 | 317.0292 | 373.3416 | 133.6995 |
| 2212 | 21166 | NM_031005 | 97.5232 | 678.6667 | 202.1629 | 312.2661 | 87.1282 |
| 136 | 1901 | AA817849 | 97.4716 | 51.5103 | 3.4812 | 72.1035 | 66.0043 |
| 129 | 11995 | AA801352 | 97.4716 | 58.4227 | 0.5425 | 67.8725 | 29.5639 |
| 1060 | 18198 | AI072063 | 97.4200 | 223.5667 | 0.9721 | 230.7480 | 62.4391 |
| 1065 | 9218 | AI072197 | 97.4200 | 47.6807 | 0.8715 | 71.3801 | 31.9428 |
| 2262 | 23097 | NM_031145 | 97.4200 | 133.0247 | 18.6534 | 70.5065 | 23.7675 |
| 989 | 10053 | AI045948 | 97.4200 | 49.2487 | 0.7590 | 66.8934 | 38.0980 |
| 1386 | 18848 | AI178816 | 97.3684 | 16.4617 | 0.3413 | 27.1611 | 11.3058 |

TABLE 5N-continued

EPINEPHRINE
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 984 | 10028 | AI045707 | 97.3684 | 205.4137 | 3.2177 | 278.2003 | 56.9774 |
| 847 | 21796 | AI012221 | 97.3684 | 623.4527 | 184.6330 | 267.9207 | 90.6188 |

TABLE 5O

Epinephrine--Core Tox Markers
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 742 | 21666 | AB012214 | 99.2276 | 26.5160 | 0.5537 | 6.1908 | 11.8188 |
| 1814 | 23651 | NM_012881 | 99.1744 | 1189.0270 | 603.8436 | 41.0596 | 145.0774 |
| 2028 | 7486 | NM_019169 | 99.1744 | 38.6977 | 0.5324 | 87.5030 | 51.1809 |
| 356 | 18128 | AA891800 | 99.1228 | 97.7840 | 0.8931 | 136.4916 | 26.0286 |
| 2280 | 16049 | NM_031541 | 98.8132 | 62.2973 | 0.9762 | 88.2642 | 88.2297 |
| 297 | 16416 | AA875098 | 98.7100 | 84.5417 | 18.0022 | 38.6044 | 12.6402 |
| 2139 | 12422 | NM_022546 | 98.6068 | 128.8727 | 4.6111 | 79.9457 | 18.8585 |
| 1760 | 25450 | NM_012609 | 98.5552 | 71.5753 | 0.5908 | 100.0363 | 33.8216 |
| 1764 | 20589 | NM_012618 | 98.5036 | 705.7920 | 156.4907 | 148.0740 | 85.6816 |
| 1907 | 24869 | NM_016992 | 98.5036 | 89.4850 | 1.5779 | 155.9979 | 43.2849 |
| 1359 | 17570 | AI177683 | 98.4004 | 219.0427 | 0.6782 | 209.9197 | 61.7961 |
| 2251 | 14970 | NM_031127 | 98.3488 | 36.4547 | 1.8231 | 80.6479 | 20.5629 |
| 2394 | 11843 | NM_053555 | 98.2456 | 125.3780 | 14.4234 | 73.8868 | 16.2415 |
| 2092 | 243 | NM_021989 | 98.0908 | 792.8837 | 10.8311 | 621.4805 | 114.4201 |
| 1988 | 20913 | NM_017272 | 97.8844 | 106.9910 | 1.1868 | 152.4929 | 40.5650 |
| 1511 | 14034 | AI232321 | 97.8844 | 80.2733 | 0.2583 | 84.1934 | 19.2986 |
| 2467 | 25249 | NM_054001 | 97.8844 | 81.8490 | 0.6821 | 101.0746 | 26.2928 |
| 458 | 15913 | AA894092 | 97.7812 | 137.9433 | 40.1589 | 32.5121 | 22.2242 |
| 1860 | 16925 | NM_013069 | 97.7812 | 642.3187 | 46.1746 | 975.4178 | 177.5760 |
| 1646 | 23219 | AJ000347 | 97.7812 | 0.1467 | 1.3517 | 21.5528 | 23.5072 |
| 2017 | 20318 | NM_019127 | 97.6780 | 14.1007 | 0.2911 | 21.6317 | 7.7240 |
| 320 | 15629 | AA875629 | 97.6780 | 44.0570 | 0.9964 | 60.2613 | 30.0527 |
| 2191 | 23488 | NM_024375 | 97.6264 | 34.2253 | 0.4176 | 42.8957 | 13.0247 |
| 2000 | 16844 | NM_017311 | 97.5748 | 2836.0520 | 13.2871 | 2828.8884 | 913.5317 |
| 84 | 18883 | AA799992 | 97.5748 | 163.1527 | 30.6395 | 68.5704 | 26.7822 |
| 2483 | 1892 | NM_057144 | 97.5232 | 2524.4427 | 258.3548 | 1211.4688 | 391.7182 |
| 84 | 18881 | AA799992 | 97.5232 | 45.3147 | 6.3140 | 18.6079 | 8.0491 |
| 1855 | 11114 | NM_013046 | 97.5232 | 59.7723 | 5.9778 | 31.5257 | 37.7707 |
| 2435 | 15003 | NM_053819 | 97.4200 | 785.0383 | 382.0336 | 94.5369 | 188.4213 |
| 2449 | 385 | NM_053885 | 97.4200 | −2.5247 | 4.4773 | 45.8836 | 22.7615 |
| 2043 | 15503 | NM_019237 | 97.4200 | 215.3473 | 5.8073 | 143.6030 | 39.6125 |
| 2569 | 18108 | NM_139105 | 97.4200 | 250.3110 | 33.9669 | 157.8583 | 23.8601 |
| 2435 | 15002 | NM_053819 | 97.3684 | 937.6463 | 311.9264 | 207.5909 | 184.6641 |
| 2556 | 17530 | NM_138877 | 97.3684 | 153.7763 | 8.8256 | 95.0549 | 23.6960 |
| 2482 | 2413 | NM_057141 | 97.3684 | 737.1813 | 3.4232 | 625.9727 | 104.5680 |
| 1942 | 1375 | NM_017122 | 97.3684 | 87.1750 | 0.8159 | 105.0913 | 34.0323 |
| 1878 | 786 | NM_013148 | 97.3684 | 20.8183 | 0.4460 | 31.8745 | 11.5904 |
| 265 | 13974 | AA860030 | 97.3168 | 1001.5317 | 187.6777 | 538.4064 | 143.4835 |
| 2458 | 15135 | NM_0539711 | 97.3168 | 1805.3227 | 222.7124 | 994.6434 | 216.5505 |
| 290 | 16215 | AA874999 | 97.3168 | 381.4167 | 68.5701 | 212.8355 | 44.1031 |
| 2123 | 2109 | NM_022511 | 97.3168 | 1133.9577 | 65.7596 | 757.7591 | 158.9157 |
| 2003 | 24533 | NM_017328 | 97.2652 | 121.7623 | 23.9496 | 272.2374 | 84.4221 |
| 2455 | 16654 | NM_053963 | 97.2136 | 22.0607 | 9.5395 | 6.3900 | 7.7609 |
| 2667 | 13646 | X62166 | 97.1620 | 1122.2877 | 163.9331 | 577.3346 | 154.8930 |
| 2392 | 15829 | NM_053551 | 97.1104 | 11.2407 | 0.4962 | 51.0544 | 73.5249 |
| 2628 | 25629 | U70270 | 97.1104 | 61.8770 | 0.9283 | 86.5926 | 34.0593 |
| 1932 | 1523 | NM_017079 | 97.1104 | 123.1260 | 12.9143 | 212.0214 | 51.9488 |
| 2214 | 15682 | NM_031011 | 97.0588 | 76.4617 | 1.9705 | 118.7850 | 33.9263 |
| 1907 | 24868 | NM_016992 | 97.0588 | 18.4540 | 0.4151 | 26.0513 | 12.4125 |
| 1649 | 20127 | AJ011116 | 97.0588 | 40.1933 | 0.6384 | 30.8397 | 21.2116 |
| 2423 | 13369 | NM_053742 | 97.0588 | 247.8370 | 1.7131 | 281.5172 | 59.2644 |
| 258 | 22940 | AA859922 | 97.0588 | 84.3060 | 1.6831 | 70.4649 | 20.4728 |
| 1776 | 503 | NM_012704 | 97.0072 | 46.9083 | 0.9373 | 63.6186 | 17.8034 |
| 1603 | 23781 | AI639012 | 97.0072 | 91.4017 | 25.3615 | 39.5741 | 16.7864 |
| 2335 | 22321 | NM_031832 | 96.9556 | 507.3317 | 93.8041 | 173.3048 | 95.6395 |
| 2341 | 17734 | NM_031970 | 96.9556 | 2502.4650 | 847.6621 | 1047.1352 | 499.3653 |
| 311 | 15446 | AA875327 | 96.9556 | 404.0587 | 6.9877 | 304.1873 | 73.1145 |
| 1629 | 17215 | AI639268 | 96.9040 | 83.5970 | 10.4867 | 168.0604 | 43.6118 |
| 2460 | 18798 | NM_053978 | 96.8524 | 107.5180 | 1.3541 | 138.4193 | 28.2947 |

TABLE 5O-continued

Epinephrine--Core Tox Markers
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2035 | 18572 | NM_019201 | 96.8524 | 908.0947 | 3.9575 | 1003.6540 | 145.8404 |
| 1956 | 21975 | NM_017154 | 96.8524 | 257.9910 | 7.7455 | 181.2767 | 79.8482 |
| 71 | 11531 | AA799773 | 96.8008 | 1110.7257 | 227.5568 | 408.4068 | 295.3104 |
| 1639 | 20032 | AI639466 | 96.8008 | 17.5237 | 1.7078 | 43.4604 | 15.2240 |
| 2054 | 10016 | NM_019289 | 96.8008 | 404.6877 | 66.9408 | 201.8223 | 61.9310 |
| 1615 | 25899 | AI639136 | 96.7492 | 15.5163 | 0.2316 | 20.5485 | 7.1895 |
| 455 | 23731 | AA894004 | 96.7492 | 263.6653 | 18.5718 | 159.9061 | 45.0677 |
| 1748 | 619 | NM_012565 | 96.7492 | 22.4083 | 1.7778 | 36.5577 | 8.6468 |
| 2183 | 20770 | NM_024160 | 96.6976 | 156.8697 | 23.4808 | 56.2296 | 41.2374 |
| 225 | 1801 | AA858636 | 96.6976 | 120.4320 | 15.6344 | 76.8255 | 18.7138 |
| 2116 | 24536 | NM_022399 | 96.6976 | 1355.7977 | 41.0844 | 998.6555 | 188.8572 |
| 2054 | 10015 | NM_019289 | 96.6460 | 420.5977 | 68.7205 | 217.8729 | 63.7868 |
| 1696 | 25359 | L13202 | 96.5944 | 33.1293 | 0.4272 | 43.7954 | 14.7516 |
| 1857 | 15253 | NM_013058 | 96.5944 | 237.1250 | 24.9522 | 108.3637 | 47.0250 |
| 2227 | 11849 | NM_031065 | 96.5944 | 1458.8320 | 107.8285 | 940.8786 | 195.5401 |
| 1612 | 12400 | AI639107 | 96.5428 | 48.3297 | 12.2020 | 24.2917 | 8.7001 |
| 2341 | 17736 | NM_031970 | 96.4912 | 1642.5653 | 546.3408 | 621.3711 | 360.1573 |
| 2454 | 16552 | NM_053961 | 96.4912 | 92.8863 | 24.4873 | 38.9750 | 18.7740 |
| 2445 | 18357 | NM_053864 | 96.4912 | 323.6223 | 3.3133 | 319.9372 | 82.7828 |
| 2379 | 16017 | NM_053401 | 96.4912 | 74.2610 | 4.5885 | 117.0576 | 30.0746 |
| 313 | 15513 | AA875431 | 96.4912 | 166.9317 | 2.7130 | 189.9391 | 42.3197 |
| 71 | 11530 | AA799773 | 96.4396 | 601.3107 | 161.2935 | 210.8034 | 173.7607 |
| 2316 | 18054 | NM_031707 | 96.4396 | 83.6250 | 2.1335 | 126.2777 | 31.6272 |
| 359 | 7050 | AA891824 | 96.4396 | 67.4593 | 1.1035 | 60.3158 | 24.3089 |
| 2063 | 22675 | NM_019358 | 96.3880 | 87.7107 | 18.4663 | 30.8168 | 20.8898 |
| 330 | 24814 | AA891209 | 96.3880 | 125.6697 | 30.0655 | 71.9543 | 16.4597 |
| 1736 | 20518 | NM_012518 | 96.3364 | 175.7517 | 3.1089 | 226.4270 | 41.2545 |
| 1809 | 13151 | NM_012862 | 96.3364 | 3338.0793 | 190.6440 | 2187.6161 | 569.2195 |
| 1700 | 25816 | L23863 | 96.2848 | 17.6030 | 0.4452 | 25.6224 | 8.5933 |
| 1611 | 22555 | AI639103 | 96.2332 | 29.4340 | 3.0467 | 12.0415 | 8.1039 |
| 2022 | 5622 | NM_019143 | 96.2332 | 406.5067 | 100.2078 | 206.3462 | 60.9271 |
| 1770 | 16218 | NM_012656 | 96.2332 | 1127.6243 | 21.3959 | 845.7607 | 365.8797 |
| 1933 | 22552 | NM_017087 | 96.1816 | 715.1360 | 22.1595 | 452.2379 | 173.4372 |
| 2395 | 4327 | NM_053563 | 96.1816 | 157.7943 | 47.5454 | 91.5411 | 27.7979 |
| 2132 | 6100 | NM_022531 | 96.1816 | 3273.6163 | 299.3398 | 2108.3253 | 503.6042 |
| 2107 | 11454 | NM_022381 | 96.1816 | 286.6350 | 5.8844 | 210.0435 | 63.7797 |
| 2355 | 25529 | NM_033096 | 96.1300 | 38.6000 | 0.7893 | 38.3339 | 74.3495 |
| 1804 | 2853 | NM_012838 | 96.0784 | 150.4390 | 47.4404 | 80.3220 | 24.7315 |
| 1786 | 343 | NM_012747 | 96.0784 | 58.3073 | 4.3074 | 53.2117 | 43.8789 |
| 1785 | 1478 | NM_012744 | 96.0268 | 23.1500 | 0.6358 | 37.8936 | 24.9431 |
| 1974 | 18148 | NM_017226 | 96.0268 | 59.9527 | 2.7085 | 98.7423 | 29.3865 |
| 1133 | 3527 | AI104278 | 99.8452 | 12.9287 | 0.0487 | 24.7505 | 21.0113 |
| 772 | 3931 | AI008697 | 99.4324 | 107.6857 | 0.2150 | 127.5319 | 30.5123 |
| 1496 | 7036 | AI231801 | 99.2776 | 101.0093 | 0.1155 | 113.8784 | 21.4829 |
| 623 | 12324 | AA946203 | 99.1228 | 35.7033 | 6.6789 | −35.6344 | 38.6620 |
| 1172 | 13717 | AI137131 | 99.0712 | 74.7137 | 0.9743 | 112.0620 | 23.7583 |
| 2205 | 21509 | NM_030847 | 98.9164 | 787.7937 | 27.5886 | 445.5429 | 136.0931 |
| 670 | 24135 | AA957736 | 98.9164 | 380.8940 | 1.7800 | 259.5384 | 91.8464 |
| 1555 | 11644 | AI235282 | 98.8648 | 510.5817 | 20.1340 | 224.8430 | 82.1521 |
| 200 | 22026 | AA850060 | 98.8132 | 3518.2023 | 8.7712 | 3305.1771 | 1100.9499 |
| 128 | 11166 | AA801346 | 98.7616 | 228.4097 | 13.3451 | 124.5399 | 35.4118 |
| 1284 | 24209 | AI172423 | 98.7616 | 130.9367 | 14.5426 | 3.0070 | 41.7960 |
| 818 | 3211 | AI010612 | 98.7100 | 136.1203 | 47.1696 | 6.0020 | 17.2314 |
| 2513 | 4049 | NM_133298 | 98.6584 | 757.4380 | 272.8084 | 42.0070 | 124.2871 |
| 2513 | 4048 | NM_133298 | 98.6584 | 331.6660 | 154.6004 | 18.3030 | 75.1596 |
| 1467 | 24270 | AI230758 | 98.5552 | 238.9863 | 2.3146 | 170.0291 | 58.4029 |
| 887 | 22592 | AI013740 | 98.5552 | 836.2727 | 287.0068 | 201.6477 | 133.2668 |
| 639 | 23326 | AA955415 | 98.5036 | 111.8597 | 0.4384 | 126.6552 | 27.4519 |
| 1268 | 1506 | AI172051 | 98.4520 | 336.9553 | 11.6236 | 239.0523 | 37.0479 |
| 712 | 3165 | AA997386 | 98.4004 | 33.5920 | 0.3715 | 30.7942 | 25.0551 |
| 1957 | 17106 | NM_017160 | 98.2972 | 49.6850 | 0.6158 | 75.5109 | 26.2033 |
| 1442 | 23435 | AI229502 | 98.2972 | 27.0300 | 1.9148 | −34.1479 | 49.1359 |
| 2253 | 13929 | NM_031131 | 98.2456 | 331.9700 | 89.3004 | 110.4635 | 47.9681 |
| 1079 | 10970 | AI073207 | 98.2456 | 42.4007 | 1.1561 | 84.6732 | 32.6599 |
| 1246 | 21771 | AI171209 | 98.2456 | 1064.0957 | 7.2340 | 920.3425 | 230.4271 |
| 2305 | 16062 | NM_031646 | 98.2456 | 1259.5520 | 34.4070 | 841.6006 | 186.6852 |
| 604 | 4207 | AA945591 | 98.2456 | 291.3373 | 74.6083 | 122.4612 | 41.6400 |
| 2103 | 23511 | NM_022294 | 98.1940 | 124.6603 | 2.0103 | 76.6181 | 30.8712 |
| 1469 | 13915 | AI230826 | 98.1424 | 61.3407 | 0.3722 | 68.1771 | 16.9576 |
| 777 | 3832 | AI008985 | 98.1424 | 57.6423 | 0.5583 | 78.0201 | 35.2295 |
| 1243 | 13702 | AI171064 | 97.9876 | 24.4990 | 0.7311 | 49.7110 | 21.5412 |
| 553 | 894 | AA926305 | 97.9876 | 409.7137 | 21.2847 | 213.4587 | 79.8531 |
| 1162 | 4969 | AI113008 | 97.9360 | 113.4747 | 56.9545 | −18.6405 | 48.1540 |

TABLE 5O-continued

Epinephrine--Core Tox Markers
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 1542 | 2765 | AI234283 | 97.8844 | 165.9460 | 2.0674 | 115.4260 | 33.7180 |
| 1528 | 5228 | AI233311 | 97.8844 | 172.1703 | 63.8689 | 17.5026 | 45.0830 |
| 1317 | 18581 | AI176160 | 97.8844 | 309.6860 | 8.9991 | 224.5213 | 58.7700 |
| 1101 | 2125 | AI102519 | 97.8328 | 458.4750 | 239.1954 | 110.1359 | 89.7111 |
| 1377 | 5760 | AI178361 | 97.8328 | 166.8853 | 2.3547 | 125.9282 | 28.0269 |
| 1342 | 10310 | AI176961 | 97.8328 | 468.2403 | 34.3944 | 773.8072 | 151.8248 |
| 1015 | 8347 | AI059519 | 97.8328 | 125.8373 | 71.4582 | 33.1032 | 24.2624 |
| 175 | 16971 | AA819691 | 97.7296 | 604.9870 | 2.2495 | 625.9080 | 110.1953 |
| 1001 | 10096 | AI058772 | 97.7296 | 45.2850 | 0.7088 | 67.9757 | 27.8152 |
| 210 | 4490 | AA851184 | 97.7296 | 350.7433 | 99.1027 | 71.4423 | 77.3708 |
| 1553 | 15004 | AI235224 | 97.6780 | 1513.7483 | 676.9818 | 333.7069 | 264.8772 |
| 1086 | 11634 | AI101338 | 97.6780 | 63.2070 | 1.0015 | 104.1398 | 33.6241 |
| 849 | 6606 | AI012308 | 97.6780 | 4957.6607 | 591.8675 | 1868.8558 | 759.0889 |
| 541 | 14945 | AA925364 | 97.6780 | 201.9357 | 4.8148 | 312.2025 | 284.6709 |
| 703 | 19396 | AA996740 | 97.6780 | 77.0060 | 0.5804 | 64.5836 | 22.0189 |
| 1059 | 9808 | AI072050 | 97.6264 | 21.9317 | 0.2473 | 28.2164 | 12.7466 |
| 1579 | 9546 | AI236520 | 97.6264 | 248.0543 | 3.4682 | 348.8435 | 71.5539 |
| 1297 | 21252 | AI175328 | 97.6264 | 21.4473 | 0.3102 | 27.0436 | 17.6819 |
| 149 | 8058 | AA818475 | 97.6264 | 502.7917 | 51.4777 | 316.4540 | 55.8216 |
| 518 | 4945 | AA924415 | 97.6264 | 48.4333 | 2.8325 | 114.2217 | 62.8329 |
| 825 | 24089 | AI010865 | 97.6264 | 383.9677 | 11.7182 | 215.7464 | 102.1879 |
| 841 | 2531 | AI011991 | 97.5748 | 232.7287 | 19.4053 | 128.3824 | 43.7997 |
| 1530 | 4475 | AI233374 | 97.5232 | 121.5643 | 1.2526 | 98.1603 | 24.6261 |
| 165 | 6098 | AA818935 | 97.5232 | 62.4710 | 5.0207 | 104.3365 | 21.8370 |
| 666 | 24040 | AA957422 | 97.5232 | 858.5613 | 317.0292 | 373.3416 | 133.6995 |
| 2212 | 21166 | NM_031005 | 97.5232 | 678.6667 | 202.1629 | 312.2661 | 87.1282 |
| 136 | 1901 | AA817849 | 97.4716 | 51.5103 | 3.4812 | 72.1035 | 66.0043 |
| 129 | 11995 | AA801352 | 97.4716 | 58.4227 | 0.5425 | 67.8725 | 29.5639 |
| 1060 | 18198 | AI072063 | 97.4200 | 223.5667 | 0.9721 | 230.7480 | 62.4391 |
| 1065 | 9218 | AI072197 | 97.4200 | 47.6807 | 0.8715 | 71.3801 | 31.9428 |
| 2262 | 23097 | NM_031145 | 97.4200 | 133.0247 | 18.6534 | 70.5065 | 23.7675 |
| 547 | 5227 | AA925924 | 97.4200 | 284.8487 | 20.7484 | 153.0970 | 50.7078 |
| 989 | 10053 | AI045948 | 97.4200 | 49.2487 | 0.7590 | 66.8934 | 38.0980 |
| 1386 | 18848 | AI178816 | 97.3684 | 16.4617 | 0.3413 | 27.1611 | 11.3058 |
| 984 | 10028 | AI045707 | 97.3684 | 205.4137 | 3.2177 | 278.2003 | 56.9774 |
| 847 | 21796 | AI012221 | 97.3684 | 623.4527 | 184.6330 | 267.9207 | 90.6188 |

TABLE 5P

EPINEPHRINE
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 1880 | 21682 | NM_013154 | 99.7415 | 170.2108 | 17.8746 | −10.0941 | 54.1422 |
| 1755 | 24716 | NM_012589 | 99.3795 | 83.0638 | 44.2356 | −7.6759 | 9.6679 |
| 1759 | 2628 | NM_012603 | 99.3795 | 101.2262 | 21.4093 | 9.7733 | 13.5113 |
| 403 | 4512 | AA892578 | 99.0176 | 100.1628 | 9.2839 | 23.0663 | 27.6873 |
| 2342 | 1475 | NM_031971 | 98.9659 | 2131.2934 | 1187.2397 | 99.1846 | 236.0731 |
| 65 | 18349 | AA799744 | 98.9142 | 419.5130 | 34.5782 | 174.2737 | 61.4315 |
| 1682 | 4407 | H33528 | 98.9142 | 183.4034 | 28.3841 | 76.5220 | 20.5864 |
| 2172 | 21238 | NM_024125 | 98.8625 | 110.8422 | 41.3186 | −25.5080 | 25.5893 |
| 609 | 22625 | AA945704 | 98.8625 | 288.1454 | 124.1975 | 64.9472 | 26.9144 |
| 2090 | 20161 | NM_021836 | 98.7590 | 283.5106 | 45.0052 | 35.6024 | 36.8795 |
| 246 | 16318 | AA859648 | 98.7590 | 194.4522 | 99.2263 | 39.8236 | 20.4925 |
| 1880 | 21683 | NM_013154 | 98.7073 | 187.7900 | 12.6924 | 48.5710 | 35.0644 |
| 1581 | 18259 | AI236601 | 98.7073 | 383.5616 | 293.5490 | 93.0553 | 39.5025 |
| 1746 | 23872 | NM_012551 | 98.6556 | 555.1498 | 216.9557 | 52.3884 | 68.5290 |
| 2687 | 12978 | X96437 | 98.6556 | 329.5664 | 109.3731 | 77.0005 | 48.5301 |
| 2641 | 10181 | X06769 | 98.6556 | 604.7244 | 207.4892 | 125.0557 | 110.9162 |
| 1759 | 2629 | NM_012603 | 98.6039 | 164.3506 | 51.0557 | 20.7590 | 13.2840 |
| 2316 | 18059 | NM_031707 | 98.6039 | 259.6754 | 203.7536 | 28.0897 | 34.0609 |
| 293 | 16312 | AA875032 | 98.5522 | 269.9038 | 57.0820 | 66.9923 | 34.2802 |
| 2303 | 567 | NM_031628 | 98.5522 | 135.7288 | 56.5042 | 11.7060 | 36.0499 |
| 1746 | 23871 | NM_012551 | 98.5522 | 162.5520 | 44.4375 | 41.5533 | 21.0213 |
| 1746 | 23869 | NM_012551 | 98.5522 | 376.3680 | 133.3922 | 41.0667 | 56.3412 |
| 1855 | 11113 | NM_013046 | 98.5522 | 74.9128 | 5.2741 | 36.0679 | 19.5003 |
| 1821 | 24431 | NM_012912 | 98.5005 | 579.7786 | 203.5851 | 74.1401 | 65.8132 |
| 1866 | 357 | NM_013086 | 98.5005 | 111.4196 | 22.3553 | 25.1729 | 17.2240 |

TABLE 5P-continued

EPINEPHRINE
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 2267 | 18597 | NM_031325 | 98.3454 | 410.7850 | 196.9638 | 93.4415 | 58.4374 |
| 2044 | 17908 | NM_019242 | 98.3454 | 247.8356 | 89.2240 | 43.3927 | 31.2296 |
| 2005 | 356 | NM_017334 | 98.3454 | 229.7986 | 49.0958 | 40.7630 | 43.8095 |
| 2511 | 25730 | NM_133290 | 98.3454 | 513.9482 | 88.0797 | 223.3287 | 70.4308 |
| 104 | 13930 | AA800613 | 98.2937 | 541.6812 | 170.7749 | 109.4264 | 59.3881 |
| 1833 | 223 | NM_012945 | 98.2937 | 178.8056 | 84.6612 | 12.7804 | 23.9861 |
| 2419 | 16122 | NM_053698 | 98.2937 | 201.4534 | 44.7091 | 64.5007 | 26.8626 |
| 1746 | 23868 | NM_012551 | 98.2420 | 1389.5956 | 403.1165 | 212.1732 | 214.4325 |
| 2005 | 355 | NM_017334 | 98.2420 | 116.8578 | 31.5423 | 9.6020 | 28.0037 |
| 1931 | 923 | NM_017076 | 98.2420 | 154.5252 | 82.8649 | 16.6897 | 16.1037 |
| 2640 | 20169 | X03347 | 98.2420 | 277.0936 | 95.7389 | 72.8978 | 72.7922 |
| 2527 | 11483 | NM_133546 | 98.1903 | 331.7654 | 63.7991 | 98.4505 | 41.2669 |
| 1944 | 21663 | NM_017126 | 98.1386 | 1165.2894 | 270.7719 | 378.5087 | 180.0980 |
| 1219 | 804 | AI169756 | 98.1386 | 189.0236 | 66.4419 | 51.8934 | 27.6155 |
| 1879 | 46 | NM_013151 | 98.1386 | 313.5256 | 74.0148 | 120.9001 | 39.0253 |
| 1976 | 20193 | NM_017232 | 98.1386 | 57.2454 | 16.2227 | 12.5417 | 12.8705 |
| 1228 | 5297 | AI170379 | 98.0869 | 636.1846 | 281.5152 | 204.1140 | 87.4082 |
| 2042 | 20433 | NM_019232 | 98.0352 | 184.8048 | 32.5754 | 65.0037 | 33.9370 |
| 325 | 5384 | AA891041 | 97.9835 | 384.9230 | 132.8474 | 41.3148 | 52.1603 |
| 2392 | 15829 | NM_053551 | 97.9835 | 422.2494 | 148.8760 | 49.0116 | 67.9183 |
| 24 | 15083 | AA799396 | 97.9835 | 171.2682 | 27.3645 | 67.0638 | 26.4706 |
| 2173 | 354 | NM_024127 | 97.9835 | 645.3834 | 325.2897 | 161.4268 | 73.4115 |
| 2396 | 15708 | NM_053565 | 97.9835 | 68.0462 | 26.7231 | 5.2693 | 17.7616 |
| 113 | 12797 | AA800790 | 97.9317 | 101.6880 | 13.3643 | 47.5052 | 17.5608 |
| 2173 | 352 | NM_024127 | 97.8800 | 192.5686 | 39.9891 | 60.2376 | 41.0027 |
| 2055 | 23679 | NM_019290 | 97.8283 | 186.3938 | 11.8022 | 37.7964 | 14.1923 |
| 1985 | 15301 | NM_017259 | 97.7766 | 572.5162 | 219.7328 | 98.3793 | 76.7665 |
| 2172 | 21239 | NM_024125 | 97.7766 | 419.1316 | 103.8663 | 117.8727 | 59.5662 |
| 2499 | 363 | NM_080780 | 97.7249 | 105.5316 | 36.2308 | 44.6670 | 19.8781 |
| 1589 | 21653 | AI237535 | 97.6732 | 269.1608 | 56.6963 | 115.9132 | 40.0318 |
| 2417 | 3455 | NM_053662 | 97.6732 | 281.7104 | 41.5154 | 138.5602 | 42.1055 |
| 2178 | 1742 | NM_024150 | 97.6732 | 118.7334 | 36.8921 | 32.6240 | 21.3836 |
| 2373 | 1609 | NM_053338 | 97.6215 | 1636.9828 | 249.3978 | 870.5481 | 286.6682 |
| 2185 | 17765 | NM_024351 | 97.6215 | 2256.6424 | 206.1313 | 1392.1893 | 281.3979 |
| 2419 | 16123 | NM_053698 | 97.6215 | 356.9620 | 118.1274 | 104.5867 | 44.3935 |
| 2417 | 3454 | NM_053662 | 97.6215 | 159.1384 | 24.8517 | 67.3493 | 29.6367 |
| 405 | 19086 | AA892598 | 97.5181 | 189.6412 | 55.5297 | 74.7669 | 27.1096 |
| 1984 | 19 | NM_017258 | 97.5181 | 509.6354 | 72.6219 | 322.9745 | 72.9912 |
| 1985 | 15300 | NM_017259 | 97.4664 | 940.0314 | 379.0212 | 241.4715 | 130.2713 |
| 1751 | 16080 | NM_012580 | 97.4664 | 103.3676 | 18.5126 | 16.6288 | 40.9284 |
| 2110 | 22412 | NM_022392 | 97.4147 | 213.8002 | 101.9986 | 92.0753 | 29.7683 |
| 23 | 18396 | AA799330 | 97.4147 | 142.5440 | 59.4536 | 42.1700 | 30.7788 |
| 1854 | 17401 | NM_013043 | 97.3630 | 1642.7358 | 584.4295 | 603.1921 | 226.6601 |
| 1846 | 3404 | NM_013011 | 97.3630 | 316.6988 | 21.2199 | 210.0892 | 45.2233 |
| 24 | 15082 | AA799396 | 97.3630 | 191.4824 | 43.5429 | 48.8199 | 46.6366 |
| 68 | 4133 | AA799762 | 97.3113 | 64.0094 | 4.7748 | 103.9881 | 20.9217 |
| 1750 | 16025 | NM_012578 | 97.3113 | 53.0716 | 4.6147 | 104.1006 | 29.2162 |
| 328 | 11940 | AA891108 | 97.3113 | 48.1170 | 6.9000 | 25.1038 | 8.4766 |
| 280 | 16074 | AA874874 | 97.3113 | 115.4958 | 11.8207 | 186.5315 | 30.3132 |
| 2515 | 4318 | NM_133306 | 97.1562 | 20.0936 | 9.9767 | 3.5640 | 4.5068 |
| 415 | 17589 | AA892851 | 97.0527 | 21.7392 | 1.4012 | 6.2329 | 8.9129 |
| 180 | 9815 | AA848218 | 97.0010 | 121.5864 | 6.2765 | 78.7610 | 20.0110 |
| 1402 | 16081 | AI179610 | 96.8976 | 208.6630 | 38.2141 | 87.3138 | 66.7896 |
| 2075 | 18713 | NM_020075 | 96.7942 | 375.9924 | 80.3421 | 221.3549 | 52.5204 |
| 2014 | 1581 | NM_017365 | 96.6908 | 487.9414 | 68.3975 | 296.6913 | 60.0325 |
| 2621 | 399 | U31668 | 96.6391 | 21.2000 | 5.2149 | 8.9482 | 4.9132 |
| 1767 | 1844 | NM_012637 | 96.6391 | 210.7696 | 6.9139 | 161.9336 | 34.8342 |
| 1887 | 21723 | NM_013174 | 96.5874 | 58.5174 | 2.8000 | 99.0297 | 32.4967 |
| 1735 | 1745 | NM_012513 | 96.3806 | 67.6086 | 16.1516 | 27.6620 | 13.5013 |
| 2514 | 1061 | NM_133303 | 96.3806 | 17.0476 | 4.4648 | 73.7109 | 45.1607 |
| 1750 | 16026 | NM_012578 | 96.3806 | 73.2400 | 12.3368 | 158.9491 | 46.8871 |
| 2111 | 22499 | NM_022393 | 96.2771 | 50.3252 | 8.1201 | 20.7980 | 11.9808 |
| 2292 | 24219 | NM_031579 | 96.2771 | 500.8952 | 77.0303 | 295.5761 | 84.1890 |
| 1793 | 5758 | NM_012778 | 96.1737 | 1258.2172 | 121.1144 | 728.8533 | 206.4390 |
| 40 | 21120 | AA799526 | 96.1220 | 237.1964 | 12.0230 | 152.8194 | 43.9886 |
| 1846 | 25279 | NM_013011 | 96.1220 | 442.4454 | 35.8349 | 292.9163 | 67.1991 |
| 2185 | 17764 | NM_024351 | 95.7601 | 2977.1100 | 324.5606 | 1942.9901 | 394.5485 |
| 1705 | 20625 | M13100 | 95.6567 | 456.8968 | 51.0519 | 1082.0410 | 486.7048 |
| 327 | 19646 | AA891054 | 95.6567 | 39.9698 | 21.4456 | 149.1969 | 60.1966 |
| 2594 | 15711 | NM_153629 | 95.5533 | 179.5744 | 33.3786 | 89.3327 | 33.1025 |
| 536 | 16499 | AA925300 | 95.5533 | −5.5418 | 21.9029 | 57.5645 | 33.5151 |
| 1664 | 21147 | D63772 | 95.5016 | 35.6852 | 3.2769 | 18.0286 | 11.2225 |
| 2072 | 904 | NM_019620 | 95.4498 | 32.7976 | 4.1948 | 64.3982 | 18.2465 |

TABLE 5P-continued

EPINEPHRINE
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 746 | 3799 | AF002281 | 95.3464 | 649.1842 | 137.6624 | 381.4697 | 114.1595 |
| 339 | 15414 | AA891551 | 95.3464 | −5.7218 | 12.5874 | 23.8691 | 11.5189 |
| 1963 | 19031 | NM_017180 | 99.4312 | 982.6658 | 120.6744 | 258.9055 | 111.5534 |
| 927 | 7751 | AI030750 | 98.9142 | 55.7776 | 3.6708 | 26.6190 | 11.5282 |
| 1384 | 23567 | AI178746 | 98.8108 | 227.4204 | 26.5291 | 45.3472 | 63.3799 |
| 1369 | 19184 | AI178025 | 98.7590 | 147.1298 | 47.5142 | 18.3058 | 24.0398 |
| 1321 | 12999 | AI176276 | 98.7073 | 1756.5374 | 138.6348 | 330.9860 | 292.2744 |
| 153 | 6054 | AA818658 | 98.7073 | 654.2018 | 295.6701 | 53.3184 | 92.2889 |
| 1207 | 12979 | AI169177 | 98.7073 | 1116.3096 | 169.5989 | 312.8437 | 193.9163 |
| 1294 | 2331 | AI175045 | 98.6556 | 2163.9720 | 213.8867 | 382.5205 | 338.0670 |
| 226 | 18350 | AA858674 | 98.6556 | 291.0254 | 8.7395 | 140.0944 | 60.6023 |
| 1064 | 7516 | AI072183 | 98.6556 | 889.7998 | 438.7596 | 50.3085 | 173.9500 |
| 600 | 22667 | AA945069 | 98.6556 | 192.7286 | 17.4709 | 58.4133 | 40.2171 |
| 1269 | 19012 | AI172056 | 98.5522 | 932.2302 | 108.1775 | 455.2176 | 113.5174 |
| 2197 | 13633 | NM_024403 | 98.5522 | 1017.1960 | 159.6258 | 340.8687 | 103.9756 |
| 591 | 14763 | AA944481 | 98.5005 | 515.9030 | 145.4453 | 24.0301 | 99.8684 |
| 586 | 22681 | AA944413 | 98.5005 | 719.6722 | 146.8975 | 300.2426 | 83.8714 |
| 2197 | 13634 | NM_024403 | 98.4488 | 1880.3100 | 310.7357 | 819.1229 | 207.2629 |
| 1512 | 11873 | AI232326 | 98.4488 | 547.9730 | 130.6466 | 147.4777 | 115.1875 |
| 1539 | 6532 | AI234105 | 98.4488 | 871.9112 | 84.2306 | 448.6074 | 126.2213 |
| 1343 | 16124 | AI176963 | 98.4488 | 689.2324 | 105.9491 | 229.3567 | 89.4439 |
| 769 | 3808 | AI008643 | 98.4488 | 1608.7652 | 223.2933 | 559.1888 | 207.2589 |
| 1320 | 22765 | AI176265 | 98.3971 | 141.9492 | 37.6784 | 22.5669 | 21.4713 |
| 1434 | 16053 | AI228596 | 98.3971 | 395.9836 | 63.5918 | 117.6825 | 86.1723 |
| 1129 | 16136 | AI103983 | 98.3971 | 331.5860 | 111.5788 | 109.1438 | 39.2430 |
| 1595 | 8759 | AI237646 | 98.3454 | 459.3384 | 173.1906 | 35.6491 | 56.0602 |
| 1251 | 14117 | AI171350 | 98.3454 | 568.3832 | 116.5057 | 1162.3826 | 221.7568 |
| 1124 | 21579 | AI103572 | 98.3454 | 245.2786 | 54.3629 | 95.5227 | 33.1673 |
| 973 | 5675 | AI045026 | 98.3454 | 621.6554 | 119.1463 | 157.2537 | 135.2641 |
| 663 | 23314 | AA957270 | 98.2937 | 1539.4846 | 620.7748 | 80.2665 | 200.8598 |
| 1026 | 17506 | AI070068 | 98.2937 | 169.7166 | 50.5107 | 51.4166 | 25.8106 |
| 1106 | 19011 | AI102618 | 98.2420 | 1208.2564 | 183.0800 | 601.0513 | 123.8886 |
| 1293 | 8053 | AI175033 | 98.1903 | 310.3878 | 22.4150 | 161.7129 | 45.3874 |
| 1254 | 22958 | AI171374 | 98.1903 | 445.7316 | 55.1817 | 232.5878 | 63.3098 |
| 1053 | 11088 | AI071703 | 98.1903 | 40.7278 | 11.0571 | 113.6213 | 33.6357 |
| 1445 | 15212 | AI229753 | 98.1386 | 286.4968 | 137.2593 | 55.7180 | 36.3182 |
| 1319 | 10182 | AI176185 | 98.1386 | 376.9936 | 167.7702 | 31.6820 | 100.4641 |
| 1160 | 12969 | AI112969 | 98.1386 | 259.9774 | 9.3908 | 157.8627 | 44.2629 |
| 1577 | 19075 | AI236473 | 98.1386 | 230.6110 | 57.9787 | 113.1016 | 25.6307 |
| 640 | 23626 | AA955540 | 98.1386 | 226.7950 | 99.5140 | 72.8989 | 32.6827 |
| 176 | 11021 | AA819767 | 98.0869 | 644.2628 | 48.0691 | 325.7648 | 108.0945 |
| 1013 | 8314 | AI059386 | 98.0869 | 140.9914 | 51.7258 | 49.2117 | 24.8297 |
| 554 | 3817 | AA926328 | 98.0869 | 311.6976 | 25.8985 | 180.3736 | 60.3209 |
| 852 | 7471 | AI012379 | 98.0352 | 398.5200 | 92.0347 | 198.9423 | 49.9844 |
| 1455 | 6217 | AI230381 | 97.9835 | 196.6190 | 114.6867 | 58.2228 | 22.1304 |
| 1575 | 15051 | AI236332 | 97.9835 | 303.7946 | 68.2762 | 119.9003 | 108.7666 |
| 156 | 19723 | AA818761 | 97.9317 | 293.6122 | 49.7000 | 109.3153 | 54.2319 |
| 237 | 16314 | AA859348 | 97.9317 | 295.3764 | 66.9849 | 63.9732 | 47.2996 |

TABLE 5Q

Epinephrine--Core Tox Markers
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 1880 | 21682 | NM_013154 | 99.7415 | 170.2108 | 17.8746 | −10.0941 | 54.1422 |
| 1755 | 24716 | NM_012589 | 99.3795 | 83.0638 | 44.2356 | −7.6759 | 9.6679 |
| 1759 | 2628 | NM_012603 | 99.3795 | 101.2262 | 21.4093 | 9.7733 | 13.5113 |
| 403 | 4512 | AA892578 | 99.0176 | 100.1628 | 9.2839 | 23.0663 | 27.6873 |
| 2342 | 1475 | NM_031971 | 98.9659 | 2131.2934 | 1187.2397 | 99.1846 | 236.0731 |
| 65 | 18349 | AA799744 | 98.9142 | 419.5130 | 34.5782 | 174.2737 | 61.4315 |
| 1682 | 4407 | H33528 | 98.9142 | 183.4034 | 28.3841 | 76.5220 | 20.5864 |
| 2172 | 21238 | NM_024125 | 98.8625 | 110.8422 | 41.3186 | −25.5080 | 25.5893 |
| 609 | 22625 | AA945704 | 98.8625 | 288.1454 | 124.1975 | 64.9472 | 26.9144 |
| 2090 | 20161 | NM_021836 | 98.7590 | 283.5106 | 45.0052 | 35.6024 | 36.8795 |
| 246 | 16318 | AA859648 | 98.7590 | 194.4522 | 99.2263 | 39.8236 | 20.4925 |
| 1880 | 21683 | NM_013154 | 98.7073 | 187.7900 | 12.6924 | 48.5710 | 35.0644 |
| 1581 | 18259 | AI236601 | 98.7073 | 383.5616 | 293.5490 | 93.0553 | 39.5025 |

TABLE 5Q-continued

Epinephrine--Core Tox Markers
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 1746 | 23872 | NM_012551 | 98.6556 | 555.1498 | 216.9557 | 52.3884 | 68.5290 |
| 2687 | 12978 | X96437 | 98.6556 | 329.5664 | 109.3731 | 77.0005 | 48.5301 |
| 2641 | 10181 | X06769 | 98.6556 | 604.7244 | 207.4892 | 125.0557 | 110.9162 |
| 1759 | 2629 | NM_012603 | 98.6039 | 164.3506 | 51.0557 | 20.7590 | 13.2840 |
| 2316 | 18059 | NM_031707 | 98.6039 | 259.6754 | 203.7536 | 28.0897 | 34.0609 |
| 293 | 16312 | AA875032 | 98.5522 | 269.9038 | 57.0820 | 66.9923 | 34.2802 |
| 2303 | 567 | NM_031628 | 98.5522 | 135.7288 | 56.5042 | 11.7060 | 36.0499 |
| 1746 | 23871 | NM_012551 | 98.5522 | 162.5520 | 44.4375 | 41.5533 | 21.0213 |
| 1746 | 23869 | NM_012551 | 98.5522 | 376.3680 | 133.3922 | 41.0667 | 56.3412 |
| 1855 | 11113 | NM_013046 | 98.5522 | 74.9128 | 5.2741 | 36.0679 | 19.5003 |
| 1821 | 24431 | NM_012912 | 98.5005 | 579.7786 | 203.5851 | 74.1401 | 65.8132 |
| 1866 | 357 | NM_013086 | 98.5005 | 111.4196 | 22.3553 | 25.1729 | 17.2240 |
| 2624 | 21654 | U53184 | 98.3454 | 551.3256 | 137.5534 | 203.2898 | 71.3742 |
| 2267 | 18597 | NM_031325 | 98.3454 | 410.7850 | 196.9638 | 93.4415 | 58.4374 |
| 2044 | 17908 | NM_019242 | 98.3454 | 247.8356 | 89.2240 | 43.3927 | 31.2296 |
| 2005 | 356 | NM_017334 | 98.3454 | 229.7986 | 49.0958 | 40.7630 | 43.8095 |
| 2511 | 25730 | NM_133290 | 98.3454 | 513.9482 | 88.0797 | 223.3287 | 70.4308 |
| 104 | 13930 | AA800613 | 98.2937 | 541.6812 | 170.7749 | 109.4264 | 59.3881 |
| 1833 | 223 | NM_012945 | 98.2937 | 178.8056 | 84.6612 | 12.7804 | 23.9861 |
| 2419 | 16122 | NM_053698 | 98.2937 | 201.4534 | 44.7091 | 64.5007 | 26.8626 |
| 1746 | 23868 | NM_012551 | 98.2420 | 1389.5956 | 403.1165 | 212.1732 | 214.4325 |
| 2005 | 355 | NM_017334 | 98.2420 | 116.8578 | 31.5423 | 9.6020 | 28.0037 |
| 1931 | 923 | NM_017076 | 98.2420 | 154.5252 | 82.8649 | 16.6897 | 16.1037 |
| 2640 | 20169 | X03347 | 98.2420 | 277.0936 | 95.7389 | 72.8978 | 72.7922 |
| 2527 | 11483 | NM_133546 | 98.1903 | 331.7654 | 63.7991 | 98.4505 | 41.2669 |
| 1944 | 21663 | NM_017126 | 98.1386 | 1165.2894 | 270.7719 | 378.5087 | 180.0980 |
| 1219 | 804 | AI169756 | 98.1386 | 189.0236 | 66.4419 | 51.8934 | 27.6155 |
| 1879 | 46 | NM_013151 | 98.1386 | 313.5256 | 74.0148 | 120.9001 | 39.0253 |
| 1976 | 20193 | NM_017232 | 98.1386 | 57.2454 | 16.2227 | 12.5417 | 12.8705 |
| 1228 | 5297 | AI170379 | 98.0869 | 636.1846 | 281.5152 | 204.1140 | 87.4082 |
| 2042 | 20433 | NM_019232 | 98.0352 | 184.8048 | 32.5754 | 65.0037 | 33.9370 |
| 325 | 5384 | AA891041 | 97.9835 | 384.9230 | 132.8474 | 41.3148 | 52.1603 |
| 2392 | 15829 | NM_053551 | 97.9835 | 422.2494 | 148.8760 | 49.0116 | 67.9183 |
| 2173 | 353 | NM_024127 | 97.9835 | 484.9402 | 257.6271 | 115.1804 | 63.5617 |
| 24 | 15083 | AA799396 | 97.9835 | 171.2682 | 27.3645 | 67.0638 | 26.4706 |
| 2173 | 354 | NM_024127 | 97.9835 | 645.3834 | 325.2897 | 161.4268 | 73.4115 |
| 2396 | 15708 | NM_053565 | 97.9835 | 68.0462 | 26.7231 | 5.2693 | 17.7616 |
| 113 | 12797 | AA800790 | 97.9317 | 101.6880 | 13.3643 | 47.5052 | 17.5608 |
| 2173 | 352 | NM_024127 | 97.8800 | 192.5686 | 39.9891 | 60.2376 | 41.0027 |
| 2055 | 23679 | NM_019290 | 97.8283 | 86.3938 | 11.8022 | 37.7964 | 14.1923 |
| 1985 | 15301 | NM_017259 | 97.7766 | 572.5162 | 219.7328 | 98.3793 | 76.7665 |
| 2172 | 21239 | NM_024125 | 97.7766 | 419.1316 | 103.8663 | 117.8727 | 59.5662 |
| 2499 | 363 | NM_080780 | 97.7249 | 105.5316 | 36.2308 | 44.6670 | 19.8781 |
| 2341 | 17734 | NM_031970 | 97.6732 | 3246.6368 | 927.5498 | 1040.2773 | 478.8499 |
| 2341 | 17736 | NM_031970 | 97.6732 | 2289.5822 | 894.5995 | 615.9135 | 340.7204 |
| 1589 | 21653 | AI237535 | 97.6732 | 269.1608 | 56.6963 | 115.9132 | 40.0318 |
| 2417 | 3455 | NM_053662 | 97.6732 | 281.7104 | 41.5154 | 138.5602 | 42.1055 |
| 2178 | 1742 | NM_024150 | 97.6732 | 118.7334 | 36.8921 | 32.6240 | 21.3836 |
| 2373 | 1609 | NM_053338 | 97.6215 | 1636.9828 | 249.3978 | 870.5481 | 286.6682 |
| 2185 | 17765 | NM_024351 | 97.6215 | 2256.6424 | 206.1313 | 1392.1893 | 281.3979 |
| 2419 | 16123 | NM_053698 | 97.6215 | 356.9620 | 118.1274 | 104.5867 | 44.3935 |
| 2417 | 3454 | NM_053662 | 97.6215 | 159.1384 | 24.8517 | 67.3493 | 29.6367 |
| 1631 | 20461 | AI639350 | 97.6215 | 39.3302 | 3.5153 | 86.2453 | 45.3078 |
| 71 | 11531 | AA799773 | 97.5698 | 1657.1368 | 674.6719 | 404.1289 | 281.1648 |
| 405 | 19086 | AA892598 | 97.5181 | 189.6412 | 55.5297 | 74.7669 | 27.1096 |
| 1984 | 19 | NM_017258 | 97.5181 | 509.6354 | 72.6219 | 322.9745 | 72.9912 |
| 71 | 11530 | AA799773 | 97.4664 | 1141.9942 | 494.4777 | 207.2001 | 158.9626 |
| 1985 | 15300 | NM_017259 | 97.4664 | 940.0314 | 379.0212 | 241.4715 | 130.2713 |
| 1751 | 16080 | NM_012580 | 97.4664 | 103.3676 | 18.5126 | 16.6288 | 40.9284 |
| 2110 | 22412 | NM_022392 | 97.4147 | 213.8002 | 101.9986 | 92.0753 | 29.7683 |
| 23 | 18396 | AA799330 | 97.4147 | 142.5440 | 59.4536 | 42.1700 | 30.7788 |
| 1854 | 17401 | NM_013043 | 97.3630 | 1642.7358 | 584.4295 | 603.1921 | 226.6601 |
| 1846 | 3404 | NM_013011 | 97.3630 | 316.6988 | 21.2199 | 210.0892 | 45.2233 |
| 24 | 15082 | AA799396 | 97.3630 | 191.4824 | 43.5429 | 48.8190 | 46.6366 |
| 68 | 4133 | AA799762 | 97.3113 | 64.0094 | 4.7748 | 103.9881 | 20.9217 |
| 1750 | 16025 | NM_012578 | 97.3113 | 53.0716 | 4.6147 | 104.1006 | 29.2162 |
| 328 | 11940 | AA891108 | 97.3113 | 48.1170 | 6.9000 | 25.1038 | 8.4766 |
| 280 | 16074 | AA874874 | 97.3113 | 115.4958 | 11.8207 | 186.5315 | 30.3132 |
| 2086 | 19710 | NM_021744 | 97.2596 | 132.0752 | 32.6093 | 48.2437 | 22.2772 |
| 2515 | 4318 | NM_133306 | 97.1562 | 20.0936 | 9.9767 | 3.5640 | 4.5068 |
| 415 | 17589 | AA892851 | 97.0527 | 21.7392 | 1.4012 | 6.2329 | 8.9129 |
| 180 | 9815 | AA848218 | 97.0010 | 121.5864 | 6.2765 | 78.7610 | 20.0110 |
| 1402 | 16081 | AI179610 | 96.8976 | 208.6630 | 38.2141 | 87.3138 | 66.7896 |

TABLE 5Q-continued

Epinephrine--Core Tox Markers
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 2075 | 18713 | NM_020075 | 96.7942 | 375.9924 | 80.3421 | 221.3549 | 52.5204 |
| 2014 | 1581 | NM_017365 | 96.6908 | 487.9414 | 68.3975 | 296.6913 | 60.0325 |
| 2621 | 399 | U31668 | 96.6391 | 21.2000 | 5.2149 | 8.9482 | 4.9132 |
| 1767 | 1844 | NM_012637 | 96.6391 | 210.7696 | 6.9139 | 161.9336 | 34.8342 |
| 1887 | 21723 | NM_013174 | 96.5874 | 58.5174 | 2.8000 | 99.0297 | 32.4967 |
| 1735 | 1745 | NM_012513 | 96.3806 | 67.6086 | 16.1516 | 27.6620 | 13.5013 |
| 2514 | 1061 | NM_133303 | 96.3806 | 17.0476 | 4.4648 | 73.7109 | 45.1607 |
| 1750 | 16026 | NM_012578 | 96.3806 | 73.2400 | 12.3368 | 158.9491 | 46.8871 |
| 2111 | 22499 | NM_022393 | 96.2771 | 50.3252 | 8.1201 | 20.7980 | 11.9808 |
| 2292 | 24219 | NM_031579 | 96.2771 | 500.8952 | 77.0303 | 295.5761 | 84.1890 |
| 1793 | 5758 | NM_012778 | 96.1737 | 1258.2172 | 121.1144 | 728.8533 | 206.4390 |
| 40 | 21120 | AA799526 | 96.1220 | 237.1964 | 12.0230 | 152.8194 | 43.9886 |
| 1846 | 25279 | NM_013011 | 96.1220 | 442.4454 | 35.8349 | 292.9163 | 67.1991 |
| 1607 | 10071 | AI639058 | 95.9669 | 534.8884 | 105.5033 | 264.8235 | 107.4576 |
| 1963 | 19031 | NM_017180 | 99.4312 | 982.6658 | 120.6744 | 258.9055 | 111.5534 |
| 927 | 7751 | AI030750 | 98.9142 | 55.7776 | 3.6708 | 26.6190 | 11.5282 |
| 1384 | 23567 | AI178746 | 98.8108 | 227.4204 | 26.5291 | 45.3472 | 63.3799 |
| 1369 | 19184 | AI178025 | 98.7590 | 147.1298 | 47.5142 | 18.3058 | 24.0398 |
| 1321 | 12999 | AI176276 | 98.7073 | 1756.5374 | 138.6348 | 330.9860 | 292.2744 |
| 153 | 6054 | AA818658 | 98.7073 | 654.2018 | 295.6701 | 53.3184 | 92.2889 |
| 1207 | 12979 | AI169177 | 98.7073 | 1116.3096 | 169.5989 | 312.8437 | 193.9163 |
| 1294 | 2331 | AI175045 | 98.6556 | 2163.9720 | 213.8867 | 382.5205 | 338.0670 |
| 226 | 18350 | AA858674 | 98.6556 | 291.0254 | 8.7395 | 140.0944 | 60.6023 |
| 1064 | 7516 | AI072183 | 98.6556 | 889.7998 | 438.7596 | 50.3085 | 173.9500 |
| 600 | 22667 | AA945069 | 98.6556 | 192.7286 | 17.4709 | 58.4133 | 40.2171 |
| 1269 | 19012 | AI172056 | 98.5522 | 932.2302 | 108.1775 | 455.2176 | 113.5174 |
| 2197 | 13633 | NM_024403 | 98.5522 | 1017.1960 | 159.6258 | 340.8687 | 103.9756 |
| 238 | 22605 | AA859447 | 98.5005 | 298.9122 | 86.8134 | 46.8640 | 36.5321 |
| 591 | 14763 | AA944481 | 98.5005 | 515.9030 | 145.4453 | 24.0301 | 99.8684 |
| 586 | 22681 | AA944413 | 98.5005 | 719.6722 | 146.8975 | 300.2426 | 83.8714 |
| 2197 | 13634 | NM_024403 | 98.4488 | 1880.3100 | 310.7357 | 819.1229 | 207.2629 |
| 1512 | 11873 | AI232326 | 98.4488 | 547.9730 | 130.6466 | 147.4777 | 115.1875 |
| 1539 | 6532 | AI234105 | 98.4488 | 871.9112 | 84.2306 | 448.6074 | 126.2213 |
| 1343 | 16124 | AI176963 | 98.4488 | 689.2324 | 105.9491 | 229.3567 | 89.4439 |
| 769 | 3808 | AI008643 | 98.4488 | 1608.7652 | 223.2933 | 559.1888 | 207.2589 |
| 1320 | 22765 | AI176265 | 98.3971 | 141.9492 | 37.6784 | 22.5669 | 21.4713 |
| 1434 | 16053 | AI228596 | 98.3971 | 395.9836 | 63.5918 | 117.6825 | 86.1723 |
| 1129 | 16136 | AI103983 | 98.3971 | 331.5860 | 111.5788 | 109.1438 | 39.2430 |
| 1595 | 8759 | AI237646 | 98.3454 | 459.3384 | 173.1906 | 35.6491 | 56.0602 |
| 1251 | 14117 | AI171350 | 98.3454 | 568.3832 | 116.5057 | 1162.3826 | 221.7568 |
| 1124 | 21579 | AI103572 | 98.3454 | 245.2786 | 54.3629 | 95.5227 | 33.1673 |
| 973 | 5675 | AI045026 | 98.3454 | 621.6554 | 119.1463 | 157.2537 | 135.2641 |
| 1241 | 12695 | AI170948 | 98.2937 | 104.4010 | 32.7881 | 1.3002 | 31.2192 |
| 663 | 23314 | AA957270 | 98.2937 | 1539.4846 | 620.7748 | 80.2665 | 200.8598 |
| 1026 | 17506 | AI070068 | 98.2937 | 169.7166 | 50.5107 | 51.4166 | 25.8106 |
| 1106 | 19011 | AI102618 | 98.2420 | 1208.2564 | 183.0800 | 601.0513 | 123.8886 |
| 1293 | 8053 | AI175033 | 98.1903 | 310.3878 | 22.4150 | 161.7129 | 45.3874 |
| 1254 | 22958 | AI171374 | 98.1903 | 445.7316 | 55.1817 | 232.5878 | 63.3098 |
| 1053 | 11088 | AI071703 | 98.1903 | 40.7278 | 11.0571 | 113.6213 | 33.6357 |
| 1445 | 15212 | AI229753 | 98.1386 | 286.4968 | 137.2593 | 55.7180 | 36.3182 |
| 1319 | 10182 | AI176185 | 98.1386 | 376.9936 | 167.7702 | 31.6820 | 100.4641 |
| 1160 | 12969 | AI112969 | 98.1386 | 259.9774 | 9.3908 | 157.8627 | 44.2629 |
| 1577 | 19075 | AI236473 | 98.1386 | 230.6110 | 57.9787 | 113.1016 | 25.6307 |
| 2101 | 6585 | NM_022266 | 98.1386 | 2421.0914 | 359.2627 | 736.8839 | 413.8339 |
| 694 | 2459 | AA964755 | 98.1386 | 1898.8080 | 723.9863 | 121.3918 | 267.6246 |
| 640 | 23626 | AA955540 | 98.1386 | 226.7950 | 99.5140 | 72.8989 | 32.6827 |
| 176 | 11021 | AA819767 | 98.0869 | 644.2628 | 48.0691 | 325.7648 | 108.0945 |
| 1013 | 8314 | AI059386 | 98.0869 | 140.9914 | 51.7258 | 49.2117 | 24.8297 |
| 554 | 3817 | AA926328 | 98.0869 | 311.6976 | 25.8985 | 180.3736 | 60.3209 |
| 852 | 7471 | AI012379 | 98.0352 | 398.5200 | 92.0347 | 198.9423 | 49.9844 |
| 1455 | 6217 | AI230381 | 97.9835 | 196.6190 | 114.6867 | 58.2228 | 22.1304 |
| 1575 | 15051 | AI236332 | 97.9835 | 303.7946 | 68.2762 | 119.9003 | 108.7666 |
| 156 | 19723 | AA818761 | 97.9317 | 293.6122 | 49.7000 | 109.3153 | 54.2319 |
| 237 | 16314 | AA859348 | 97.9317 | 295.3764 | 66.9849 | 63.9732 | 47.2996 |

TABLE 5R

EPIRUBICIN
Timepoint(s): 6, 192 hrs

| SEQ ID | GLGC ID | GenBank Accession No. | LDA Score | Mean Tox | SD Tox | Mean Nontox | SD Nontox |
|---|---|---|---|---|---|---|---|
| 408 | 20065 | AA892647 | 93.6486 | 64.5336 | 15.5144 | 28.3182 | 29.0093 |
| 256 | 22773 | AA859885 | 92.3077 | 284.2659 | 40.2072 | 459.7835 | 112.4690 |
| 2064 | 23491 | NM_019359 | 90.0208 | 64.4093 | 19.8092 | 116.5459 | 34.5374 |
| 457 | 10540 | AA894027 | 89.9584 | 79.6845 | 31.1727 | 22.9667 | 23.9684 |
| 139 | 2143 | AA817892 | 88.4615 | 205.6064 | 19.3914 | 261.7126 | 54.9187 |
| 468 | 3910 | AA894345 | 87.9418 | 117.9722 | 6.1754 | 145.6334 | 35.4866 |
| 267 | 15884 | AA866276 | 87.8274 | 428.9210 | 71.0840 | 724.7975 | 186.7630 |
| 184 | 2324 | AA848545 | 87.7859 | 100.4435 | 5.4519 | 81.7793 | 29.3883 |
| 397 | 8599 | AA892522 | 87.2557 | 161.8975 | 28.0984 | 100.2554 | 36.8683 |
| 321 | 15638 | AA875633 | 87.1622 | 563.8050 | 83.5590 | 932.5900 | 306.9782 |
| 2601 | 3244 | S63519 | 87.1622 | 194.1251 | 7.6588 | 175.9356 | 33.8489 |
| 2476 | 9528 | NM_057104 | 87.0062 | 39.5442 | 1.7304 | 38.7435 | 25.0338 |
| 58 | 20092 | AA799637 | 86.6944 | 37.2246 | 5.1645 | 34.0494 | 18.0370 |
| 2405 | 20902 | NM_053593 | 86.6424 | 136.3531 | 6.7880 | 158.2420 | 30.0573 |
| 463 | 2133 | AA894193 | 86.5385 | 46.9168 | 4.5796 | 34.4053 | 13.4303 |
| 2190 | 15623 | NM_024369 | 86.3306 | 245.5920 | 54.3446 | 418.3828 | 140.4630 |
| 2274 | 634 | NM_031509 | 86.2578 | 233.1804 | 64.6370 | 95.2150 | 54.3206 |
| 2248 | 23569 | NM_031122 | 86.0707 | 150.4479 | 7.7162 | 126.2006 | 23.9627 |
| 2185 | 17764 | NM_024351 | 86.0603 | 2515.6902 | 214.7747 | 1942.4118 | 398.2909 |
| 2273 | 18654 | NM_031358 | 86.0083 | 104.5548 | 44.7109 | 218.9800 | 64.6883 |
| 2429 | 1016 | NM_053772 | 85.9667 | 130.3715 | 17.5267 | 94.4053 | 45.5947 |
| 2686 | 18031 | X94551 | 85.9148 | 331.9946 | 28.2218 | 387.7143 | 97.9114 |
| 2500 | 23033 | NM_080888 | 85.9148 | 382.1855 | 34.8056 | 526.8407 | 135.4403 |
| 1930 | 18957 | NM_017075 | 85.8524 | 1133.3488 | 53.5900 | 910.3338 | 163.5995 |
| 1736 | 20518 | NM_012518 | 85.8108 | 184.9967 | 10.9456 | 226.6997 | 41.2712 |
| 2274 | 635 | NM_031509 | 85.3222 | 173.9367 | 53.8127 | 93.8402 | 42.0856 |
| 2626 | 25619 | U64705 | 85.2807 | 737.8122 | 95.7001 | 572.0521 | 115.1693 |
| 2274 | 25525 | NM_031509 | 85.2703 | 185.5478 | 54.7659 | 78.6183 | 46.6012 |
| 1987 | 20601 | NM_017268 | 85.1351 | 60.9161 | 6.8553 | 83.8053 | 29.2937 |
| 1922 | 20876 | NM_017050 | 85.1247 | 1477.8560 | 94.3479 | 1188.7541 | 225.8488 |
| 2544 | 25237 | NM_134452 | 85.0312 | 36.8579 | 15.2615 | 80.7048 | 36.1521 |
| 2604 | 25066 | S75280 | 84.7713 | 236.0595 | 50.3392 | 163.9011 | 83.2976 |
| 1817 | 187 | NM_012903 | 84.7609 | 138.2698 | 29.4137 | 54.9629 | 47.4598 |
| 1936 | 10888 | NM_017094 | 84.7609 | 63.2809 | 6.7913 | 52.5103 | 31.2517 |
| 2263 | 1291 | NM_031149 | 84.7089 | 349.3815 | 44.9135 | 256.0730 | 55.9576 |
| 2088 | 17936 | NM_021766 | 84.3971 | 42.1342 | 7.8386 | 28.8558 | 10.6646 |
| 271 | 16607 | AA866364 | 84.3555 | 161.5580 | 11.0476 | 140.6459 | 36.4500 |
| 2568 | 17868 | NM_139104 | 84.3035 | 91.0739 | 16.4840 | 137.3277 | 44.9267 |
| 1507 | 409 | AI232268 | 84.2516 | 53.9426 | 2.9469 | 62.5564 | 12.5587 |
| 48 | 20972 | AA799580 | 84.1892 | 685.9562 | 126.8069 | 1004.5982 | 223.9314 |
| 2258 | 17379 | NM_031138 | 84.0333 | 566.0024 | 52.1466 | 437.6768 | 98.7187 |
| 1886 | 2012 | NM_013173 | 84.0333 | 51.4565 | 7.7452 | 73.9695 | 17.2172 |
| 2530 | 1827 | NM_133572 | 83.9397 | 24.3368 | 15.2526 | 75.2777 | 47.8439 |
| 2142 | 20762 | NM_022588 | 83.8877 | 73.8346 | 9.2642 | 91.5686 | 17.0952 |
| 2081 | 25445 | NM_021654 | 83.8877 | 33.1559 | 6.2801 | 33.1519 | 27.0709 |
| 1856 | 24874 | NM_013057 | 83.8358 | 36.3819 | 4.0736 | 38.2723 | 18.4138 |
| 2355 | 25569 | NM_033096 | 83.7318 | 51.7451 | 9.8328 | 34.5213 | 17.6905 |
| 2195 | 25070 | NM_024392 | 83.7214 | 210.4100 | 28.7273 | 159.6915 | 36.5691 |
| 64 | 18061 | AA799735 | 83.6694 | 159.2217 | 21.0681 | 115.9734 | 32.9274 |
| 1402 | 16081 | AI179610 | 83.6590 | 145.6088 | 47.3785 | 87.3385 | 67.1593 |
| 1972 | 18967 | NM_017222 | 83.6071 | 393.5761 | 85.9385 | 203.7180 | 105.0874 |
| 2144 | 20960 | NM_022598 | 83.5655 | 691.0195 | 61.2470 | 520.7054 | 116.1343 |
| 2185 | 17765 | NM_024351 | 83.5135 | 1741.1042 | 178.9719 | 1393.0553 | 286.5207 |
| 2144 | 20959 | NM_022598 | 83.5135 | 306.9811 | 36.5119 | 218.9331 | 62.0721 |
| 1770 | 16219 | NM_012656 | 83.4719 | 484.5323 | 119.0956 | 789.5112 | 258.3472 |
| 2439 | 16099 | NM_053837 | 83.4200 | 374.8630 | 21.6957 | 430.6596 | 62.5971 |
| 2172 | 21239 | NM_024125 | 83.3992 | 221.4428 | 46.3566 | 118.3619 | 62.8627 |
| 2626 | 25618 | U64705 | 83.3576 | 777.8311 | 87.4808 | 624.9041 | 128.5676 |
| 2294 | 14542 | NM_031596 | 83.2640 | 30.6546 | 6.1426 | 21.3064 | 17.0990 |
| 2666 | 15875 | X62145 | 83.1081 | 1422.4221 | 65.2450 | 1569.9365 | 300.7935 |
| 764 | 15849 | AI008074 | 83.0977 | 497.5558 | 92.3428 | 271.6573 | 141.4369 |
| 2316 | 18057 | NM_031707 | 83.0977 | 25.4141 | 2.6996 | 20.2121 | 9.4747 |
| 277 | 9391 | AA866477 | 83.0561 | 2201.7503 | 129.6568 | 2047.1440 | 419.5544 |
| 400 | 11202 | AA892554 | 83.0457 | 69.4587 | 10.5124 | 47.7518 | 15.8933 |
| 1127 | 4402 | AI103874 | 82.9938 | 267.3028 | 36.0275 | 194.1380 | 60.3745 |
| 611 | 20619 | AA945737 | 82.9938 | 4.0962 | 6.6296 | 22.2013 | 13.2651 |
| 465 | 22783 | AA894207 | 82.9522 | 609.1080 | 69.8339 | 472.5891 | 166.6911 |
| 2526 | 1824 | NM_133545 | 82.9002 | 87.3108 | 10.0804 | 112.6497 | 25.9379 |
| 2138 | 9541 | NM_022542 | 82.8378 | 555.4538 | 91.6877 | 402.8147 | 108.5197 |
| 2079 | 18729 | NM_021578 | 82.7963 | 14.1671 | 11.8544 | 42.3843 | 27.7798 |
| 1850 | 1338 | NM_013022 | 82.7339 | 51.0268 | 15.7818 | 26.4355 | 18.1819 |
| 2286 | 18317 | NM_031561 | 82.7339 | 1103.1219 | 189.3486 | 630.0896 | 288.1701 |

TABLE 5R-continued

EPIRUBICIN
Timepoint(s): 6, 192 hrs

| SEQ ID | GLGC ID | GenBank Accession No. | LDA Score | Mean Tox | SD Tox | Mean Nontox | SD Nontox |
|---|---|---|---|---|---|---|---|
| 2357 | 2577 | NM_033236 | 82.6299 | 163.8201 | 10.2165 | 127.8969 | 39.1821 |
| 443 | 19505 | AA893634 | 82.5780 | 29.6876 | 6.2768 | 49.9631 | 16.3707 |
| 1789 | 13731 | NM_012755 | 82.5260 | 137.1868 | 20.1514 | 192.5144 | 41.4634 |
| 17 | 25104 | AA685903 | 82.5260 | 293.0527 | 38.8201 | 173.1177 | 90.2175 |
| 2378 | 623 | NM_053369 | 82.4844 | 110.7857 | 25.1048 | 165.3757 | 60.2912 |
| 1737 | 2735 | NM_012519 | 82.4740 | 28.9793 | 6.0732 | 18.2200 | 15.8770 |
| 1725 | 10743 | M64780 | 82.4324 | 127.0427 | 17.4009 | 164.5138 | 43.0218 |
| 2221 | 15886 | NM_031035 | 82.3701 | 283.3204 | 46.2343 | 407.5226 | 96.1521 |
| 283 | 16084 | AA874889 | 82.3285 | 23.4277 | 5.1613 | 34.5399 | 14.6850 |
| 1805 | 338 | NM_012843 | 82.3285 | 9.6305 | 10.6024 | 41.6928 | 35.9824 |
| 2330 | 15864 | NM_031797 | 82.2765 | 42.2848 | 9.5215 | 64.2521 | 21.7497 |
| 2307 | 5358 | NM_031675 | 82.2765 | 30.1691 | 9.1089 | 52.8179 | 32.3491 |
| 2090 | 20161 | NM_021836 | 82.2557 | 72.3282 | 30.7027 | 36.5091 | 40.8862 |
| 2615 | 16675 | U17565 | 82.2245 | 6.4648 | 9.8542 | 23.9162 | 17.4864 |
| 2150 | 20509 | NM_022689 | 82.2245 | 41.7443 | 3.8443 | 35.8325 | 15.1488 |
| 2299 | 24234 | NM_031614 | 82.2141 | 110.0508 | 21.1288 | 77.0101 | 32.6692 |
| 2008 | 15037 | NM_017347 | 82.2141 | 158.7025 | 43.1588 | 251.0986 | 68.6957 |
| 2495 | 17960 | NM_080583 | 82.1726 | 115.5419 | 19.4553 | 135.9037 | 33.8947 |
| 315 | 15412 | AA875500 | 82.0478 | 72.9889 | 28.1407 | 38.9881 | 25.5078 |
| 102 | 12253 | AA800549 | 82.0166 | 17.9676 | 4.2628 | 23.8982 | 22.7983 |
| 1601 | 25854 | AI639001 | 81.9127 | 35.6123 | 7.9702 | 50.3945 | 16.5373 |
| 2559 | 7395 | NM_138883 | 81.9127 | 3223.9060 | 176.7481 | 3550.2689 | 741.6043 |
| 2234 | 1295 | NM_031097 | 81.9023 | 49.4074 | 14.2289 | 75.3296 | 19.2455 |
| 1678 | 24033 | H33101 | 81.9023 | 99.2837 | 18.7151 | 146.7463 | 37.6711 |
| 2584 | 15640 | NM_145775 | 81.8087 | 96.0308 | 14.7136 | 142.3732 | 61.0904 |
| 2366 | 1596 | NM_053294 | 81.7464 | 84.1073 | 5.6887 | 102.3077 | 17.1709 |
| 2392 | 15829 | NM_053551 | 81.7256 | 178.6291 | 111.9201 | 49.6041 | 71.8434 |
| 324 | 19388 | AA891032 | 81.7048 | 47.1590 | 13.9443 | 30.9755 | 45.9566 |
| 1206 | 23152 | AI169170 | 95.8940 | 1335.9175 | 118.1675 | 867.9193 | 203.9039 |
| 1117 | 3584 | AI103106 | 94.7505 | 14.2293 | 5.4921 | 60.6882 | 32.4469 |
| 217 | 21713 | AA851637 | 93.2952 | 582.7896 | 69.9045 | 872.7558 | 176.6252 |
| 1992 | 15538 | NM_017283 | 93.1393 | 536.0414 | 54.6891 | 365.6804 | 104.8045 |
| 767 | 21229 | AI008371 | 93.0353 | 62.9916 | 11.0545 | 27.1504 | 18.6457 |
| 700 | 2803 | AA996451 | 92.4116 | 97.1603 | 21.4838 | 176.3510 | 50.7559 |
| 1140 | 4782 | AI104570 | 92.2037 | 108.8619 | 15.8476 | 183.7873 | 47.7795 |
| 1042 | 23437 | AI071166 | 91.7879 | 236.7137 | 41.3343 | 139.6025 | 71.4791 |
| 1290 | 11173 | AI175005 | 91.5281 | 243.0114 | 58.0247 | 535.3317 | 167.9921 |
| 713 | 14582 | AA997412 | 91.2682 | 127.6744 | 21.5199 | 224.2760 | 70.2202 |
| 1004 | 10115 | AI058890 | 91.2682 | 29.6057 | 13.6555 | 90.3885 | 44.5235 |
| 141 | 5982 | AA817999 | 90.9563 | 330.2865 | 56.5047 | 504.3480 | 103.6195 |
| 1265 | 24220 | AI171978 | 90.8004 | 75.6789 | 14.2419 | 48.9576 | 26.7107 |
| 2159 | 23608 | NM_022867 | 90.8004 | 504.9734 | 53.1811 | 370.6369 | 85.3745 |
| 823 | 17761 | AI010662 | 90.3326 | 628.0054 | 52.1838 | 454.0933 | 117.2960 |
| 590 | 22431 | AA944463 | 90.1767 | 43.1080 | 22.9255 | 110.5954 | 42.0717 |
| 1300 | 4445 | AI175466 | 89.2412 | 496.0604 | 33.5495 | 649.1682 | 124.3616 |
| 1094 | 11399 | AI101924 | 89.0852 | 86.8469 | 15.6233 | 155.1791 | 51.7814 |
| 2149 | 6121 | NM_022686 | 88.9293 | 21.1135 | 4.1346 | 11.2633 | 8.4403 |
| 827 | 18438 | AI010930 | 88.9293 | 634.1819 | 51.5064 | 470.5666 | 122.5918 |
| 543 | 4285 | AA925708 | 88.6071 | 187.1363 | 42.6328 | 304.2508 | 62.9055 |
| 1309 | 22451 | AI175992 | 88.5551 | 69.9633 | 16.1178 | 151.1270 | 54.6803 |
| 1232 | 11585 | AI170502 | 88.5135 | 428.5571 | 54.5189 | 583.7686 | 113.3086 |
| 481 | 18890 | AA899964 | 88.5135 | 622.3692 | 39.7606 | 834.6452 | 207.6526 |
| 2181 | 562 | NM_024156 | 88.4615 | 351.8821 | 19.9393 | 443.1682 | 93.7766 |
| 679 | 2195 | AA963746 | 88.3992 | 37.4029 | 12.5528 | 12.5809 | 11.0479 |
| 577 | 11413 | AA943981 | 88.1497 | 41.8912 | 13.2820 | 116.6002 | 69.4703 |
| 1273 | 6974 | AI172263 | 88.0457 | 465.5023 | 57.8721 | 672.4599 | 169.8077 |
| 1069 | 10918 | AI072733 | 88.0353 | 249.3467 | 44.9415 | 394.0465 | 82.6490 |
| 125 | 10549 | AA801255 | 88.0249 | 76.7015 | 27.5227 | 25.7768 | 13.2437 |
| 508 | 18162 | AA924013 | 87.9938 | 672.9671 | 157.9230 | 1379.7346 | 622.7619 |
| 652 | 22899 | AA956555 | 87.8794 | 99.8766 | 31.4158 | 44.2337 | 33.3480 |
| 1208 | 2607 | AI169211 | 87.8378 | 210.1685 | 36.9080 | 309.7591 | 77.6187 |
| 1343 | 16124 | AI176963 | 87.7235 | 349.2498 | 69.2475 | 230.5006 | 94.8320 |
| 155 | 4330 | AA818747 | 87.5260 | 291.9245 | 58.6099 | 457.8991 | 140.3640 |
| 1334 | 15959 | AI176540 | 87.5156 | 166.1477 | 35.3812 | 284.1650 | 68.3560 |
| 1560 | 3650 | AI235738 | 87.2141 | 27.5894 | 7.3449 | 47.3570 | 16.8362 |
| 1537 | 2146 | AI233965 | 87.1102 | 112.9026 | 7.9507 | 83.1270 | 69.9111 |
| 1049 | 19668 | AI071538 | 87.0374 | 294.4770 | 103.1179 | 104.9414 | 48.2427 |
| 1444 | 13977 | AI229707 | 86.9543 | 324.9940 | 47.9945 | 473.8557 | 139.7205 |
| 1412 | 5482 | AI180252 | 86.7879 | 131.7752 | 46.1137 | 262.4037 | 74.2493 |
| 1368 | 22691 | AI177967 | 86.6944 | 610.5659 | 137.7533 | 925.4717 | 241.2703 |
| 1316 | 17223 | AI176140 | 86.6840 | 1740.5481 | 162.7909 | 1385.7345 | 197.6986 |
| 1213 | 11550 | AI169591 | 86.5800 | 53.8907 | 15.8747 | 24.7288 | 17.1509 |

TABLE 5R-continued

EPIRUBICIN
Timepoint(s): 6, 192 hrs

| SEQ ID | GLGC ID | GenBank Accession No. | LDA Score | Mean Tox | SD Tox | Mean Nontox | SD Nontox |
|---|---|---|---|---|---|---|---|
| 1486 | 8004 | AI231532 | 86.4865 | 51.9950 | 8.1689 | 33.3889 | 24.2458 |
| 1355 | 26254 | AI177357 | 86.4345 | 62.2933 | 6.7403 | 43.5870 | 16.5093 |
| 1113 | 24229 | AI102972 | 86.3306 | 40.4595 | 25.6329 | 102.7587 | 67.3230 |
| 588 | 19480 | AA944442 | 86.3202 | 1082.1691 | 173.5370 | 1683.1091 | 376.5196 |
| 1471 | 8036 | AI230884 | 86.3098 | 134.7036 | 31.9390 | 73.2170 | 22.4198 |
| 791 | 9746 | AI009555 | 86.2786 | 152.0881 | 23.8073 | 109.2433 | 62.9276 |
| 1275 | 23313 | AI172271 | 86.1642 | 193.6157 | 31.1318 | 300.9419 | 73.0184 |
| 564 | 6691 | AA943028 | 86.1227 | 96.9943 | 24.9702 | 158.1074 | 51.5964 |
| 891 | 2708 | AI013882 | 86.1227 | 523.6743 | 46.8008 | 660.4570 | 128.0638 |
| 1045 | 11017 | AI071222 | 86.0707 | 44.1708 | 21.1458 | 104.5216 | 47.2598 |
| 1468 | 14430 | AI230798 | 86.0707 | −4.2543 | 7.5839 | 23.7641 | 26.1542 |
| 1489 | 2422 | AI231615 | 86.0707 | 131.8345 | 17.6804 | 191.8780 | 69.0197 |
| 922 | 665 | AI030430 | 86.0187 | 655.9712 | 54.2070 | 561.4934 | 112.5356 |
| 531 | 5070 | AA925031 | 85.9667 | 85.7730 | 10.6372 | 52.6396 | 36.2695 |
| 622 | 22711 | AA946072 | 85.9148 | 180.0290 | 22.1305 | 230.2369 | 47.3605 |
| 146 | 6522 | AA818261 | 85.9044 | 450.1290 | 145.1702 | 835.3920 | 230.1413 |
| 1376 | 6502 | AI178283 | 85.8628 | 159.2748 | 22.1170 | 232.6916 | 70.0673 |
| 477 | 17243 | AA899894 | 85.8628 | 207.4676 | 55.0211 | 347.7619 | 112.2982 |
| 1164 | 6166 | AI136516 | 85.8524 | 165.8695 | 54.9624 | 322.5498 | 92.7068 |
| 1123 | 7528 | AI103548 | 85.7588 | 95.4966 | 8.9508 | 63.3362 | 27.7343 |
| 1291 | 7740 | AI175011 | 85.6965 | 416.2965 | 59.9352 | 299.4983 | 66.7080 |
| 1097 | 3996 | AI102061 | 85.6445 | 87.6525 | 14.7965 | 59.6366 | 16.0125 |
| 1256 | 13453 | AI171518 | 85.5509 | 201.6490 | 33.7731 | 300.0235 | 81.7371 |
| 1510 | 4716 | AI232313 | 85.5405 | 170.1268 | 17.6057 | 125.1288 | 30.6648 |
| 1307 | 21755 | AI175977 | 85.4990 | 438.1096 | 78.0876 | 628.7300 | 162.3387 |
| 510 | 4907 | AA924091 | 85.4990 | 136.2406 | 13.5281 | 173.5136 | 37.6766 |
| 596 | 22536 | AA944803 | 85.3950 | 710.5183 | 98.6998 | 1051.4300 | 301.1097 |
| 1189 | 13181 | AI144948 | 85.3846 | 43.2573 | 10.9705 | 19.9964 | 14.0652 |
| 1154 | 18439 | AI111877 | 85.3846 | 356.3238 | 37.3752 | 258.2394 | 67.8627 |
| 1582 | 11445 | AI236613 | 85.3846 | 157.7293 | 42.6245 | 285.6630 | 83.7123 |

TABLE 5S

HYDRALAZINE
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 368 | 15087 | AA892010 | 98.7590 | 156.8356 | 5.1580 | 247.9661 | 48.5522 |
| 1663 | 1884 | D50695 | 98.1903 | 212.7678 | 15.4227 | 146.8696 | 33.4932 |
| 467 | 17336 | AA894297 | 97.7766 | 38.8984 | 6.0547 | 15.5544 | 7.6289 |
| 1323 | 13339 | AI176308 | 97.1562 | 621.0880 | 36.3859 | 418.4784 | 87.1565 |
| 2592 | 10544 | NM_152935 | 97.0527 | 579.5536 | 26.8199 | 430.2195 | 65.2285 |
| 1632 | 25964 | AI639352 | 96.8976 | 10.3804 | 1.5050 | 30.7610 | 28.7726 |
| 1800 | 10248 | NM_012797 | 96.8459 | 560.9118 | 75.9608 | 306.7008 | 83.5683 |
| 2177 | 20801 | NM_024148 | 96.8459 | 124.0848 | 9.9768 | 78.3221 | 18.5023 |
| 1990 | 17959 | NM_017277 | 96.6908 | 196.1464 | 32.6060 | 103.5609 | 35.1979 |
| 2416 | 1316 | NM_053656 | 96.3806 | 194.5946 | 3.0724 | 220.5001 | 67.6819 |
| 1857 | 15253 | NM_013058 | 96.1737 | 213.1780 | 15.3416 | 108.2212 | 47.0196 |
| 91 | 21065 | AA800179 | 95.9152 | 64.0334 | 6.5672 | 32.7124 | 16.7123 |
| 2402 | 21170 | NM_053585 | 95.7084 | 23.4838 | 3.1293 | 4.4235 | 16.1799 |
| 2336 | 4748 | NM_031834 | 95.5016 | 80.0904 | 8.0144 | 44.1474 | 44.7732 |
| 897 | 15494 | AI014094 | 95.2430 | 30.1844 | 11.4627 | 1.2506 | 13.1609 |
| 2337 | 8385 | NM_031836 | 95.1913 | 65.6368 | 3.4862 | 120.7273 | 53.3853 |
| 441 | 22149 | AA893607 | 95.1913 | 102.1954 | 21.5573 | 44.6483 | 21.6509 |
| 2298 | 19022 | NM_031609 | 95.1913 | 166.9424 | 17.2286 | 106.2918 | 27.3335 |
| 2444 | 1570 | NM_053857 | 95.1913 | 188.7068 | 22.2973 | 128.2530 | 34.5486 |
| 1939 | 4391 | NM_017101 | 95.1913 | 964.1682 | 28.6948 | 748.8637 | 167.1622 |
| 2285 | 692 | NM_031557 | 95.1396 | 226.4920 | 31.5708 | 136.7682 | 35.6521 |
| 2207 | 1048 | NM_030863 | 94.9845 | 34.4978 | 1.3618 | 32.2165 | 23.4399 |
| 1793 | 5758 | NM_012778 | 94.8811 | 1126.7468 | 67.5204 | 729.5331 | 208.0611 |
| 2022 | 5618 | NM_019143 | 94.8811 | 20.6124 | 0.6174 | 16.1073 | 12.4939 |
| 2075 | 18713 | NM_020075 | 94.7777 | 337.1688 | 47.9403 | 221.5557 | 53.1969 |
| 2679 | 25741 | X76489 | 94.7777 | 316.6112 | 28.7189 | 204.9095 | 55.1017 |
| 1450 | 23042 | AI230130 | 94.7777 | 168.7624 | 7.8811 | 106.7368 | 46.2615 |
| 2589 | 25435 | NM_147208 | 94.7260 | 4.4656 | 4.8069 | 40.9287 | 21.5174 |
| 2255 | 13359 | NM_031135 | 94.6743 | 67.3408 | 14.1570 | 20.7383 | 20.7125 |
| 2568 | 17868 | NM_139104 | 94.6743 | 223.1472 | 24.4925 | 136.4057 | 44.6227 |

TABLE 5S-continued

HYDRALAZINE
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 87 | 23344 | AA800034 | 94.5191 | 312.8444 | 8.5720 | 258.7436 | 47.1229 |
| 2471 | 17326 | NM_054008 | 94.4674 | 103.0512 | 25.6833 | 42.3484 | 24.4297 |
| 312 | 15510 | AA875428 | 94.4157 | 193.4632 | 17.2712 | 281.2604 | 54.4386 |
| 1926 | 1943 | NM_017061 | 94.3640 | 106.5466 | 18.1488 | 62.4307 | 19.5604 |
| 42 | 15560 | AA799538 | 94.3640 | 19.8352 | 2.6627 | 38.4841 | 17.5475 |
| 2112 | 23061 | NM_022394 | 94.3123 | 50.6234 | 0.7799 | 56.6232 | 17.4678 |
| 1868 | 1521 | NM_013091 | 94.2606 | 133.3518 | 17.4480 | 68.3514 | 34.5064 |
| 380 | 18190 | AA892280 | 94.2606 | 104.4614 | 3.4337 | 142.4649 | 35.8774 |
| 2289 | 1921 | NM_031576 | 94.2089 | 130.4758 | 22.4579 | 81.5571 | 23.6977 |
| 2479 | 23310 | NM_057119 | 94.1572 | 121.0986 | 7.7792 | 79.1103 | 28.4253 |
| 2558 | 945 | NM_138882 | 93.9504 | 34.0030 | 9.4963 | −12.4155 | 31.0088 |
| 2080 | 18946 | NM_021584 | 93.7435 | 30.7076 | 3.0945 | 13.8638 | 10.5136 |
| 1951 | 24106 | NM_017141 | 93.6401 | 48.1790 | 5.6697 | 27.1419 | 10.6941 |
| 96 | 21656 | AA800202 | 93.6401 | 20.8806 | 2.4819 | 39.6907 | 13.3864 |
| 1930 | 18957 | NM_017075 | 93.5367 | 785.0618 | 16.6500 | 913.2878 | 164.5502 |
| 372 | 23892 | AA892120 | 93.4850 | 63.0390 | 7.1285 | 43.9236 | 10.1395 |
| 2142 | 20762 | NM_022588 | 93.4333 | 69.1156 | 3.7502 | 91.5013 | 17.0914 |
| 311 | 15446 | AA875327 | 93.3816 | 425.6222 | 30.8100 | 303.8692 | 72.8527 |
| 382 | 18209 | AA892318 | 93.3299 | 123.0876 | 5.5037 | 88.5967 | 32.0752 |
| 252 | 22385 | AA859805 | 93.2782 | 234.0026 | 17.9207 | 148.7964 | 70.9091 |
| 2066 | 18820 | NM_019367 | 93.2265 | 88.4046 | 3.8870 | 94.9261 | 46.6153 |
| 415 | 17589 | AA892851 | 93.1748 | 23.0494 | 6.7302 | 6.2261 | 8.8905 |
| 1982 | 16601 | NM_017252 | 93.1748 | 14.8828 | 1.2193 | 27.1258 | 12.9479 |
| 2208 | 1928 | NM_030872 | 93.0714 | 612.9376 | 10.0815 | 573.3866 | 132.1135 |
| 903 | 17957 | AI028975 | 93.0196 | 100.3830 | 12.8643 | 66.2742 | 17.5071 |
| 394 | 14066 | AA892504 | 92.9679 | 82.6706 | 2.6372 | 111.0196 | 31.3767 |
| 2672 | 436 | X67877 | 92.8645 | 91.0144 | 12.4145 | 58.2971 | 17.2789 |
| 1955 | 16955 | NM_017151 | 92.8645 | 351.1696 | 24.0086 | 534.1851 | 180.8971 |
| 2480 | 727 | NM_057123 | 92.8128 | 250.8246 | 5.8409 | 222.3852 | 33.1218 |
| 2663 | 25711 | X60468 | 92.7611 | 60.4372 | 5.8554 | 27.9624 | 21.9218 |
| 2527 | 18043 | NM_133546 | 92.7094 | 100.0874 | 16.5917 | 62.8439 | 21.7182 |
| 1929 | 11152 | NM_017073 | 92.6060 | 336.3804 | 36.5219 | 214.4555 | 89.4738 |
| 2160 | 24283 | NM_022869 | 92.5543 | 56.7636 | 4.8815 | 84.0133 | 26.7697 |
| 419 | 12848 | AA892916 | 92.4509 | 46.4060 | 9.3354 | 26.6783 | 13.1691 |
| 2126 | 3900 | NM_022516 | 92.4509 | 30.1638 | 6.7989 | 8.1642 | 13.2507 |
| 247 | 22407 | AA859680 | 92.3992 | 145.0898 | 36.4334 | 262.9633 | 69.4955 |
| 295 | 16342 | AA875060 | 92.3992 | 56.6232 | 6.2416 | 34.9010 | 12.4906 |
| 1708 | 20714 | M14972 | 92.3992 | 36.3614 | 2.6050 | 7.0023 | 32.3092 |
| 1749 | 482 | NM_012567 | 92.3475 | 41.2860 | 4.8405 | 109.9989 | 77.8782 |
| 1656 | 25257 | D13623 | 92.3475 | 103.9680 | 11.1885 | 70.6630 | 18.2516 |
| 1909 | 20921 | NM_016999 | 92.3475 | 89.1870 | 13.7751 | 49.6330 | 23.9242 |
| 115 | 17658 | AA800853 | 92.3475 | 20.4468 | 3.4186 | 41.4294 | 20.5741 |
| 1645 | 20083 | AI639523 | 92.3475 | 13.0912 | 3.5158 | 40.5189 | 21.6018 |
| 1728 | 3762 | M86341 | 92.3475 | 60.4542 | 2.8419 | 42.2743 | 16.7555 |
| 2014 | 1581 | NM_017365 | 92.3475 | 381.3852 | 18.7110 | 297.2422 | 61.4305 |
| 933 | 23950 | AI031019 | 92.2958 | 81.2448 | 11.7875 | 58.9087 | 13.0678 |
| 2105 | 17158 | NM_022298 | 92.2958 | 692.2852 | 19.4813 | 744.8099 | 211.2131 |
| 1750 | 16026 | NM_012578 | 92.2441 | 237.7962 | 30.8417 | 158.0972 | 46.9047 |
| 2354 | 21104 | NM_033021 | 92.1923 | 175.6340 | 9.9545 | 126.3519 | 35.6131 |
| 753 | 20741 | AF084186 | 92.0889 | 195.6502 | 31.8691 | 123.0799 | 39.9077 |
| 1623 | 19749 | AI639203 | 92.0889 | 62.3318 | 4.5405 | 42.0015 | 13.4042 |
| 2107 | 11454 | NM_022381 | 92.0889 | 258.2222 | 10.1641 | 210.0320 | 63.8915 |
| 1834 | 5033 | NM_012966 | 92.0889 | 758.2678 | 14.0368 | 683.2052 | 151.6138 |
| 2394 | 11843 | NM_053555 | 91.9855 | 89.5282 | 3.4154 | 73.9656 | 16.4826 |
| 2354 | 21103 | NM_033021 | 91.9338 | 382.6494 | 64.5228 | 269.4251 | 66.5565 |
| 2522 | 25543 | NM_133524 | 91.9338 | 35.7336 | 1.2476 | 40.1607 | 16.7910 |
| 1801 | 20246 | NM_012807 | 91.7787 | 27.9992 | 6.3133 | 46.1156 | 22.2777 |
| 350 | 11959 | AA891735 | 91.7270 | 37.8310 | 5.1631 | 65.3994 | 19.8840 |
| 240 | 13595 | AA859508 | 91.6236 | 124.2288 | 5.6409 | 96.4356 | 18.2726 |
| 1660 | 25276 | D28966 | 91.6236 | −19.5760 | 13.2759 | 95.0678 | 96.0023 |
| 2107 | 11455 | NM_022381 | 91.6236 | 127.6180 | 11.4570 | 85.5654 | 31.9573 |
| 2289 | 1920 | NM_031576 | 91.5719 | 329.6462 | 22.8902 | 255.1135 | 63.6334 |
| 466 | 3929 | AA894233 | 91.5202 | 0.8188 | 6.1616 | 21.7883 | 12.2968 |
| 2313 | 16663 | NM_031695 | 91.5202 | 28.6692 | 1.1725 | 23.2420 | 10.2207 |
| 338 | 21905 | AA891546 | 91.4685 | 83.4162 | 1.6888 | 94.6712 | 16.8457 |
| 2505 | 11709 | NM_130431 | 91.4685 | 251.7840 | 16.1910 | 167.6742 | 56.0592 |
| 107 | 5257 | AA800673 | 91.4685 | 109.8050 | 7.3292 | 74.9256 | 23.9694 |
| 273 | 15980 | AA866426 | 91.4168 | 108.6496 | 9.3397 | 76.9870 | 21.0493 |
| 2537 | 517 | NM_134350 | 91.4168 | 63.0800 | 8.9266 | 102.9841 | 33.5337 |
| 2216 | 1024 | NM_031016 | 91.3650 | 30.9232 | 1.2299 | 44.3473 | 19.0074 |
| 1115 | 8124 | AI103071 | 98.8625 | 95.3660 | 7.7097 | 40.2143 | 17.6130 |
| 805 | 15988 | AI010108 | 98.2937 | 558.6684 | 65.8687 | 241.6226 | 86.0058 |
| 2387 | 14904 | NM_053492 | 98.1903 | 112.3884 | 1.2288 | 83.6469 | 20.3510 |

TABLE 5S-continued

HYDRALAZINE
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 928 | 19257 | AI030775 | 97.7766 | 513.5628 | 37.1821 | 301.9994 | 73.4440 |
| 1420 | 23015 | AI227724 | 97.6215 | 153.2294 | 30.5337 | 77.7618 | 21.7425 |
| 1572 | 5007 | AI236229 | 97.5181 | 1227.9742 | 164.0440 | 736.2918 | 160.4563 |
| 634 | 23471 | AA955162 | 97.3113 | 189.1040 | 51.5207 | 77.4026 | 35.9134 |
| 771 | 12398 | AI008689 | 97.3113 | 399.6760 | 9.1169 | 280.6130 | 66.7741 |
| 992 | 6828 | AI058359 | 97.1562 | 671.4382 | 59.8131 | 327.2167 | 123.5972 |
| 229 | 17236 | AA858903 | 97.0010 | 778.2720 | 64.5047 | 428.0899 | 134.2179 |
| 498 | 26075 | AA900993 | 97.0010 | 924.5460 | 22.1006 | 1301.2541 | 323.3296 |
| 691 | 14342 | AA964595 | 96.7425 | 59.0536 | 1.1919 | 83.3173 | 28.1826 |
| 2524 | 2788 | NM_133528 | 96.6908 | 243.0384 | 1.5378 | 223.5537 | 41.0819 |
| 642 | 23673 | AA955684 | 96.6908 | 209.5468 | 7.9002 | 360.8423 | 128.9266 |
| 1381 | 21311 | AI178688 | 96.5874 | 252.0194 | 18.5667 | 173.1230 | 35.7047 |
| 558 | 22677 | AA942718 | 96.5874 | 426.8144 | 74.5008 | 154.5159 | 88.3326 |
| 787 | 3979 | AI009368 | 96.5874 | 116.0628 | 24.6605 | 49.4074 | 22.1134 |
| 1476 | 19082 | AI231038 | 96.4840 | 289.2080 | 11.0645 | 223.3971 | 34.5298 |
| 1215 | 6888 | AI169615 | 96.4323 | 1068.6526 | 93.9476 | 691.3709 | 176.1165 |
| 676 | 3953 | AA963260 | 96.3806 | 201.1584 | 13.2141 | 118.9865 | 36.8447 |
| 1247 | 5953 | AI171231 | 96.3289 | 169.6634 | 17.2572 | 290.3810 | 71.8326 |
| 1012 | 8303 | AI059352 | 96.3289 | 92.3654 | 8.0782 | 50.7243 | 18.0310 |
| 599 | 21973 | AA944840 | 96.3289 | 94.0224 | 1.4839 | 84.8166 | 31.2021 |
| 1562 | 2687 | AI235877 | 96.2771 | 62.2784 | 2.6128 | 100.0773 | 25.5429 |
| 1093 | 2042 | AI101921 | 96.1737 | 320.1662 | 58.4861 | 142.4172 | 69.3252 |
| 1460 | 23998 | AI230578 | 96.1220 | 83.0044 | 19.9299 | 37.4956 | 13.9322 |

TABLE 5T

Hydralazine--Core Tox Markers
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 1788 | 3601 | NM_012751 | 99.2761 | 143.3200 | 14.3187 | 61.9043 | 21.6682 |
| 1673 | 13083 | H31665 | 98.8625 | 49.1638 | 8.2301 | 9.7738 | 8.8766 |
| 368 | 15087 | AA892010 | 98.7590 | 156.8356 | 5.1580 | 247.9661 | 48.5522 |
| 2052 | 20735 | NM_019283 | 98.7073 | 261.2344 | 24.8554 | 101.7244 | 47.4726 |
| 1882 | 25567 | NM_013156 | 98.6556 | 230.1810 | 33.0818 | 67.0123 | 33.9517 |
| 2052 | 20734 | NM_019283 | 98.3454 | 247.5826 | 38.2069 | 94.2223 | 46.8991 |
| 1663 | 1884 | D50695 | 98.1903 | 212.7678 | 15.4227 | 146.8696 | 33.4932 |
| 1882 | 3430 | NM_013156 | 98.1386 | 189.1080 | 13.1173 | 107.6670 | 28.9271 |
| 467 | 17336 | AA894297 | 97.7766 | 38.8984 | 6.0547 | 15.5544 | 7.6289 |
| 2546 | 19894 | NM_138518 | 97.7249 | 446.0524 | 124.8880 | 189.3509 | 64.3562 |
| 1323 | 13339 | AI176308 | 97.1562 | 621.0880 | 36.3859 | 418.4784 | 87.1565 |
| 2592 | 10544 | NM_152935 | 97.0527 | 579.5536 | 26.8199 | 430.2195 | 65.2285 |
| 1632 | 25964 | AI639352 | 96.8976 | 10.3804 | 1.5050 | 30.7610 | 28.7726 |
| 1800 | 10248 | NM_012797 | 96.8459 | 560.9118 | 75.9608 | 306.7008 | 83.5683 |
| 2177 | 20801 | NM_024148 | 96.8459 | 124.0848 | 9.9768 | 78.3221 | 18.5023 |
| 2444 | 1571 | NM_053857 | 96.8459 | 290.1124 | 33.2546 | 172.0863 | 53.6339 |
| 1990 | 17959 | NM_017277 | 96.6908 | 196.1464 | 32.6060 | 103.5609 | 35.1979 |
| 2421 | 25379 | NM_053713 | 96.6391 | 314.9680 | 26.0216 | 190.4498 | 49.6170 |
| 2421 | 22411 | NM_053713 | 96.6391 | 183.1822 | 16.2164 | 92.2423 | 37.2974 |
| 2416 | 1316 | NM_053656 | 96.3806 | 194.5946 | 3.0724 | 220.5001 | 67.6819 |
| 2336 | 4749 | NM_031834 | 96.3289 | 273.3598 | 7.2158 | 198.2721 | 80.4716 |
| 2049 | 23419 | NM_019257 | 96.2771 | 347.5576 | 37.7552 | 207.3125 | 56.4910 |
| 1857 | 15253 | NM_013058 | 96.1737 | 213.1780 | 15.3416 | 108.2212 | 47.0196 |
| 2587 | 20740 | NM_145878 | 95.9152 | 780.8648 | 98.8353 | 449.8457 | 143.1811 |
| 91 | 21065 | AA800179 | 95.9152 | 64.0334 | 6.5672 | 32.7124 | 16.7123 |
| 2402 | 21170 | NM_053585 | 95.7084 | 23.4838 | 3.1293 | 4.4235 | 16.1799 |
| 305 | 18897 | AA875207 | 95.6567 | 66.4808 | 4.7508 | 159.2470 | 64.7550 |
| 2336 | 4748 | NM_031834 | 95.5016 | 80.0904 | 8.0144 | 44.1474 | 44.7732 |
| 897 | 15494 | AI014094 | 95.2430 | 30.1844 | 11.4627 | 1.2506 | 13.1609 |
| 2337 | 8385 | NM_031836 | 95.1913 | 65.6368 | 3.4862 | 120.7273 | 53.3853 |
| 441 | 22149 | AA893607 | 95.1913 | 102.1954 | 21.5573 | 44.6483 | 21.6509 |
| 2298 | 19022 | NM_031609 | 95.1913 | 166.9424 | 17.2286 | 106.2918 | 27.3335 |
| 2444 | 1570 | NM_053857 | 95.1913 | 188.7068 | 22.2973 | 128.2530 | 34.5486 |
| 1939 | 4391 | NM_017101 | 95.1913 | 964.1682 | 28.6948 | 748.8637 | 167.1622 |
| 2285 | 692 | NM_031557 | 95.1396 | 226.4920 | 31.5708 | 136.7682 | 35.6521 |
| 2207 | 1048 | NM_030863 | 94.9845 | 34.4978 | 1.3618 | 32.2165 | 23.4399 |
| 1793 | 5758 | NM_012778 | 94.8811 | 1126.7468 | 67.5204 | 729.5331 | 208.0611 |
| 2022 | 5618 | NM_019143 | 94.8811 | 20.6124 | 0.6174 | 16.1073 | 12.4939 |

TABLE 5T-continued

Hydralazine--Core Tox Markers
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 2075 | 18713 | NM_020075 | 94.7777 | 337.1688 | 47.9403 | 221.5557 | 53.1969 |
| 2679 | 25741 | X76489 | 94.7777 | 316.6112 | 28.7189 | 204.9095 | 55.1017 |
| 1450 | 23042 | AI230130 | 94.7777 | 168.7624 | 7.8811 | 106.7368 | 46.2615 |
| 2589 | 25435 | NM_147208 | 94.7260 | 4.4656 | 4.8069 | 40.9287 | 21.5174 |
| 2255 | 13359 | NM_031135 | 94.6743 | 67.3408 | 14.1570 | 20.7383 | 20.7125 |
| 2568 | 17868 | NM_139104 | 94.6743 | 223.1472 | 24.4925 | 136.4057 | 44.6227 |
| 418 | 1031 | AA892863 | 94.6225 | 110.6578 | 6.0793 | 73.9500 | 19.1861 |
| 398 | 17468 | AA892545 | 94.6225 | 41.4512 | 2.5169 | 59.0650 | 10.9062 |
| 87 | 23344 | AA800034 | 94.5191 | 312.8444 | 8.5720 | 258.7436 | 47.1229 |
| 2471 | 17326 | NM_054008 | 94.4674 | 103.0512 | 25.6833 | 42.3484 | 24.4297 |
| 312 | 15510 | AA875428 | 94.4157 | 193.4632 | 17.2712 | 281.2604 | 54.4386 |
| 1926 | 1943 | NM_017061 | 94.3640 | 106.5466 | 18.1488 | 62.4307 | 19.5604 |
| 42 | 15560 | AA799538 | 94.3640 | 19.8352 | 2.6627 | 38.4841 | 17.5475 |
| 2112 | 23061 | NM_022394 | 94.3123 | 50.6234 | 0.7799 | 56.6232 | 17.4678 |
| 1868 | 1521 | NM_013091 | 94.2606 | 133.3518 | 17.4480 | 68.3514 | 34.5064 |
| 380 | 18190 | AA892280 | 94.2606 | 104.4614 | 3.4337 | 142.4649 | 35.8774 |
| 370 | 13420 | AA892042 | 94.2089 | 643.8456 | 55.5188 | 449.4092 | 100.5780 |
| 2289 | 1921 | NM_031576 | 94.2089 | 130.4758 | 22.4579 | 81.5571 | 23.6977 |
| 2479 | 23310 | NM_057119 | 94.1572 | 121.0986 | 7.7792 | 79.1103 | 28.4253 |
| 2558 | 945 | NM_138882 | 93.9504 | 34.0030 | 9.4963 | −12.4155 | 31.0088 |
| 2080 | 18946 | NM_021584 | 93.7435 | 30.7076 | 3.0945 | 13.8638 | 10.5136 |
| 1951 | 24106 | NM_017141 | 93.6401 | 48.1790 | 5.6697 | 27.1419 | 10.6941 |
| 96 | 21656 | AA800202 | 93.6401 | 20.8806 | 2.4819 | 39.6907 | 13.3864 |
| 1930 | 18957 | NM_017075 | 93.5367 | 785.0618 | 16.6500 | 913.2878 | 164.5502 |
| 372 | 23892 | AA892120 | 93.4850 | 63.0390 | 7.1285 | 43.9236 | 10.1395 |
| 2142 | 20762 | NM_022588 | 93.4333 | 69.1156 | 3.7502 | 91.5013 | 17.0914 |
| 311 | 15446 | AA875327 | 93.3816 | 425.6222 | 30.8100 | 303.8692 | 72.8527 |
| 382 | 18209 | AA892318 | 93.3299 | 123.0876 | 5.5037 | 88.5967 | 32.0752 |
| 252 | 22385 | AA859805 | 93.2782 | 234.0026 | 17.9207 | 148.7964 | 70.9091 |
| 2066 | 18820 | NM_019367 | 93.2265 | 88.4046 | 3.8870 | 94.9261 | 46.6153 |
| 415 | 17589 | AA892851 | 93.1748 | 23.0494 | 6.7302 | 6.2261 | 8.8905 |
| 1982 | 16601 | NM_017252 | 93.1748 | 14.8828 | 1.2193 | 27.1258 | 12.9479 |
| 2208 | 1928 | NM_030872 | 93.0714 | 612.9376 | 10.0815 | 573.3866 | 132.1135 |
| 903 | 17957 | AI028975 | 93.0196 | 100.3830 | 12.8643 | 66.2742 | 17.5071 |
| 394 | 14066 | AA892504 | 92.9679 | 82.6706 | 2.6372 | 111.0196 | 31.3767 |
| 2672 | 436 | X67877 | 92.8645 | 91.0144 | 12.4145 | 58.2971 | 17.2789 |
| 1955 | 16955 | NM_017151 | 92.8645 | 351.1696 | 24.0086 | 534.1851 | 180.8971 |
| 2480 | 727 | NM_057123 | 92.8128 | 250.8246 | 5.8409 | 222.3852 | 33.1218 |
| 2663 | 25711 | X60468 | 92.7611 | 60.4372 | 5.8554 | 27.9624 | 21.9218 |
| 2527 | 18043 | NM_133546 | 92.7094 | 100.0874 | 16.5917 | 62.8439 | 21.7182 |
| 1929 | 11152 | NM_017073 | 92.6060 | 336.3804 | 36.5219 | 214.4555 | 89.4738 |
| 2160 | 24283 | NM_022869 | 92.5543 | 56.7636 | 4.8815 | 84.0133 | 26.7697 |
| 419 | 12848 | AA892916 | 92.4509 | 46.4060 | 9.3354 | 26.6783 | 13.1691 |
| 2126 | 3900 | NM_022516 | 92.4509 | 30.1638 | 6.7989 | 8.1642 | 13.2507 |
| 247 | 22407 | AA859680 | 92.3992 | 145.0898 | 36.4334 | 262.9633 | 69.4955 |
| 295 | 16342 | AA875060 | 92.3992 | 56.6232 | 6.2416 | 34.9010 | 12.4906 |
| 1708 | 20714 | M14972 | 92.3992 | 36.3614 | 2.6050 | 7.0023 | 32.3092 |
| 1749 | 482 | NM_012567 | 92.3475 | 41.2860 | 4.8405 | 109.9989 | 77.8782 |
| 1656 | 25257 | D13623 | 92.3475 | 103.9680 | 11.1885 | 70.6630 | 18.2516 |
| 1909 | 20921 | NM_016999 | 92.3475 | 89.1870 | 13.7751 | 49.6330 | 23.9242 |
| 115 | 17658 | AA800853 | 92.3475 | 20.4468 | 3.4186 | 41.4294 | 20.5741 |
| 1645 | 20083 | AI639523 | 92.3475 | 13.0912 | 3.5158 | 40.5189 | 21.6018 |
| 1728 | 3762 | M86341 | 92.3475 | 60.4542 | 2.8419 | 42.2743 | 16.7555 |
| 2014 | 1581 | NM_017365 | 92.3475 | 381.3852 | 18.7110 | 297.2422 | 61.4305 |
| 933 | 23950 | AI031019 | 92.2958 | 81.2448 | 11.7875 | 58.9087 | 13.0678 |
| 2105 | 17158 | NM_022298 | 92.2958 | 692.2852 | 19.4813 | 744.8099 | 211.2131 |
| 1750 | 16026 | NM_012578 | 92.2441 | 237.9962 | 30.8417 | 158.0972 | 46.9047 |
| 2354 | 21104 | NM_033021 | 92.1923 | 175.6340 | 9.9545 | 126.3519 | 35.6131 |
| 753 | 20741 | AF084186 | 92.0889 | 195.6502 | 31.8691 | 123.0799 | 39.9077 |
| 1623 | 19749 | AI639203 | 92.0889 | 62.3318 | 4.5405 | 42.0015 | 13.4042 |
| 2107 | 11454 | NM_022381 | 92.0889 | 258.2222 | 10.1641 | 210.0320 | 63.8915 |
| 1834 | 5033 | NM_012966 | 92.0889 | 758.2678 | 14.0368 | 683.2052 | 151.6138 |
| 616 | 21351 | AA945932 | 99.4829 | 80.6988 | 6.2490 | 12.1389 | 20.9160 |
| 762 | 11728 | AI007884 | 99.3278 | 753.1340 | 68.6619 | 380.7892 | 93.2638 |
| 884 | 9551 | AI013558 | 99.2761 | 796.8730 | 49.0184 | 498.5805 | 85.2638 |
| 1436 | 13270 | AI228760 | 99.1727 | 476.3998 | 65.5985 | 163.7858 | 60.4464 |
| 1068 | 6548 | AI072658 | 98.8625 | 694.7628 | 100.4281 | 213.2618 | 77.0934 |
| 1115 | 8124 | AI103071 | 98.8625 | 95.3660 | 7.7097 | 40.2143 | 17.6130 |
| 2482 | 2416 | NM_057141 | 98.7590 | 501.2280 | 5.6277 | 346.1962 | 87.9370 |
| 1361 | 6562 | AI177734 | 98.7073 | 47.5550 | 3.1216 | 81.4447 | 17.6739 |
| 549 | 5258 | AA926089 | 98.7073 | 664.1520 | 45.8208 | 402.7573 | 69.9663 |
| 699 | 15885 | AA965207 | 98.6556 | 280.7466 | 25.1179 | 145.7606 | 36.6394 |
| 1025 | 8745 | AI069939 | 98.6556 | 215.8620 | 38.9721 | 107.9325 | 39.4425 |

TABLE 5T-continued

Hydralazine--Core Tox Markers
Timepoint(s): 6 hrs

| SEQ ID | GLGC ID | GenBank Accession No. | LDA Score | Mean Tox | SD Tox | Mean Nontox | SD Nontox |
|---|---|---|---|---|---|---|---|
| 892 | 7299 | AI013911 | 98.6039 | 773.1158 | 120.8460 | 251.5905 | 113.1404 |
| 194 | 11726 | AA849518 | 98.5005 | 533.5082 | 40.5515 | 286.8237 | 89.8029 |
| 194 | 11727 | AA849518 | 98.5005 | 604.3898 | 48.0730 | 319.2727 | 85.6607 |
| 797 | 22464 | AI009713 | 98.5005 | 278.9364 | 40.1997 | 124.1771 | 46.7906 |
| 537 | 5129 | AA925335 | 98.4488 | 169.9756 | 12.3029 | 86.1985 | 28.2466 |
| 610 | 23035 | AA945712 | 98.3971 | 245.7036 | 21.6546 | 123.3464 | 34.7819 |
| 805 | 15988 | AI010108 | 98.2937 | 558.6684 | 65.8687 | 241.6226 | 86.0058 |
| 1259 | 5292 | AI171607 | 98.2420 | 376.7596 | 113.5796 | 91.9099 | 69.3469 |
| 2387 | 14904 | NM_053492 | 98.1903 | 112.3884 | 1.2288 | 83.6469 | 20.3510 |
| 595 | 12303 | AA944786 | 98.1903 | 112.7144 | 15.4871 | 28.6056 | 39.0416 |
| 2400 | 3050 | NM_053582 | 98.0869 | 228.8394 | 38.5682 | 88.4676 | 65.8110 |
| 1121 | 15841 | AI103465 | 98.0352 | 85.1580 | 5.2567 | 50.2158 | 13.6288 |
| 1216 | 23110 | AI169640 | 98.0352 | 344.7718 | 15.4324 | 210.0800 | 56.4770 |
| 688 | 2378 | AA964501 | 97.9835 | 129.8426 | 19.3748 | 56.7000 | 19.6457 |
| 816 | 6936 | AI010593 | 97.9317 | 198.0056 | 27.9364 | 98.0114 | 30.9212 |
| 932 | 22614 | AI031004 | 97.8800 | 156.9550 | 73.5855 | 45.3235 | 24.0818 |
| 710 | 3003 | AA997330 | 97.8283 | 417.5536 | 106.1557 | 70.3467 | 60.2634 |
| 928 | 19257 | AI030775 | 97.7766 | 513.5628 | 37.1821 | 301.9994 | 73.4440 |
| 1445 | 15212 | AI229753 | 97.6732 | 116.1712 | 20.9712 | 56.5987 | 40.6347 |
| 1420 | 23015 | AI227724 | 97.6215 | 153.2294 | 30.5337 | 77.7618 | 21.7425 |
| 938 | 7867 | AI043695 | 97.6215 | 248.1136 | 37.4367 | 97.2828 | 44.8662 |
| 1484 | 13966 | AI231421 | 97.5698 | 194.0216 | 33.4736 | 104.6886 | 27.0718 |
| 918 | 7615 | AI030163 | 97.5698 | 91.9202 | 11.3562 | 29.7933 | 25.0687 |
| 1022 | 8495 | AI059971 | 97.5698 | 192.2230 | 8.3247 | 131.8170 | 29.8504 |
| 1572 | 5007 | AI236229 | 97.5181 | 1227.9742 | 164.0440 | 736.2918 | 160.4563 |
| 1196 | 11331 | AI145556 | 97.4147 | 140.2186 | 14.3519 | 87.0803 | 18.9431 |
| 612 | 14955 | AA945750 | 97.4147 | 181.0944 | 80.5659 | −178.9106 | 195.8687 |
| 835 | 3941 | AI011598 | 97.3630 | 380.7426 | 47.4343 | 180.8175 | 67.4454 |
| 634 | 23471 | AA955162 | 97.3113 | 189.1040 | 51.5207 | 77.4026 | 35.9134 |
| 771 | 12398 | AI008689 | 97.3113 | 399.6760 | 9.1169 | 280.6130 | 66.7741 |
| 869 | 7220 | AI013098 | 97.2596 | 51.8602 | 0.7886 | 76.1486 | 29.3080 |
| 1457 | 6560 | AI230440 | 97.1562 | 432.4062 | 30.2947 | 282.7162 | 57.5640 |
| 992 | 6828 | AI058359 | 97.1562 | 671.4382 | 59.8131 | 327.2167 | 123.5972 |
| 1478 | 17903 | AI231083 | 97.1044 | 244.5414 | 29.1343 | 137.7887 | 38.4653 |
| 575 | 9658 | AA943748 | 97.1044 | 244.7306 | 62.7510 | 99.7752 | 47.9401 |
| 229 | 17236 | AA858903 | 97.0010 | 778.2720 | 64.5047 | 428.0899 | 134.2179 |
| 1199 | 5531 | AI145859 | 97.0010 | 172.8490 | 10.8200 | 102.8946 | 29.5049 |
| 2400 | 3049 | NM_053582 | 97.0010 | 498.4446 | 86.8179 | 249.9030 | 136.4987 |
| 498 | 26075 | AA900993 | 97.0010 | 924.5460 | 22.1006 | 1301.2541 | 323.3296 |
| 1254 | 22958 | AI171374 | 96.8976 | 375.6922 | 31.5155 | 232.9499 | 64.3866 |
| 164 | 6094 | AA818911 | 96.7942 | 223.6600 | 29.8316 | 112.4906 | 42.5031 |
| 1568 | 23230 | AI236146 | 96.7425 | 162.8192 | 9.7664 | 252.2847 | 53.4630 |
| 691 | 14342 | AA964595 | 96.7425 | 59.0536 | 1.1919 | 83.3173 | 28.1826 |
| 485 | 4725 | AA900290 | 96.7425 | 239.6758 | 67.2939 | 87.1054 | 101.4360 |
| 2524 | 2788 | NM_133528 | 96.6908 | 243.0384 | 1.5378 | 223.5537 | 41.0819 |
| 642 | 23673 | AA955684 | 96.6908 | 209.5468 | 7.9002 | 360.8423 | 128.9266 |
| 1398 | 13029 | AI179391 | 96.5874 | 435.5570 | 85.3821 | 201.6063 | 84.8801 |
| 1381 | 21311 | AI178688 | 96.5874 | 252.0194 | 18.5667 | 173.1230 | 35.7047 |
| 558 | 22677 | AA942718 | 96.5874 | 426.8144 | 74.5008 | 154.5159 | 88.3326 |
| 787 | 3979 | AI009368 | 96.5874 | 116.0628 | 24.6605 | 49.4074 | 22.1134 |
| 497 | 22666 | AA900974 | 96.5357 | 125.0378 | 7.3520 | 78.9438 | 39.9018 |
| 1594 | 3615 | AI237645 | 96.4840 | 575.8332 | 43.2667 | 305.7159 | 136.9796 |
| 1476 | 19082 | AI231038 | 96.4840 | 289.2080 | 11.0645 | 223.3971 | 34.5298 |
| 1215 | 6888 | AI169615 | 96.4323 | 1068.6526 | 93.9476 | 691.3709 | 176.1165 |
| 1586 | 12098 | AI237075 | 96.3806 | 90.9948 | 33.1508 | −8.9047 | 39.2096 |
| 676 | 3953 | AA963260 | 96.3806 | 201.1584 | 13.2141 | 118.9865 | 36.8447 |
| 190 | 18673 | AA849028 | 96.3806 | 237.2430 | 27.7351 | 143.5021 | 35.7604 |
| 152 | 6053 | AA818655 | 96.3289 | 36.2648 | 5.1090 | 11.4704 | 11.8845 |
| 1092 | 4432 | AI101851 | 96.3289 | 116.5428 | 21.4180 | 46.0566 | 26.6820 |
| 1247 | 5953 | AI171231 | 96.3289 | 169.6634 | 17.2572 | 290.3810 | 71.8326 |
| 1012 | 8303 | AI059352 | 96.3289 | 92.3654 | 8.0782 | 50.7243 | 18.0310 |
| 599 | 21973 | AA944840 | 96.3289 | 94.0224 | 1.4839 | 84.8166 | 31.2021 |
| 1562 | 2687 | AI235877 | 96.2771 | 62.2784 | 2.6128 | 100.0773 | 25.5429 |
| 1227 | 2729 | AI170363 | 96.2254 | 276.0500 | 17.5150 | 480.2069 | 152.8510 |
| 1093 | 2042 | AI101921 | 96.1737 | 320.1662 | 58.4861 | 142.4172 | 69.3252 |
| 1460 | 23998 | AI230578 | 96.1220 | 83.0044 | 19.9299 | 37.4956 | 13.9322 |

TABLE 5U

IFOSPHAMIDE
Timepoint(s): 48, 144 hrs

| SEQ ID | GLGC ID | GenBank Accession No. | LDA Score | Mean Tox | SD Tox | Mean Nontox | SD Nontox |
|---|---|---|---|---|---|---|---|
| 1780 | 1632 | NM_012717 | 93.9252 | 21.9256 | 4.7059 | 49.1647 | 16.3980 |
| 2281 | 4010 | NM_031543 | 92.7310 | 83.0657 | 23.0504 | 36.4157 | 46.9120 |
| 2441 | 1780 | NM_053846 | 92.4195 | 35.5666 | 5.7305 | 49.4382 | 25.5523 |
| 2052 | 20734 | NM_019283 | 92.3676 | 144.9521 | 23.4277 | 94.5444 | 48.0442 |
| 2121 | 8587 | NM_022505 | 92.3157 | 20.8803 | 4.2288 | 41.8238 | 16.9462 |
| 2692 | 25790 | Z21935 | 92.2638 | 35.6152 | 5.7390 | 59.4251 | 16.3800 |
| 1816 | 16708 | NM_012895 | 91.8484 | 88.5919 | 17.8854 | 157.9072 | 40.9954 |
| 2622 | 20224 | U47014 | 91.7965 | 26.1801 | 4.6261 | 54.4380 | 23.6048 |
| 2294 | 14543 | NM_031596 | 91.5369 | 48.5444 | 13.3595 | 5.1087 | 27.4423 |
| 2267 | 18596 | NM_031325 | 91.2773 | 10.5340 | 2.2310 | 21.6064 | 8.7291 |
| 1810 | 4338 | NM_012866 | 91.2253 | 69.7044 | 4.9022 | 93.0153 | 21.2727 |
| 2530 | 1827 | NM_133572 | 91.2253 | 16.2629 | 9.8338 | 75.3003 | 47.7747 |
| 1721 | 24844 | M58040 | 90.9657 | 6.6279 | 6.2995 | 54.7281 | 38.8846 |
| 1687 | 16260 | J01878 | 90.4465 | 45.4320 | 8.2771 | 79.8531 | 24.0301 |
| 2108 | 695 | NM_022388 | 90.2908 | 53.2826 | 3.7848 | 69.0072 | 17.9080 |
| 2001 | 1904 | NM_017315 | 90.2908 | 47.5752 | 5.7608 | 84.8968 | 39.3159 |
| 2583 | 305 | NM_145773 | 90.1350 | 22.3219 | 9.1616 | 53.6244 | 26.0163 |
| 1666 | 25306 | D84485 | 90.1350 | −11.1511 | 13.4777 | 24.5088 | 23.8453 |
| 2678 | 16272 | X76456 | 90.0312 | 25.6340 | 8.0024 | 50.4168 | 16.9726 |
| 2013 | 20232 | NM_017364 | 89.9792 | 12.6166 | 3.2958 | 27.4022 | 10.9487 |
| 2150 | 20509 | NM_022689 | 89.9273 | 20.0840 | 3.0939 | 36.0410 | 15.0767 |
| 1659 | 16610 | D28557 | 89.7715 | 499.3631 | 73.4028 | 756.9499 | 181.8408 |
| 1920 | 24697 | NM_017048 | 89.5119 | 105.8682 | 9.8884 | 155.6203 | 42.9715 |
| 373 | 16899 | AA892127 | 89.4600 | 32.9150 | 4.8111 | 20.0086 | 13.3720 |
| 2434 | 25262 | NM_053814 | 89.1485 | 28.4856 | 3.1939 | 42.4705 | 14.5360 |
| 2449 | 385 | NM_053885 | 89.1485 | 11.8336 | 5.9556 | 46.0511 | 22.7486 |
| 751 | 2881 | AF056034 | 88.9927 | 252.2559 | 62.0365 | 398.2385 | 92.6266 |
| 1753 | 20313 | NM_012585 | 88.8370 | 8.0980 | 9.4173 | 29.3879 | 10.8937 |
| 425 | 12022 | AA893105 | 88.8370 | 23.3220 | 5.1564 | 49.3675 | 23.7717 |
| 2535 | 1463 | NM_134334 | 88.3697 | 637.2336 | 174.0208 | 362.0256 | 132.6660 |
| 1618 | 20073 | AI639152 | 88.2658 | 2.9439 | 8.0267 | 40.0215 | 19.4706 |
| 1621 | 5159 | AI639185 | 87.9543 | 336.6101 | 76.6035 | 172.3420 | 76.1563 |
| 2201 | 348 | NM_030586 | 87.6947 | 47.5134 | 9.5651 | 81.4591 | 28.9767 |
| 2564 | 15380 | NM_139083 | 87.6428 | 1163.6321 | 88.1712 | 936.7430 | 371.0795 |
| 2250 | 1265 | NM_031124 | 87.4870 | 13.2800 | 9.0537 | 32.1539 | 11.5110 |
| 2412 | 15777 | NM_053630 | 87.4870 | 15.1453 | 5.2606 | 35.8179 | 18.4377 |
| 2474 | 17709 | NM_057101 | 87.3832 | 131.6908 | 17.2177 | 181.8362 | 42.2679 |
| 2473 | 25290 | NM_057100 | 87.1236 | 587.7248 | 84.2770 | 388.4657 | 110.4809 |
| 2174 | 17226 | NM_024131 | 87.1236 | 269.8507 | 29.5324 | 190.1852 | 46.8537 |
| 2519 | 19326 | NM_133419 | 86.8640 | 69.1733 | 6.3079 | 55.9080 | 24.3541 |
| 386 | 2832 | AA892388 | 86.8120 | 120.5140 | 13.6626 | 150.9123 | 24.0289 |
| 1824 | 1765 | NM_012919 | 86.8120 | 47.8216 | 9.6220 | 83.6380 | 31.6316 |
| 1855 | 11113 | NM_013046 | 86.7082 | 14.1942 | 9.7635 | 36.4740 | 19.6053 |
| 1940 | 15776 | NM_017108 | 86.7082 | 151.7243 | 22.4822 | 244.3187 | 74.2967 |
| 2117 | 24643 | NM_022400 | 86.6044 | 215.9132 | 50.8641 | 69.3391 | 74.1356 |
| 1737 | 25365 | NM_012519 | 86.3967 | 9.7790 | 7.4931 | 47.8117 | 33.8018 |
| 6 | 1808 | AI014135 | 86.3448 | 5.7119 | 5.3248 | 97.1407 | 156.9111 |
| 2046 | 11218 | NM_019247 | 86.3448 | 38.1513 | 30.2508 | 128.0294 | 49.1823 |
| 1622 | 19795 | AI639197 | 86.3448 | 34.0938 | 13.5264 | 68.0481 | 27.3656 |
| 1946 | 167 | NM_017131 | 86.3448 | 345.9002 | 83.9734 | 587.3977 | 174.9745 |
| 756 | 2947 | AF099093 | 86.2928 | 24.4228 | 9.0045 | 51.3409 | 20.3344 |
| 433 | 21652 | AA893267 | 86.2409 | 16.3704 | 19.2389 | 25.6408 | 11.2378 |
| 2133 | 6577 | NM_022532 | 86.2409 | 150.3376 | 9.2802 | 123.4940 | 35.7175 |
| 2198 | 938 | NM_024486 | 86.2409 | 9.6093 | 3.2930 | 21.0064 | 10.0987 |
| 2685 | 25765 | X89706 | 86.2409 | 33.1944 | 8.5889 | 65.7206 | 19.4755 |
| 2319 | 20210 | NM_031710 | 86.1890 | 24.6803 | 11.0628 | 56.1610 | 17.5939 |
| 1919 | 24597 | NM_017040 | 86.1890 | 561.1767 | 51.1917 | 483.0641 | 109.4266 |
| 1807 | 1249 | NM_012850 | 86.1371 | 41.7076 | 8.2689 | 60.5223 | 14.3267 |
| 2611 | 25571 | S98336 | 86.1371 | 36.6171 | 8.0319 | 54.8128 | 15.1105 |
| 1899 | 20732 | NM_013217 | 86.1371 | 12.7066 | 4.1574 | 23.3332 | 9.0825 |
| 2167 | 15727 | NM_022953 | 86.1371 | 16.3477 | 7.4304 | 39.3159 | 13.5947 |
| 1798 | 16947 | NM_012793 | 86.0332 | 50.5529 | 10.1535 | 76.5861 | 22.0020 |
| 2466 | 16962 | NM_053999 | 85.9813 | 6.9492 | 6.2045 | 28.2084 | 13.7644 |
| 224 | 23069 | AA858572 | 85.9294 | 31.9091 | 4.3861 | 44.3683 | 10.8900 |
| 2630 | 2153 | U75404 | 85.7736 | 289.2098 | 43.1231 | 220.9612 | 123.1106 |
| 2592 | 10544 | NM_152935 | 85.7736 | 353.9149 | 29.0669 | 431.7080 | 65.7848 |
| 2098 | 20450 | NM_022239 | 85.7736 | 52.3184 | 7.1360 | 72.6463 | 22.4439 |
| 1935 | 23665 | NM_017092 | 85.7217 | 34.9232 | 7.1230 | 51.8690 | 12.9006 |
| 300 | 15310 | AA875123 | 85.6698 | 38.2432 | 6.9779 | 56.7156 | 15.2127 |
| 2482 | 2413 | NM_057141 | 85.6179 | 752.3984 | 55.8953 | 625.1376 | 104.2356 |
| 2687 | 25770 | X96437 | 85.6179 | 69.4238 | 33.3087 | 160.7589 | 60.1974 |
| 2156 | 58 | NM_022715 | 85.5659 | 97.7782 | 5.3308 | 91.3499 | 24.6679 |
| 351 | 17693 | AA891737 | 85.5140 | 61.2944 | 7.7884 | 44.4666 | 18.2384 |

TABLE 5U-continued

IFOSPHAMIDE
Timepoint(s): 48, 144 hrs

| SEQ ID | GLGC ID | GenBank Accession No. | LDA Score | Mean Tox | SD Tox | Mean Nontox | SD Nontox |
|---|---|---|---|---|---|---|---|
| 2015 | 20536 | NM_019122 | 85.5140 | 35.1599 | 9.6132 | 11.9589 | 22.6823 |
| 2383 | 21866 | NM_053472 | 85.3583 | 113.1301 | 31.5776 | 217.3893 | 93.2963 |
| 2018 | 455 | NM_019131 | 85.3583 | 3398.0386 | 634.4508 | 4996.0023 | 1069.3956 |
| 2104 | 19423 | NM_022297 | 85.3063 | 57.2618 | 11.3319 | 97.6164 | 39.0480 |
| 1665 | 1356 | D83538 | 85.3063 | 37.6693 | 8.3923 | 20.4105 | 11.3700 |
| 1945 | 24522 | NM_017130 | 85.3063 | 8.8614 | 7.9366 | 27.5777 | 12.2626 |
| 2275 | 17427 | NM_031510 | 85.2025 | 323.6780 | 57.0555 | 221.4037 | 65.8713 |
| 288 | 17303 | AA874990 | 85.2025 | 33.7866 | 2.8455 | 41.9456 | 9.1403 |
| 2126 | 162 | NM_022516 | 84.9429 | 20.8002 | 17.6035 | 42.5670 | 23.7219 |
| 761 | 10108 | AI007857 | 84.8910 | 91.7666 | 10.7510 | 63.6700 | 27.1232 |
| 436 | 22355 | AA893338 | 84.7871 | 16.5914 | 5.3296 | 31.9805 | 12.8094 |
| 746 | 3799 | AF002281 | 84.6833 | 248.9998 | 58.6310 | 384.0977 | 115.4912 |
| 2216 | 1025 | NM_031016 | 84.5275 | 10.6336 | 5.2061 | 33.1574 | 21.1802 |
| 2644 | 2464 | X13411 | 84.5275 | 32.8120 | 3.7668 | 39.8959 | 13.1058 |
| 2216 | 1024 | NM_031016 | 84.4237 | 21.5096 | 7.3160 | 44.4910 | 18.9310 |
| 2424 | 10510 | NM_053743 | 84.4237 | 231.8057 | 17.9081 | 245.7739 | 69.5059 |
| 2286 | 18315 | NM_031561 | 84.2679 | 752.9110 | 151.6886 | 1144.1357 | 341.8948 |
| 329 | 18582 | AA891207 | 84.2679 | 338.0744 | 29.3245 | 250.5000 | 55.4897 |
| 70 | 18360 | AA799771 | 84.2160 | 279.0253 | 73.8143 | 410.2238 | 103.7573 |
| 106 | 17997 | AA800671 | 84.2160 | 25.9506 | 5.2089 | 38.3192 | 11.5819 |
| 2636 | 983 | U89745 | 84.2160 | 84.9207 | 11.7220 | 119.6201 | 32.5343 |
| 2290 | 942 | NM_031577 | 84.2160 | 10.7322 | 6.7701 | 24.4656 | 9.1480 |
| 2322 | 15507 | NM_031735 | 84.2160 | 11.5281 | 3.6762 | 20.9932 | 6.5180 |
| 1650 | 2401 | AJ011607 | 84.1121 | 19.7984 | 18.8561 | 54.8464 | 22.2599 |
| 394 | 14066 | AA892504 | 84.0602 | 83.1214 | 8.6258 | 111.1332 | 31.3829 |
| 2415 | 1118 | NM_053655 | 84.0602 | 20.3108 | 7.7863 | 51.3574 | 21.9794 |
| 1800 | 10248 | NM_012797 | 84.0083 | 373.7648 | 49.7422 | 307.3939 | 85.4952 |
| 730 | 3390 | AA998195 | 96.5213 | 98.0716 | 16.5306 | 13.2468 | 32.8732 |
| 1592 | 11375 | AI237594 | 95.9502 | 47.0950 | 6.7258 | 101.4006 | 31.7853 |
| 904 | 5422 | AI028998 | 95.9502 | 255.9669 | 15.3339 | 447.6795 | 137.3423 |
| 1005 | 5549 | AI058942 | 95.6906 | 171.8383 | 14.2889 | 272.7479 | 88.2184 |
| 680 | 6276 | AA963767 | 95.6386 | 16.9686 | 15.6448 | 103.0190 | 46.1880 |
| 882 | 12796 | AI013495 | 95.6386 | −12.9629 | 11.2831 | 41.7692 | 26.8851 |
| 705 | 2962 | AA996953 | 95.5348 | 59.8316 | 8.6970 | 117.4927 | 32.2233 |
| 693 | 2424 | AA964617 | 95.4829 | 744.0810 | 64.6463 | 456.9711 | 109.4196 |
| 1590 | 23288 | AI237581 | 95.3271 | 162.0457 | 22.1140 | 272.3246 | 62.0544 |
| 1569 | 14594 | AI236152 | 95.2233 | 37.3820 | 25.3448 | −20.8144 | 26.6169 |
| 964 | 5710 | AI044740 | 95.1194 | 64.4711 | 7.2831 | 115.7780 | 29.5012 |
| 766 | 2657 | AI008275 | 94.9117 | 404.4319 | 47.1948 | 214.9007 | 86.2187 |
| 519 | 4954 | AA924444 | 94.8079 | 75.8566 | 48.3559 | 300.5078 | 120.2101 |
| 1054 | 8712 | AI071935 | 94.7560 | 93.8463 | 20.1516 | 10.3414 | 49.3580 |
| 996 | 10070 | AI058505 | 94.7040 | 34.6609 | 9.5241 | 79.8852 | 30.3408 |
| 955 | 5433 | AI044271 | 94.6521 | 48.3568 | 7.0044 | 97.6852 | 36.0229 |
| 562 | 3952 | AA943016 | 94.3406 | 142.5596 | 15.2222 | 220.9986 | 49.2334 |
| 644 | 12426 | AA955760 | 94.2368 | 36.4587 | 34.9450 | −53.9307 | 40.6853 |
| 1974 | 15108 | NM_017226 | 94.2368 | 33.5728 | 7.3179 | 75.1760 | 24.1931 |
| 986 | 5890 | AI045836 | 94.0810 | 144.1226 | 16.6702 | 237.2963 | 56.8326 |
| 910 | 7447 | AI029432 | 93.8733 | 54.7359 | 9.9771 | 104.1249 | 30.7595 |
| 924 | 7698 | AI030527 | 93.6656 | 74.4883 | 11.5063 | 149.5131 | 47.2443 |
| 985 | 16335 | AI045744 | 93.6137 | 88.6708 | 40.5413 | 266.6131 | 136.8408 |
| 491 | 4779 | AA900825 | 93.5618 | 40.2461 | 5.2003 | 66.4230 | 17.3590 |
| 1414 | 3352 | AI180334 | 93.5099 | 721.7098 | 75.5300 | 447.0117 | 132.9273 |
| 1007 | 10171 | AI059209 | 93.5099 | 91.0491 | 22.1459 | 180.0318 | 47.2872 |
| 999 | 8103 | AI058653 | 93.4579 | −7.6890 | 9.1160 | 54.2286 | 37.7280 |
| 236 | 15160 | AA859346 | 93.3541 | 87.2868 | 16.4703 | 213.1044 | 92.6222 |
| 773 | 16034 | AI008701 | 93.3541 | 109.7919 | 25.9816 | 218.6182 | 58.2329 |
| 944 | 3899 | AI043904 | 93.3022 | 60.4683 | 21.0169 | −11.5877 | 35.8785 |
| 1032 | 21364 | AI070392 | 93.1983 | 72.5470 | 39.8668 | 262.2539 | 123.5654 |
| 1360 | 9521 | AI177706 | 93.1464 | 55.8598 | 9.0144 | 91.8144 | 22.2810 |
| 192 | 2075 | AA849394 | 93.0426 | 44.3953 | 8.3172 | 89.0395 | 28.0498 |
| 214 | 19214 | AA851364 | 92.8349 | 127.8322 | 22.3277 | 37.8946 | 63.3805 |
| 1598 | 14842 | AI237724 | 92.7830 | 49.3027 | 12.6519 | 102.6669 | 39.3891 |
| 567 | 22187 | AA943229 | 92.7830 | 409.4556 | 129.1747 | 867.5699 | 267.7624 |
| 209 | 21782 | AA851034 | 92.6791 | 38.6721 | 27.8222 | 122.8371 | 47.2701 |
| 2375 | 9352 | NM_053347 | 92.6791 | 378.4376 | 53.4050 | 552.6199 | 96.8881 |
| 993 | 8039 | AI058419 | 92.6791 | 68.3052 | 18.3267 | 140.0283 | 49.5285 |
| 1036 | 10453 | AI070697 | 92.6272 | 53.9392 | 16.4808 | 132.5562 | 49.1075 |
| 850 | 11408 | AI012353 | 92.6272 | 32.4582 | 18.6918 | 129.4645 | 55.9234 |
| 2588 | 5095 | NM_147140 | 92.6272 | 416.0853 | 28.8365 | 567.1313 | 110.1052 |
| 1041 | 9554 | AI071131 | 92.5753 | 40.4331 | 14.8696 | 97.1900 | 33.8327 |
| 720 | 3265 | AA997784 | 92.4714 | 41.5882 | 12.8118 | 98.6859 | 36.9127 |
| 613 | 3637 | AA945878 | 92.3676 | 15.1582 | 7.5334 | 41.6123 | 22.4054 |
| 581 | 22405 | AA944341 | 92.3157 | 133.8187 | 32.5703 | 238.9619 | 59.6023 |

TABLE 5U-continued

IFOSPHAMIDE
Timepoint(s): 48, 144 hrs

| SEQ ID | GLGC ID | GenBank Accession No. | LDA Score | Mean Tox | SD Tox | Mean Nontox | SD Nontox |
|---|---|---|---|---|---|---|---|
| 883 | 7264 | AI013499 | 92.2638 | 27.2209 | 10.8354 | 72.6050 | 47.7981 |
| 870 | 16686 | AI013160 | 92.2118 | 118.8172 | 33.9194 | 234.5096 | 69.1124 |
| 994 | 6737 | AI058451 | 92.1080 | 177.6041 | 46.8049 | 85.4628 | 68.4928 |
| 738 | 2526 | AA998979 | 92.1080 | 236.0059 | 26.3307 | 326.7278 | 58.8308 |
| 1024 | 8557 | AI060221 | 92.1080 | 124.4789 | 33.6220 | 298.5563 | 128.6680 |
| 920 | 10690 | AI030276 | 92.1080 | 26.9454 | 4.5462 | 6.3091 | 18.2157 |
| 484 | 22480 | AA900230 | 92.1080 | 67.8894 | 14.8504 | 144.3945 | 51.0405 |
| 657 | 5990 | AA956907 | 92.0561 | 483.3228 | 40.6774 | 361.6884 | 71.5924 |
| 971 | 6496 | AI044887 | 92.0042 | 91.6501 | 25.0566 | 188.0613 | 55.0460 |
| 768 | 21889 | AI008393 | 91.9522 | 72.4361 | 17.2609 | 128.0111 | 31.2454 |
| 801 | 23092 | AI009819 | 91.9003 | 276.9497 | 35.3796 | 396.4401 | 70.1076 |
| 976 | 5726 | AI045194 | 91.8484 | 47.5982 | 14.2846 | 92.5981 | 28.6611 |
| 1002 | 8158 | AI058824 | 91.8484 | 213.3934 | 48.7506 | 403.2356 | 114.7865 |
| 1020 | 10277 | AI059925 | 91.8484 | 25.4588 | 9.4491 | 82.9826 | 42.3476 |
| 734 | 3781 | AA998375 | 91.7445 | −8.0857 | 12.0879 | 30.3861 | 26.3140 |
| 488 | 4750 | AA900469 | 91.6926 | 129.3269 | 39.4346 | 255.8295 | 84.7185 |
| 931 | 17552 | AI030833 | 91.6926 | 54.2706 | 13.2305 | 100.7306 | 33.8001 |
| 621 | 22708 | AA946063 | 91.6926 | 165.1820 | 16.0246 | 252.7250 | 71.8390 |
| 221 | 19159 | AA851953 | 91.6407 | 347.2374 | 57.9407 | 243.3276 | 58.7902 |
| 901 | 12805 | AI028870 | 91.6407 | 46.1116 | 10.1198 | 12.1679 | 53.7115 |
| 696 | 2492 | AA964866 | 91.5888 | 191.2070 | 34.7816 | 110.1686 | 42.6341 |
| 473 | 22308 | AA899535 | 91.5888 | 311.2068 | 57.2959 | 130.6294 | 104.9578 |
| 857 | 5595 | AI012467 | 91.5369 | 133.1074 | 12.8488 | 188.8985 | 46.4980 |
| 947 | 5370 | AI044087 | 91.5369 | 44.2783 | 20.8570 | 134.8288 | 63.6771 |

TABLE 5V

Ifosphamide--Core Tox Markers
Timepoint(s): 48, 144 hrs

| SEQ ID | GLGC ID | GenBank Accession No. | LDA Score | Mean Tox | SD Tox | Mean Nontox | SD Nontox |
|---|---|---|---|---|---|---|---|
| 1894 | 16448 | NM_013197 | 97.1963 | 52.2061 | 15.1149 | 282.8893 | 132.2836 |
| 2213 | 25517 | NM_031010 | 96.9886 | 47.0090 | 5.5888 | 164.7448 | 104.5660 |
| 1389 | 18907 | AI178971 | 96.0540 | 43.0038 | 37.5571 | 445.5213 | 256.1916 |
| 1928 | 6654 | NM_017068 | 95.9502 | 66.3403 | 7.8424 | 32.6269 | 13.7744 |
| 2356 | 25468 | NM_033234 | 95.4829 | 1301.8949 | 1387.7861 | 6101.7220 | 2467.7418 |
| 2356 | 25469 | NM_033234 | 94.7560 | 1031.8324 | 1010.7518 | 4514.6746 | 1818.4718 |
| 1780 | 1632 | NM_012717 | 93.9252 | 21.9256 | 4.7059 | 49.1647 | 16.3980 |
| 1869 | 1684 | NM_013096 | 93.6137 | 1779.0361 | 1757.4448 | 6747.6461 | 2993.0791 |
| 2281 | 4010 | NM_031543 | 92.7310 | 83.0657 | 23.0504 | 36.4157 | 46.9120 |
| 2441 | 1780 | NM_053846 | 92.4195 | 35.5666 | 5.7305 | 49.4382 | 25.5523 |
| 2052 | 20734 | NM_019283 | 92.3676 | 144.9521 | 23.4277 | 94.5444 | 48.0442 |
| 2121 | 8587 | NM_022505 | 92.3157 | 20.8803 | 4.2288 | 41.8238 | 16.9462 |
| 2692 | 25790 | Z21935 | 92.2638 | 35.6152 | 5.7390 | 59.4251 | 16.3800 |
| 1816 | 16708 | NM_012895 | 91.8484 | 88.5919 | 17.8854 | 157.9072 | 40.9954 |
| 2622 | 20224 | U47014 | 91.7965 | 26.1801 | 4.6261 | 54.4380 | 23.6048 |
| 2294 | 14543 | NM_031596 | 91.5369 | 48.5444 | 13.3595 | 5.1087 | 27.4423 |
| 2267 | 18596 | NM_031325 | 91.2773 | 10.5340 | 2.2310 | 21.6064 | 8.7291 |
| 1810 | 4338 | NM_012866 | 91.2253 | 69.7044 | 4.9022 | 93.0153 | 21.2727 |
| 2530 | 1827 | NM_133572 | 91.2253 | 16.2629 | 9.8338 | 75.3003 | 47.7747 |
| 1721 | 24844 | M58040 | 90.9657 | 6.6279 | 6.2995 | 54.7281 | 38.8846 |
| 1599 | 9501 | AI638949 | 90.9138 | 152.3359 | 11.4546 | 118.4492 | 23.4890 |
| 1687 | 16260 | J01878 | 90.4465 | 45.4320 | 8.2771 | 79.8531 | 24.0301 |
| 2108 | 695 | NM_022388 | 90.2908 | 53.2826 | 3.7848 | 69.0072 | 17.9080 |
| 2001 | 1904 | NM_017315 | 90.2908 | 47.5752 | 5.7608 | 84.8968 | 39.3159 |
| 2213 | 1845 | NM_031010 | 90.1869 | −39.5333 | 15.8480 | 50.2903 | 75.5014 |
| 2583 | 305 | NM_145773 | 90.1350 | 22.3219 | 9.1616 | 53.6244 | 26.0163 |
| 1666 | 25306 | D84485 | 90.1350 | −11.1511 | 13.4777 | 24.5808 | 23.8453 |
| 2678 | 16272 | X76456 | 90.0312 | 25.6340 | 8.0024 | 50.4168 | 16.9722 |
| 2013 | 20232 | NM_017364 | 89.9792 | 12.6166 | 3.2958 | 27.4022 | 10.9487 |
| 2150 | 20509 | NM_022689 | 89.9273 | 20.0840 | 3.0939 | 36.0410 | 15.0767 |
| 1659 | 16610 | D28557 | 89.7715 | 499.3631 | 73.4028 | 756.9499 | 181.8408 |
| 1920 | 24697 | NM_017048 | 89.5119 | 105.8682 | 9.8884 | 155.6203 | 42.9715 |
| 373 | 16899 | AA892127 | 89.4600 | 32.9150 | 4.8111 | 20.0086 | 13.3720 |
| 2434 | 25262 | NM_053814 | 89.1485 | 28.4856 | 3.1939 | 42.4705 | 14.5360 |
| 2449 | 385 | NM_053885 | 89.1485 | 11.8336 | 5.9556 | 46.0511 | 22.7486 |
| 751 | 2881 | AF056034 | 88.9927 | 252.2559 | 62.0365 | 398.2385 | 92.6266 |
| 1753 | 20313 | NM_012585 | 88.8370 | 8.0980 | 9.4173 | 29.3879 | 10.8937 |

TABLE 5V-continued

Ifosphamide—Core Tox Markers
Timepoint(s): 48, 144 hrs

| SEQ ID | GLGC ID | GenBank Accession No. | LDA Score | Mean Tox | SD Tox | Mean Nontox | SD Nontox |
|---|---|---|---|---|---|---|---|
| 425 | 12022 | AA893105 | 88.8370 | 23.3220 | 5.1564 | 49.3675 | 23.7717 |
| 2535 | 1463 | NM_134334 | 88.3697 | 637.2336 | 174.0208 | 362.0256 | 132.6660 |
| 1618 | 20073 | AI639152 | 88.2658 | 2.9439 | 8.0267 | 40.0215 | 19.4706 |
| 1837 | 956 | NM_012976 | 88.2658 | 109.0921 | 25.9296 | 220.8949 | 96.5220 |
| 2281 | 4011 | NM_031543 | 88.0062 | 26.8526 | 6.8641 | 15.2646 | 19.2039 |
| 1621 | 5159 | AI639185 | 87.9543 | 336.6101 | 76.6035 | 172.3420 | 76.1563 |
| 2201 | 348 | NM_030586 | 87.6947 | 47.5134 | 9.5651 | 81.4591 | 28.9767 |
| 2564 | 15380 | NM_139083 | 87.6428 | 1163.6321 | 88.1712 | 936.7430 | 371.0795 |
| 2250 | 1265 | NM_031124 | 87.4870 | 13.2800 | 9.0537 | 32.1539 | 11.5110 |
| 2412 | 15777 | NM_053630 | 87.4870 | 15.1453 | 5.2606 | 35.8179 | 18.4377 |
| 2474 | 17709 | NM_057101 | 87.3832 | 131.6908 | 17.2177 | 181.8362 | 42.2679 |
| 2473 | 25290 | NM_057100 | 87.1236 | 587.7248 | 84.2770 | 388.4657 | 110.4809 |
| 2174 | 17226 | NM_024131 | 87.1236 | 269.8507 | 29.5324 | 190.1852 | 46.8537 |
| 2519 | 19326 | NM_133419 | 86.8640 | 69.1733 | 6.3079 | 55.9080 | 24.3541 |
| 386 | 2832 | AA892388 | 86.8120 | 120.5410 | 13.6626 | 150.9123 | 24.0289 |
| 1824 | 1765 | NM_012919 | 86.8120 | 47.8216 | 9.6220 | 83.6380 | 31.6316 |
| 1855 | 11113 | NM_013046 | 86.7082 | 14.1942 | 9.7635 | 36.4740 | 19.6053 |
| 1940 | 15776 | NM_017108 | 86.7082 | 151.7243 | 22.4822 | 244.3187 | 74.2967 |
| 2117 | 24643 | NM_022400 | 86.6044 | 215.9132 | 50.8641 | 69.3391 | 74.1356 |
| 1737 | 25365 | NM_012519 | 86.3967 | 9.7790 | 7.4931 | 47.8117 | 33.8018 |
| 6 | 1808 | AI014135 | 86.3448 | 5.7119 | 5.3248 | 97.1407 | 156.9111 |
| 2046 | 11218 | NM_019247 | 86.3448 | 38.1513 | 30.2508 | 128.0294 | 49.1823 |
| 1622 | 19795 | AI639197 | 86.3448 | 34.0938 | 13.5264 | 68.0481 | 27.3656 |
| 1946 | 167 | NM_017131 | 86.3448 | 345.9002 | 83.9734 | 587.3977 | 174.9745 |
| 756 | 2947 | AF099093 | 86.2928 | 24.4228 | 9.0045 | 51.3409 | 20.3344 |
| 433 | 21652 | AA893267 | 86.2409 | 16.3704 | 19.2389 | 25.6408 | 11.2378 |
| 2133 | 6577 | NM_022532 | 86.2409 | 150.3376 | 9.2802 | 123.4940 | 35.7175 |
| 2198 | 938 | NM_024486 | 86.2409 | 9.6093 | 3.2930 | 21.0064 | 10.0987 |
| 2685 | 25765 | X89706 | 86.2409 | 33.1944 | 8.5889 | 65.7206 | 19.4755 |
| 2319 | 20210 | NM_031710 | 86.1890 | 24.6803 | 11.0628 | 56.1610 | 17.5939 |
| 1919 | 24597 | NM_017040 | 86.1890 | 561.1767 | 51.1917 | 483.0641 | 109.4266 |
| 1807 | 1249 | NM_012850 | 86.1371 | 41.7076 | 8.2689 | 60.5223 | 14.3267 |
| 2611 | 25571 | S98336 | 86.1371 | 36.6171 | 8.0319 | 54.8128 | 15.1105 |
| 1899 | 20732 | NM_013217 | 86.1371 | 12.7066 | 4.1574 | 23.3332 | 9.0825 |
| 2167 | 15727 | NM_022953 | 86.1371 | 16.3477 | 7.4304 | 39.3159 | 13.5947 |
| 1798 | 16947 | NM_012793 | 86.0332 | 50.5529 | 10.1535 | 76.5861 | 22.0020 |
| 2466 | 16962 | NM_053999 | 85.9813 | 6.9492 | 6.2045 | 28.2084 | 13.7644 |
| 224 | 23069 | AA858572 | 85.9294 | 31.9091 | 4.3861 | 44.3683 | 10.8900 |
| 2630 | 2153 | U75404 | 85.7736 | 289.2098 | 43.1231 | 220.9612 | 123.1106 |
| 2592 | 10544 | NM_152935 | 85.7736 | 353.9149 | 29.0669 | 431.7640 | 65.7848 |
| 2098 | 20450 | NM_022239 | 85.7736 | 52.3184 | 7.1360 | 72.6463 | 22.4439 |
| 1935 | 23665 | NM_017092 | 85.7217 | 34.9232 | 7.1230 | 51.8690 | 12.9006 |
| 300 | 15310 | AA875123 | 85.6698 | 38.2432 | 6.9779 | 56.7156 | 15.2127 |
| 2482 | 2413 | NM_057141 | 85.6179 | 752.3984 | 55.8953 | 625.1376 | 104.2356 |
| 2687 | 25770 | X96437 | 85.6179 | 69.4238 | 33.3087 | 160.7589 | 60.1974 |
| 2156 | 58 | NM_022715 | 85.5659 | 97.7782 | 5.3308 | 91.3499 | 24.6679 |
| 351 | 17693 | AA891737 | 85.5140 | 61.2944 | 7.7884 | 44.4666 | 18.2384 |
| 2015 | 20536 | NM_019122 | 85.5140 | 35.1599 | 9.6132 | 11.9589 | 22.6823 |
| 2383 | 21866 | NM_053472 | 85.3583 | 113.1301 | 31.5776 | 217.3893 | 93.2963 |
| 2018 | 455 | NM_019131 | 85.3583 | 3398.0386 | 634.4508 | 4996.0023 | 1069.3956 |
| 2104 | 19423 | NM_022297 | 85.3063 | 57.2618 | 11.3319 | 97.6164 | 39.0480 |
| 1665 | 1356 | D83538 | 85.3063 | 37.6669 | 8.3923 | 20.4105 | 11.3700 |
| 1945 | 24522 | NM_017130 | 85.3063 | 8.8614 | 7.9366 | 27.5777 | 12.2626 |
| 2275 | 17427 | NM_031510 | 85.2025 | 323.6780 | 57.0555 | 221.4037 | 65.8713 |
| 288 | 17303 | AA874990 | 85.2025 | 33.7866 | 2.8455 | 41.9456 | 9.1403 |
| 2126 | 162 | NM_022516 | 84.9429 | 20.8002 | 17.6035 | 42.5670 | 23.7219 |
| 761 | 10108 | AI007857 | 84.8910 | 91.7666 | 10.7510 | 63.6700 | 27.1232 |
| 436 | 22355 | AA893338 | 84.7871 | 16.5914 | 5.3296 | 31.9805 | 12.8094 |
| 746 | 3799 | AF002281 | 84.6833 | 248.9998 | 58.6310 | 384.0977 | 115.4912 |
| 2216 | 1025 | NM_031016 | 84.5275 | 10.6336 | 5.2061 | 33.1574 | 21.1802 |
| 2644 | 2464 | X13411 | 84.5275 | 32.8120 | 3.7668 | 39.8959 | 13.1058 |
| 2216 | 1024 | NM_031016 | 84.4237 | 21.5096 | 7.3160 | 44.4910 | 18.9310 |
| 2424 | 10510 | NM_053743 | 84.4237 | 231.8057 | 17.9081 | 245.7739 | 69.5059 |
| 198 | 8515 | AA849917 | 98.3385 | 195.2183 | 33.1208 | 516.7584 | 139.8226 |
| 2530 | 1831 | NM_133572 | 97.3001 | 61.1163 | 13.5200 | 193.4309 | 75.5834 |
| 1869 | 26150 | NM_013096 | 97.0924 | 239.4870 | 199.4131 | 3011.7153 | 1987.2217 |
| 1406 | 1687 | AI179971 | 97.0405 | 641.7103 | 593.6589 | 4468.7838 | 1778.5097 |
| 796 | 19358 | AI009675 | 97.0405 | 378.9000 | 312.7266 | 2479.5780 | 947.3107 |
| 730 | 3390 | AA998195 | 96.5213 | 98.0716 | 16.5306 | 13.2468 | 32.8732 |
| 1869 | 1689 | NM_013096 | 96.2098 | 1657.4481 | 1651.1974 | 9093.2905 | 4046.8430 |
| 2356 | 17832 | NM_033234 | 96.1059 | 753.9386 | 718.7494 | 5637.5942 | 2321.1012 |
| 854 | 7120 | AI012393 | 96.0540 | 3.4607 | 7.5661 | 52.6522 | 27.1502 |
| 1592 | 11375 | AI237594 | 95.9502 | 47.0950 | 6.7258 | 101.4006 | 31.7853 |

TABLE 5V-continued

Ifosphamide--Core Tox Markers
Timepoint(s): 48, 144 hrs

| SEQ ID | GLGC ID | GenBank Accession No. | LDA Score | Mean Tox | SD Tox | Mean Nontox | SD Nontox |
|---|---|---|---|---|---|---|---|
| 904 | 5422 | AI028998 | 95.9502 | 255.9669 | 15.3339 | 447.6795 | 137.3423 |
| 1005 | 5549 | AI058942 | 95.6906 | 171.8383 | 14.2889 | 272.7479 | 88.2184 |
| 680 | 6276 | AA963767 | 95.6386 | 16.9686 | 15.6448 | 103.0190 | 46.1880 |
| 882 | 12796 | AI013495 | 95.6386 | −12.9629 | 11.2831 | 41.7692 | 26.8851 |
| 705 | 2962 | AA996953 | 95.5348 | 59.8316 | 8.6970 | 117.4927 | 32.2233 |
| 998 | 8612 | AI058527 | 95.5348 | 0.2689 | 6.9976 | 46.0127 | 28.3992 |
| 693 | 2424 | AA964617 | 95.4829 | 744.0810 | 64.6463 | 456.9711 | 109.4196 |
| 1590 | 23288 | AI237581 | 95.3271 | 162.0457 | 22.1140 | 272.3246 | 62.0544 |
| 1569 | 14594 | AI236152 | 95.2233 | 37.3820 | 25.3448 | −20.8144 | 26.6169 |
| 964 | 5710 | AI044740 | 95.1194 | 64.4711 | 7.2831 | 115.7780 | 29.5012 |
| 1431 | 17892 | AI228438 | 94.9637 | 74.1322 | 32.9001 | 496.0090 | 309.0373 |
| 766 | 2657 | AI008275 | 94.9117 | 404.4319 | 47.1948 | 214.9007 | 86.2187 |
| 517 | 23096 | AA924352 | 94.8598 | 303.9404 | 28.8283 | 106.0388 | 116.0834 |
| 519 | 4954 | AA924444 | 94.8079 | 75.8566 | 48.3559 | 300.5078 | 120.2101 |
| 1054 | 8712 | AI071935 | 94.7560 | 93.8463 | 20.1516 | 10.3414 | 49.3580 |
| 996 | 10070 | AI058505 | 94.7040 | 34.6609 | 9.5241 | 79.8852 | 30.3408 |
| 2200 | 17917 | NM_024488 | 94.6521 | 94.8277 | 47.9334 | −207.1858 | 165.7049 |
| 955 | 5433 | AI044271 | 94.6521 | 48.3568 | 7.0044 | 97.6852 | 36.0229 |
| 2530 | 1830 | NM_133572 | 94.5483 | 21.8907 | 8.9622 | 91.8654 | 47.1237 |
| 562 | 3952 | AA943016 | 94.3406 | 142.5596 | 15.2222 | 220.9986 | 49.2334 |
| 644 | 12426 | AA955760 | 94.2368 | 36.4587 | 34.9450 | −53.9307 | 40.6853 |
| 1974 | 15108 | NM_017226 | 94.2368 | 33.5728 | 7.3179 | 75.1760 | 24.1931 |
| 986 | 5890 | AI045836 | 94.0810 | 144.1226 | 16.6702 | 237.2963 | 56.8326 |
| 910 | 7447 | AI029432 | 93.8733 | 54.7359 | 9.9771 | 104.1249 | 30.7595 |
| 924 | 7698 | AI030527 | 93.6656 | 74.4883 | 11.5063 | 149.5131 | 47.2443 |
| 985 | 16335 | AI045744 | 93.6137 | 88.6708 | 40.5413 | 266.6131 | 136.8408 |
| 491 | 4779 | AA900825 | 93.5618 | 40.2461 | 5.2003 | 66.4230 | 17.3590 |
| 1414 | 3352 | AI180334 | 93.5099 | 721.7098 | 75.5300 | 447.0117 | 132.9273 |
| 1007 | 10171 | AI059209 | 93.5099 | 91.0491 | 22.1459 | 180.0318 | 47.2872 |
| 999 | 8103 | AI058653 | 93.4579 | −7.6890 | 9.1160 | 54.2286 | 37.7280 |
| 236 | 15160 | AA859346 | 93.3541 | 87.2868 | 16.4703 | 213.1044 | 92.6622 |
| 773 | 16034 | AI008701 | 93.3541 | 109.7919 | 25.9816 | 18.6182 | 58.2329 |
| 944 | 3899 | AI043904 | 93.3022 | 60.4683 | 21.0169 | −11.5877 | 35.8785 |
| 1032 | 21364 | AI070392 | 93.1983 | 72.5470 | 39.8668 | 262.2539 | 123.5654 |
| 174 | 6176 | AA819657 | 93.1983 | 38.5042 | 16.9291 | 124.2971 | 49.3222 |
| 1360 | 9521 | AI177706 | 93.1464 | 55.8598 | 9.0144 | 91.8144 | 22.2810 |
| 192 | 2075 | AA849394 | 93.0426 | 44.3953 | 8.3172 | 89.0395 | 28.0498 |
| 214 | 19214 | AA851364 | 92.8349 | 127.8322 | 22.3277 | 37.8946 | 63.3805 |
| 1598 | 14842 | AI237724 | 92.7830 | 49.3027 | 12.6519 | 102.6669 | 39.3891 |
| 567 | 22187 | AA943229 | 92.7830 | 409.4556 | 129.1747 | 867.5699 | 267.7624 |
| 209 | 21782 | AA851034 | 92.6791 | 38.6721 | 27.8222 | 122.8371 | 47.2701 |
| 2375 | 9352 | NM_053347 | 92.6791 | 378.4376 | 53.4050 | 552.6199 | 96.8881 |
| 993 | 8039 | AI058419 | 92.6791 | 68.3052 | 18.3267 | 140.0283 | 49.5285 |
| 1036 | 10453 | AI070697 | 92.6272 | 53.9392 | 16.4808 | 132.5562 | 49.1075 |
| 850 | 11408 | AI012353 | 92.6272 | 32.4582 | 18.6918 | 129.4645 | 55.9234 |
| 2588 | 5095 | NM_147140 | 92.6272 | 416.0853 | 28.8365 | 567.1313 | 110.1052 |
| 1041 | 9554 | AI071131 | 92.5753 | 40.4331 | 14.8696 | 97.1900 | 33.8327 |
| 720 | 3265 | AA997784 | 92.4714 | 41.5882 | 12.8118 | 98.6859 | 36.9127 |
| 613 | 3637 | AA945878 | 92.3676 | 15.1582 | 7.5334 | 41.6123 | 22.4054 |
| 1869 | 1685 | NM_013096 | 92.3157 | 3767.8787 | 3620.3845 | 16237.8222 | 9744.3700 |
| 581 | 22405 | AA944341 | 92.3157 | 133.8187 | 32.5703 | 238.9619 | 59.6023 |
| 883 | 7264 | AI013499 | 92.2638 | 27.2209 | 10.8354 | 72.6050 | 47.7981 |
| 870 | 16686 | AI013160 | 92.2118 | 118.8172 | 33.9194 | 234.5096 | 69.1124 |
| 994 | 6737 | AI058451 | 92.1080 | 177.6041 | 46.8049 | 85.4628 | 68.4928 |
| 738 | 2526 | AA998979 | 92.1080 | 236.0059 | 26.3307 | 326.7278 | 58.8308 |
| 1024 | 8557 | AI060221 | 92.1080 | 124.4789 | 33.6220 | 298.5563 | 128.6680 |
| 920 | 10690 | AI030276 | 92.1080 | 26.9454 | 4.5462 | 6.3091 | 18.2157 |
| 484 | 22480 | AA900230 | 92.1080 | 67.8894 | 14.8504 | 144.3945 | 51.0405 |
| 657 | 5990 | AA956907 | 92.0561 | 483.3228 | 40.6774 | 361.6884 | 71.5924 |
| 971 | 6496 | AI044887 | 92.0042 | 25.0566 | 25.0566 | 188.0613 | 55.0460 |
| 768 | 21889 | AI008393 | 91.9522 | 72.4361 | 17.2609 | 128.0111 | 31.2454 |
| 801 | 23092 | AI009819 | 91.9003 | 276.9497 | 35.3796 | 396.4401 | 70.1076 |
| 976 | 5726 | AI045194 | 91.8484 | 47.5982 | 4.2846 | 92.5981 | 28.6611 |
| 1002 | 8158 | AI058824 | 91.8484 | 213.3934 | 48.7506 | 403.2356 | 114.7865 |
| 1020 | 10277 | AI059925 | 91.8484 | 25.4588 | 9.4491 | 82.9826 | 42.3476 |
| 734 | 3781 | AA998375 | 91.7445 | −8.0857 | 12.0879 | 30.3861 | 26.3140 |
| 488 | 4750 | AA900469 | 91.6926 | 129.3269 | 39.4346 | 255.8295 | 84.7185 |
| 931 | 17552 | AI030833 | 91.6926 | 54.2706 | 13.2305 | 100.7306 | 33.8001 |
| 621 | 22708 | AA946063 | 91.6926 | 165.1820 | 16.0246 | 252.7250 | 71.8390 |
| 221 | 19159 | AA851953 | 91.6407 | 347.2374 | 57.9407 | 243.3276 | 58.7902 |
| 901 | 12805 | AI028870 | 91.6407 | 46.1116 | 10.1198 | 12.1679 | 53.7115 |
| 696 | 2492 | AA964866 | 91.5888 | 191.2070 | 34.7816 | 110.1686 | 42.6341 |
| 473 | 22308 | AA899535 | 91.5888 | 311.2068 | 57.2959 | 130.6294 | 104.9578 |

TABLE 5V-continued

Ifosphamide—Core Tox Markers
Timepoint(s): 48, 144 hrs

| SEQ ID | GLGC ID | GenBank Accession No. | LDA Score | Mean Tox | SD Tox | Mean Nontox | SD Nontox |
|---|---|---|---|---|---|---|---|
| 857 | 5595 | AI012467 | 91.5369 | 133.1074 | 12.8488 | 188.8985 | 46.4980 |
| 947 | 5370 | AI044087 | 91.5369 | 44.2783 | 20.8570 | 134.8288 | 63.6771 |

TABLE 5W

ISOPROTERENOL
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 1827 | 1977 | NM_012930 | 99.2761 | 281.1560 | 19.9468 | 553.2170 | 108.9731 |
| 1608 | 17383 | AI639060 | 99.2244 | 242.5684 | 60.2422 | 9.3550 | 26.2362 |
| 1814 | 23651 | NM_012881 | 99.0693 | 1262.3600 | 965.5064 | 38.3062 | 119.7939 |
| 2231 | 18308 | NM_031091 | 98.2420 | 364.6776 | 43.3971 | 726.0715 | 147.7221 |
| 1764 | 20589 | NM_012618 | 98.0869 | 686.0406 | 217.7915 | 147.0226 | 81.7174 |
| 380 | 18190 | AA892280 | 97.9835 | 61.2730 | 11.9914 | 142.6882 | 35.4957 |
| 2440 | 20869 | NM_053843 | 97.7249 | 191.1688 | 54.1307 | 61.7710 | 37.3905 |
| 2265 | 20862 | NM_031154 | 97.2079 | 109.6054 | 9.1395 | 202.5150 | 51.9772 |
| 1669 | 25801 | E12286 | 97.1562 | 93.4938 | 32.8141 | 34.2978 | 17.5263 |
| 2651 | 20872 | X51707 | 97.0527 | 2107.4202 | 138.5598 | 1374.1089 | 298.2244 |
| 404 | 15876 | AA892582 | 97.0010 | 2286.4682 | 205.9736 | 1515.4745 | 242.0758 |
| 1896 | 20855 | NM_013200 | 97.0010 | 438.1068 | 58.9423 | 701.2188 | 121.6465 |
| 1903 | 815 | NM_013224 | 96.8459 | 2397.1246 | 164.5055 | 1484.6920 | 348.7453 |
| 1949 | 24886 | NM_017138 | 96.8459 | 2430.0154 | 191.4842 | 1650.1080 | 273.4053 |
| 1896 | 20856 | NM_013200 | 96.8459 | 660.1966 | 91.9345 | 1097.4267 | 184.9369 |
| 2287 | 9620 | NM_031570 | 96.7425 | 1309.2228 | 111.2494 | 796.0881 | 180.1810 |
| 265 | 13974 | AA860030 | 96.7425 | 950.2598 | 158.6988 | 537.7136 | 142.7811 |
| 2137 | 9240 | NM_022540 | 96.6908 | 841.4074 | 37.9755 | 1171.9326 | 182.4209 |
| 84 | 18881 | AA799992 | 96.6391 | 43.1530 | 7.8137 | 18.5638 | 7.9904 |
| 2659 | 25702 | X58465 | 96.6391 | 1006.5474 | 52.0540 | 717.8472 | 132.1563 |
| 2151 | 17586 | NM_022694 | 96.4840 | 168.2388 | 26.2737 | 99.2782 | 23.1224 |
| 2364 | 15867 | NM_053289 | 96.4840 | 76.8508 | 7.7156 | 39.3922 | 53.8512 |
| 2694 | 17481 | Z49761 | 96.4323 | 44.0366 | 6.8639 | 8.6432 | 17.6908 |
| 2318 | 16918 | NM_031709 | 96.3806 | 2701.6484 | 298.5475 | 1656.8293 | 390.8094 |
| 2009 | 468 | NM_017348 | 96.3806 | 253.3670 | 4.6985 | 335.6019 | 77.0161 |
| 2231 | 18307 | NM_031091 | 96.3289 | 77.1716 | 18.0621 | 197.3083 | 62.0223 |
| 2123 | 2109 | NM_022511 | 96.3289 | 1185.6356 | 179.4987 | 756.7138 | 157.0759 |
| 2037 | 18569 | NM_019212 | 96.2254 | 3600.5110 | 873.6649 | 1593.1738 | 595.1392 |
| 2458 | 15135 | NM_053971 | 96.1220 | 1536.2712 | 135.8295 | 994.3579 | 218.0367 |
| 263 | 4222 | AA860024 | 96.1220 | 1291.4320 | 87.5453 | 980.3590 | 130.9204 |
| 383 | 13647 | AA892367 | 96.1220 | 1151.5724 | 181.5847 | 559.6657 | 202.5750 |
| 2658 | 5667 | X58200 | 96.0186 | 1612.5846 | 102.2626 | 1149.1016 | 189.6771 |
| 2601 | 3244 | S63519 | 96.0186 | 120.3262 | 8.1327 | 176.4112 | 33.5751 |
| 1686 | 17159 | J00797 | 95.9152 | 1572.3148 | 187.6344 | 1018.6373 | 243.3853 |
| 2093 | 17100 | NM_022179 | 95.7601 | 2047.7910 | 178.7334 | 1308.2477 | 293.8709 |
| 2152 | 17729 | NM_022697 | 95.7601 | 1918.3926 | 161.8414 | 1323.1157 | 225.7358 |
| 2464 | 18025 | NM_053989 | 95.7601 | 123.1492 | 7.0280 | 183.1607 | 36.0667 |
| 396 | 23888 | AA892520 | 95.7084 | 111.4202 | 15.3955 | 56.8814 | 21.8637 |
| 2140 | 21076 | NM_022584 | 95.7084 | 76.1978 | 4.6504 | 123.0470 | 28.4901 |
| 1932 | 1523 | NM_017079 | 95.7084 | 122.9916 | 17.2852 | 212.2060 | 51.8349 |
| 2220 | 690 | NM_031034 | 95.6567 | 44.4970 | 1.2320 | 43.1497 | 21.6870 |
| 2667 | 13646 | X62166 | 95.6050 | 946.2256 | 83.5885 | 577.1178 | 155.8400 |
| 2642 | 14966 | X07551 | 95.6050 | 116.9316 | 18.4361 | 39.1802 | 45.8032 |
| 2668 | 15387 | X62482 | 95.5533 | 1127.9196 | 97.1354 | 765.4720 | 152.9382 |
| 1986 | 7594 | NM_017260 | 95.5533 | 42.7394 | 8.6206 | 21.5775 | 9.6285 |
| 1643 | 20056 | AI639504 | 95.5533 | 91.0126 | 16.1662 | 154.1554 | 29.1854 |
| 1949 | 24885 | NM_017138 | 95.5016 | 1825.4132 | 196.0255 | 1170.4232 | 257.0082 |
| 396 | 23889 | AA892520 | 95.4498 | 193.3960 | 50.6143 | 94.2180 | 32.1467 |
| 54 | 17380 | AA799612 | 95.4498 | 411.4880 | 45.1926 | 602.8949 | 97.2775 |
| 2246 | 20839 | NM_031113 | 95.3981 | 2157.4994 | 150.2386 | 1521.6955 | 266.3647 |
| 2649 | 25686 | X51536 | 95.3981 | 1409.5814 | 104.8654 | 970.9436 | 195.1788 |
| 2258 | 17379 | NM_031138 | 95.3981 | 300.4482 | 20.9956 | 439.7134 | 98.9308 |
| 2506 | 14959 | NM_130734 | 95.2947 | 1152.2914 | 74.7831 | 802.2623 | 158.5034 |
| 2659 | 10109 | X58465 | 95.2947 | 1758.3110 | 118.9654 | 1264.7123 | 227.5776 |
| 109 | 21377 | AA800719 | 95.1913 | 166.6046 | 15.3011 | 99.7410 | 31.3940 |
| 1758 | 18387 | NM_012598 | 95.1913 | 1591.3322 | 135.0484 | 2366.1538 | 453.0061 |
| 1923 | 1876 | NM_017052 | 95.1396 | 48.7360 | 3.7356 | 82.1938 | 24.3829 |
| 367 | 17374 | AA891978 | 95.1396 | 211.4694 | 5.6650 | 273.8754 | 58.5667 |
| 288 | 17303 | AA874990 | 95.0879 | 28.4336 | 1.5918 | 41.9396 | 9.1066 |

TABLE 5W-continued

ISOPROTERENOL
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2124 | 3027 | NM_022514 | 95.0362 | 2264.5632 | 150.9679 | 1608.7857 | 296.6061 |
| 1913 | 17815 | NM_017015 | 94.9845 | 25.1606 | 7.0400 | 6.0317 | 8.2944 |
| 268 | 17217 | AA866299 | 94.9845 | 335.5012 | 7.1145 | 405.3749 | 80.9328 |
| 2650 | 18250 | X51706 | 94.9328 | 2294.3592 | 147.3030 | 1649.1933 | 321.1304 |
| 2051 | 1143 | NM_019280 | 94.9328 | 83.5102 | 5.9807 | 128.6649 | 30.2698 |
| 2237 | 23854 | NM_031101 | 94.8294 | 1140.2992 | 146.7358 | 709.1314 | 172.4544 |
| 2193 | 2812 | NM_024386 | 94.8294 | 57.9592 | 3.3591 | 89.9564 | 24.8832 |
| 2645 | 20810 | X14181 | 94.7777 | 3017.1464 | 362.7701 | 2018.4821 | 406.7029 |
| 1986 | 7593 | NM_017260 | 94.7777 | 107.9794 | 13.5568 | 65.6747 | 22.4021 |
| 2533 | 1728 | NM_133618 | 94.7777 | 1063.3382 | 64.9909 | 1491.8039 | 266.1204 |
| 2256 | 15052 | NM_031136 | 94.7260 | 4286.7688 | 739.8015 | 2732.5401 | 638.0684 |
| 2159 | 23606 | NM_022867 | 94.7260 | 446.1930 | 36.8473 | 640.8500 | 109.2710 |
| 409 | 23783 | AA892773 | 94.7260 | 296.0890 | 15.7047 | 404.1912 | 68.2440 |
| 346 | 4459 | AA891721 | 94.7260 | 23.8026 | 3.2653 | 43.7754 | 15.8319 |
| 2194 | 22 | NM_024388 | 94.6743 | 23.2500 | 8.8763 | 108.2320 | 102.4995 |
| 38 | 15303 | AA799518 | 94.6225 | 121.2882 | 11.3289 | 215.2800 | 56.6663 |
| 2194 | 21 | NM_024388 | 94.5191 | 25.0396 | 2.4980 | 62.7119 | 52.7892 |
| 330 | 24814 | AA891209 | 94.5191 | 104.1916 | 8.7462 | 71.9542 | 16.6319 |
| 2162 | 2008 | NM_022936 | 94.5191 | 40.3384 | 1.9517 | 62.5625 | 33.9581 |
| 2286 | 18319 | NM_031561 | 94.5191 | 558.4844 | 27.1746 | 864.7216 | 243.3743 |
| 2232 | 15202 | NM_031093 | 94.5191 | 1683.4932 | 138.6406 | 1015.8598 | 357.1087 |
| 66 | 17494 | AA799751 | 94.5191 | 165.2608 | 10.1135 | 247.6753 | 54.0337 |
| 2647 | 19244 | X15013 | 94.4674 | 2381.5768 | 137.5725 | 1810.0884 | 305.1647 |
| 2314 | 21575 | NM_031698 | 94.4674 | 185.8712 | 7.1711 | 142.3836 | 30.5794 |
| 2257 | 15486 | NM_031137 | 94.3640 | 15.8234 | 0.7048 | 26.0108 | 16.0510 |
| 2492 | 10498 | NM_078617 | 94.3640 | 1997.8460 | 323.6599 | 1376.3590 | 271.7471 |
| 360 | 16023 | AA891872 | 94.3123 | 1098.3534 | 62.6343 | 1591.1177 | 334.1844 |
| 2461 | 15468 | NM_053982 | 94.2606 | 1764.6184 | 146.7957 | 1309.5903 | 219.7387 |
| 1904 | 18305 | NM_013226 | 94.2606 | 3179.0632 | 379.2372 | 2113.8723 | 463.9186 |
| 1848 | 20178 | NM_013014 | 94.2606 | 24.0734 | 5.5628 | −2.6341 | 30.9588 |
| 2648 | 15626 | X17665 | 94.2089 | 2696.1736 | 223.2380 | 1808.3848 | 402.0718 |
| 2654 | 18606 | X53504 | 94.2089 | 1187.2666 | 93.6190 | 822.6851 | 177.2054 |
| 1758 | 18386 | NM_012598 | 94.2089 | 1463.4778 | 250.1575 | 2274.2335 | 449.1281 |
| 375 | 11384 | AA892149 | 94.2089 | 30.5094 | 0.8177 | 33.3866 | 11.0480 |
| 2232 | 15201 | NM_031093 | 94.1055 | 3246.1558 | 357.7373 | 2274.4849 | 449.2785 |
| 1701 | 12058 | L25387 | 94.1055 | 129.6848 | 4.0030 | 101.1381 | 38.1588 |
| 2078 | 15335 | NM_021264 | 94.0538 | 890.1394 | 89.1651 | 618.3418 | 136.2742 |
| 1875 | 21840 | NM_013128 | 94.0538 | 369.6284 | 22.7713 | 525.3803 | 122.9813 |
| 248 | 20582 | AA859688 | 93.8469 | 325.5276 | 35.9961 | 493.2211 | 97.7707 |
| 1653 | 5049 | D10655 | 93.8469 | 509.5548 | 31.1298 | 737.5654 | 170.5862 |
| 2458 | 15136 | NM_053971 | 93.7435 | 1629.6028 | 243.9665 | 1070.6605 | 271.5419 |
| 2513 | 19456 | NM_133298 | 99.0693 | 298.1502 | 177.2594 | 1.7645 | 27.0914 |
| 887 | 22592 | AI013740 | 98.9659 | 758.3822 | 153.9430 | 200.7379 | 132.3437 |
| 2513 | 4048 | NM_133298 | 98.8108 | 683.6852 | 414.7907 | 15.8348 | 54.8179 |
| 2513 | 4049 | NM_133298 | 98.6556 | 1077.9050 | 555.8633 | 38.8703 | 101.8792 |
| 604 | 4207 | AA945591 | 98.3454 | 290.4604 | 65.3118 | 122.1165 | 40.9110 |
| 1161 | 2296 | AI112979 | 98.2937 | 379.8296 | 138.1372 | 119.8422 | 39.0667 |
| 1474 | 11893 | AI230951 | 98.0352 | 180.3784 | 87.3723 | 3.6850 | 39.7708 |
| 1101 | 2125 | AI102519 | 97.9317 | 488.2134 | 244.5406 | 109.2617 | 87.0160 |
| 489 | 16753 | AA900474 | 97.9311 | 228.0646 | 109.3065 | −5.2427 | 64.2031 |
| 1451 | 7650 | AI230142 | 97.8800 | 336.5038 | 126.0327 | 104.0033 | 39.0348 |
| 2386 | 16394 | NM_053485 | 97.8283 | 1953.5320 | 301.7161 | 776.7555 | 285.1212 |
| 666 | 24040 | AA957422 | 97.7766 | 978.5796 | 315.0650 | 371.7175 | 128.6161 |
| 149 | 8058 | AA818475 | 97.7249 | 518.1870 | 64.7283 | 315.9890 | 54.8417 |
| 866 | 4232 | AI012958 | 97.7249 | 507.8808 | 143.7363 | 185.4600 | 77.5704 |
| 540 | 21500 | AA925353 | 97.6732 | 302.2368 | 83.4080 | 88.8370 | 88.7562 |
| 601 | 22556 | AA945100 | 97.5181 | 73.0724 | 20.5771 | 20.3416 | 14.8252 |
| 570 | 22223 | AA943440 | 97.4147 | 52.9336 | 7.9327 | 223.7111 | 108.7679 |
| 564 | 6691 | AA943028 | 97.4147 | 347.9868 | 74.7675 | 156.4936 | 49.8047 |
| 1028 | 4967 | AI070179 | 97.3630 | 88.9172 | 20.1806 | 36.4109 | 41.2124 |
| 158 | 4491 | AA818798 | 97.3113 | 153.5246 | 56.1239 | 46.1077 | 27.4902 |
| 1565 | 14776 | AI235950 | 97.3113 | 288.4110 | 18.9884 | 444.9225 | 80.9918 |
| 1353 | 13539 | AI177280 | 97.3113 | 183.1240 | 55.3367 | 74.3225 | 25.9366 |
| 483 | 3903 | AA899986 | 97.2596 | 34.9996 | 41.3641 | −126.2066 | 69.6649 |
| 1357 | 17826 | AI177403 | 97.0010 | 41.9274 | 21.5602 | 4.8398 | 9.9495 |
| 637 | 23498 | AA955248 | 97.0010 | 224.7006 | 18.7019 | 366.4700 | 165.6921 |
| 1439 | 16203 | AI229196 | 96.9493 | 78.9488 | 12.7853 | 139.5266 | 48.7555 |
| 1029 | 18 | AI070195 | 96.9493 | 163.0158 | 11.9147 | 87.7965 | 33.5906 |
| 735 | 3505 | AA998430 | 96.9493 | 201.4542 | 43.7494 | −34.7538 | 122.1253 |
| 842 | 24038 | AI012109 | 96.8976 | 512.3702 | 127.4492 | 214.5274 | 78.1911 |
| 654 | 18296 | AA956703 | 96.8976 | 264.4690 | 9.2486 | 176.4902 | 54.0493 |
| 527 | 2888 | AA924902 | 96.7942 | 572.6298 | 56.5113 | 985.9715 | 212.4677 |
| 1250 | 14960 | AI171319 | 96.7425 | 2827.0198 | 325.2308 | 1623.3914 | 445.4860 |

TABLE 5W-continued

ISOPROTERENOL
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2338 | 10269 | NM_031838 | 96.4840 | 3223.7554 | 534.9910 | 1981.1927 | 399.6866 |
| 1480 | 20845 | AI231140 | 96.4323 | 756.6490 | 199.2139 | 283.6651 | 204.3095 |
| 1198 | 8339 | AI145761 | 96.3806 | 67.1254 | 3.5227 | 109.8235 | 26.8107 |
| 1014 | 8729 | AI059485 | 96.2771 | 37.7988 | 23.4009 | −26.2680 | 25.5023 |
| 1532 | 4670 | AI233714 | 96.2254 | 651.6486 | 37.0112 | 968.8950 | 197.5406 |
| 706 | 16496 | AA996955 | 96.2254 | 1007.5318 | 80.5526 | 662.3587 | 140.2810 |
| 814 | 19778 | AI010455 | 96.2254 | 162.7704 | 19.4915 | 96.6441 | 28.4757 |
| 888 | 16584 | AI013765 | 96.1737 | 206.5866 | 43.5278 | 99.5119 | 41.5816 |
| 1394 | 7213 | AI179356 | 96.1220 | 982.3286 | 81.0719 | 596.6911 | 156.4134 |
| 733 | 19458 | AA998345 | 96.1220 | 175.6176 | 45.8215 | 81.8809 | 28.5183 |
| 1477 | 13934 | AI231044 | 96.0703 | −9.7620 | 18.9704 | 108.1365 | 52.0482 |
| 677 | 2173 | AA963627 | 96.0703 | 6108.5984 | 663.8294 | 3420.8716 | 1129.3754 |
| 1517 | 11157 | AI232494 | 96.0186 | 1426.7052 | 70.8267 | 1973.4101 | 332.9831 |
| 532 | 23173 | AA925057 | 96.0186 | 2830.0816 | 416.7392 | 1561.9613 | 463.9543 |
| 981 | 6808 | AI045600 | 96.0186 | 633.8266 | 119.9903 | 355.8146 | 97.7043 |
| 1131 | 21927 | AI104117 | 95.9669 | 986.1244 | 93.9318 | 636.1205 | 133.3608 |
| 1071 | 10919 | AI072744 | 95.9152 | 2262.2648 | 491.2299 | 842.8495 | 664.3673 |
| 1302 | 18507 | AI175551 | 95.8635 | 845.7300 | 91.6336 | 509.8879 | 133.9074 |
| 1107 | 19379 | AI102711 | 95.8635 | 483.4050 | 16.0720 | 371.4526 | 67.5500 |
| 2586 | 20046 | NM_145784 | 95.8118 | 36.0804 | 13.2519 | 9.6159 | 8.6421 |
| 154 | 11864 | AA818717 | 95.8118 | 53.4336 | 6.5507 | 86.2261 | 22.5507 |
| 1108 | 22171 | AI102734 | 95.7601 | 459.3624 | 3.3321 | 481.9651 | 81.2899 |
| 502 | 4858 | AA901238 | 95.7601 | 26.0362 | 6.4666 | −26.1668 | 33.6523 |

TABLE 5X

Isoproterenol--Tox Core Markers
Timepoints(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 1827 | 1977 | NM_012930 | 99.2761 | 281.1560 | 119.9468 | 553.2170 | 108.9731 |
| 1608 | 17383 | AI639060 | 99.2244 | 242.5684 | 60.2422 | 9.3550 | 26.2362 |
| 1814 | 23651 | NM_012881 | 99.0693 | 1262.3600 | 965.5064 | 38.3062 | 119.7939 |
| 2231 | 18308 | NM_031091 | 98.2420 | 364.6776 | 43.3971 | 726.0715 | 147.7221 |
| 1764 | 20589 | NM_012618 | 98.0869 | 686.0406 | 217.7915 | 147.0226 | 81.7174 |
| 380 | 18190 | AA892280 | 97.9835 | 61.2730 | 11.9914 | 142.6882 | 35.4957 |
| 2440 | 20869 | NM_053843 | 97.7249 | 191.1688 | 54.1307 | 61.7710 | 37.3905 |
| 410 | 12118 | AA892775 | 97.6215 | 1593.8502 | 366.4674 | 541.2085 | 291.0134 |
| 2435 | 15003 | NM_053819 | 97.2079 | 499.7730 | 126.9177 | 94.5838 | 190.8987 |
| 2265 | 20862 | NM_031154 | 97.2079 | 109.6054 | 9.1395 | 202.5150 | 51.9772 |
| 2435 | 15002 | NM_053819 | 97.1562 | 640.5422 | 115.1965 | 207.6172 | 187.0907 |
| 1669 | 25801 | E12286 | 97.1562 | 93.4938 | 32.8141 | 34.2978 | 17.5263 |
| 2651 | 20872 | X51707 | 97.0527 | 2107.4202 | 138.5598 | 1374.1089 | 298.2244 |
| 404 | 15876 | AA892582 | 97.0010 | 2286.4682 | 205.9736 | 1515.4745 | 242.0758 |
| 1896 | 20855 | NM_013200 | 97.0010 | 438.1068 | 58.9423 | 701.2188 | 121.6465 |
| 1903 | 815 | NM_013224 | 96.8459 | 2397.1246 | 164.5055 | 1484.6920 | 348.7453 |
| 1949 | 24886 | NM_017138 | 96.8459 | 2430.0154 | 191.4842 | 1650.1080 | 273.4053 |
| 1896 | 20856 | NM_013200 | 96.8459 | 660.1966 | 91.9345 | 1097.4267 | 184.9369 |
| 2335 | 22321 | NM_031832 | 96.7425 | 579.0476 | 242.9531 | 172.2432 | 91.8309 |
| 2287 | 9620 | NM_031570 | 96.7425 | 1309.2228 | 111.2494 | 796.0881 | 180.1810 |
| 2651 | 13974 | AA860030 | 96.7425 | 950.2598 | 158.6988 | 537.7136 | 142.7811 |
| 2137 | 9240 | NM_022540 | 96.6908 | 841.4074 | 37.9755 | 1171.9326 | 182.4209 |
| 84 | 18881 | AA799992 | 96.6391 | 43.1530 | 7.8137 | 18.5638 | 7.9904 |
| 2659 | 25702 | X58465 | 96.6391 | 1006.5474 | 52.0540 | 717.8472 | 132.1563 |
| 2151 | 17586 | NM_022694 | 96.4840 | 168.2388 | 26.2737 | 99.2782 | 23.1224 |
| 2364 | 15867 | NM_053289 | 96.4840 | 76.8508 | 7.7156 | 39.3922 | 53.8512 |
| 2694 | 17481 | Z49761 | 96.4323 | 44.0366 | 6.8639 | 8.6432 | 17.6908 |
| 2318 | 16918 | NM_031709 | 96.3806 | 2701.6484 | 298.5475 | 1656.8293 | 390.8094 |
| 2009 | 468 | NM_017348 | 96.3806 | 253.3670 | 4.6985 | 335.6019 | 77.0161 |
| 2231 | 18307 | NM_031091 | 96.3289 | 77.1716 | 18.0621 | 197.3083 | 62.0223 |
| 2123 | 2109 | NM_022511 | 96.3289 | 1185.6356 | 179.4987 | 756.7138 | 157.0759 |
| 2037 | 18569 | NM_019212 | 96.2254 | 3600.5110 | 873.6649 | 1593.1738 | 595.1392 |
| 2311 | 20743 | NM_031684 | 96.2254 | 103.6790 | 6.8918 | 155.0261 | 28.0319 |
| 2458 | 15135 | NM_053971 | 96.1220 | 1536.2712 | 135.8295 | 994.3579 | 218.0367 |
| 263 | 4222 | AA860024 | 96.1220 | 1291.4320 | 87.5453 | 980.3590 | 130.9204 |
| 383 | 13647 | AA892367 | 96.1220 | 1151.5724 | 181.5847 | 559.6657 | 202.5750 |
| 2658 | 5667 | X58200 | 96.0186 | 1612.5846 | 102.2626 | 1149.1016 | 189.6771 |
| 2601 | 3244 | S63519 | 96.0186 | 120.3262 | 8.1327 | 176.4112 | 33.5751 |

TABLE 5X-continued

Isoproterenol--Tox Core Markers
Timepoints(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2242 | 16847 | NM_031109 | 95.9152 | 1577.3310 | 112.3690 | 1115.1014 | 190.3333 |
| 1686 | 17159 | J00797 | 95.9152 | 1572.3148 | 187.6344 | 1018.6373 | 243.3853 |
| 2093 | 17100 | NM_022179 | 95.7601 | 2047.7910 | 178.7334 | 1308.2477 | 293.8709 |
| 2152 | 17729 | NM_022697 | 95.7601 | 1918.3926 | 161.8414 | 1323.1157 | 225.7358 |
| 2464 | 18025 | NM_053989 | 95.7601 | 123.1492 | 7.0280 | 183.1607 | 36.0667 |
| 396 | 23888 | AA892520 | 95.7084 | 111.4202 | 15.3955 | 56.8814 | 21.8637 |
| 2140 | 21076 | NM_022584 | 95.7084 | 76.1978 | 4.6504 | 123.0470 | 28.4901 |
| 1932 | 1523 | NM_017079 | 95.7084 | 122.9916 | 17.2852 | 212.2060 | 51.8349 |
| 312 | 15510 | AA875428 | 95.6567 | 189.7192 | 13.2887 | 281.2798 | 54.4113 |
| 2220 | 690 | NM_031034 | 95.6567 | 44.4970 | 1.2320 | 43.1497 | 21.6870 |
| 2667 | 13646 | X62166 | 95.6050 | 946.2256 | 83.5885 | 577.1178 | 155.8400 |
| 2642 | 14966 | X07551 | 95.6050 | 116.9316 | 18.4361 | 39.1802 | 45.8032 |
| 2668 | 15387 | X62482 | 95.5533 | 1127.9196 | 97.1354 | 765.4720 | 152.9382 |
| 1986 | 7594 | NM_017260 | 95.5533 | 42.7394 | 8.6206 | 21.5775 | 9.6285 |
| 1643 | 20056 | AI639504 | 95.5533 | 91.0126 | 16.1662 | 154.1554 | 29.1854 |
| 1949 | 24885 | NM_017138 | 95.5016 | 1825.4132 | 196.0255 | 1170.4232 | 257.0082 |
| 396 | 23889 | AA892520 | 95.4498 | 193.3960 | 50.6143 | 94.2180 | 32.1467 |
| 54 | 17380 | AA799612 | 95.4498 | 411.4880 | 45.1926 | 602.8949 | 97.2775 |
| 2246 | 20839 | NM_031113 | 95.3981 | 2157.4994 | 150.2386 | 1521.6955 | 266.3647 |
| 2649 | 25686 | X51536 | 95.3981 | 1409.5814 | 104.8654 | 970.9436 | 195.1788 |
| 2258 | 17379 | NM_031138 | 95.3981 | 300.4482 | 20.9956 | 439.7134 | 98.9308 |
| 2506 | 14959 | NM_130734 | 95.2947 | 1152.2914 | 74.7831 | 802.2623 | 158.5034 |
| 2659 | 10109 | X58465 | 95.2947 | 1758.3110 | 118.9654 | 1264.7123 | 227.5776 |
| 109 | 21377 | AA800719 | 95.1913 | 166.6046 | 15.3011 | 99.7410 | 31.3940 |
| 1758 | 18387 | NM_012598 | 95.1913 | 1591.3322 | 135.0484 | 2366.1538 | 453.0061 |
| 2483 | 1892 | NM_057144 | 95.1396 | 2186.4372 | 487.7466 | 1210.5009 | 391.5950 |
| 1923 | 1876 | NM_017052 | 95.1396 | 48.7360 | 3.7356 | 82.1938 | 24.3829 |
| 367 | 17374 | AA891978 | 95.1396 | 211.4694 | 5.6650 | 273.8754 | 58.5667 |
| 288 | 17303 | AA874990 | 95.0879 | 28.4336 | 1.5918 | 41.9396 | 9.1066 |
| 2124 | 3027 | NM_022514 | 95.0362 | 2264.5632 | 150.9679 | 1608.7857 | 296.6061 |
| 1913 | 17815 | NM_017015 | 94.9845 | 25.1606 | 7.0400 | 6.0317 | 8.2944 |
| 268 | 17217 | AA866299 | 94.9845 | 335.5012 | 7.1145 | 405.3749 | 80.9328 |
| 2650 | 18250 | X51706 | 94.9328 | 2294.3592 | 147.3030 | 1649.1933 | 321.1304 |
| 2051 | 1143 | NM_019280 | 94.9328 | 83.5102 | 5.9807 | 128.6649 | 30.2698 |
| 2237 | 23854 | NM_031101 | 94.8294 | 1140.2992 | 146.7358 | 709.1314 | 172.4544 |
| 2193 | 2812 | NM_024386 | 94.8294 | 57.9592 | 3.3591 | 89.9564 | 24.8832 |
| 2645 | 20810 | X14181 | 94.7777 | 3017.1464 | 362.7701 | 2018.4821 | 406.7029 |
| 1986 | 7593 | NM_017260 | 94.7777 | 107.9794 | 13.5568 | 65.6747 | 22.4021 |
| 2533 | 1728 | NM_133618 | 94.7777 | 1063.3382 | 64.9909 | 1491.8039 | 266.1204 |
| 2256 | 15052 | NM_031136 | 94.7260 | 4286.7688 | 739.8015 | 2732.5401 | 638.0684 |
| 2159 | 23606 | NM_022867 | 94.7260 | 446.1930 | 36.8473 | 640.8500 | 109.2710 |
| 409 | 23783 | AA892773 | 94.7260 | 296.0890 | 15.7047 | 404.1912 | 68.2440 |
| 346 | 4459 | AA891721 | 94.7260 | 23.8026 | 3.2653 | 43.7754 | 15.8319 |
| 2194 | 22 | NM_024388 | 94.6743 | 23.2500 | 8.8763 | 108.2320 | 102.4995 |
| 38 | 15303 | AA799518 | 94.6225 | 121.2882 | 11.3289 | 215.2800 | 56.6663 |
| 2194 | 21 | NM_024388 | 94.5191 | 25.0396 | 2.4980 | 62.7119 | 52.7892 |
| 330 | 24814 | AA891209 | 94.5191 | 104.1916 | 8.7462 | 71.9542 | 16.6319 |
| 2162 | 2008 | NM_022936 | 94.5191 | 40.3384 | 1.9517 | 62.5625 | 33.9581 |
| 2286 | 18319 | NM_031561 | 94.5191 | 558.4844 | 27.1746 | 864.7216 | 243.3743 |
| 2232 | 15202 | NM_031093 | 94.5191 | 1683.4932 | 138.6406 | 1015.8598 | 357.1087 |
| 66 | 17494 | AA799751 | 94.5191 | 165.2608 | 10.1135 | 247.6753 | 54.0337 |
| 2647 | 19244 | X15013 | 94.4674 | 2381.5768 | 137.5725 | 1810.0884 | 305.1647 |
| 2314 | 21575 | NM_031698 | 94.4674 | 185.8712 | 7.1711 | 142.3836 | 30.5794 |
| 2257 | 15486 | NM_031137 | 94.3640 | 15.8234 | 0.7048 | 26.0108 | 16.0510 |
| 2492 | 10498 | NM_078617 | 94.3640 | 1997.8460 | 323.6599 | 1376.3590 | 271.7471 |
| 360 | 16023 | AA891872 | 94.3123 | 1098.3534 | 62.6343 | 1591.1177 | 334.1844 |
| 2461 | 15468 | NM_053982 | 94.2606 | 1764.6184 | 146.7957 | 1309.5903 | 219.7387 |
| 1904 | 18305 | NM_013226 | 94.2606 | 3179.0632 | 379.2372 | 2113.8723 | 463.9186 |
| 1848 | 20178 | NM_013014 | 94.2606 | 24.0734 | 5.5628 | −2.6341 | 30.9588 |
| 2648 | 15626 | X17665 | 94.2089 | 2696.1736 | 223.2380 | 1808.3848 | 402.0718 |
| 2654 | 18606 | X53504 | 94.2089 | 1187.2666 | 93.6190 | 822.6851 | 177.2054 |
| 1758 | 18386 | NM_012598 | 94.2089 | 1463.4778 | 250.1575 | 2274.2335 | 449.1281 |
| 2513 | 19456 | NM_133298 | 99.0693 | 298.1502 | 177.2594 | 1.7645 | 27.0914 |
| 887 | 22592 | AI013740 | 98.9659 | 758.3822 | 153.9430 | 200.7379 | 132.3437 |
| 2513 | 4048 | NM_133298 | 98.8108 | 683.6852 | 414.7907 | 15.8348 | 54.8179 |
| 2513 | 4049 | NM_133298 | 98.6556 | 1077.9050 | 555.8633 | 38.8703 | 101.8792 |
| 604 | 4207 | AA945591 | 98.3454 | 290.4604 | 65.3118 | 122.1165 | 40.9110 |
| 1161 | 2296 | AI112979 | 98.2937 | 379.8296 | 138.1372 | 119.8422 | 39.0667 |
| 1474 | 11893 | AI230951 | 98.0352 | 180.3784 | 87.3723 | 3.6850 | 39.7708 |
| 1101 | 2125 | AI102519 | 97.9317 | 488.2134 | 244.5406 | 109.2617 | 87.0160 |
| 489 | 16753 | AA900474 | 97.9317 | 228.0646 | 109.3065 | −5.2427 | 64.2031 |
| 1451 | 7650 | AI230142 | 97.8800 | 336.5038 | 126.0327 | 104.0033 | 39.0348 |
| 2386 | 16394 | NM_053485 | 97.8283 | 1953.5320 | 301.7161 | 776.7555 | 285.1212 |

TABLE 5X-continued

Isoproterenol--Tox Core Markers
Timepoints(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 666 | 24040 | AA957422 | 97.7766 | 978.5796 | 315.0650 | 371.7175 | 128.6161 |
| 149 | 8058 | AA818475 | 97.7249 | 518.1870 | 64.7283 | 315.9890 | 54.8417 |
| 866 | 4232 | AI012958 | 97.7249 | 507.8808 | 143.7363 | 185.4600 | 77.5704 |
| 540 | 21500 | AA925353 | 97.6732 | 302.2368 | 83.4080 | 88.8370 | 88.7562 |
| 849 | 6606 | AI012308 | 97.5181 | 5040.9788 | 864.8078 | 1862.0365 | 743.3288 |
| 601 | 22556 | AA945100 | 97.5181 | 73.0724 | 20.5771 | 20.3416 | 14.8252 |
| 570 | 22223 | AA943440 | 97.4147 | 52.9336 | 7.9327 | 223.7111 | 108.7679 |
| 564 | 6691 | AA943028 | 97.4147 | 347.9868 | 74.7675 | 156.4936 | 49.8047 |
| 1028 | 4967 | AI070179 | 97.3630 | 88.9172 | 20.1806 | 36.4109 | 41.2124 |
| 158 | 4491 | AA818798 | 97.3113 | 153.5246 | 56.1239 | 46.1077 | 27.4902 |
| 1565 | 14776 | AI235950 | 97.3113 | 288.4110 | 18.9884 | 444.9225 | 80.9918 |
| 1353 | 13539 | AI177280 | 97.3113 | 183.1240 | 55.3367 | 74.3225 | 25.9366 |
| 1553 | 15004 | AI235224 | 97.2596 | 972.5216 | 213.6666 | 334.0647 | 270.6975 |
| 483 | 3903 | AA899986 | 97.2596 | 34.9996 | 41.3641 | −126.2066 | 69.6649 |
| 1308 | 4074 | AI175990 | 97.0527 | −0.9616 | 3.5722 | 63.0220 | 44.5968 |
| 1357 | 17826 | AI177403 | 97.0010 | 41.9274 | 21.5602 | 4.8398 | 9.9495 |
| 637 | 23498 | AA955248 | 97.0010 | 224.7006 | 18.7019 | 366.4700 | 165.6921 |
| 1439 | 16203 | AI229196 | 96.9493 | 78.9488 | 12.7853 | 139.5266 | 48.7555 |
| 1029 | 18 | AI070195 | 96.9493 | 163.0158 | 11.9147 | 87.7965 | 33.5906 |
| 735 | 3505 | AA998430 | 96.9493 | 201.4542 | 43.7494 | −34.7538 | 122.1253 |
| 842 | 24038 | AI012109 | 96.8976 | 512.3702 | 127.4492 | 214.5274 | 78.1911 |
| 654 | 18296 | AA956703 | 96.8976 | 264.4690 | 9.2486 | 176.4902 | 54.0493 |
| 527 | 2888 | AA924902 | 96.7942 | 572.6298 | 56.5113 | 985.9715 | 212.4677 |
| 1250 | 14960 | AI171319 | 96.7425 | 2827.0198 | 325.2308 | 1623.3914 | 445.4860 |
| 847 | 21796 | AI012221 | 96.5874 | 546.7450 | 109.0500 | 267.5819 | 90.7752 |
| 2338 | 10269 | NM_031838 | 96.4840 | 3223.7554 | 534.9910 | 1981.1927 | 399.6866 |
| 1480 | 20845 | AI231140 | 96.4323 | 756.6490 | 199.2139 | 283.6651 | 204.3095 |
| 1198 | 8339 | AI145761 | 96.3806 | 67.1254 | 3.5227 | 109.8235 | 26.8107 |
| 1014 | 8729 | AI059485 | 96.2771 | 37.7988 | 23.4009 | −26.2680 | 25.5023 |
| 1532 | 4670 | AI233714 | 96.2254 | 651.6486 | 37.0112 | 968.8950 | 197.5406 |
| 706 | 16496 | AA996955 | 96.2254 | 1007.5318 | 80.5526 | 662.3587 | 140.2810 |
| 814 | 19778 | AI010455 | 96.2254 | 162.7704 | 19.4915 | 96.6441 | 28.4757 |
| 888 | 16584 | AI013765 | 96.1737 | 206.5866 | 43.5278 | 99.5119 | 41.5816 |
| 1394 | 7213 | AI179356 | 96.1220 | 982.3286 | 81.0719 | 596.6911 | 156.4134 |
| 733 | 19458 | AA998345 | 96.1220 | 175.6176 | 45.8215 | 81.8809 | 28.5183 |
| 1477 | 13934 | AI231044 | 96.0703 | −9.7620 | 18.9704 | 108.1365 | 52.0482 |
| 677 | 2173 | AA963627 | 96.0703 | 6108.5984 | 663.8294 | 3420.8716 | 1129.3754 |
| 1517 | 11157 | AI232494 | 96.0186 | 1426.7052 | 70.8267 | 1973.4101 | 332.9831 |
| 532 | 23173 | AA925057 | 96.0186 | 2830.0816 | 416.7392 | 1561.9613 | 463.9543 |
| 981 | 6808 | AI045600 | 96.0186 | 633.8266 | 119.9903 | 355.8146 | 97.7043 |
| 1131 | 21927 | AI104117 | 95.9669 | 986.1244 | 93.9318 | 636.1205 | 133.3608 |
| 1071 | 10919 | AI072744 | 95.9152 | 2262.2648 | 491.2299 | 842.8495 | 664.3673 |
| 1302 | 18507 | AI175551 | 95.8635 | 845.7300 | 91.6336 | 509.8879 | 133.9074 |
| 1107 | 19379 | AI102711 | 95.8635 | 483.4050 | 16.0720 | 371.4526 | 67.5500 |
| 2586 | 20046 | NM_145784 | 95.8118 | 36.0804 | 13.2519 | 9.6159 | 8.6421 |
| 154 | 11864 | AA818717 | 95.8118 | 53.4336 | 6.5507 | 86.2261 | 22.5507 |
| 1108 | 22171 | AI102734 | 95.7601 | 459.3624 | 3.3321 | 481.9651 | 81.2899 |
| 502 | 4858 | AA901238 | 95.7601 | 26.0362 | 6.4666 | −26.1668 | 33.6523 |

TABLE 5Y

ISOPROTERENOL
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 2687 | 12978 | X964371 | 98.7552 | 352.9183 | 148.1483 | 76.0207 | 44.1639 |
| 2187 | 15353 | NM_024356 | 98.7552 | 81.3138 | 17.4250 | 18.8333 | 16.0010 |
| 1607 | 10071 | AI639058 | 98.7033 | 821.1028 | 124.3194 | 261.6078 | 96.5124 |
| 1330 | 15191 | AI176456 | 98.5996 | 2781.0180 | 387.0119 | 163.7317 | 512.0743 |
| 2267 | 18597 | NM_031325 | 98.4959 | 499.5431 | 190.0962 | 91.7173 | 49.7384 |
| 1944 | 21663 | NM_017126 | 98.4440 | 1334.9931 | 249.2728 | 374.6519 | 167.2969 |
| 2624 | 21654 | U53184 | 98.4440 | 611.2753 | 171.5647 | 201.7092 | 64.9493 |
| 1931 | 923 | NM_017076 | 98.4440 | 90.8740 | 16.6163 | 16.7889 | 18.4273 |
| 65 | 18349 | AA799744 | 98.4440 | 478.1215 | 106.8624 | 173.0242 | 57.0200 |
| 2550 | 15189 | NM_138826 | 98.4440 | 1742.6363 | 442.7734 | 328.3733 | 338.7748 |
| 1228 | 5297 | AI170379 | 98.3921 | 615.3920 | 146.7141 | 202.9419 | 86.0200 |
| 2005 | 355 | NM_017334 | 98.3921 | 144.1484 | 66.8185 | 9.0417 | 25.8332 |

TABLE 5Y-continued

ISOPROTERENOL
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 405 | 19085 | AA892598 | 98.3402 | 105.9926 | 7.1071 | 51.9125 | 13.5311 |
| 253 | 14213 | AA859827 | 98.3402 | 81.8985 | 39.5920 | 5.9781 | 18.6993 |
| 2187 | 15349 | NM_024356 | 98.3402 | 33.7044 | 5.1757 | 5.5100 | 7.7175 |
| 2539 | 606 | NM_134352 | 98.1846 | 51.3164 | 25.3613 | −42.5922 | 30.7423 |
| 1769 | 9423 | NM_012649 | 98.1328 | 553.7720 | 184.8660 | 164.9800 | 70.6014 |
| 1746 | 23871 | NM_012551 | 98.0809 | 97.1849 | 16.2049 | 41.7192 | 22.3572 |
| 2044 | 17908 | NM_019242 | 98.0290 | 175.6236 | 70.8006 | 43.3557 | 32.3530 |
| 2299 | 24235 | NM_031614 | 97.7178 | 502.2883 | 120.4755 | 200.2612 | 69.1510 |
| 434 | 16168 | AA893280 | 97.6660 | 419.3260 | 99.7763 | 174.7149 | 51.2477 |
| 1746 | 23868 | NM_012551 | 97.6141 | 878.2495 | 232.1880 | 212.7525 | 223.4270 |
| 1682 | 4407 | H33528 | 97.4585 | 149.4351 | 30.5043 | 76.4713 | 20.9009 |
| 2403 | 21445 | NM_053587 | 97.3548 | 101.0935 | 31.3816 | 10.1848 | 21.8312 |
| 2551 | 16248 | NM_138827 | 97.3548 | 137.3399 | 55.4662 | 59.6988 | 28.2691 |
| 2276 | 12580 | NM_031514 | 97.2510 | 39.1018 | 3.7604 | 19.4473 | 9.3645 |
| 2141 | 21063 | NM_022585 | 97.0954 | 269.1979 | 68.9186 | 138.1918 | 40.8935 |
| 1835 | 2555 | NM_012967 | 96.9917 | 102.6296 | 18.5182 | 45.7962 | 22.3728 |
| 1715 | 15580 | M33648 | 96.8880 | 20.8356 | 3.6311 | 57.5401 | 27.3956 |
| 2665 | 21657 | X61381 | 96.5249 | 1417.1173 | 72.5551 | 952.3487 | 227.6092 |
| 2413 | 857 | NM_053633 | 96.1100 | 28.9336 | 7.8593 | 10.3651 | 7.6321 |
| 450 | 12031 | AA893860 | 95.9025 | 122.3580 | 16.6208 | 79.3065 | 16.2251 |
| 370 | 13420 | AA892042 | 95.8506 | 741.9540 | 177.3292 | 447.9899 | 97.0308 |
| 1956 | 21975 | NM_017154 | 95.6950 | 379.2371 | 82.7804 | 179.8726 | 77.7814 |
| 2273 | 18654 | NM_031358 | 94.9170 | 91.0856 | 22.2450 | 218.8543 | 64.7382 |
| 250 | 22670 | AA859750 | 94.9170 | 87.7800 | 10.8918 | 58.5102 | 22.1820 |
| 304 | 15372 | AA875205 | 94.8133 | 276.3340 | 31.1240 | 196.9995 | 35.3333 |
| 2553 | 23166 | NM_138839 | 94.5539 | 174.9606 | 35.0933 | 108.1004 | 29.0997 |
| 2302 | 21772 | NM_031624 | 94.5021 | 31.5186 | 6.3787 | 53.9458 | 13.9213 |
| 268 | 17217 | AA866299 | 94.1390 | 220.3939 | 63.2378 | 406.5476 | 79.2552 |
| 1631 | 20461 | AI639350 | 93.5166 | 39.6906 | 11.3937 | 86.3883 | 45.2957 |
| 1901 | 1495 | NM_013221 | 93.2054 | 58.7065 | 13.0068 | 97.8139 | 21.3675 |
| 1959 | 20702 | NM_017166 | 93.1017 | 62.6646 | 15.8674 | 150.4033 | 64.8806 |
| 1677 | 6980 | H330011 | 93.0498 | 73.5706 | 20.6392 | 148.6863 | 42.9104 |
| 2359 | 12364 | NM_033351 | 92.7386 | 78.0485 | 30.5955 | 150.6970 | 39.5405 |
| 247 | 22406 | AA859680 | 92.5311 | 32.1614 | 7.8468 | 71.1168 | 25.7014 |
| 2550 | 15190 | NM_138826 | 92.2977 | 1513.5051 | 492.4513 | 233.0620 | 318.7829 |
| 2373 | 1609 | NM_053338 | 92.2977 | 2384.3983 | 748.6648 | 861.9603 | 250.1131 |
| 1855 | 11114 | NM_013046 | 92.2459 | 107.3391 | 45.4225 | 30.9844 | 37.0615 |
| 1828 | 18695 | NM_012931 | 92.2459 | 186.5778 | 60.9505 | 34.3160 | 37.8180 |
| 1746 | 23872 | NM_012551 | 92.1940 | 254.0449 | 68.2202 | 53.3226 | 76.4607 |
| 2268 | 11258 | NM_031327 | 92.1421 | 76.6668 | 51.8112 | 7.9910 | 23.7166 |
| 1821 | 24431 | NM_012912 | 92.0902 | 246.7884 | 51.7590 | 75.3299 | 74.6725 |
| 1866 | 357 | NM_013086 | 92.0384 | 131.7186 | 56.3783 | 24.7360 | 14.8555 |
| 2292 | 24219 | NM_031579 | 91.9865 | 700.8180 | 165.0733 | 293.2780 | 76.0644 |
| 2695 | 8664 | Z75029 | 91.9346 | 449.4940 | 184.1137 | 121.8197 | 232.3482 |
| 2229 | 79 | NM_031079 | 91.9087 | 12.5920 | 13.4528 | 46.8587 | 17.6624 |
| 1759 | 2629 | NM_012603 | 91.7790 | 79.7505 | 28.9873 | 21.0142 | 16.1187 |
| 1746 | 23869 | NM_012551 | 91.6234 | 191.3961 | 43.7164 | 41.5583 | 60.3323 |
| 1759 | 2628 | NM_012603 | 91.6234 | 50.0411 | 22.4365 | 9.9134 | 14.5363 |
| 104 | 13930 | AA800613 | 91.5716 | 341.2365 | 123.7107 | 109.7446 | 63.8078 |
| 1402 | 16081 | AI179610 | 91.4678 | 283.1665 | 71.6150 | 86.3178 | 64.8101 |
| 2437 | 16173 | NM_053822 | 91.4678 | 135.4999 | 115.5643 | 12.7211 | 22.2919 |
| 1589 | 21653 | AI237535 | 91.4678 | 256.8784 | 47.5480 | 115.5382 | 39.5117 |
| 317 | 15558 | AA875537 | 91.2863 | 400.9904 | 54.7628 | 284.1459 | 67.0559 |
| 2299 | 24234 | NM_031614 | 91.2604 | 178.7678 | 52.1777 | 76.5083 | 31.2171 |
| 1961 | 17301 | NM_017173 | 91.2344 | 244.7880 | 65.1023 | 503.6495 | 155.3687 |
| 2352 | 1171 | NM_032071 | 91.1826 | 12.3360 | 7.3422 | 42.4541 | 18.2492 |
| 405 | 19086 | AA892598 | 91.1566 | 182.9205 | 84.7158 | 74.4652 | 25.8672 |
| 2168 | 3337 | NM_022961 | 90.9751 | 32.8491 | 7.7769 | 56.5652 | 15.7571 |
| 319 | 15618 | AA875620 | 90.9492 | 170.6329 | 45.1415 | 99.3937 | 20.2053 |
| 325 | 5384 | AA891041 | 90.8973 | 221.5421 | 77.2111 | 41.6013 | 55.6977 |
| 1783 | 25264 | NM_012735 | 90.8973 | 227.0814 | 69.5155 | 87.0662 | 38.0346 |
| 1880 | 21683 | NM_013154 | 90.8454 | 148.5981 | 40.5336 | 48.4630 | 35.2076 |
| 1751 | 16080 | NM_012580 | 90.7936 | 127.7414 | 44.5598 | 16.1566 | 40.0453 |
| 2396 | 15708 | NM_053565 | 90.6898 | 37.3911 | 38.2594 | 5.3283 | 17.9073 |
| 1880 | 21682 | NM_013154 | 90.6380 | 52.7226 | 24.3565 | −9.6802 | 55.4380 |
| 2484 | 19481 | NM_057153 | 90.6120 | 60.8750 | 24.6242 | 130.6872 | 42.4070 |
| 2052 | 20735 | NM_019283 | 90.5861 | 206.9780 | 37.1741 | 101.6782 | 47.8880 |
| 2410 | 13005 | NM_053623 | 90.5861 | 40.8021 | 15.7360 | 18.3284 | 7.0857 |
| 1747 | 6478 | NM_012559 | 90.5861 | 25.7568 | 8.7839 | 5.2883 | 15.5425 |
| 2188 | 1146 | NM_024359 | 90.5083 | 44.9031 | 8.1407 | 26.2567 | 11.3719 |
| 1985 | 15299 | NM_017259 | 90.4305 | 197.4190 | 65.7521 | 89.0845 | 56.6466 |
| 2528 | 244 | NM_133551 | 90.3786 | 156.3640 | 46.9174 | 62.8042 | 43.9511 |

TABLE 5Y-continued

ISOPROTERENOL
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 2395 | 4327 | NM_053563 | 90.3786 | 167.6989 | 32.2599 | 91.1153 | 27.1878 |
| 1767 | 1844 | NM_012637 | 90.3786 | 273.3641 | 60.0557 | 161.2621 | 33.1657 |
| 1985 | 15301 | NM_017259 | 90.2749 | 275.3141 | 71.8896 | 99.3702 | 83.5499 |
| 2180 | 21696 | NM_024152 | 90.1712 | 248.2800 | 45.9105 | 148.8757 | 35.6262 |
| 2358 | 23715 | NM_033237 | 90.1712 | 50.0364 | 19.5135 | 9.8703 | 25.3169 |
| 71 | 11530 | AA799773 | 90.1193 | 574.8966 | 215.2208 | 208.9971 | 171.5733 |
| 2178 | 1742 | NM_024150 | 90.0674 | 92.4420 | 22.6140 | 32.5742 | 21.6654 |
| 23 | 18396 | AA799330 | 90.0156 | 120.3561 | 28.1293 | 42.0418 | 30.9956 |
| 2406 | 21709 | NM_053596 | 89.8081 | 404.6953 | 99.5321 | 253.0117 | 57.5390 |
| 2282 | 18389 | NM_031545 | 89.7562 | 2201.3679 | 666.7713 | 822.4031 | 1450.9286 |
| 2247 | 19040 | NM_031114 | 89.7562 | 479.3534 | 100.1299 | 253.0582 | 74.9023 |
| 57 | 20981 | AA799636 | 89.6784 | 7.4018 | 4.3907 | 22.2741 | 10.9001 |
| 328 | 11940 | AA891108 | 89.6006 | 45.3046 | 7.7585 | 25.0555 | 8.4377 |
| 1815 | 16871 | NM_012887 | 89.4450 | 36.4405 | 7.8425 | 83.1332 | 23.8242 |
| 1929 | 11153 | NM_017073 | 89.3932 | 810.0581 | 106.9252 | 466.5159 | 161.7207 |
| 2687 | 25770 | X96437 | 89.3932 | 312.4753 | 89.7107 | 158.6471 | 58.7619 |
| 1575 | 15051 | AI236332 | 99.0664 | 443.4744 | 120.1727 | 118.1688 | 105.2816 |
| 2390 | 14380 | NM_053536 | 99.0145 | 109.7573 | 20.4326 | 393.4073 | 117.0146 |
| 1445 | 15212 | AI229753 | 98.9627 | 247.3969 | 36.9788 | 55.3243 | 36.0133 |
| 1134 | 11522 | AI104303 | 98.9627 | 578.4656 | 132.9934 | 132.2183 | 69.5679 |
| 1063 | 10837 | AI072144 | 98.8071 | 313.3713 | 78.4539 | 83.4558 | 36.8555 |
| 778 | 3278 | AI008988 | 98.8071 | 657.2108 | 312.5556 | 98.5710 | 63.9682 |
| 1380 | 22197 | AI178527 | 98.7552 | 318.3303 | 41.7592 | 117.6359 | 47.2927 |
| 635 | 9452 | AA955206 | 98.7552 | 2066.7979 | 515.2685 | 256.7530 | 195.9874 |
| 1207 | 12979 | AI169177 | 98.6515 | 1450.3701 | 617.2876 | 307.5710 | 166.2674 |
| 1554 | 6632 | AI235277 | 98.5996 | 264.5670 | 28.3884 | 123.5062 | 41.0642 |
| 559 | 23005 | AA942770 | 98.5996 | 429.3003 | 118.3420 | 92.8878 | 61.3990 |
| 900 | 16631 | AI028856 | 98.5996 | 454.1945 | 144.2120 | 63.0882 | 68.9947 |
| 1321 | 12999 | AI176276 | 98.5477 | 2114.0113 | 468.0488 | 323.5830 | 261.2734 |
| 2197 | 13634 | NM_024403 | 98.5477 | 1799.7813 | 262.5017 | 816.4888 | 202.0960 |
| 1311 | 22311 | AI176007 | 98.5477 | 430.7144 | 129.7666 | 141.0606 | 46.3543 |
| 781 | 21632 | AI009167 | 98.5477 | 635.4675 | 93.9765 | 199.9939 | 94.6385 |
| 495 | 23038 | AA900881 | 98.5477 | 223.4274 | 94.5228 | 19.4000 | 121.8662 |
| 1434 | 16053 | AI228596 | 98.4959 | 688.2729 | 332.0089 | 114.3908 | 65.9618 |
| 1495 | 23165 | AI231799 | 98.4959 | 511.6118 | 163.8996 | 162.7842 | 66.5254 |
| 982 | 10020 | AI045632 | 98.4959 | 245.6274 | 41.4642 | 116.6828 | 99.3943 |
| 1512 | 11873 | AI232326 | 98.3921 | 526.2920 | 199.8569 | 146.4113 | 112.8255 |
| 2197 | 13633 | NM_024403 | 98.3921 | 720.9066 | 85.3469 | 341.2228 | 109.8750 |
| 485 | 4725 | AA900290 | 98.3921 | 702.0448 | 322.4170 | 82.7935 | 80.9031 |
| 2276 | 12581 | NM_031514 | 98.2884 | 104.9441 | 11.7630 | 46.5185 | 19.3381 |
| 694 | 2459 | AA964755 | 98.2884 | 1557.5773 | 429.6716 | 118.6922 | 268.2199 |
| 600 | 22667 | AA945069 | 98.2365 | 195.3284 | 32.8641 | 57.9737 | 39.4160 |
| 1524 | 3823 | AI233147 | 98.1846 | 801.3471 | 113.8072 | 367.7490 | 92.1859 |
| 497 | 22666 | AA900974 | 98.1846 | 237.1916 | 41.8806 | 77.8696 | 37.2347 |
| 1044 | 9583 | AI071185 | 98.0290 | 311.3110 | 95.8546 | 75.2475 | 55.2575 |
| 1391 | 8477 | AI179167 | 97.9772 | 1390.6749 | 243.1126 | 591.4111 | 173.1700 |
| 2087 | 20035 | NM_021754 | 97.9253 | 475.5420 | 132.6227 | 167.5188 | 63.9564 |
| 2516 | 657 | NM_133380 | 97.8734 | 486.1475 | 140.5853 | 223.6214 | 55.7424 |
| 1326 | 3014 | AI176362 | 97.8216 | 67.7219 | 23.1470 | 250.0182 | 74.2719 |
| 1165 | 21019 | AI136547 | 97.8216 | 90.2080 | 16.7173 | 30.2218 | 21.6609 |
| 543 | 4285 | AA925708 | 97.8216 | 162.4419 | 20.6060 | 304.2127 | 62.7546 |
| 891 | 2708 | AI013882 | 97.7697 | 1175.8810 | 187.4086 | 654.7607 | 118.6857 |
| 572 | 22248 | AA943537 | 97.7178 | 884.1129 | 234.6878 | 357.8314 | 137.9962 |
| 638 | 22596 | AA955298 | 97.6660 | 118.2271 | 12.3468 | 69.8706 | 18.3731 |
| 1384 | 23567 | AI178746 | 97.5104 | 182.7065 | 33.4229 | 45.1516 | 63.5584 |
| 956 | 5442 | AI044299 | 97.4585 | 144.7093 | 59.1476 | 432.4571 | 111.2343 |
| 1583 | 22939 | AI236669 | 97.4066 | −22.5254 | 16.7130 | 77.9927 | 39.0291 |
| 1299 | 13460 | AI175375 | 97.3548 | 163.2601 | 30.5731 | 334.8609 | 66.5139 |
| 958 | 5461 | AI044338 | 97.1992 | 270.5833 | 66.6813 | 117.8721 | 40.8380 |
| 579 | 22378 | AA944212 | 97.0954 | 125.3759 | 37.6062 | 272.2137 | 61.3862 |
| 622 | 22711 | AA946072 | 97.0954 | 131.2524 | 15.0016 | 230.5375 | 46.7545 |
| 1503 | 3434 | AI232014 | 97.0436 | 2080.6321 | 375.1512 | 754.8197 | 380.5227 |
| 770 | 11325 | AI008647 | 96.7842 | 18.5315 | 6.2871 | 67.2413 | 34.5907 |
| 1558 | 14094 | AI235377 | 96.5249 | 62.1649 | 6.0106 | 101.0184 | 19.5343 |
| 838 | 2519 | AI011770 | 96.4730 | 115.4741 | 15.6764 | 66.6505 | 20.7364 |
| 913 | 7493 | AI029608 | 96.4212 | 180.9653 | 38.9298 | 78.5313 | 34.8173 |
| 912 | 17451 | AI029450 | 96.4212 | 550.1054 | 54.2374 | 375.8753 | 61.5990 |
| 503 | 4861 | AA901290 | 96.4212 | 86.1575 | 14.1922 | 174.6200 | 46.5278 |
| 572 | 22247 | AA943537 | 96.3693 | 1014.8936 | 169.8130 | 585.7927 | 159.2645 |
| 732 | 3738 | AA998256 | 96.3174 | 414.7075 | 62.2150 | 214.5883 | 63.7076 |
| 880 | 12233 | AI013474 | 96.3174 | 226.4356 | 57.4500 | 105.7821 | 47.8050 |

TABLE 5Z

Isoproterenol—Core Tox Markers
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 2277 | 20448 | NM_031530 | 98.7552 | 735.8648 | 361.8894 | 74.8274 | 112.6130 |
| 2687 | 12978 | X96437 | 98.7552 | 352.9183 | 148.1483 | 76.0207 | 44.1639 |
| 2187 | 15353 | NM_024356 | 98.7552 | 81.3138 | 17.4250 | 18.8333 | 16.0010 |
| 1607 | 10071 | AI639058 | 98.7033 | 821.1028 | 124.3194 | 261.6078 | 96.5124 |
| 1330 | 15191 | AI176456 | 98.5996 | 2781.0180 | 387.0119 | 163.7317 | 512.0743 |
| 2277 | 20449 | NM_031530 | 98.5477 | 998.4564 | 497.2317 | 98.8724 | 167.8554 |
| 2267 | 18597 | NM_031325 | 98.4959 | 499.5431 | 190.0962 | 91.7173 | 49.7384 |
| 1944 | 21663 | NM_017126 | 98.4440 | 1334.9931 | 249.2728 | 374.6519 | 167.2969 |
| 2624 | 21654 | U53184 | 98.4440 | 611.2753 | 171.5647 | 201.7092 | 64.9493 |
| 1931 | 923 | NM_017076 | 98.4440 | 90.8740 | 16.6163 | 16.7889 | 18.4273 |
| 65 | 18349 | AA799744 | 98.4440 | 478.1215 | 106.8624 | 173.0242 | 57.0200 |
| 2550 | 15189 | NM_138826 | 98.4440 | 1742.6363 | 442.7734 | 328.3733 | 338.7748 |
| 1228 | 5297 | AI170379 | 98.3921 | 615.3920 | 146.7141 | 202.9419 | 86.0200 |
| 2005 | 355 | NM_017334 | 98.3921 | 144.1484 | 66.8185 | 9.0417 | 25.8332 |
| 405 | 19085 | AA892598 | 98.3402 | 105.9926 | 7.1071 | 51.9125 | 13.5311 |
| 253 | 14213 | AA859827 | 98.3402 | 81.8985 | 39.5920 | 5.9781 | 18.6993 |
| 2187 | 15349 | NM_024356 | 98.3402 | 33.7044 | 5.1757 | 5.5100 | 7.7175 |
| 2539 | 606 | NM_134352 | 98.1846 | 51.3164 | 25.3613 | −42.5922 | 30.7423 |
| 1769 | 9423 | NM_012649 | 98.1328 | 553.7720 | 184.8660 | 164.9800 | 70.6014 |
| 1746 | 23871 | NM_012551 | 98.0809 | 97.1849 | 16.2049 | 41.7192 | 22.3572 |
| 2044 | 17908 | NM_019242 | 98.0290 | 175.6236 | 70.8006 | 43.3557 | 32.3530 |
| 2105 | 17161 | NM_022298 | 98.0290 | 899.1763 | 458.1172 | 200.9148 | 106.0668 |
| 2435 | 15002 | NM_053819 | 97.9253 | 1147.2365 | 305.9131 | 202.0650 | 167.6146 |
| 2435 | 15003 | NM_053819 | 97.8734 | 1127.1396 | 424.1492 | 88.1165 | 165.1318 |
| 1747 | 6477 | NM_012559 | 97.7697 | 28.2950 | 13.0796 | 4.5515 | 17.6521 |
| 2299 | 24235 | NM_031614 | 97.7178 | 502.2883 | 120.4755 | 200.2612 | 69.1510 |
| 434 | 16168 | AA893280 | 97.6660 | 419.3260 | 99.7763 | 174.7149 | 51.2477 |
| 1746 | 23868 | NM_012551 | 97.6141 | 878.2495 | 232.1880 | 212.7525 | 223.4270 |
| 1854 | 17401 | NM_013043 | 97.4585 | 1283.2069 | 160.7080 | 602.9406 | 233.5276 |
| 1682 | 4407 | H33528 | 97.4585 | 149.4351 | 30.5043 | 76.4713 | 20.9009 |
| 2403 | 21445 | NM_053587 | 97.3548 | 101.0935 | 31.3816 | 10.1848 | 21.8312 |
| 2551 | 16248 | NM_138827 | 97.3548 | 137.3399 | 55.4662 | 59.6988 | 28.2691 |
| 2276 | 12580 | NM_031514 | 97.2510 | 39.1018 | 3.7604 | 19.4473 | 9.3645 |
| 71 | 11531 | AA799773 | 97.1992 | 1234.1090 | 315.0112 | 403.7401 | 287.9205 |
| 2141 | 21063 | NM_022585 | 97.0954 | 269.1979 | 68.9186 | 138.1918 | 40.8935 |
| 1835 | 2555 | NM_012967 | 96.9917 | 102.6296 | 18.5182 | 45.7962 | 22.3728 |
| 1715 | 15580 | M33648 | 96.8880 | 20.8356 | 3.6311 | 57.5401 | 27.3956 |
| 2073 | 574 | NM_019905 | 96.7324 | 1198.1129 | 265.6557 | 601.0594 | 148.9908 |
| 2665 | 21657 | X61381 | 96.5249 | 1417.1173 | 72.5551 | 952.3487 | 227.6092 |
| 2413 | 857 | NM_053633 | 96.1100 | 28.9336 | 7.8593 | 10.3651 | 7.6321 |
| 450 | 12031 | AA893860 | 95.9025 | 122.3580 | 16.6208 | 79.3065 | 16.2251 |
| 370 | 13420 | AA892042 | 95.8506 | 741.9540 | 177.3292 | 447.9899 | 97.0308 |
| 1956 | 21975 | NM_017154 | 95.6950 | 379.2371 | 82.7804 | 179.8726 | 77.7814 |
| 2273 | 18654 | NM_031358 | 94.9170 | 91.0856 | 22.2450 | 218.8543 | 64.7382 |
| 250 | 22670 | AA859750 | 94.9170 | 87.7800 | 10.8918 | 58.5102 | 22.1820 |
| 304 | 15372 | AA875205 | 94.8133 | 276.3340 | 31.1240 | 196.9995 | 35.3333 |
| 2553 | 23166 | NM_138839 | 94.5539 | 174.9606 | 35.0933 | 108.1004 | 29.0997 |
| 2302 | 21772 | NM_031624 | 94.5021 | 31.5186 | 6.3787 | 53.9458 | 13.9213 |
| 268 | 17217 | AA866299 | 94.1390 | 220.3939 | 63.2378 | 406.5476 | 79.2552 |
| 1631 | 20461 | AI639350 | 93.5166 | 39.6906 | 11.3937 | 86.3883 | 45.2957 |
| 1901 | 1495 | NM_013221 | 93.2054 | 58.7065 | 13.0068 | 97.8139 | 21.3675 |
| 1959 | 20702 | NM_017166 | 93.1017 | 62.6646 | 15.8674 | 150.4033 | 64.8806 |
| 1677 | 6980 | H33001 | 93.0498 | 73.5706 | 20.6392 | 148.6863 | 42.9104 |
| 2359 | 12364 | NM_033351 | 92.7386 | 78.0485 | 30.5955 | 150.6970 | 39.5405 |
| 247 | 22406 | AA859680 | 92.5311 | 32.1614 | 7.8468 | 71.1168 | 25.7014 |
| 2311 | 20743 | NM_031684 | 92.4274 | 105.6991 | 15.2831 | 155.1691 | 27.9319 |
| 2550 | 15190 | NM_138826 | 92.2977 | 1513.5051 | 492.4513 | 233.0620 | 318.7829 |
| 2373 | 1609 | NM_053338 | 92.2977 | 2384.3983 | 748.6648 | 861.9603 | 250.1131 |
| 1855 | 11114 | NM_013046 | 92.2459 | 107.3391 | 45.4225 | 30.9844 | 37.0615 |
| 1828 | 18695 | NM_012931 | 92.2459 | 186.5778 | 60.9505 | 34.3160 | 37.8180 |
| 1746 | 23872 | NM_012551 | 92.1940 | 254.0449 | 68.2202 | 53.3226 | 76.4607 |
| 2268 | 11258 | NM_031327 | 92.1421 | 76.6668 | 51.8112 | 7.9910 | 23.7166 |
| 1821 | 24431 | NM_012912 | 92.0902 | 246.7884 | 51.7590 | 75.3299 | 74.6725 |
| 1866 | 357 | NM_013086 | 92.0384 | 131.7186 | 56.3783 | 24.7360 | 14.8555 |
| 2292 | 24219 | NM_031579 | 91.9865 | 700.8180 | 165.0733 | 293.2780 | 76.0644 |
| 2695 | 8664 | Z75029 | 91.9346 | 449.4940 | 184.1137 | 121.8197 | 232.3482 |
| 2229 | 79 | NM_031079 | 91.9087 | 12.5920 | 13.4528 | 46.8587 | 17.6624 |
| 1759 | 2629 | NM_012603 | 91.7790 | 79.7505 | 28.9873 | 21.0142 | 16.1187 |
| 1746 | 23869 | NM_012551 | 91.6234 | 191.3961 | 43.7164 | 41.5583 | 60.3323 |
| 1759 | 2628 | NM_012603 | 91.6234 | 50.0411 | 22.4365 | 9.9134 | 14.5363 |
| 104 | 13930 | AA800613 | 91.5716 | 341.2365 | 123.7107 | 109.7446 | 63.8078 |
| 1402 | 16081 | AI179610 | 91.4678 | 283.1665 | 71.6150 | 86.3178 | 64.8101 |
| 2437 | 16173 | NM_053822 | 91.4678 | 135.4999 | 115.5643 | 12.7211 | 22.2919 |

TABLE 5Z-continued

Isoproterenol--Core Tox Markers
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 1589 | 21653 | AI237535 | 91.4678 | 256.8784 | 47.5480 | 115.5382 | 39.5117 |
| 317 | 15558 | AA875537 | 91.2863 | 400.9904 | 54.7628 | 284.1459 | 67.0559 |
| 2299 | 24234 | NM_031614 | 91.2604 | 178.7678 | 52.1777 | 76.5083 | 31.2171 |
| 1961 | 17301 | NM_017173 | 91.2344 | 244.7880 | 65.1023 | 503.6495 | 155.3687 |
| 2352 | 1171 | NM_032071 | 91.1826 | 12.3360 | 7.3422 | 42.4541 | 18.2492 |
| 405 | 19086 | AA892598 | 91.1566 | 182.9205 | 84.7158 | 74.4652 | 25.8672 |
| 2168 | 3337 | NM_022961 | 90.9751 | 32.8491 | 7.7769 | 56.5652 | 15.7571 |
| 319 | 15618 | AA875620 | 90.9492 | 170.6329 | 45.1415 | 99.3937 | 20.2053 |
| 325 | 5384 | AA891041 | 90.8973 | 221.5421 | 77.2111 | 41.6013 | 55.6977 |
| 1783 | 25264 | NM_012735 | 90.8973 | 227.0814 | 69.5155 | 87.0662 | 38.0346 |
| 1880 | 21683 | NM_013154 | 90.8454 | 148.5981 | 40.5336 | 48.4630 | 35.2076 |
| 1751 | 16080 | NM_012580 | 90.7936 | 127.7414 | 44.5598 | 16.1566 | 40.0453 |
| 2396 | 15708 | NM_053565 | 90.6898 | 37.3911 | 38.2594 | 5.3283 | 17.9073 |
| 1880 | 21682 | NM_013154 | 90.6380 | 52.7226 | 24.3565 | −9.6802 | 55.4380 |
| 2484 | 19481 | NM_057153 | 90.6120 | 60.8750 | 24.6242 | 130.6872 | 42.4070 |
| 2052 | 20735 | NM_019283 | 90.5861 | 206.9780 | 37.1741 | 101.6782 | 47.8880 |
| 2410 | 13005 | NM_053623 | 90.5861 | 40.8021 | 15.7360 | 18.3284 | 7.0857 |
| 1747 | 6478 | NM_012559 | 90.5861 | 25.7568 | 8.7839 | 5.2883 | 15.5425 |
| 2188 | 1146 | NM_024359 | 90.5083 | 44.9031 | 8.1407 | 26.2567 | 11.3719 |
| 2341 | 17735 | NM_031970 | 90.4824 | 2633.2529 | 624.1825 | 1096.1175 | 562.1722 |
| 1985 | 15299 | NM_017259 | 90.4305 | 197.4190 | 65.7521 | 89.0845 | 56.6466 |
| 2528 | 244 | NM_133551 | 90.3786 | 156.3640 | 46.9174 | 62.8042 | 43.9511 |
| 2395 | 4327 | NM_053563 | 90.3786 | 167.6698 | 32.2599 | 91.1153 | 27.1878 |
| 1767 | 1844 | NM_012637 | 90.3786 | 273.3641 | 60.0557 | 161.2621 | 33.1657 |
| 1985 | 15301 | NM_017259 | 90.2749 | 275.3141 | 71.8896 | 99.3702 | 83.5499 |
| 2180 | 21696 | NM_024152 | 90.1712 | 248.2800 | 45.9105 | 148.8757 | 35.6262 |
| 2358 | 23715 | NM_033237 | 90.1712 | 50.0364 | 19.5135 | 9.8703 | 25.3169 |
| 1575 | 15051 | AI236332 | 99.0664 | 443.4744 | 120.1727 | 118.1688 | 105.2816 |
| 2390 | 14380 | NM_053536 | 99.0145 | 109.7573 | 20.4326 | 393.4073 | 117.0146 |
| 1445 | 15212 | AI229753 | 98.9627 | 247.3969 | 36.9788 | 55.3243 | 36.9133 |
| 1134 | 11522 | AI104303 | 98.9627 | 578.4656 | 132.9934 | 132.2183 | 69.5679 |
| 1063 | 10837 | AI072144 | 98.8071 | 313.3713 | 78.4539 | 83.4558 | 36.8555 |
| 778 | 3278 | AI008988 | 98.8071 | 657.2108 | 312.5556 | 98.5710 | 63.9682 |
| 1380 | 22197 | AI178527 | 98.7552 | 318.3303 | 41.7592 | 117.6359 | 47.2927 |
| 635 | 9452 | AA955206 | 98.7552 | 2066.7979 | 515.2685 | 256.7530 | 195.9874 |
| 1207 | 12979 | AI169177 | 98.6515 | 1450.3701 | 617.2876 | 307.5710 | 166.2674 |
| 1554 | 6632 | AI235277 | 98.5996 | 264.5670 | 28.3884 | 123.5062 | 41.0642 |
| 559 | 23005 | AA942770 | 98.5996 | 429.3003 | 118.3420 | 92.8878 | 61.3990 |
| 900 | 16631 | AI028856 | 98.5996 | 454.1945 | 144.2120 | 63.0882 | 68.9947 |
| 1321 | 12999 | AI176276 | 98.5477 | 2114.0113 | 468.0488 | 323.5830 | 261.2734 |
| 2197 | 13634 | NM_024403 | 98.5477 | 1799.7813 | 262.5017 | 816.4888 | 202.0960 |
| 1311 | 22311 | AI176007 | 98.5477 | 430.7144 | 129.7666 | 141.0606 | 46.3543 |
| 781 | 21632 | AI009167 | 98.5477 | 635.4675 | 93.9765 | 199.9939 | 94.6385 |
| 495 | 23038 | AA900881 | 98.5477 | 223.4274 | 94.5228 | 19.4000 | 121.8662 |
| 1434 | 16053 | AI228596 | 98.4959 | 688.2729 | 332.0089 | 114.3908 | 65.9618 |
| 1495 | 23165 | AI231799 | 98.4959 | 511.6118 | 163.8996 | 162.7842 | 66.5254 |
| 982 | 10020 | AI045632 | 98.4959 | 245.6274 | 41.4642 | 116.6828 | 99.3943 |
| 1512 | 11873 | AI232326 | 98.3921 | 526.2920 | 199.8569 | 146.4113 | 112.8255 |
| 2197 | 13633 | NM_024403 | 98.3921 | 720.9066 | 85.3469 | 341.2228 | 109.8750 |
| 485 | 4725 | AA900290 | 98.3921 | 702.0448 | 322.4170 | 82.7935 | 80.9031 |
| 687 | 18830 | AA964496 | 98.3402 | 7951.0865 | 1512.4960 | 3660.0327 | 894.6208 |
| 2276 | 12581 | NM_031514 | 98.2884 | 104.9441 | 11.7630 | 46.5185 | 19.3381 |
| 694 | 2459 | AA964755 | 98.2884 | 1557.5773 | 429.6716 | 118.6922 | 268.2199 |
| 600 | 22667 | AA945069 | 98.2365 | 195.3284 | 32.8641 | 57.9737 | 39.4160 |
| 1524 | 3823 | AI233147 | 98.1846 | 801.3471 | 113.8072 | 367.7490 | 92.1859 |
| 497 | 22666 | AA900974 | 98.1846 | 237.1916 | 41.8806 | 77.8696 | 37.2347 |
| 1044 | 9583 | AI071185 | 98.0290 | 311.3110 | 95.8546 | 75.2475 | 55.2575 |
| 1391 | 8477 | AI179167 | 97.9772 | 1390.6749 | 243.1126 | 591.4111 | 173.1700 |
| 1553 | 15004 | AI235224 | 97.9253 | 1643.2824 | 595.2255 | 326.5114 | 242.7752 |
| 1248 | 22432 | AI171263 | 97.9253 | 247.4485 | 31.3929 | 123.2399 | 35.0023 |
| 2087 | 20035 | NM_021754 | 97.9253 | 475.5420 | 132.6227 | 167.5188 | 63.9564 |
| 2516 | 657 | NM_13338 | 97.8734 | 486.1475 | 140.5853 | 223.6214 | 55.7424 |
| 1326 | 3014 | AI176362 | 97.8216 | 67.7219 | 23.1470 | 250.0182 | 74.2719 |
| 1165 | 21019 | AI136547 | 97.8216 | 90.2080 | 16.7173 | 30.2218 | 21.6609 |
| 543 | 4285 | AA925708 | 97.8216 | 162.4419 | 20.6060 | 304.2127 | 62.7546 |
| 873 | 20086 | AI013260 | 97.7697 | 672.3814 | 66.6413 | 325.3166 | 119.2784 |
| 891 | 2708 | AI013882 | 97.7697 | 1175.8810 | 187.4086 | 654.7607 | 118.6857 |
| 847 | 21796 | AI012221 | 97.7178 | 588.2593 | 92.7064 | 266.3687 | 88.3268 |
| 572 | 22248 | AA943537 | 97.7178 | 884.1129 | 234.6878 | 357.8314 | 137.9962 |
| 638 | 22596 | AA955298 | 97.6660 | 118.2271 | 12.3468 | 69.8706 | 18.3731 |
| 1384 | 23567 | AI178746 | 97.5104 | 182.7065 | 33.4229 | 45.1516 | 63.5584 |
| 956 | 5442 | AI044299 | 97.4585 | 144.7093 | 59.1476 | 432.4571 | 111.2343 |
| 1583 | 22939 | AI236669 | 97.4066 | −22.5254 | 16.7130 | 77.9927 | 39.0291 |

TABLE 5Z-continued

Isoproterenol--Core Tox Markers
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 1299 | 13460 | AI175375 | 97.3548 | 163.2601 | 30.5731 | 334.8609 | 66.5139 |
| 958 | 5461 | AI044338 | 97.1992 | 270.5833 | 66.6813 | 117.8721 | 40.8380 |
| 579 | 22378 | AA944212 | 97.0954 | 125.3759 | 37.6062 | 272.2137 | 61.3862 |
| 622 | 22711 | AA946072 | 97.0954 | 131.2524 | 15.0016 | 230.5375 | 46.7545 |
| 1503 | 3434 | AI232014 | 97.0436 | 2080.6321 | 375.1512 | 754.8197 | 380.5227 |
| 770 | 11325 | AI008647 | 96.7842 | 18.5315 | 6.2871 | 67.2413 | 34.5907 |
| 1558 | 14094 | AI235377 | 96.5249 | 62.1649 | 6.0106 | 101.0184 | 19.5343 |
| 1264 | 4420 | AI171916 | 96.5249 | 259.2045 | 27.0460 | 447.5475 | 93.3492 |
| 838 | 2519 | AI011770 | 96.4730 | 115.4741 | 15.6764 | 66.6505 | 20.7364 |
| 913 | 7493 | AI029608 | 96.4212 | 180.9653 | 38.9298 | 78.5313 | 34.8173 |
| 912 | 7451 | AI029450 | 96.4212 | 550.1054 | 54.2374 | 375.8753 | 61.5990 |
| 503 | 4861 | AA901290 | 96.4212 | 86.1575 | 14.1922 | 174.6200 | 46.5278 |
| 572 | 22247 | AA943537 | 96.3693 | 1014.8936 | 169.8130 | 585.7927 | 159.2645 |
| 732 | 3738 | AA998256 | 96.3174 | 414.7075 | 62.2150 | 214.5883 | 63.7076 |
| 880 | 12233 | AI013474 | 96.3174 | 226.4356 | 57.4500 | 105.7821 | 47.8050 |

TABLE 5AA

MINOXIDIL
Timepoint(s): 24, 360 hrs

| SEQ ID | GLGC ID | GenBank Accession No. | LDA Score | Mean Tox | SD Tox | Mean Nontox | SD Nontox |
|---|---|---|---|---|---|---|---|
| 1686 | 17159 | J00797 | 97.9296 | 1535.1755 | 76.9139 | 1018.2949 | 243.6029 |
| 2076 | 13486 | NM_020306 | 94.7205 | 111.6373 | 12.2897 | 62.1586 | 24.2603 |
| 112 | 19101 | AA800787 | 92.5983 | 122.8642 | 21.7259 | 204.4361 | 48.1276 |
| 2502 | 4739 | NM_130400 | 92.3395 | 86.8648 | 11.3728 | 57.5600 | 18.1403 |
| 2691 | 18352 | Z12298 | 91.7184 | 1509.5612 | 194.6524 | 1119.9762 | 225.6242 |
| 1792 | 17257 | NM_012766 | 91.4596 | 489.6277 | 39.4658 | 363.6353 | 115.5172 |
| 1779 | 20889 | NM_012716 | 89.9068 | 191.0543 | 22.3705 | 290.7158 | 82.0058 |
| 2545 | 19077 | NM_134455 | 89.8551 | 104.0118 | 22.2276 | 64.1095 | 30.6956 |
| 2399 | 653 | NM_053580 | 89.8033 | 58.0272 | 12.7224 | 113.7814 | 42.1623 |
| 1888 | 22306 | NM_013179 | 89.8033 | 118.8083 | 6.6397 | 97.5426 | 27.7850 |
| 1651 | 20519 | C06598 | 89.6480 | 247.3042 | 32.4829 | 184.0616 | 41.4326 |
| 2331 | 2114 | NM_031798 | 89.5445 | 102.2935 | 19.1370 | 63.3928 | 27.2316 |
| 2023 | 278 | NM_019150 | 89.3375 | 28.2742 | 1.4531 | 21.2334 | 10.4896 |
| 2047 | 24849 | NM_019248 | 89.1304 | 57.0278 | 15.2284 | 26.7227 | 18.9685 |
| 2031 | 23481 | NM_019185 | 88.6128 | 180.5617 | 37.1558 | 279.0484 | 69.0602 |
| 898 | 15247 | AI014169 | 88.3540 | 594.1170 | 90.9858 | 1036.0101 | 387.3794 |
| 449 | 4556 | AA893811 | 88.3023 | 57.4057 | 5.5534 | 73.5059 | 14.2452 |
| 342 | 4447 | AA891596 | 88.2505 | 6.5295 | 4.3706 | 22.5996 | 11.6781 |
| 1861 | 21830 | NM_013073 | 88.1988 | 22.2358 | 13.4090 | 6.4232 | 13.2608 |
| 1423 | 22845 | AI227887 | 87.9917 | 972.4108 | 249.9982 | 663.3576 | 133.7391 |
| 1998 | 14004 | NM_017305 | 87.9917 | 6.1840 | 3.9783 | 20.6089 | 11.3367 |
| 1983 | 1496 | NM_017255 | 87.8882 | 38.5365 | 3.3711 | 30.4905 | 10.1674 |
| 2688 | 19279 | Y00350 | 87.7329 | 148.6213 | 8.3623 | 175.1188 | 22.8916 |
| 470 | 24329 | AA899253 | 87.6294 | 177.1675 | 35.5945 | 115.9628 | 50.3133 |
| 452 | 3446 | AA893970 | 87.6294 | 21.0733 | 5.0581 | 35.2549 | 11.3903 |
| 456 | 22584 | AA894009 | 87.6294 | 27.7973 | 1.6250 | 30.4191 | 13.5657 |
| 2067 | 1324 | NM_019371 | 87.2153 | 461.6210 | 49.8053 | 604.8895 | 117.9678 |
| 1770 | 16217 | NM_012656 | 87.1118 | 3824.9220 | 882.7480 | 2319.0562 | 624.0469 |
| 1712 | 15049 | M24542 | 87.1118 | 4504.9502 | 852.5258 | 3170.1238 | 567.3331 |
| 2067 | 1323 | NM_019371 | 87.1118 | 74.5447 | 34.6738 | 84.6947 | 78.3095 |
| 2347 | 18499 | NM_031984 | 87.0600 | 149.7308 | 36.8585 | 184.3176 | 23.5573 |
| 2286 | 18317 | NM_031561 | 86.8530 | 266.9008 | 101.6113 | 637.2423 | 290.5617 |
| 2677 | 24232 | X75207 | 86.7495 | 107.0823 | 23.2712 | 53.3905 | 21.7130 |
| 1689 | 17136 | J04035 | 86.6977 | 765.2605 | 188.8314 | 518.4444 | 370.7999 |
| 2232 | 15203 | NM_031093 | 86.5424 | 209.2850 | 18.7806 | 175.4825 | 31.2844 |
| 2301 | 15767 | NM_031623 | 86.5424 | 153.3083 | 19.9098 | 214.1710 | 51.9186 |
| 611 | 20619 | AA945737 | 86.5424 | 8.4417 | 3.6252 | 22.0994 | 13.3336 |
| 316 | 24470 | AA875523 | 86.4907 | 5199.1175 | 1173.8016 | 3543.3523 | 655.6704 |
| 1762 | 638 | NM_012613 | 86.3872 | 220.1460 | 41.7079 | 154.1979 | 27.6018 |
| 1743 | 20704 | NM_012541 | 86.2836 | 55.3490 | 10.3700 | 38.4184 | 13.4073 |
| 1872 | 38 | NM_013114 | 86.2836 | 39.8378 | 5.5516 | 26.8456 | 15.6675 |
| 1901 | 1495 | NM_013221 | 86.2836 | 78.0432 | 7.0184 | 97.6129 | 21.6056 |
| 2136 | 8597 | NM_022538 | 86.1284 | 196.5925 | 21.7031 | 158.7965 | 41.7885 |
| 1770 | 16220 | NM_012656 | 86.0248 | 3307.8400 | 955.9316 | 1861.1020 | 637.3267 |
| 2560 | 3015 | NM_138895 | 85.7660 | 3456.6195 | 319.6428 | 2832.5081 | 571.0351 |

TABLE 5AA-continued

MINOXIDIL
Timepoint(s): 24, 360 hrs

| SEQ ID | GLGC ID | GenBank Accession No. | LDA Score | Mean Tox | SD Tox | Mean Nontox | SD Nontox |
|---|---|---|---|---|---|---|---|
| 2266 | 15273 | NM_031237 | 85.7660 | 7.8428 | 8.3445 | 41.9616 | 33.9196 |
| 2340 | 25802 | NM_031969 | 85.7143 | 870.9612 | 173.0430 | 599.6281 | 153.6135 |
| 1911 | 24676 | NM_017010 | 85.6625 | 78.1665 | 66.5388 | 29.2018 | 42.2911 |
| 2256 | 15052 | NM_031136 | 85.6625 | 2988.2460 | 1447.5559 | 2738.9965 | 641.1183 |
| 72 | 6425 | AA799784 | 85.6625 | 133.3380 | 19.8127 | 171.6206 | 37.1599 |
| 1773 | 24854 | NM_012676 | 85.6108 | 9986.6790 | 3057.9794 | 5883.6151 | 2004.8095 |
| 2409 | 20243 | NM_053615 | 85.6108 | 102.1265 | 13.6846 | 145.6152 | 39.4919 |
| 1791 | 18066 | NM_012762 | 85.6108 | 29.1457 | 2.4528 | 24.3851 | 10.5830 |
| 2336 | 4748 | NM_031834 | 85.5590 | 10.3340 | 6.7481 | 44.5435 | 44.7903 |
| 262 | 23347 | AA860015 | 85.5072 | 51.3743 | 12.1529 | 75.7981 | 18.3704 |
| 2681 | 25743 | X80130 | 85.4555 | 10896.4638 | 3468.3621 | 6169.2740 | 2236.3347 |
| 1745 | 225 | NM_012544 | 85.4555 | 118.1477 | 6.9233 | 100.7150 | 24.0142 |
| 1829 | 13723 | NM_012935 | 85.4037 | 5941.5757 | 1135.6019 | 4146.5143 | 930.0375 |
| 83 | 18400 | AA799991 | 85.4037 | 23.9422 | 3.9205 | 35.5996 | 11.7212 |
| 2597 | 15693 | S56679 | 85.3520 | 41.9673 | 17.0293 | 11.3160 | 12.6595 |
| 1654 | 19053 | D12770 | 85.3520 | 7254.8842 | 1634.9432 | 4760.8397 | 1174.8799 |
| 2425 | 18175 | NM_053752 | 85.3520 | 1215.6852 | 370.8997 | 1104.2417 | 184.1830 |
| 1757 | 7125 | NM_012595 | 85.3002 | 6166.8172 | 1368.3779 | 4046.9460 | 1056.8198 |
| 2388 | 16135 | NM_053516 | 85.2484 | 10911.3320 | 3922.1706 | 5965.1645 | 2441.7735 |
| 2162 | 2008 | NM_022936 | 85.2484 | 27.9260 | 9.9940 | 62.6626 | 33.8959 |
| 1993 | 20579 | NM_017288 | 85.2484 | 297.5433 | 17.8361 | 330.2801 | 72.3142 |
| 1730 | 25470 | M95791 | 85.1967 | 48.7750 | 31.1751 | 113.5910 | 50.2175 |
| 2392 | 15829 | NM_053551 | 85.0932 | 9.4337 | 4.3052 | 51.1893 | 73.5987 |
| 1950 | 492 | NM_017140 | 85.0932 | 278.1547 | 97.2279 | 204.4257 | 142.3758 |
| 2105 | 17160 | NM_022298 | 85.0414 | 2458.4503 | 584.9161 | 1701.4877 | 418.3734 |
| 323 | 15688 | AA875664 | 85.0414 | 20.8720 | 10.3842 | 3.8851 | 12.5812 |
| 2162 | 2006 | NM_022936 | 85.0414 | 15.7493 | 11.3731 | 48.6313 | 34.3839 |
| 2452 | 1426 | NM_053950 | 84.9896 | 138.3758 | 10.2143 | 164.7051 | 26.7628 |
| 1968 | 14694 | NM_017202 | 84.8861 | 8305.6658 | 1969.5601 | 5139.4218 | 1603.5780 |
| 1433 | 1473 | AI228548 | 84.8344 | 55.8370 | 61.7688 | 87.6367 | 37.7793 |
| 1896 | 20856 | NM_013200 | 84.8344 | 894.7287 | 94.8152 | 1096.4226 | 186.9748 |
| 2073 | 574 | NM_019905 | 84.7826 | 891.9672 | 157.5993 | 604.1970 | 157.9704 |
| 1723 | 457 | M60666 | 84.7826 | 248.1988 | 59.0873 | 158.7303 | 42.8702 |
| 1910 | 8417 | NM_017008 | 84.7826 | 6221.1195 | 1255.4826 | 4274.3303 | 1041.5922 |
| 2291 | 21715 | NM_031578 | 84.7826 | 22.1428 | 13.6070 | 16.2253 | 8.1616 |
| 1627 | 19962 | AI639248 | 84.7826 | 226.9462 | 21.9785 | 185.0458 | 47.1174 |
| 2689 | 17146 | Y07534 | 84.7826 | −18.3883 | 21.4537 | 25.1069 | 46.3683 |
| 1994 | 12349 | NM_017290 | 84.7308 | 10182.5327 | 2968.3730 | 6241.6225 | 2082.2998 |
| 2021 | 14973 | NM_019140 | 84.6791 | −6.8377 | 19.9513 | 35.9551 | 37.2450 |
| 2350 | 20554 | NM_031987 | 84.6791 | 95.3840 | 10.5063 | 75.2273 | 36.9955 |
| 2184 | 16476 | NM_024162 | 84.6273 | 8890.1327 | 2400.0048 | 5819.3897 | 1786.9339 |
| 2048 | 18761 | NM_019250 | 84.5756 | 280.9035 | 65.6858 | 183.3302 | 52.5721 |
| 2447 | 1352 | NM_053880 | 84.5756 | 29.7100 | 6.0583 | 142.8774 | 11.5999 |
| 2657 | 15106 | X57529 | 84.4720 | 2774.0492 | 1085.5440 | 2609.7190 | 530.2224 |
| 745 | 22567 | AB017544 | 84.4203 | 126.3540 | 15.3602 | 99.1372 | 25.0108 |
| 347 | 17039 | AA891727 | 84.3685 | 289.4128 | 117.4056 | 481.3267 | 112.7896 |
| 2379 | 16017 | NM_053401 | 84.3685 | 134.7493 | 10.8127 | 116.8148 | 30.1731 |
| 1930 | 18956 | NM_017075 | 84.3685 | 127.6873 | 13.5706 | 174.9933 | 58.0411 |
| 2202 | 1852 | NM_030826 | 84.3168 | 3436.9930 | 678.2439 | 2513.5506 | 495.5841 |
| 2361 | 23895 | NM_033485 | 84.2650 | 26.6828 | 4.2999 | 17.5019 | 8.6704 |
| 2647 | 25679 | X15013 | 84.2650 | 1560.7147 | 84.3130 | 1414.3321 | 275.4721 |
| 2508 | 1502 | NM_130746 | 84.2133 | 42.7670 | 3.5109 | 53.1598 | 20.5090 |
| 1648 | 7602 | AJ001929 | 84.1615 | 686.2697 | 64.4793 | 525.7856 | 87.1102 |
| 2459 | 15343 | NM_053973 | 84.1615 | 116.0975 | 11.6612 | 141.1608 | 26.3964 |
| 264 | 23585 | AA860029 | 84.1097 | 32.9085 | 23.8997 | 26.0858 | 10.7947 |
| 1327 | 19006 | AI176393 | 94.7205 | 1785.7690 | 198.2123 | 1058.7331 | 328.0473 |
| 2210 | 8815 | NM_030991 | 94.2547 | 388.5743 | 27.2550 | 259.0826 | 76.3901 |
| 1112 | 11723 | AI102896 | 93.9441 | 55.8792 | 10.0073 | 4.4362 | 31.9769 |
| 1952 | 15365 | NM_017147 | 93.8923 | 1108.1207 | 492.5541 | 1030.5675 | 215.3048 |
| 2062 | 2088 | NM_019341 | 92.9607 | 485.9728 | 85.8473 | 307.2277 | 85.7764 |
| 1368 | 22691 | AI177967 | 92.6501 | 1390.9820 | 238.5001 | 919.3204 | 239.7806 |
| 1567 | 14869 | AI236089 | 92.1325 | 123.3242 | 6.6322 | 88.7640 | 36.0959 |
| 871 | 16984 | AI013161 | 92.1325 | 329.9662 | 62.9378 | 602.8346 | 177.1319 |
| 173 | 6168 | AA819606 | 92.0807 | 76.9700 | 5.1471 | 53.9067 | 19.3694 |
| 1306 | 19004 | AI175875 | 91.8219 | 1833.6993 | 213.7395 | 1107.2121 | 448.3080 |
| 806 | 4177 | AI010123 | 91.7702 | 322.1253 | 33.4508 | 486.6640 | 117.9772 |
| 1971 | 20632 | NM_017220 | 91.6149 | 91.8260 | 37.3026 | 192.7485 | 55.4387 |
| 1220 | 13427 | AI169993 | 91.2526 | 4.5580 | 12.9423 | 23.9666 | 12.5520 |
| 2494 | 2541 | NM_080479 | 90.8903 | 67.8027 | 17.9265 | 24.7398 | 26.4131 |
| 1235 | 2534 | AI170632 | 90.8385 | 28.0445 | 4.0410 | 47.2322 | 13.7237 |
| 1058 | 9806 | AI072036 | 90.4762 | 10.4643 | 11.4493 | 34.3519 | 14.8863 |
| 1312 | 12298 | AI176055 | 90.3209 | 86.3223 | 32.0470 | 161.8749 | 46.4191 |

TABLE 5AA-continued

MINOXIDIL
Timepoint(s): 24, 360 hrs

| SEQ ID | GLGC ID | GenBank Accession No. | LDA Score | Mean Tox | SD Tox | Mean Nontox | SD Nontox |
|---|---|---|---|---|---|---|---|
| 929 | 17013 | AI030797 | 90.2174 | 85.4747 | 9.4603 | 122.4431 | 30.6685 |
| 216 | 13627 | AA851493 | 90.0104 | 75.7057 | 5.4585 | 55.9724 | 31.3140 |
| 993 | 8039 | AI058419 | 89.8033 | 183.8938 | 14.1961 | 139.0876 | 49.8228 |
| 969 | 9914 | AI044855 | 89.6998 | −0.4020 | 34.7773 | 72.2003 | 56.1763 |
| 1031 | 8854 | AI070285 | 89.6480 | 67.5712 | 6.2645 | 50.3999 | 28.1094 |
| 1084 | 5421 | AI101270 | 89.5963 | 374.9627 | 38.3972 | 283.4432 | 148.7481 |
| 1364 | 11791 | AI177843 | 89.5445 | 108.2222 | 7.7685 | 139.8817 | 32.9493 |
| 934 | 7842 | AI031052 | 89.5445 | 2.6935 | 8.9314 | 25.5130 | 14.7431 |
| 516 | 12346 | AA924346 | 89.5445 | 472.4318 | 59.0587 | 678.7885 | 440.2343 |
| 808 | 2612 | AI010241 | 89.4410 | 36.9472 | 5.5990 | 57.8448 | 17.5537 |
| 2421 | 13622 | NM_053713 | 89.0787 | 375.5315 | 43.6054 | 253.3860 | 94.4454 |
| 830 | 5983 | AI011070 | 88.9752 | 311.8697 | 61.2478 | 585.0836 | 201.7810 |
| 1443 | 18643 | AI229702 | 88.8716 | 239.7207 | 20.7273 | 306.2247 | 60.9991 |
| 1244 | 22033 | AI171165 | 88.8716 | 132.9733 | 8.2770 | 174.4417 | 52.8980 |
| 1572 | 5007 | AI236229 | 88.8716 | 572.3495 | 40.5614 | 739.8550 | 164.1606 |
| 1242 | 7011 | AI171019 | 88.7681 | 236.2587 | 24.5283 | 327.1433 | 72.6244 |
| 168 | 12305 | AA819220 | 88.7164 | 184.9173 | 25.1616 | 131.5672 | 39.8234 |
| 2126 | 3904 | NM_022516 | 88.5611 | 227.7152 | 28.3711 | 135.5882 | 94.2873 |
| 203 | 6649 | AA850563 | 88.5611 | −10.8562 | 23.5637 | 32.7590 | 148.9578 |
| 789 | 3836 | AI009420 | 88.5093 | 3826.9087 | 290.6592 | 2981.9296 | 664.5439 |
| 649 | 498 | AA956278 | 88.4576 | 888.2553 | 81.8895 | 700.3447 | 149.0531 |
| 2471 | 17330 | NM_054008 | 88.2505 | 91.7602 | 13.7975 | 59.3632 | 23.0230 |
| 937 | 7852 | AI043636 | 88.2505 | 106.6953 | 105.2722 | 312.2733 | 70.4524 |
| 625 | 23027 | AA946264 | 88.1988 | 45.5408 | 2.7099 | 52.7099 | 36.7406 |
| 1066 | 9305 | AI072520 | 88.0952 | 123.7258 | 5.2230 | 142.3025 | 30.6411 |
| 724 | 26114 | AA997904 | 87.9917 | 219.1497 | 24.9829 | 210.3639 | 119.0981 |
| 1473 | 13928 | AI230939 | 87.9400 | 333.4505 | 72.3694 | 529.8971 | 149.5635 |
| 1407 | 6455 | AI179984 | 87.8882 | 314.3333 | 78.4011 | 196.3007 | 97.3929 |
| 1224 | 22942 | AI170251 | 87.8364 | 134.9742 | 30.7739 | 193.5716 | 44.6292 |
| 1363 | 22882 | AI177804 | 87.8364 | 100.1367 | 30.4959 | 165.3614 | 46.6765 |

TABLE 5BB

Minoxidil--Core Tox Markers
Timepoints(s): 24-360 hrs

| SEQ ID | GLGC ID | GenBank Accession No. | LDA Score | Mean Tox | SD Tox | Mean Nontox | SD Nontox |
|---|---|---|---|---|---|---|---|
| 1686 | 17159 | J00797 | 97.9296 | 1535.1755 | 76.9139 | 1018.2949 | 243.6029 |
| 2076 | 13486 | NM_020306 | 94.7205 | 111.6373 | 12.2897 | 62.1586 | 24.2603 |
| 2172 | 21239 | NM_024125 | 94.3064 | 22.3625 | 26.2908 | 120.0252 | 63.2600 |
| 2674 | 16426 | X70369 | 93.7371 | 2794.4317 | 568.1511 | 1664.8534 | 493.6781 |
| 2587 | 20740 | NM_145878 | 93.3230 | 658.5560 | 67.8767 | 450.2627 | 144.3448 |
| 2575 | 21818 | NM_139342 | 93.2195 | 67.1282 | 17.1294 | 35.9466 | 17.7241 |
| 112 | 19101 | AA800787 | 92.5983 | 122.8642 | 21.7259 | 204.4361 | 48.1276 |
| 2502 | 4739 | NM_130400 | 92.3395 | 86.8648 | 11.3728 | 57.5600 | 18.1403 |
| 2691 | 18352 | Z12298 | 91.7184 | 1509.5612 | 194.6524 | 1119.9762 | 225.6242 |
| 1792 | 17257 | NM_012766 | 91.4596 | 489.6277 | 39.4658 | 363.6353 | 115.5172 |
| 2680 | 25094 | X77117 | 90.8903 | 180.9713 | 12.3123 | 130.5678 | 45.9415 |
| 1667 | 22762 | D89730 | 90.5797 | 16.6943 | 4.8300 | 38.5006 | 16.7286 |
| 1754 | 15098 | NM_012588 | 90.5797 | 40.3148 | 6.5807 | 80.3784 | 48.0732 |
| 1779 | 20889 | NM_012716 | 89.9068 | 191.0543 | 22.3705 | 290.7158 | 82.0058 |
| 2545 | 19077 | NM_134455 | 89.8551 | 104.0118 | 22.2276 | 64.1095 | 30.6956 |
| 2399 | 653 | NM_053580 | 89.8033 | 58.0272 | 12.7224 | 113.7814 | 42.1623 |
| 1888 | 22306 | NM_013179 | 89.8033 | 118.8083 | 6.6397 | 97.5426 | 27.7850 |
| 1651 | 20519 | C06598 | 89.6480 | 247.3042 | 32.4829 | 184.0616 | 41.4326 |
| 2331 | 2114 | NM_031798 | 89.5445 | 102.2935 | 19.1370 | 63.3928 | 27.2316 |
| 2023 | 278 | NM_019150 | 89.3375 | 28.2742 | 1.4531 | 21.2334 | 10.4896 |
| 2336 | 4749 | NM_031834 | 89.3375 | 118.0348 | 10.6809 | 199.1591 | 80.4388 |
| 2047 | 24849 | NM_019248 | 89.1304 | 57.0278 | 15.2284 | 26.7227 | 18.9685 |
| 1951 | 24106 | NM_017141 | 89.1304 | 16.5707 | 2.1016 | 27.3165 | 10.7777 |
| 2696 | 15569 | Z78279 | 88.9752 | 515.0702 | 33.0112 | 450.4971 | 188.3790 |
| 2031 | 23481 | NM_019185 | 88.6128 | 180.5617 | 37.1558 | 279.0484 | 69.0602 |
| 898 | 15247 | AI014169 | 88.3540 | 594.1170 | 90.9858 | 1036.0101 | 387.3794 |
| 449 | 4556 | AA893811 | 88.3023 | 57.4057 | 5.5534 | 73.5059 | 14.2452 |
| 342 | 4447 | AA891596 | 88.2505 | 6.5295 | 4.3706 | 22.5996 | 11.6781 |
| 1861 | 21830 | NM_013073 | 88.1988 | 22.2358 | 13.4090 | 6.4232 | 13.2608 |
| 1423 | 22845 | AI227887 | 87.9917 | 972.4108 | 249.9982 | 663.3576 | 133.7391 |

TABLE 5BB-continued

Minoxidil--Core Tox Markers
Timepoints(s): 24-360 hrs

| SEQ ID | GLGC ID | GenBank Accession No. | LDA Score | Mean Tox | SD Tox | Mean Nontox | SD Nontox |
|---|---|---|---|---|---|---|---|
| 1998 | 14004 | NM_017305 | 87.9917 | 6.1840 | 3.9783 | 20.6089 | 11.3367 |
| 2347 | 18500 | NM_031984 | 87.8882 | 417.7607 | 156.7008 | 261.4327 | 60.1646 |
| 1874 | 2005 | NM_013127 | 87.8882 | 15.2705 | 9.9215 | 40.6188 | 18.0238 |
| 1983 | 1496 | NM_017255 | 87.8882 | 38.5365 | 3.3711 | 30.4905 | 10.1674 |
| 2688 | 19279 | Y00350 | 87.7329 | 148.6213 | 8.3623 | 175.1188 | 22.8916 |
| 470 | 24329 | AA899253 | 87.6294 | 177.1675 | 35.5945 | 115.9628 | 50.3133 |
| 452 | 3446 | AA893970 | 87.6294 | 21.0733 | 15.0581 | 35.2549 | 11.3903 |
| 456 | 22584 | AA894009 | 87.6294 | 27.7973 | 1.6250 | 30.4191 | 13.5657 |
| 1774 | 1514 | NM_012678 | 87.3706 | 350.3045 | 76.6199 | 236.9005 | 131.7093 |
| 2067 | 1324 | NM_019371 | 87.2153 | 461.6210 | 49.8053 | 604.8895 | 117.9678 |
| 1770 | 16217 | NM_012656 | 87.1118 | 3824.9220 | 882.7480 | 2319.0562 | 624.0469 |
| 1712 | 15049 | M24542 | 87.1118 | 4504.9502 | 852.5258 | 3170.1238 | 567.3331 |
| 256 | 22773 | AA859885 | 87.1118 | 770.9792 | 186.8368 | 456.0336 | 110.1548 |
| 2067 | 1323 | NM_019371 | 87.1118 | 74.5447 | 34.6738 | 184.6947 | 78.3095 |
| 9 | 16130 | J01435 | 87.0600 | 11743.3033 | 4153.6583 | 5911.3587 | 2296.0001 |
| 2347 | 18499 | NM_031984 | 87.0600 | 149.7308 | 36.8585 | 84.3176 | 23.5573 |
| 9 | 25319 | J01435 | 86.9565 | 15949.7140 | 5786.8404 | 8021.2090 | 3356.7757 |
| 2286 | 18317 | NM_031561 | 86.8530 | 266.9008 | 101.6113 | 637.2423 | 290.5617 |
| 2677 | 24232 | X75207 | 86.7495 | 107.0823 | 23.2712 | 53.3905 | 21.7130 |
| 1689 | 17136 | J04035 | 86.6977 | 765.2605 | 188.8314 | 518.4444 | 370.7999 |
| 2232 | 15203 | NM_031093 | 86.5424 | 209.2850 | 18.7806 | 175.4825 | 31.2844 |
| 2301 | 15767 | NM_031623 | 86.5424 | 153.3083 | 19.9098 | 214.1710 | 51.9186 |
| 611 | 20619 | AA945737 | 86.5424 | 8.4417 | 3.6252 | 22.0994 | 13.3336 |
| 316 | 24470 | AA875523 | 86.4907 | 5199.1175 | 1173.8016 | 3543.3523 | 655.6704 |
| 2489 | 8641 | NM_057211 | 86.4907 | 206.6823 | 28.5084 | 319.4634 | 102.2740 |
| 9 | 25050 | J01435 | 86.3872 | 9783.8722 | 2938.9524 | 4904.4341 | 1867.2089 |
| 1762 | 638 | NM_012613 | 86.3872 | 220.1460 | 41.7079 | 154.1979 | 27.6018 |
| 1743 | 20704 | NM_012541 | 86.2836 | 55.3490 | 10.3700 | 38.4184 | 13.4073 |
| 1872 | 38 | NM_013114 | 86.2836 | 39.8378 | 5.5516 | 26.8456 | 15.6675 |
| 1901 | 1495 | NM_013221 | 86.2836 | 78.0432 | 7.0184 | 97.6129 | 21.6056 |
| 8 | 14983 | AI179150 | 86.1801 | 15391.6560 | 5866.9293 | 7271.2874 | 3760.1150 |
| 2044 | 17908 | NM_019242 | 86.1801 | 14.8280 | 7.8844 | 44.6283 | 34.9133 |
| 2136 | 8597 | NM_022538 | 86.1284 | 196.5925 | 21.7031 | 158.7965 | 41.7885 |
| 1770 | 16220 | NM_012656 | 86.0248 | 3307.8400 | 955.9316 | 1861.1020 | 637.3267 |
| 2006 | 20848 | NM_017343 | 86.0248 | 1885.2807 | 179.2060 | 1611.7709 | 278.3017 |
| 2414 | 18644 | NM_053648 | 85.9213 | 6525.7058 | 2192.4313 | 3783.2014 | 1348.4227 |
| 98 | 600 | AA800222 | 85.9213 | 263.1263 | 18.4761 | 327.9509 | 63.1450 |
| 2560 | 3015 | NM_138895 | 85.7660 | 3456.6195 | 319.6428 | 2832.5081 | 571.0351 |
| 2266 | 15273 | NM_031237 | 85.7660 | 7.8428 | 8.3445 | 41.9616 | 33.9196 |
| 293 | 16312 | AA875032 | 85.7660 | 36.0062 | 8.4127 | 68.2350 | 37.3538 |
| 2221 | 15886 | NM_031035 | 85.7660 | 489.1110 | 29.4380 | 405.7301 | 96.6313 |
| 2607 | 21583 | S77900 | 85.7143 | 649.1815 | 148.8583 | 367.9905 | 122.3493 |
| 2340 | 25802 | NM_031969 | 85.7143 | 870.9612 | 173.0430 | 599.6281 | 153.6135 |
| 1911 | 24676 | NM_017010 | 85.6625 | 78.1665 | 66.5388 | 29.2018 | 42.2911 |
| 2256 | 15052 | NM_031136 | 85.6625 | 2988.2460 | 1447.5559 | 2738.9965 | 641.1183 |
| 72 | 6425 | AA799784 | 85.6625 | 133.3380 | 19.8127 | 171.6206 | 37.1599 |
| 3 | 19421 | AA945152 | 85.6108 | 10187.8595 | 2889.2061 | 5515.1032 | 2050.0750 |
| 1773 | 24854 | NM_012676 | 85.6108 | 9986.6790 | 3057.9794 | 5883.6151 | 2004.8095 |
| 2409 | 20243 | NM_053615 | 85.6108 | 102.1265 | 13.6846 | 145.6152 | 39.4919 |
| 1791 | 18066 | NM_012762 | 85.6108 | 29.1457 | 2.4528 | 24.3851 | 10.5830 |
| 2336 | 4748 | NM_031834 | 85.5590 | 10.3340 | 6.7481 | 44.5435 | 44.7903 |
| 2259 | 15185 | NM_031140 | 85.5072 | 1365.5805 | 220.1448 | 930.1042 | 185.4481 |
| 262 | 23347 | AA860015 | 85.5072 | 51.3743 | 12.1529 | 75.7981 | 18.3704 |
| 2681 | 25743 | X80130 | 85.4555 | 10896.4638 | 3468.3621 | 6169.2740 | 2236.3347 |
| 1745 | 225 | NM_012544 | 85.4555 | 118.1477 | 6.9233 | 100.7150 | 24.0142 |
| 11 | 25439 | M35826 | 85.4037 | 9451.4727 | 3142.0210 | 5039.2187 | 2135.4098 |
| 1829 | 13723 | NM_012935 | 85.4037 | 5941.5757 | 1135.6019 | 4146.5143 | 930.0375 |
| 83 | 18400 | AA799991 | 85.4037 | 23.9422 | 3.9205 | 35.5996 | 11.7212 |
| 2597 | 15693 | S56679 | 85.3520 | 41.9673 | 17.0293 | 11.3160 | 12.6595 |
| 1654 | 19053 | D12770 | 85.3520 | 7254.8842 | 1634.9432 | 4760.8397 | 1174.8799 |
| 2425 | 18175 | NM_053752 | 85.3520 | 1215.6852 | 370.8997 | 1104.2417 | 184.1830 |
| 1757 | 7125 | NM_012595 | 85.3002 | 6166.8172 | 1368.3779 | 4046.9460 | 1056.8198 |
| 2388 | 16135 | NM_053516 | 85.2484 | 10911.3320 | 3922.1706 | 5965.1645 | 2441.7735 |
| 2162 | 20084 | NM_022936 | 85.2484 | 27.9260 | 19.9940 | 62.6626 | 33.8959 |
| 1993 | 20579 | NM_017288 | 85.2484 | 297.5433 | 17.8361 | 330.2801 | 72.3142 |
| 275 | 16001 | AA866452 | 85.1967 | 15974.5118 | 5460.2030 | 8722.9676 | 3508.9738 |
| 1730 | 25470 | M95791 | 85.1967 | 48.7750 | 31.1751 | 113.5910 | 50.2175 |
| 2392 | 15829 | NM_053551 | 85.0932 | 9.4337 | 4.3052 | 51.1893 | 73.5987 |
| 12 | 21152 | X14848 | 85.0932 | 13313.3515 | 3985.4397 | 7030.1502 | 2975.0295 |
| 10 | 25051 | J01436 | 85.0932 | 10025.3403 | 2691.1454 | 5378.7115 | 1991.5350 |
| 155 | 4330 | AA818747 | 99.6894 | 1252.8993 | 159.2015 | 451.2431 | 125.8274 |
| 845 | 14668 | AI012185 | 96.0145 | 112.8827 | 12.5993 | 59.0254 | 21.3859 |
| 722 | 2757 | AA997851 | 95.5487 | 1366.7942 | 213.6854 | 812.0674 | 245.0921 |

TABLE 5BB-continued

Minoxidil--Core Tox Markers
Timepoints(s): 24-360 hrs

| SEQ ID | GLGC ID | GenBank Accession No. | LDA Score | Mean Tox | SD Tox | Mean Nontox | SD Nontox |
|---|---|---|---|---|---|---|---|
| 1327 | 19006 | AI176393 | 94.7205 | 1785.7690 | 198.2123 | 1058.7331 | 328.0473 |
| 2210 | 8815 | NM_030991 | 94.2547 | 388.5743 | 27.2550 | 259.0826 | 76.3901 |
| 1112 | 11723 | AI102896 | 93.9441 | 55.8792 | 10.0073 | 4.4362 | 31.9769 |
| 1952 | 15365 | NM_017147 | 93.8923 | 1108.1207 | 492.5541 | 1030.5675 | 215.3048 |
| 1137 | 18831 | AI104357 | 93.8923 | 3436.3307 | 405.7014 | 2495.9422 | 667.4217 |
| 2062 | 2088 | NM_019341 | 92.9607 | 485.9728 | 85.8473 | 307.2277 | 85.7764 |
| 588 | 19480 | AA944442 | 92.9089 | 2041.7307 | 65.2682 | 1674.6607 | 379.8807 |
| 874 | 3088 | AI013369 | 92.8054 | 36.3220 | 2.5840 | 55.6612 | 29.2505 |
| 1368 | 22691 | AI177967 | 92.6501 | 1390.9820 | 238.5001 | 919.3204 | 239.7806 |
| 196 | 24128 | AA849766 | 92.6501 | 298.9320 | 9.0540 | 234.2646 | 172.1699 |
| 1428 | 22915 | AI228299 | 92.3913 | 157.3257 | 6.9909 | 129.3154 | 27.7499 |
| 1567 | 14869 | AI236089 | 92.1325 | 123.3242 | 6.6322 | 88.7640 | 36.0959 |
| 871 | 16984 | AI013161 | 92.1325 | 329.9662 | 62.9378 | 602.8346 | 177.1319 |
| 173 | 6168 | AA819606 | 92.0807 | 76.9700 | 5.1471 | 53.9067 | 19.3694 |
| 1180 | 6638 | AI137579 | 91.9772 | 100.7265 | 19.7930 | 178.9038 | 53.2986 |
| 1306 | 19004 | AI175875 | 91.8219 | 1833.6993 | 213.7395 | 1107.2121 | 448.3080 |
| 806 | 4177 | AI010123 | 91.7702 | 322.1253 | 33.4508 | 486.6640 | 117.9772 |
| 1971 | 20632 | NM_017220 | 91.6149 | 91.8260 | 37.3026 | 192.7485 | 55.4387 |
| 1343 | 16124 | AI176963 | 91.3043 | 131.6897 | 19.9910 | 232.3437 | 95.2916 |
| 1220 | 13427 | AI169993 | 91.2526 | 4.5580 | 12.9423 | 23.9666 | 12.5307 |
| 2494 | 2541 | NM_080479 | 90.8903 | 67.8027 | 17.9265 | 24.7398 | 26.4131 |
| 1235 | 2534 | AI170632 | 90.8385 | 28.0445 | 4.0410 | 47.2322 | 13.7237 |
| 172 | 6282 | AA819523 | 90.6832 | 222.7068 | 17.6865 | 161.6796 | 56.2408 |
| 1058 | 9806 | AI072036 | 90.4762 | 10.4643 | 11.4493 | 34.3519 | 14.8863 |
| 1102 | 5969 | AI102520 | 90.3727 | 289.7607 | 31.3499 | 429.4605 | 123.9606 |
| 1312 | 12298 | AI176055 | 90.3209 | 86.3223 | 32.0470 | 161.8749 | 46.4191 |
| 1326 | 3014 | AI176362 | 90.2174 | 167.0213 | 17.4882 | 249.0241 | 75.7553 |
| 929 | 17013 | AI030797 | 90.2174 | 85.4747 | 9.4603 | 122.4431 | 30.6685 |
| 216 | 13627 | AA851493 | 90.0104 | 75.7057 | 5.4585 | 55.9724 | 31.3140 |
| 993 | 8039 | AI058419 | 89.8033 | 183.8938 | 14.1961 | 139.0876 | 49.8228 |
| 969 | 9914 | AI044855 | 89.6998 | −0.4020 | 34.7773 | 72.2003 | 56.1763 |
| 1031 | 8854 | AI070285 | 89.6480 | 67.5712 | 6.2645 | 50.3999 | 28.1094 |
| 1084 | 5421 | AI101270 | 89.5963 | 374.9627 | 38.3972 | 283.4432 | 148.7481 |
| 135 | 1802 | AA817841 | 89.5963 | 104.6767 | 14.1076 | 154.3923 | 40.2828 |
| 598 | 21581 | AA944828 | 89.5963 | 712.2452 | 73.1184 | 560.6088 | 118.9825 |
| 1364 | 11791 | AI177843 | 89.5445 | 108.2222 | 7.7685 | 139.8817 | 32.9493 |
| 934 | 7842 | AI031052 | 89.5445 | 2.6935 | 8.9314 | 25.5130 | 14.7431 |
| 516 | 12346 | AA924346 | 89.5445 | 472.4318 | 59.0587 | 678.7885 | 440.2343 |
| 808 | 2612 | AI010241 | 89.4410 | 36.9472 | 5.5990 | 57.8448 | 17.5537 |
| 2421 | 13622 | NM_053713 | 89.0787 | 375.5315 | 43.6054 | 253.3860 | 94.4454 |
| 830 | 5983 | AI011070 | 88.9752 | 311.8697 | 61.2478 | 585.0836 | 201.7810 |
| 1443 | 18643 | AI229702 | 88.8716 | 239.7207 | 20.7273 | 306.2247 | 60.9991 |
| 1244 | 22033 | AI171165 | 88.8716 | 132.9733 | 8.2770 | 174.4417 | 52.8980 |
| 1572 | 5007 | AI236229 | 88.8716 | 572.3495 | 40.5614 | 739.8550 | 164.1606 |
| 1242 | 7011 | AI171019 | 88.7681 | 236.2587 | 24.5283 | 327.1433 | 72.6244 |
| 168 | 12305 | AA819220 | 88.7164 | 184.9173 | 25.1616 | 131.5672 | 39.8234 |
| 2126 | 3904 | NM_022516 | 88.5611 | 227.7152 | 28.3711 | 135.5882 | 94.2873 |
| 203 | 6649 | AA850563 | 88.5611 | −10.8562 | 23.5637 | 32.7590 | 148.9578 |
| 789 | 3836 | AI009420 | 88.5093 | 3826.9087 | 290.6592 | 2981.9296 | 664.5439 |
| 649 | 498 | AA956278 | 88.4576 | 888.2553 | 81.8895 | 700.3447 | 149.0531 |
| 2471 | 17330 | NM_054008 | 88.2505 | 91.7602 | 13.7975 | 59.3632 | 23.0230 |
| 937 | 7852 | AI043636 | 88.2505 | 106.6953 | 105.2722 | 312.2733 | 70.4524 |
| 1252 | 18047 | AI171359 | 88.1988 | 156.8232 | 3.9296 | 167.4510 | 38.3251 |
| 625 | 23027 | AA946264 | 88.1988 | 45.5408 | 2.7099 | 52.7099 | 36.7406 |
| 1150 | 23596 | AI105435 | 88.1470 | 216.1497 | 32.2812 | 306.1806 | 67.1082 |
| 1066 | 9305 | AI072520 | 88.0952 | 123.7258 | 5.2230 | 142.3025 | 30.6411 |
| 474 | 20038 | AA899797 | 88.0952 | 135.2602 | 21.1150 | 199.3672 | 51.0314 |
| 724 | 26114 | AA997904 | 87.9917 | 219.1497 | 24.9829 | 210.3639 | 119.0981 |
| 1473 | 13928 | AI230939 | 87.9400 | 333.4505 | 72.3694 | 529.8971 | 149.5635 |
| 1407 | 6455 | AI179984 | 87.8882 | 314.3333 | 78.4011 | 196.3007 | 97.3929 |
| 2389 | 18826 | NM_053523 | 87.8882 | 683.4078 | 108.4593 | 1028.9475 | 264.7740 |
| 1224 | 22942 | AI170251 | 87.8364 | 134.9742 | 30.7739 | 193.5716 | 44.6292 |
| 1363 | 22882 | AI177804 | 87.8364 | 100.1367 | 30.4959 | 165.3614 | 46.6765 |

TABLE 5CC

NOREPINEPHRINE
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2024 | 20863 | NM_019152 | 99.6904 | 57.5080 | 1.2093 | 152.0204 | 49.7409 |
| 2470 | 17431 | NM_054006 | 99.1228 | 474.9520 | 1.4949 | 437.1764 | 108.1993 |
| 336 | 21951 | AA891535 | 98.6584 | 69.3167 | 0.1386 | 77.8674 | 18.0240 |
| 1716 | 17211 | M34331 | 98.0392 | 2705.5817 | 23.7082 | 2036.3654 | 574.6117 |
| 110 | 17648 | AA800735 | 97.9876 | 167.4683 | 0.6089 | 178.3401 | 43.2454 |
| 2154 | 17808 | NM_022699 | 97.9360 | 1712.9783 | 24.2555 | 1271.1624 | 255.7192 |
| 8 | 14983 | AI179150 | 97.9360 | 9490.9897 | 246.4261 | 7314.6962 | 3829.3447 |
| 446 | 19411 | AA893667 | 97.8844 | 100.8437 | 0.4210 | 112.6130 | 36.6267 |
| 1742 | 20357 | NM_012534 | 97.7812 | 41.3160 | 1.5967 | 92.4611 | 37.0762 |
| 2520 | 10660 | NM_133423 | 97.6780 | 71.1927 | 0.3765 | 68.2986 | 17.8215 |
| 2671 | 20844 | X65228 | 97.4200 | 2095.0633 | 27.4653 | 1583.7326 | 367.3536 |
| 2393 | 17298 | NM_053553 | 97.4200 | 197.8003 | 1.1728 | 202.4156 | 46.4171 |
| 2193 | 2811 | NM_024386 | 97.4200 | 54.3710 | 1.4083 | 86.9006 | 26.2123 |
| 1860 | 16924 | NM_013069 | 97.2136 | 325.3807 | 6.4975 | 225.0529 | 107.4393 |
| 648 | 23357 | AA956114 | 97.1620 | 127.7170 | 1.0540 | 144.3015 | 32.4500 |
| 1731 | 17991 | M96626 | 97.0072 | 13.6307 | 0.6479 | 26.1271 | 9.2577 |
| 2209 | 21801 | NM_030987 | 97.0072 | 191.3690 | 1.7931 | 160.2509 | 36.7703 |
| 1653 | 5049 | D10655 | 96.9556 | 453.6563 | 28.9136 | 737.2678 | 170.4712 |
| 1771 | 21087 | NM_012661 | 96.8524 | 20.9507 | 0.6866 | 27.2381 | 320.9153 |
| 1941 | 20746 | NM_017113 | 96.8524 | 575.6373 | 6.1367 | 491.5957 | 121.8270 |
| 2113 | 18221 | NM_022395 | 96.5944 | 137.9597 | 2.3388 | 189.7786 | 52.6548 |
| 2153 | 17757 | NM_022698 | 96.5428 | 147.7873 | 1.3945 | 128.8930 | 28.2779 |
| 1768 | 14924 | NM_012645 | 96.4396 | 51.8627 | 1.3141 | 38.0575 | 24.1160 |
| 2634 | 25643 | U77829 | 96.1300 | 105.8687 | 1.0779 | 127.2940 | 27.8507 |
| 1729 | 13489 | M91599 | 95.9752 | 6.2677 | 1.7932 | 21.3974 | 9.1426 |
| 2627 | 20386 | U68562 | 95.7172 | 265.7490 | 2.9274 | 333.1644 | 84.5056 |
| 2349 | 19768 | NM_031986 | 95.7172 | 674.4197 | 8.5199 | 796.3149 | 122.8559 |
| 2427 | 15996 | NM_053769 | 95.6140 | 105.4843 | 2.2465 | 154.0898 | 79.1755 |
| 2193 | 2812 | NM_024386 | 95.6140 | 63.1260 | 1.6503 | 89.8743 | 24.9196 |
| 2157 | 194 | NM_022861 | 95.5624 | 24.1963 | 0.4803 | 19.9540 | 14.3888 |
| 2125 | 2696 | NM_022515 | 95.5624 | 1762.8073 | 31.4524 | 1422.2921 | 365.6896 |
| 279 | 16070 | AA874873 | 95.4592 | 50.8690 | 1.5166 | 71.7919 | 28.5871 |
| 2367 | 20235 | NM_053302 | 95.4592 | 37.5317 | 1.8408 | 47.0293 | 26.5541 |
| 2038 | 2632 | NM_019213 | 95.4076 | 167.9587 | 1.6753 | 186.7841 | 29.5856 |
| 383 | 13647 | AA892367 | 95.3560 | 1105.3833 | 354.4977 | 561.0303 | 204.2384 |
| 1839 | 571 | NM_012982 | 95.3560 | 79.6580 | 3.0611 | 97.1701 | 46.0338 |
| 275 | 1600 | AA866452 | 95.3560 | 11808.5667 | 498.3945 | 8758.3158 | 3566.9879 |
| 744 | 15772 | AB015645 | 95.3044 | 20.7357 | 0.4255 | 25.8650 | 10.5094 |
| 399 | 16507 | AA892547 | 95.2012 | 102.8060 | 2.9377 | 144.1605 | 46.3039 |
| 306 | 15384 | AA875217 | 95.0464 | 26.9193 | 2.2940 | 48.4330 | 18.7361 |
| 2232 | 15202 | NM_031093 | 94.9948 | 1630.9773 | 97.0261 | 1017.4003 | 358.3999 |
| 2693 | 19694 | Z48444 | 94.8400 | 35.2940 | 1.0696 | 39.4846 | 18.5360 |
| 1852 | 18076 | NM_013030 | 94.7884 | 0.4443 | 1.5758 | 32.3208 | 28.9133 |
| 1606 | 15450 | AI639035 | 94.7884 | 14.0293 | 0.5515 | 20.3809 | 6.5776 |
| 86 | 23343 | AA800016 | 94.7884 | 22.5627 | 0.8490 | 30.7679 | 10.1335 |
| 2343 | 24644 | NM_031972 | 94.6852 | 48.7800 | 35.4267 | 59.7429 | 17.0549 |
| 2206 | 16292 | NM_030860 | 94.5820 | 55.0530 | 4.1845 | 23.2692 | 28.5015 |
| 2642 | 14966 | X07551 | 94.5820 | 92.8293 | 8.8838 | 39.4153 | 46.0119 |
| 2608 | 25547 | S78556 | 94.5304 | 260.6713 | 11.4421 | 355.9494 | 129.4296 |
| 67 | 17875 | AA799755 | 94.4788 | 20.1533 | 1.4421 | 2.7236 | 25.5290 |
| 1812 | 20945 | NM_012875 | 94.4788 | 2040.6570 | 88.0696 | 1595.1554 | 294.2624 |
| 2564 | 15380 | NM_139083 | 94.4272 | 1863.6317 | 378.2755 | 935.9807 | 366.6477 |
| 2152 | 17729 | NM_022697 | 94.3756 | 1776.1277 | 125.5025 | 1324.7848 | 228.2950 |
| 1653 | 5050 | D10655 | 94.3756 | 346.5397 | 15.9769 | 516.2596 | 120.7928 |
| 1761 | 1299 | NM_012610 | 94.3756 | 232.6140 | 23.9980 | 115.5967 | 73.0578 |
| 62 | 20994 | AA799717 | 94.3756 | 138.7977 | 2.4628 | 119.6022 | 30.7760 |
| 34 | 11350 | AA799488 | 94.3240 | 31.5207 | 1.8216 | 63.4682 | 29.9900 |
| 2531 | 24609 | NM_133585 | 94.2724 | 21.7690 | 0.8361 | 37.0927 | 240.4283 |
| 50 | 20975 | AA799599 | 94.2724 | 97.1543 | 6.9311 | 148.5012 | 38.4501 |
| 285 | 16139 | AA874927 | 94.2208 | 131.1017 | 1.4153 | 140.0184 | 32.8568 |
| 185 | 25110 | AA848546 | 94.2208 | 66.0483 | 2.2815 | 84.1086 | 16.1268 |
| 344 | 19321 | AA891666 | 94.1692 | 221.5020 | 2.7681 | 249.6174 | 41.8258 |
| 740 | 25137 | AB005540 | 94.1692 | 25.3893 | 0.8747 | 34.1161 | 11.2576 |
| 1827 | 1977 | NM_012930 | 94.0144 | 318.8380 | 83.1405 | 552.5388 | 109.7705 |
| 1877 | 5837 | NM_013143 | 94.0144 | 20.2693 | 20.7539 | 108.6565 | 64.8043 |
| 1170 | 13090 | AI136977 | 93.9628 | 75.7560 | 2.9234 | 99.2587 | 42.8080 |
| 2596 | 19888 | S56464 | 93.9628 | 183.8520 | 7.2264 | 133.6778 | 51.2786 |
| 30 | 18365 | AA799442 | 93.9112 | 88.5537 | 2.3153 | 112.8918 | 77.1579 |
| 2074 | 15911 | NM_019907 | 93.9112 | 134.4520 | 7.6642 | 194.2536 | 44.9941 |
| 2131 | 4615 | NM_022525 | 93.8596 | 884.0333 | 50.4101 | 586.9161 | 207.1906 |
| 1605 | 4035 | AI639023 | 93.8596 | 79.2893 | 2.2117 | 89.5571 | 32.1003 |
| 462 | 21989 | AA894188 | 93.8080 | 87.8107 | 1.1828 | 98.5063 | 18.7718 |

TABLE 5CC-continued

NOREPINEPHRINE
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2625 | 1283 | U61729 | 93.7564 | 90.1383 | 2.9178 | 110.1922 | 40.4636 |
| 2434 | 25262 | NM_053814 | 93.7564 | 44.5400 | 1.0002 | 42.3342 | 14.5553 |
| 2463 | 17653 | NM_053986 | 93.7564 | 24.3393 | 0.6370 | 26.8303 | 11.6319 |
| 2111 | 22499 | NM_022393 | 93.7564 | 32.1947 | 2.0163 | 20.9150 | 12.1488 |
| 2652 | 16715 | X53054 | 93.7049 | 21.5823 | 1.3680 | 15.6291 | 12.6757 |
| 2579 | 15761 | NM_145091 | 93.6533 | 12.5080 | 2.4564 | 32.0276 | 15.4752 |
| 2006 | 16382 | NM_017343 | 93.6533 | 81.5550 | 2.0418 | 97.3052 | 31.9369 |
| 1634 | 19152 | AI639387 | 93.6533 | 78.5820 | 1.4082 | 90.5775 | 21.3603 |
| 357 | 23083 | AA891802 | 93.6017 | 51.3330 | 1.3946 | 55.2908 | 16.9676 |
| 1692 | 23486 | K02816 | 93.5501 | 290.4820 | 8.6006 | 378.9140 | 72.1118 |
| 1671 | 12360 | H31456 | 93.4985 | 35.1090 | 3.2411 | 60.0728 | 25.8807 |
| 1899 | 20728 | NM_013217 | 93.4985 | 699.3180 | 33.9924 | 915.6553 | 202.6830 |
| 100 | 21086 | AA800305 | 93.3953 | 60.6500 | 3.0185 | 87.2985 | 25.8805 |
| 2296 | 20840 | NM_031604 | 93.3437 | 101.9150 | 2.6021 | 91.4824 | 39.3794 |
| 2439 | 16099 | NM_053837 | 93.2921 | 512.4647 | 14.8688 | 429.8306 | 62.4877 |
| 2214 | 15683 | NM_031011 | 93.2405 | 79.7163 | 2.9852 | 102.8190 | 42.0203 |
| 2552 | 16400 | NM_138828 | 93.1889 | 483.1180 | 51.1795 | 316.1201 | 193.0789 |
| 16 | 25103 | AA685876 | 93.1373 | 87.7253 | 2.0728 | 65.0932 | 41.5711 |
| 110 | 17649 | AA800735 | 93.1373 | 192.8347 | 9.2057 | 262.4957 | 83.2930 |
| 1996 | 23825 | NM_017299 | 93.1373 | 57.1467 | 1.4480 | 63.5002 | 19.0013 |
| 2287 | 9620 | NM_031570 | 93.0857 | 1102.1280 | 83.6335 | 797.7883 | 183.0347 |
| 2501 | 9952 | NM_080902 | 93.0857 | 415.3687 | 15.3125 | 545.4961 | 105.7077 |
| 747 | 1097 | AF016296 | 93.0857 | 264.3353 | 8.4195 | 303.0990 | 100.2771 |
| 1636 | 5014 | AI639410 | 93.0341 | 23.0340 | 1.6781 | 43.0242 | 18.7763 |
| 75 | 14504 | AA799804 | 93.0341 | 388.5153 | 24.7725 | 528.3181 | 118.3967 |
| 2350 | 20554 | NM_031987 | 92.9825 | 64.9137 | 3.4897 | 175.3841 | 36.9748 |
| 2443 | 16361 | NM_053853 | 92.9825 | 28.3843 | 2.5207 | 44.7460 | 11.8878 |
| 550 | 17157 | AA926129 | 92.9825 | 107.4930 | 5.5723 | 80.0165 | 26.0867 |
| 200 | 22028 | AA850060 | 99.5872 | 13375.5767 | 47.8547 | 9974.9350 | 3731.3312 |
| 831 | 13787 | AI011462 | 99.3808 | 37.6450 | 0.1778 | 53.1175 | 15.6581 |
| 2497 | 17662 | NM_080697 | 99.0712 | 118.4780 | 2.1611 | 176.1766 | 35.6440 |
| 1078 | 9466 | AI073135 | 98.9164 | 175.5210 | 1.9121 | 31.3618 | 134.6260 |
| 987 | 2360 | AI045911 | 98.8648 | 233.2330 | 0.5882 | 219.7876 | 49.6824 |
| 1475 | 16087 | AI231011 | 98.8132 | 67.8230 | 0.4857 | 100.7151 | 34.7807 |
| 968 | 7992 | AI044845 | 98.6584 | 127.6070 | 0.5441 | 139.5139 | 42.5869 |
| 1439 | 16203 | AI229196 | 98.6068 | 85.3683 | 3.5578 | 139.3817 | 48.8127 |
| 948 | 5371 | AI044089 | 98.6068 | 23.7507 | 0.4097 | 10.4518 | 9.4883 |
| 1009 | 8285 | AI059298 | 98.4520 | 90.8623 | 0.4857 | 95.7843 | 28.6578 |
| 882 | 12796 | AI013495 | 98.2972 | 38.0497 | 0.3103 | 41.2723 | 27.3302 |
| 974 | 24290 | AI045040 | 98.2972 | 90.5837 | 2.6147 | 361.6428 | 374.6028 |
| 2071 | 16 | NM_019386 | 98.1940 | 1822.0580 | 42.5386 | 1233.0724 | 320.4945 |
| 479 | 9114 | AA899951 | 98.1424 | −8.5253 | 1.4263 | 31.4281 | 25.9729 |
| 674 | 11500 | AA963171 | 97.9360 | 671.5923 | 15.7799 | 465.7576 | 119.3952 |
| 2209 | 21805 | NM_030987 | 97.8844 | 480.5100 | 7.3892 | 343.1120 | 76.1132 |
| 166 | 6136 | AA819086 | 97.8328 | 47.2520 | 0.9249 | 66.0209 | 16.0978 |
| 837 | 21468 | AI011749 | 97.7812 | −83.5257 | 5.4755 | 44.3069 | 81.3374 |
| 1174 | 15969 | AI137302 | 97.6780 | 280.0903 | 1.1936 | 311.6277 | 53.2081 |
| 1081 | 19371 | AI100841 | 97.5748 | 65.2587 | 0.7805 | 89.8295 | 32.0983 |
| 876 | 26148 | AI013396 | 97.5748 | 44.5913 | 0.4646 | 43.9464 | 31.9266 |
| 1109 | 5891 | AI102745 | 97.5232 | 110.9577 | 3.0678 | 40.5915 | 59.6948 |
| 2262 | 23097 | NM_031145 | 97.5232 | 89.0547 | 1.0120 | 70.6426 | 24.0133 |
| 1513 | 15246 | AI232332 | 97.4716 | 46.4467 | 0.4743 | 53.2756 | 15.3668 |
| 1195 | 13375 | AI145454 | 97.4716 | 4.4203 | 0.9991 | 35.7215 | 22.1446 |
| 1576 | 4911 | AI236405 | 97.4716 | 23.6933 | 0.2376 | 28.3943 | 14.1208 |
| 1322 | 16438 | AI176294 | 97.4716 | 635.3450 | 11.7897 | 472.8945 | 130.7109 |
| 685 | 2095 | AA964362 | 97.4716 | 93.3360 | 1.4555 | 124.5051 | 25.6095 |
| 725 | 10614 | AA997985 | 97.4716 | 316.9750 | 10.2247 | 136.9156 | 110.6099 |
| 170 | 9310 | AA819367 | 97.3684 | 91.8597 | 1.0511 | 121.8552 | 36.8422 |
| 1088 | 18212 | AI101494 | 97.3684 | 41.2213 | 5.1671 | −19.9520 | 34.9405 |
| 1182 | 12654 | AI137864 | 97.3684 | 112.8583 | 10.6705 | 234.9660 | 90.1942 |
| 879 | 22493 | AI013466 | 97.3684 | 256.6973 | 1.8373 | 213.1873 | 56.4399 |
| 1023 | 10302 | AI060137 | 97.3684 | 27.9787 | 0.5209 | 17.3983 | 19.9656 |
| 1545 | 6387 | AI234664 | 97.3168 | 70.9853 | 0.3674 | 75.6112 | 15.3600 |
| 1118 | 17642 | AI103357 | 97.2136 | 21.3120 | 0.7327 | 43.6575 | 20.4405 |
| 615 | 22682 | AA945910 | 97.2136 | 23.4507 | 0.9202 | 27.2053 | 31.3254 |
| 1543 | 14202 | AI234326 | 97.1620 | 77.3710 | 1.1937 | 96.9214 | 35.6696 |
| 212 | 21456 | AA851239 | 97.1620 | 22.3423 | 0.8300 | 7.7116 | 22.1473 |
| 561 | 19016 | AA943015 | 97.1104 | 395.3907 | 7.3295 | 277.0878 | 74.8662 |
| 1383 | 15091 | AI178740 | 97.0588 | 99.1530 | 1.7515 | 138.2585 | 37.7845 |
| 2272 | 20087 | NM_031357 | 97.0072 | 67.3520 | 0.6694 | 66.8587 | 27.1307 |
| 2381 | 6712 | NM_053448 | 96.9556 | 169.7277 | 1.8176 | 189.1622 | 57.1238 |
| 695 | 2476 | AA964841 | 96.9040 | 53.3413 | 0.8480 | 55.5428 | 32.4163 |

TABLE 5CC-continued

NOREPINEPHRINE
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 1229 | 22707 | AI170384 | 96.8008 | 17.7820 | 1.2756 | 42.3511 | 26.8561 |
| 864 | 7171 | AI012761 | 96.8008 | 94.3337 | 1.2532 | 83.6124 | 30.5140 |
| 1274 | 23703 | AI172265 | 96.6976 | 31.0490 | 0.3480 | 29.0504 | 14.2729 |
| 1167 | 24212 | AI136747 | 96.6976 | 2582.6843 | 21.4587 | 2283.2783 | 408.2796 |
| 1210 | 149 | AI169272 | 96.6976 | 66.2783 | 0.8071 | 76.7152 | 15.8431 |
| 1019 | 8423 | AI059728 | 96.6976 | 227.7503 | 3.3440 | 366.9388 | 292.2468 |
| 840 | 14625 | AI011949 | 96.6976 | 68.5233 | 0.9441 | 81.2621 | 23.5113 |
| 1072 | 9408 | AI072835 | 96.5944 | 59.6917 | 1.7766 | 39.0365 | 17.3643 |
| 813 | 21825 | AI010418 | 96.5944 | 56.4700 | 1.5143 | 88.3463 | 35.4890 |
| 123 | 21427 | AA801181 | 96.4912 | 79.2123 | 1.3763 | 103.8133 | 29.5468 |
| 776 | 12828 | AI008796 | 96.4396 | 57.7353 | 0.9357 | 66.8836 | 32.7675 |
| 1825 | 20757 | NM_012923 | 96.3364 | 2414.1663 | 17.0973 | 2271.8254 | 422.0171 |
| 1446 | 24117 | AI229785 | 96.3364 | 26.6910 | 2.0888 | 10.4170 | 17.5507 |
| 565 | 2675 | AA943099 | 96.3364 | 1148.9510 | 10.6599 | 947.0135 | 243.8608 |
| 952 | 12778 | AI044211 | 96.2848 | 152.6843 | 2.5320 | 183.5233 | 43.7221 |
| 540 | 21500 | AA925353 | 96.2848 | 237.3877 | 54.4652 | 89.4782 | 89.7241 |
| 1234 | 16689 | AI170561 | 96.2332 | 104.0237 | 1.2517 | 108.6236 | 32.2312 |
| 2571 | 22595 | NM_139253 | 96.2332 | 166.8360 | 2.7171 | 194.4342 | 42.3266 |
| 195 | 21264 | AA849731 | 96.2332 | 122.8987 | 1.7320 | 103.6940 | 20.7544 |
| 1432 | 13741 | AI228462 | 96.1816 | 26.0263 | 0.3138 | 32.8458 | 17.8267 |
| 552 | 20327 | AA926265 | 96.1300 | 122.6457 | 1.3007 | 117.4239 | 39.8879 |
| 1409 | 4189 | AI180081 | 96.0784 | 343.5817 | 2.9074 | 392.8493 | 91.9355 |
| 1505 | 8959 | AI232128 | 96.0784 | 82.2207 | 1.8721 | 58.2600 | 21.4847 |
| 1496 | 7036 | AI231801 | 96.0784 | 90.0790 | 2.0404 | 113.9122 | 21.4538 |
| 487 | 4732 | AA900343 | 96.0784 | 165.0377 | 1.5663 | 187.3527 | 37.0863 |
| 1008 | 8265 | AI059246 | 96.0784 | 118.6537 | 1.7219 | 90.1576 | 33.6246 |
| 957 | 5454 | AI044330 | 96.0784 | 32.1143 | 2.3840 | 14.5283 | 17.3022 |
| 1236 | 15393 | AI170663 | 96.0268 | 270.5937 | 15.8566 | 187.4393 | 42.2588 |
| 1285 | 2208 | AI172472 | 96.0268 | 162.0793 | 6.7166 | 223.0357 | 44.7220 |
| 919 | 10685 | AI030213 | 96.0268 | 23.6977 | 0.5614 | 36.1425 | 15.1425 |
| 1535 | 15085 | AI233829 | 95.9752 | 885.2107 | 4.7521 | 972.5390 | 174.5670 |

TABLE 5DD

Norepinephrine--Core Tox Markers
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2024 | 20863 | NM_019152 | 99.6904 | 57.5080 | 1.2093 | 152.0204 | 49.7409 |
| 2470 | 17431 | NM_054006 | 99.1228 | 474.9520 | 1.4949 | 437.1764 | 108.1993 |
| 336 | 21951 | AA891535 | 98.6584 | 69.3167 | 0.1386 | 77.8674 | 18.0240 |
| 1716 | 17211 | M34331 | 98.0392 | 2705.5817 | 23.7082 | 2036.3654 | 574.6117 |
| 110 | 17648 | AA800735 | 97.9876 | 167.4683 | 0.6089 | 178.3401 | 43.2454 |
| 2154 | 17808 | NM_022699 | 97.9360 | 1712.9783 | 24.2555 | 1271.1624 | 255.7192 |
| 8 | 14983 | AI179150 | 97.9360 | 9490.9897 | 246.4261 | 7314.6962 | 3829.3447 |
| 446 | 19411 | AA893667 | 97.8844 | 100.8437 | 0.4210 | 112.6130 | 36.6267 |
| 1742 | 20357 | NM_012534 | 97.7812 | 41.3160 | 1.5967 | 92.4611 | 37.0762 |
| 2520 | 10660 | NM_133423 | 97.6780 | 71.1927 | 0.3765 | 68.2986 | 17.8215 |
| 2671 | 20844 | X65228 | 97.4200 | 2095.0633 | 27.4653 | 1583.7326 | 367.3536 |
| 2393 | 17298 | NM_053553 | 97.4200 | 197.8003 | 1.1728 | 202.4156 | 46.4171 |
| 2193 | 2811 | NM_024386 | 97.4200 | 54.3710 | 1.4083 | 86.9006 | 26.2123 |
| 1860 | 16924 | NM_013069 | 97.2136 | 325.3807 | 6.4975 | 225.0529 | 107.4393 |
| 648 | 23357 | AA956114 | 97.1620 | 127.7170 | 1.0540 | 144.3015 | 32.4500 |
| 1731 | 17991 | M96626 | 97.0072 | 13.6307 | 0.6479 | 26.1271 | 9.2577 |
| 2209 | 21801 | NM_030987 | 97.0072 | 191.3690 | 1.7931 | 160.2509 | 36.7703 |
| 1653 | 5049 | D10655 | 96.9556 | 453.6563 | 28.9136 | 737.2678 | 170.4712 |
| 1771 | 21087 | NM_012661 | 96.8524 | 20.9507 | 0.6866 | 27.2381 | 1320.9153 |
| 1941 | 20746 | NM_017113 | 96.8524 | 575.6373 | 6.1367 | 491.5957 | 121.8270 |
| 2113 | 18221 | NM_022395 | 96.5944 | 137.9597 | 2.3388 | 189.7786 | 52.6548 |
| 2153 | 17757 | NM_022698 | 96.5428 | 147.7873 | 1.3945 | 128.8930 | 28.2779 |
| 1768 | 14924 | NM_012645 | 96.4396 | 51.8627 | 1.3141 | 38.0575 | 24.1160 |
| 2634 | 25643 | U77829 | 96.1300 | 105.8687 | 1.0779 | 127.2940 | 27.8507 |
| 1729 | 13489 | M91599 | 95.9752 | 6.2677 | 1.7932 | 21.3974 | 9.1426 |
| 2093 | 17100 | NM_022179 | 95.9236 | 1933.0853 | 99.4724 | 1310.1293 | 296.4873 |
| 2627 | 20386 | U68562 | 95.7172 | 265.7490 | 2.9274 | 333.1644 | 84.5056 |
| 2349 | 19768 | NM_031986 | 95.7172 | 674.4197 | 8.5199 | 796.3149 | 122.8559 |
| 2427 | 15996 | NM_053769 | 95.6140 | 105.4843 | 2.2465 | 154.0898 | 79.1755 |

TABLE 5DD-continued

Norepinephrine--Core Tox Markers
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2193 | 2812 | NM_024386 | 95.6140 | 63.1260 | 1.6503 | 89.8743 | 24.9196 |
| 2157 | 194 | NM_022861 | 95.5624 | 24.1963 | 0.4803 | 19.9540 | 14.3888 |
| 2125 | 2696 | NM_022515 | 95.5624 | 1762.8073 | 31.4524 | 1422.2921 | 365.6896 |
| 279 | 16070 | AA874873 | 95.4592 | 50.8690 | 1.5166 | 71.7919 | 28.5871 |
| 2367 | 20235 | NM_053302 | 95.4592 | 37.5317 | 1.8408 | 47.0293 | 26.5541 |
| 2038 | 2632 | NM_019213 | 95.4076 | 167.9587 | 1.6753 | 186.7841 | 29.5856 |
| 383 | 13647 | AA892367 | 95.3560 | 1105.3833 | 354.4977 | 561.0303 | 204.2384 |
| 1839 | 571 | NM_012982 | 95.3560 | 79.6580 | 3.0611 | 97.1701 | 46.0338 |
| 275 | 16001 | AA866452 | 95.3560 | 11808.5667 | 498.3945 | 8758.3158 | 3566.9879 |
| 744 | 15772 | AB015645 | 95.3044 | 20.7357 | 0.4255 | 25.8650 | 10.5094 |
| 399 | 16507 | AA892547 | 95.2012 | 102.8060 | 2.9377 | 144.1605 | 46.3039 |
| 306 | 15384 | AA875217 | 95.0464 | 26.9193 | 2.2940 | 48.4330 | 18.7361 |
| 2232 | 15202 | NM_031093 | 94.9948 | 1630.9773 | 97.0261 | 1017.4003 | 358.3999 |
| 2693 | 19694 | Z48444 | 94.8400 | 35.2940 | 1.0696 | 39.4846 | 18.5360 |
| 1852 | 18076 | NM_013030 | 94.7884 | 0.4443 | 1.5758 | 32.3208 | 28.9133 |
| 1606 | 15450 | AI639035 | 94.7884 | 14.0293 | 0.5515 | 20.3809 | 6.5776 |
| 86 | 23343 | AA800016 | 94.7884 | 22.5627 | 0.8490 | 30.7679 | 10.1335 |
| 2343 | 24644 | NM_031972 | 94.6852 | 48.7800 | 35.4267 | 59.7429 | 17.0549 |
| 2206 | 16292 | NM_030860 | 94.5820 | 55.0530 | 4.1845 | 23.2692 | 28.5015 |
| 2642 | 14966 | X07551 | 94.5820 | 92.8293 | 8.8838 | 139.4153 | 46.0119 |
| 2608 | 25547 | S78556 | 94.5304 | 260.6713 | 11.4421 | 355.9494 | 129.4296 |
| 67 | 17875 | AA799755 | 94.4788 | 20.1533 | 1.4421 | 2.7236 | 25.5290 |
| 1812 | 20945 | NM_012875 | 94.4788 | 2040.6570 | 88.0696 | 1595.1554 | 294.2624 |
| 2564 | 15380 | NM_139083 | 94.4272 | 1863.6317 | 378.2755 | 935.9807 | 366.6477 |
| 2152 | 17729 | NM_022697 | 94.3756 | 1776.1277 | 125.5025 | 1324.7848 | 228.2950 |
| 1653 | 5050 | D10655 | 94.3756 | 346.5397 | 15.9769 | 516.2596 | 120.7928 |
| 1761 | 1299 | NM_012610 | 94.3756 | 232.6140 | 23.9980 | 115.5967 | 73.0578 |
| 62 | 20994 | AA799717 | 94.3756 | 138.7977 | 2.4628 | 119.6022 | 30.7760 |
| 34 | 11350 | AA799488 | 94.3240 | 31.5207 | 1.8216 | 63.4682 | 29.9900 |
| 2531 | 24609 | NM_133585 | 94.2724 | 21.7690 | 0.8361 | 37.0927 | 240.4283 |
| 50 | 20975 | AA799599 | 94.2724 | 97.1543 | 6.9311 | 148.5012 | 38.4501 |
| 285 | 16139 | AA874927 | 94.2208 | 131.1017 | 1.4153 | 140.0184 | 32.8568 |
| 185 | 25110 | AA848546 | 94.2208 | 66.0483 | 2.2815 | 84.1086 | 16.1268 |
| 344 | 19321 | AA891666 | 94.1692 | 221.5020 | 2.7681 | 249.6174 | 41.8258 |
| 740 | 25137 | AB005540 | 94.1692 | 25.3893 | 0.8747 | 34.1161 | 11.2576 |
| 1827 | 1977 | NM_012930 | 94.0144 | 318.8380 | 83.1405 | 552.5388 | 109.7705 |
| 1877 | 5837 | NM_013143 | 94.0144 | 20.2693 | 20.7539 | 108.6565 | 64.8043 |
| 1170 | 13090 | AI136977 | 93.9628 | 75.7560 | 2.9234 | 99.2587 | 42.8080 |
| 2596 | 19888 | S56464 | 93.9628 | 183.8520 | 7.2264 | 133.6778 | 51.2786 |
| 30 | 18365 | AA799442 | 93.9112 | 88.5537 | 2.3153 | 112.8918 | 77.1579 |
| 2074 | 15911 | NM_019907 | 93.9112 | 134.4520 | 7.6642 | 194.2536 | 44.9941 |
| 2131 | 4615 | NM_022525 | 93.8596 | 884.0333 | 50.4101 | 586.9161 | 207.1906 |
| 1605 | 4035 | AI639023 | 93.8596 | 79.2893 | 2.2117 | 89.5571 | 32.1003 |
| 462 | 21989 | AA894188 | 93.8080 | 87.8107 | 1.1828 | 98.5063 | 18.7718 |
| 2625 | 1283 | U61729 | 93.7564 | 90.1383 | 2.9178 | 110.1922 | 40.4636 |
| 2434 | 25262 | NM_053814 | 93.7564 | 44.5400 | 1.0002 | 42.3342 | 14.5553 |
| 2463 | 17653 | NM_053986 | 93.7564 | 24.3393 | 0.6370 | 26.8303 | 11.6319 |
| 2111 | 22499 | NM_022393 | 93.7564 | 32.1947 | 2.0163 | 20.9150 | 12.1488 |
| 2652 | 16715 | X53054 | 93.7049 | 21.5823 | 1.3680 | 15.6291 | 12.6757 |
| 2579 | 15761 | NM_145091 | 93.6533 | 12.5080 | 2.4564 | 32.0276 | 15.4752 |
| 2006 | 16382 | NM_017343 | 93.6533 | 81.5550 | 2.0418 | 97.3052 | 31.9369 |
| 1634 | 19152 | AI639387 | 93.6533 | 78.5820 | 1.4082 | 90.5775 | 21.3603 |
| 357 | 23083 | AA891802 | 93.6017 | 51.3330 | 1.3946 | 55.2908 | 16.9676 |
| 1692 | 23486 | K02816 | 93.5501 | 290.4820 | 8.6006 | 378.9140 | 72.1118 |
| 1671 | 12360 | H31456 | 93.4985 | 35.1090 | 3.2411 | 60.0728 | 25.8807 |
| 1899 | 20728 | NM_013217 | 93.4985 | 699.3180 | 33.9924 | 915.6553 | 202.6830 |
| 100 | 21086 | AA800305 | 93.3953 | 60.6500 | 3.0185 | 87.2985 | 25.8805 |
| 2296 | 20840 | NM_031604 | 93.3437 | 101.9150 | 2.6021 | 91.4824 | 39.3794 |
| 2439 | 16099 | NM_053837 | 93.2921 | 512.4647 | 14.8688 | 429.8306 | 62.4877 |
| 2214 | 15683 | NM_031011 | 93.2405 | 79.7163 | 2.9852 | 102.8190 | 42.0203 |
| 2552 | 16400 | NM_138828 | 93.1889 | 483.1180 | 51.1795 | 316.1201 | 193.0789 |
| 16 | 25103 | AA685876 | 93.1373 | 87.7253 | 2.0728 | 65.0932 | 41.5711 |
| 110 | 17649 | AA800735 | 93.1373 | 192.8347 | 9.2057 | 262.4957 | 83.2930 |
| 1996 | 23825 | NM_017299 | 93.1373 | 57.1467 | 1.4480 | 63.5002 | 19.0013 |
| 2287 | 9620 | NM_031570 | 93.0857 | 1102.1280 | 83.6335 | 797.7883 | 183.0347 |
| 2501 | 9952 | NM_080902 | 93.0857 | 415.3687 | 15.3125 | 545.4961 | 105.7077 |
| 747 | 1097 | AF016296 | 93.0857 | 264.3353 | 8.4195 | 303.0990 | 100.2771 |
| 1636 | 5014 | AI639410 | 93.0341 | 23.0340 | 1.6781 | 43.0242 | 18.7763 |
| 75 | 14504 | AA799804 | 93.0341 | 388.5153 | 24.7725 | 528.3181 | 118.3967 |
| 2350 | 20554 | NM_031987 | 92.9825 | 64.9137 | 3.4897 | 75.3841 | 36.9748 |
| 2443 | 16361 | NM_053853 | 92.9825 | 28.3843 | 2.5207 | 44.7460 | 11.8878 |
| 200 | 22028 | AA850060 | 99.5872 | 13375.5767 | 47.8547 | 9974.9350 | 3731.3312 |
| 831 | 13787 | AI011462 | 99.3808 | 37.6450 | 0.1778 | 153.1175 | 15.6581 |

TABLE 5DD-continued

Norepinephrine--Core Tox Markers
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2497 | 17662 | NM_080697 | 99.0712 | 118.4780 | 2.1611 | 176.1766 | 35.6440 |
| 1078 | 9466 | AI073135 | 98.9164 | 175.5210 | 1.9121 | 31.3618 | 134.6260 |
| 987 | 2360 | AI045911 | 98.8648 | 233.2330 | 0.5882 | 219.7876 | 49.6824 |
| 1475 | 16087 | AI231011 | 98.8132 | 67.8230 | 0.4857 | 100.7151 | 34.7807 |
| 968 | 7992 | AI044845 | 98.6584 | 127.6070 | 0.5441 | 139.5139 | 42.5869 |
| 1439 | 16203 | AI229196 | 98.6068 | 85.3683 | 3.5578 | 139.3817 | 48.8127 |
| 948 | 5371 | AI044089 | 98.6068 | 23.7507 | 0.4097 | 10.4518 | 9.4883 |
| 1009 | 8285 | AI059298 | 98.4520 | 90.8623 | 0.4857 | 95.7843 | 28.6578 |
| 882 | 12796 | AI013495 | 98.2972 | 38.0497 | 0.3103 | 41.2723 | 27.3302 |
| 974 | 24290 | AI045040 | 98.2972 | 90.5837 | 2.6147 | 361.6428 | 374.6028 |
| 2071 | 16 | NM_019386 | 98.1940 | 1822.0580 | 42.5386 | 1233.0724 | 320.4945 |
| 479 | 9114 | AA899951 | 98.1424 | −8.5253 | 1.4263 | 31.4281 | 25.9729 |
| 674 | 11500 | AA963171 | 97.9360 | 671.5923 | 15.7799 | 465.7576 | 119.3952 |
| 2209 | 21805 | NM_030987 | 97.8844 | 480.5100 | 7.3892 | 343.1120 | 76.1132 |
| 166 | 6136 | AA819086 | 97.8328 | 47.2520 | 0.9249 | 66.0209 | 16.0978 |
| 837 | 21468 | AI011749 | 97.7812 | −83.5257 | 5.4755 | 44.3069 | 81.3374 |
| 1174 | 15969 | AI137302 | 97.6780 | 280.0903 | 1.1936 | 311.6277 | 53.2081 |
| 1081 | 19371 | AI100841 | 97.5748 | 65.2587 | 0.7805 | 89.8295 | 32.0983 |
| 876 | 26148 | AI013396 | 97.5748 | 44.5913 | 0.4646 | 43.9464 | 31.9266 |
| 1109 | 5891 | AI102745 | 97.5232 | 110.9577 | 3.0678 | 40.5915 | 59.6948 |
| 2262 | 23097 | NM_031145 | 97.5232 | 89.0547 | 1.0120 | 70.6426 | 24.0133 |
| 1513 | 15246 | AI232332 | 97.4716 | 46.4467 | 0.4743 | 53.2756 | 15.3668 |
| 1195 | 13375 | AI145454 | 97.4716 | 4.4203 | 0.9991 | 35.7215 | 22.1446 |
| 1576 | 4911 | AI236405 | 97.4716 | 23.6933 | 0.2376 | 28.3943 | 14.1208 |
| 1322 | 16438 | AI176294 | 97.4716 | 635.3450 | 11.7897 | 472.8945 | 130.7109 |
| 685 | 2095 | AA964362 | 97.4716 | 93.3360 | 1.4555 | 124.5051 | 25.6095 |
| 725 | 10614 | AA997985 | 97.4716 | 316.9750 | 10.2247 | 136.9156 | 110.6099 |
| 170 | 9310 | AA819367 | 97.3684 | 91.8597 | 1.0511 | 121.8552 | 36.8422 |
| 1088 | 18212 | AI101494 | 97.3684 | 41.2213 | 5.1671 | −19.9520 | 34.9405 |
| 1182 | 12654 | AI137864 | 97.3684 | 112.8583 | 10.6705 | 234.9660 | 90.1942 |
| 879 | 22493 | AI013466 | 97.3684 | 256.6973 | 1.8373 | 213.1873 | 56.4399 |
| 1023 | 10302 | AI060137 | 97.3684 | 27.9787 | 0.5209 | 17.3983 | 19.9656 |
| 1545 | 6387 | AI234664 | 97.3168 | 70.9853 | 0.3674 | 75.6112 | 15.3600 |
| 1118 | 17642 | AI103357 | 97.2136 | 21.3120 | 0.7327 | 43.6575 | 20.4405 |
| 615 | 22682 | AA945910 | 97.2136 | 23.4507 | 0.9202 | 27.2053 | 31.3254 |
| 1543 | 14202 | AI234326 | 97.1620 | 77.3710 | 1.1937 | 96.9214 | 35.6696 |
| 212 | 21456 | AA851239 | 97.1620 | 22.3423 | 0.8300 | 7.7116 | 22.1473 |
| 561 | 19016 | AA943015 | 97.1104 | 395.3907 | 7.3295 | 277.0878 | 74.8662 |
| 1383 | 15091 | AI178740 | 97.0588 | 99.1530 | 1.7515 | 138.2585 | 37.7845 |
| 2272 | 20087 | NM_031357 | 97.0072 | 67.3520 | 0.6694 | 66.8587 | 27.1307 |
| 2381 | 6712 | NM_053448 | 96.9556 | 169.7277 | 1.8176 | 189.1622 | 57.1238 |
| 695 | 2476 | AA964841 | 96.9040 | 53.3413 | 0.8480 | 55.5428 | 32.4163 |
| 1229 | 22707 | AI170384 | 96.8008 | 17.7820 | 1.2756 | 42.3511 | 26.8561 |
| 864 | 7171 | AI012761 | 96.8008 | 94.3337 | 1.2532 | 83.6124 | 30.5140 |
| 1274 | 23703 | AI172265 | 96.6976 | 31.0490 | 0.3480 | 29.0504 | 14.2729 |
| 1167 | 24212 | AI136747 | 96.6976 | 2582.6843 | 21.4587 | 2283.2783 | 408.2796 |
| 1210 | 149 | AI169272 | 96.6976 | 66.2783 | 0.8071 | 76.7152 | 15.8431 |
| 1019 | 8423 | AI059728 | 96.6976 | 227.7503 | 3.3440 | 366.9388 | 292.2468 |
| 840 | 146251 | AI011949 | 96.6976 | 68.5233 | 0.9441 | 81.2621 | 23.5113 |
| 1072 | 9408 | AI072835 | 96.5944 | 59.6917 | 1.7766 | 39.0365 | 17.3643 |
| 813 | 21825 | AI010418 | 96.5944 | 56.4700 | 1.5143 | 88.3463 | 35.4890 |
| 123 | 21427 | AA801181 | 96.4912 | 79.2123 | 1.3763 | 103.8133 | 29.5468 |
| 776 | 12828 | AI008796 | 96.4396 | 57.7353 | 0.9357 | 66.8836 | 32.7675 |
| 1825 | 20757 | NM_012923 | 96.3364 | 2414.1663 | 17.0973 | 2271.8254 | 422.0171 |
| 1446 | 24117 | AI229785 | 96.3364 | 26.6910 | 2.0888 | 10.4170 | 17.5507 |
| 565 | 2675 | AA943099 | 96.3364 | 1148.9510 | 10.6599 | 947.0135 | 243.8608 |
| 952 | 12778 | AI044211 | 96.2848 | 152.6843 | 2.5320 | 183.5233 | 43.7221 |
| 540 | 21500 | AA925353 | 96.2848 | 237.3877 | 54.4652 | 89.4782 | 89.7241 |
| 1234 | 16689 | AI170561 | 96.2332 | 104.0237 | 1.2517 | 108.6236 | 32.2312 |
| 2571 | 22595 | NM_139253 | 96.2332 | 166.8360 | 2.7171 | 194.4342 | 42.3266 |
| 195 | 21264 | AA849731 | 96.2332 | 122.8987 | 1.7320 | 103.6940 | 20.7544 |
| 1432 | 13741 | AI228462 | 96.1816 | 26.0263 | 0.3138 | 32.8458 | 17.8267 |
| 1128 | 11516 | AI103962 | 96.1300 | 81.2373 | 2.7040 | 119.3780 | 33.2341 |
| 552 | 20327 | AA926265 | 96.1300 | 122.6457 | 1.3007 | 117.4239 | 39.8879 |
| 1409 | 4189 | AI180081 | 96.0784 | 343.5817 | 2.9074 | 392.8493 | 91.9355 |
| 1505 | 8959 | AI232128 | 96.0784 | 82.2207 | 1.8721 | 58.2600 | 21.4847 |
| 1496 | 7036 | AI231801 | 96.0784 | 90.0790 | 2.0404 | 113.9122 | 21.4538 |
| 487 | 4732 | AA900343 | 96.0784 | 165.0377 | 1.5663 | 187.3527 | 37.0863 |
| 1008 | 8265 | AI059246 | 96.0784 | 118.6537 | 1.7219 | 90.1576 | 33.6246 |
| 957 | 5454 | AI044330 | 96.0784 | 32.1143 | 2.3840 | 14.5283 | 17.3022 |
| 1236 | 15393 | AI170663 | 96.0268 | 270.5937 | 15.8566 | 187.4393 | 42.2588 |
| 1285 | 2208 | AI172472 | 96.0268 | 162.0793 | 6.7166 | 223.0357 | 44.7220 |

TABLE 5DD-continued

Norepinephrine--Core Tox Markers
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 919 | 10685 | AI030213 | 96.0268 | 23.6977 | 0.5614 | 36.1425 | 15.1425 |
| 1535 | 15085 | AI233829 | 95.9752 | 885.2107 | 4.7521 | 972.5390 | 174.5670 |

TABLE 5EE

NOREPINEPHRINE
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 1031 | 6892 | AA800551 | 99.4813 | 263.3163 | 66.1789 | 66.7882 | 31.0846 |
| 2161 | 6891 | NM_022934 | 99.4295 | 805.9879 | 119.4903 | 250.4163 | 82.8820 |
| 2695 | 8664 | Z75029 | 99.2739 | 1607.5828 | 418.0726 | 112.2090 | 188.2090 |
| 2341 | 17734 | NM_031970 | 98.7033 | 3990.9268 | 581.3210 | 1027.2344 | 428.8438 |
| 1335 | 16518 | AI176546 | 98.6515 | 1977.6365 | 445.9983 | 763.7900 | 253.8228 |
| 2341 | 17736 | NM_031970 | 98.4440 | 2529.2289 | 492.7151 | 608.7162 | 319.5188 |
| 1944 | 21663 | NM_017126 | 98.3921 | 1440.2189 | 312.1577 | 373.7786 | 161.1208 |
| 2499 | 363 | NM_080780 | 98.2365 | 112.7505 | 30.0230 | 44.4177 | 19.3890 |
| 2483 | 1892 | NM_057144 | 98.1328 | 2802.2854 | 341.4428 | 1202.3530 | 371.2073 |
| 1866 | 357 | NM_013086 | 98.0809 | 73.5020 | 15.4920 | 25.2192 | 17.8083 |
| 2173 | 354 | NM_024127 | 98.0809 | 553.4614 | 186.9081 | 160.6835 | 74.3664 |
| 2185 | 17765 | NM_024351 | 98.0809 | 2316.9869 | 210.1469 | 1388.9983 | 275.7749 |
| 1854 | 17401 | NM_013043 | 97.8734 | 1692.6079 | 353.9725 | 599.5431 | 218.5884 |
| 2341 | 17735 | NM_031970 | 97.8216 | 4082.1361 | 1121.4657 | 1084.0936 | 505.1141 |
| 2449 | 385 | NM_053885 | 95.6950 | −0.6526 | 7.8050 | 46.1192 | 22.5750 |
| 2095 | 20204 | NM_022196 | 95.4876 | 9.0690 | 9.4593 | 42.6701 | 13.7144 |
| 1750 | 16026 | NM_012578 | 95.2801 | 78.3944 | 13.6112 | 159.1730 | 46.7838 |
| 272 | 11865 | AA866383 | 93.9315 | 26.5984 | 8.8112 | 64.6395 | 19.3332 |
| 348 | 23058 | AA891733 | 93.6722 | 146.0564 | 35.0956 | 283.2263 | 71.9984 |
| 2342 | 8663 | NM_031971 | 93.2832 | 727.9441 | 520.6358 | −55.1429 | 146.5325 |
| 2342 | 1475 | NM_031971 | 92.7645 | 1938.9946 | 1033.7095 | 94.4565 | 217.4632 |
| 2316 | 18059 | NM_031707 | 92.4533 | 273.4070 | 133.1863 | 27.2551 | 31.3860 |
| 2277 | 20448 | NM_031530 | 92.4015 | 736.0876 | 490.7340 | 74.8256 | 108.9987 |
| 2268 | 11258 | NM_031327 | 92.2977 | 110.7936 | 89.7714 | 7.7077 | 21.7879 |
| 2277 | 20449 | NM_031530 | 92.2459 | 1033.4939 | 521.5685 | 98.5816 | 165.7143 |
| 1759 | 2629 | NM_012603 | 92.0902 | 90.5585 | 40.0410 | 20.9245 | 15.5802 |
| 1931 | 923 | NM_017076 | 92.0384 | 103.1869 | 40.4358 | 16.6868 | 17.6992 |
| 2044 | 17908 | NM_019242 | 92.0384 | 202.9623 | 78.7039 | 43.1288 | 31.1735 |
| 1581 | 18259 | AI236601 | 91.9865 | 238.4859 | 97.3566 | 93.3552 | 46.0079 |
| 2005 | 355 | NM_017334 | 91.9346 | 87.8504 | 34.0407 | 9.5089 | 28.1285 |
| 2485 | 15461 | NM_057191 | 91.9346 | 444.1755 | 193.8804 | 106.2839 | 54.2785 |
| 2267 | 18597 | NM_031325 | 91.8309 | 263.7544 | 75.1004 | 93.6741 | 61.8674 |
| 2173 | 353 | NM_024127 | 91.8309 | 435.7853 | 161.9288 | 114.4376 | 63.1917 |
| 1833 | 223 | NM_012945 | 91.7790 | 144.8780 | 67.7257 | 12.5453 | 23.9093 |
| 2528 | 244 | NM_133551 | 91.6753 | 303.9644 | 134.5401 | 61.5793 | 37.4726 |
| 1330 | 15191 | AI176456 | 91.4160 | 1323.7188 | 675.7651 | 175.8255 | 552.7855 |
| 1746 | 23868 | NM_012551 | 91.3122 | 894.6340 | 436.2035 | 212.6165 | 220.7827 |
| 71 | 11530 | AA799773 | 91.1566 | 999.6595 | 378.7252 | 205.4721 | 156.9648 |
| 542 | 5167 | AA925529 | 91.0788 | 73.3379 | 26.1360 | 25.7047 | 27.9237 |
| 405 | 19085 | AA892598 | 91.0529 | 92.1740 | 18.5335 | 52.0272 | 13.8484 |
| 312 | 15510 | AA875428 | 91.0270 | 196.0304 | 36.3396 | 281.5123 | 54.2591 |
| 387 | 22868 | AA892391 | 90.9232 | 14.9119 | 4.4812 | 28.6827 | 8.8600 |
| 746 | 3799 | AF002281 | 90.6380 | 750.1286 | 157.2905 | 379.7988 | 110.5086 |
| 2178 | 1742 | NM_024150 | 90.6380 | 104.5040 | 42.1347 | 32.4741 | 21.1420 |
| 2229 | 79 | NM_031079 | 90.6120 | 18.4890 | 9.5247 | 46.8097 | 17.7675 |
| 1944 | 21662 | NM_017126 | 90.4305 | 37.9036 | 11.1011 | 3.7015 | 11.5339 |
| 329 | 18582 | AA891207 | 90.2490 | 168.8623 | 27.1634 | 251.9951 | 55.6036 |
| 2437 | 16173 | NM_053822 | 90.2230 | 67.9840 | 34.6720 | 13.2814 | 126.1690 |
| 2293 | 5496 | NM_031589 | 90.1971 | 145.9714 | 10.2833 | 68.5173 | 13.6940 |
| 1899 | 20728 | NM_013217 | 90.1452 | 606.7143 | 125.8443 | 917.5459 | 201.3214 |
| 2185 | 17764 | NM_024351 | 90.0156 | 3163.5308 | 519.9248 | 1938.2249 | 384.4218 |
| 328 | 11940 | AA891108 | 89.9637 | 45.6983 | 7.5672 | 25.0523 | 8.4310 |
| 2413 | 857 | NM_053633 | 89.9118 | 29.8086 | 7.9906 | 10.3579 | 7.6130 |
| 1607 | 10071 | AI639058 | 89.8081 | 540.8850 | 117.5623 | 263.9332 | 106.1775 |
| 2111 | 22499 | NM_022393 | 89.6006 | 50.9446 | 12.0167 | 20.7009 | 11.8397 |
| 319 | 15617 | AA875620 | 89.5488 | 35.0314 | 14.6256 | 15.0018 | 8.2473 |
| 319 | 15618 | AA875620 | 89.2894 | 146.0054 | 29.2866 | 99.5980 | 20.9977 |
| 2075 | 18715 | NM_020075 | 89.2376 | 256.8166 | 57.9299 | 151.0548 | 40.5827 |
| 1718 | 21400 | M36410 | 89.0560 | 61.2115 | 13.3773 | 106.3284 | 32.1543 |

TABLE 5EE-continued

NOREPINEPHRINE
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 2247 | 19040 | NM_031114 | 89.0301 | 452.5429 | 120.7826 | 253.2807 | 75.3125 |
| 2403 | 21445 | NM_053587 | 88.9782 | 60.1424 | 23.7036 | 10.5246 | 22.9670 |
| 2484 | 19481 | NM_057153 | 88.7967 | 68.2556 | 21.4951 | 130.6260 | 42.5148 |
| 2550 | 15189 | NM_138826 | 88.5114 | 757.2838 | 239.9481 | 336.5505 | 361.6568 |
| 2282 | 18389 | NM_031545 | 88.2521 | 1826.1269 | 641.7089 | 825.5171 | 459.3395 |
| 2172 | 21239 | NM_024125 | 88.2521 | 243.9681 | 83.0284 | 118.3888 | 62.3919 |
| 536 | 16499 | AA925300 | 88.0965 | −1.1534 | 33.3176 | 57.7244 | 33.3571 |
| 2553 | 23166 | NM_138839 | 88.0446 | 170.4068 | 42.1077 | 108.1382 | 29.1160 |
| 2450 | 753 | NM_053897 | 87.9149 | 68.1009 | 5.2162 | 57.5494 | 20.5305 |
| 2556 | 25039 | NM_138877 | 87.6037 | 286.6995 | 44.2026 | 404.9923 | 94.3883 |
| 2419 | 16122 | NM_053698 | 87.5778 | 119.7388 | 37.9603 | 64.7526 | 28.1717 |
| 1834 | 5034 | NM_012966 | 87.5778 | 1164.1774 | 132.1500 | 884.7553 | 148.4135 |
| 1858 | 14997 | NM_013059 | 87.5000 | 555.6661 | 54.0072 | 746.1537 | 155.8718 |
| 1419 | 1377 | AI227715 | 87.5000 | 38.9810 | 5.4946 | 57.5690 | 19.5886 |
| 1868 | 1521 | NM_013091 | 87.4222 | 128.7296 | 49.7904 | 68.1875 | 34.1946 |
| 2673 | 602 | X68101 | 87.3185 | 139.4460 | 48.7242 | 229.9013 | 48.2442 |
| 2342 | 8662 | NM_031971 | 86.9813 | 257.6134 | 185.2497 | −34.8090 | 75.2818 |
| 2342 | 8661 | NM_031971 | 86.9813 | 250.8268 | 154.0243 | 10.2067 | 65.0503 |
| 2089 | 22351 | NM_021835 | 86.7998 | 65.9775 | 18.6803 | 41.1423 | 15.1897 |
| 1971 | 1527 | NM_017220 | 86.7220 | 8.1863 | 6.8239 | 25.1339 | 12.3022 |
| 2359 | 12364 | NM_033351 | 86.6961 | 74.7339 | 33.5477 | 150.7245 | 39.4713 |
| 1633 | 18295 | AI639381 | 86.6961 | 83.1748 | 64.3321 | 173.4615 | 51.1680 |
| 972 | 20983 | AI044900 | 86.4108 | 345.9545 | 55.2211 | 479.1295 | 109.6979 |
| 2273 | 18654 | NM_031358 | 86.3330 | 89.2891 | 44.9318 | 218.8692 | 64.6229 |
| 1840 | 764 | NM_012988 | 86.3330 | 50.5666 | 18.4217 | 101.3529 | 27.5301 |
| 2228 | 6349 | NM_031077 | 86.2033 | 116.8153 | 14.3162 | 151.7734 | 33.0023 |
| 2532 | 1271 | NM_133593 | 86.1255 | 52.7259 | 9.5378 | 80.4345 | 15.6506 |
| 2687 | 12978 | X96437 | 86.0996 | 308.5996 | 230.1202 | 76.3885 | 43.7321 |
| 609 | 22625 | AA945704 | 86.0477 | 188.2085 | 98.2440 | 65.0820 | 29.2058 |
| 260 | 23336 | AA859981 | 85.9959 | 66.5710 | 8.7131 | 93.1635 | 24.9841 |
| 76 | 11422 | AA799812 | 85.9699 | 53.8790 | 22.4691 | 113.2816 | 31.5290 |
| 343 | 4448 | AA891631 | 85.8662 | 17.4248 | 5.1796 | 35.2285 | 10.6554 |
| 1821 | 24431 | NM_012912 | 85.7884 | 425.6855 | 273.1575 | 73.8453 | 65.3863 |
| 1792 | 17257 | NM_012766 | 85.7884 | 242.1913 | 50.2257 | 365.4273 | 115.4767 |
| 29 | 17137 | AA799438 | 85.7624 | 367.5156 | 191.1552 | 857.4529 | 258.2968 |
| 1965 | 5676 | NM_017188 | 85.7365 | 25.5498 | 28.0838 | 76.9172 | 45.5600 |
| 95 | 21069 | AA800200 | 85.6846 | 36.6796 | 3.9627 | 49.5086 | 14.2318 |
| 2485 | 15460 | NM_057191 | 85.6328 | 436.1656 | 264.6770 | 100.3814 | 63.7207 |
| 750 | 19058 | AF054618 | 85.6328 | 19.0441 | 2.7660 | 24.9122 | 12.4186 |
| 253 | 14213 | AA859827 | 85.5809 | 75.0461 | 41.6040 | 6.0349 | 18.8872 |
| 584 | 20795 | AA944397 | 85.5290 | 361.8271 | 199.9596 | 110.7948 | 57.7895 |
| 1056 | 8665 | AI071965 | 99.1183 | 3826.7229 | 1669.2221 | 413.1920 | 335.0125 |
| 1595 | 8759 | AI237646 | 98.4440 | 339.5654 | 116.1490 | 35.3245 | 57.8247 |
| 669 | 23732 | AA957653 | 98.3921 | 1134.9133 | 214.4420 | 329.8413 | 145.8289 |
| 1445 | 15212 | AI229753 | 98.2884 | 254.2340 | 76.3460 | 55.2676 | 36.1656 |
| 769 | 3808 | AI008643 | 98.1328 | 1556.4444 | 331.4931 | 556.3567 | 199.8705 |
| 663 | 23314 | AA957270 | 98.1328 | 1320.4768 | 670.9375 | 77.5428 | 192.5340 |
| 820 | 3139 | AI010618 | 98.0290 | 3317.1991 | 585.8836 | 1711.6874 | 340.0816 |
| 1046 | 9604 | AI071230 | 97.9772 | 2744.8634 | 1014.6649 | 384.8144 | 345.9048 |
| 1434 | 16053 | AI228596 | 97.9772 | 333.2519 | 75.7808 | 117.3370 | 86.2544 |
| 1493 | 15171 | AI231792 | 97.9253 | 2108.9989 | 591.0550 | 1029.9120 | 260.3607 |
| 1294 | 2331 | AI175045 | 97.7697 | 1845.3030 | 533.8146 | 379.6211 | 333.8526 |
| 1343 | 16124 | AI176963 | 97.7697 | 619.0150 | 169.0273 | 228.5083 | 87.7501 |
| 492 | 14712 | AA900860 | 97.5104 | 324.5103 | 65.6300 | 155.8050 | 42.3838 |
| 579 | 22378 | AA944212 | 97.2510 | 134.3710 | 28.4687 | 272.1390 | 61.5948 |
| 781 | 21632 | AI009167 | 97.1473 | 516.5784 | 118.5630 | 200.9806 | 98.2866 |
| 1503 | 3434 | AI232014 | 97.0436 | 2236.3513 | 500.5160 | 753.5275 | 374.6549 |
| 1483 | 23304 | AI231310 | 96.9398 | 214.1941 | 40.7498 | 123.0396 | 36.3114 |
| 739 | 12664 | AA999110 | 96.1618 | 37.5723 | 14.3677 | 112.9597 | 33.6585 |
| 701 | 2861 | AA996583 | 96.1618 | 83.9905 | 15.7656 | 46.8376 | 15.6812 |
| 1299 | 13460 | AI175375 | 95.5394 | 185.8708 | 40.8718 | 334.6733 | 66.9248 |
| 218 | 21514 | AA851660 | 95.3320 | 108.6159 | 26.3403 | 57.8617 | 20.4835 |
| 723 | 3290 | AA997883 | 95.2282 | 259.4525 | 54.3802 | 444.5074 | 79.6490 |
| 1430 | 6102 | AI228335 | 95.0207 | 68.4524 | 17.6339 | 36.5686 | 14.9042 |
| 728 | 3511 | AA998152 | 94.9689 | 224.9530 | 44.7671 | 91.6020 | 52.8324 |
| 494 | 4790 | AA900875 | 94.9170 | −39.7215 | 33.4762 | 151.9333 | 96.7369 |
| 1427 | 12946 | AI228291 | 94.8651 | 135.0391 | 20.0304 | 218.9686 | 41.9762 |
| 714 | 3207 | AA997466 | 94.7614 | 45.5743 | 48.5801 | 242.4891 | 97.5193 |
| 1034 | 8938 | AI070590 | 94.6058 | 9.0184 | 10.2678 | 71.8879 | 34.7491 |
| 1429 | 8917 | AI228301 | 94.3465 | 85.9886 | 24.2129 | 168.4718 | 38.9581 |
| 909 | 12662 | AI029179 | 93.8797 | 24.1668 | 17.5314 | 85.9064 | 31.0954 |
| 1540 | 14494 | AI234222 | 93.8278 | 146.9951 | 34.1009 | 226.4663 | 37.3047 |
| 1122 | 4873 | AI103531 | 93.6722 | 223.9209 | 72.9117 | 447.2041 | 116.5943 |

TABLE 5EE-continued

NOREPINEPHRINE
Timepoint(s): 3, 6 hrs

| SEQ ID | GLGC ID | GenBank Accession No. | LDA Score | Mean Tox | SD Tox | Mean Nontox | SD Nontox |
|---|---|---|---|---|---|---|---|
| 956 | 5442 | AI044299 | 93.5166 | 224.1333 | 69.1508 | 431.7980 | 112.6526 |
| 226 | 18350 | AA858674 | 93.3091 | 241.2716 | 40.0402 | 140.0376 | 60.8767 |
| 1253 | 16599 | AI171366 | 93.2054 | 335.5149 | 61.8090 | 591.6306 | 143.1488 |
| 1522 | 14088 | AI232982 | 93.0498 | 14.6789 | 16.9187 | 81.9165 | 37.8533 |
| 1099 | 16596 | AI102486 | 92.9979 | 158.2274 | 46.7335 | 315.6517 | 82.3981 |
| 1050 | 22929 | AI071578 | 92.9979 | 278.7673 | 75.8229 | 735.8519 | 314.8335 |
| 1227 | 2729 | AI170363 | 92.8423 | 230.7750 | 70.2194 | 481.2179 | 151.9874 |
| 1575 | 15051 | AI236332 | 92.5311 | 208.6471 | 41.5312 | 120.1176 | 109.4713 |
| 153 | 6054 | AA818658 | 92.4533 | 691.3863 | 298.0596 | 51.1399 | 82.1514 |
| 943 | 7913 | AI043849 | 92.3496 | 159.3261 | 65.7056 | 52.0903 | 38.6015 |
| 1176 | 11238 | AI137410 | 92.2199 | 12.9080 | 5.0509 | 41.7424 | 22.5899 |
| 2493 | 8820 | NM_080399 | 92.1162 | 191.3825 | 68.6766 | 400.2327 | 122.6294 |
| 832 | 24022 | AI011474 | 92.0643 | 56.1263 | 13.4650 | 102.0367 | 26.9371 |
| 635 | 9452 | AA955206 | 92.0384 | 1134.7661 | 463.3626 | 264.4877 | 243.9946 |
| 694 | 2459 | AA964755 | 91.9865 | 1774.2951 | 789.0601 | 116.8937 | 251.3637 |
| 1395 | 4188 | AI179366 | 91.9606 | 0.5915 | 9.1017 | 33.1719 | 22.3639 |
| 1173 | 13291 | AI137286 | 91.9346 | 500.4205 | 228.8126 | 170.4361 | 55.9152 |
| 485 | 4725 | AA900290 | 91.9346 | 500.0794 | 221.4606 | 84.4696 | 93.1704 |
| 905 | 11326 | AI029015 | 91.9087 | 82.5878 | 44.3182 | 192.7032 | 58.3028 |
| 991 | 8012 | AI058330 | 91.9087 | 50.4938 | 7.5181 | 29.4405 | 13.8090 |
| 2517 | 7700 | NM_133386 | 91.7790 | 130.7185 | 44.6686 | 39.2479 | 24.6893 |
| 977 | 5775 | AI045378 | 91.7790 | 286.7219 | 134.6842 | 25.8344 | 40.0816 |
| 1237 | 13365 | AI170676 | 91.7531 | 27.3019 | 13.9094 | 80.7765 | 43.8288 |
| 1245 | 17783 | AI171206 | 91.7272 | 686.6200 | 210.1304 | 234.4352 | 89.0104 |
| 1179 | 17402 | AI137553 | 91.6753 | 361.7129 | 84.0620 | 120.8395 | 52.7337 |
| 923 | 10710 | AI030494 | 91.6494 | 64.5291 | 13.7797 | 100.4503 | 23.1614 |
| 1010 | 8290 | AI059312 | 91.5975 | −22.2361 | 13.4745 | 25.3368 | 31.6710 |
| 1063 | 10837 | AI072144 | 91.5716 | 226.3690 | 71.4687 | 84.1778 | 40.4337 |
| 1584 | 22443 | AI236761 | 91.5716 | 114.8048 | 78.8654 | 32.8697 | 23.8497 |
| 973 | 5675 | AI045026 | 91.5197 | 406.3161 | 126.2639 | 157.5955 | 137.4801 |
| 1119 | 11721 | AI103391 | 91.4419 | 34.3244 | 10.5013 | 77.0222 | 30.2750 |
| 497 | 22666 | AA900974 | 91.4160 | 235.1778 | 80.8618 | 77.8863 | 36.8367 |
| 880 | 12233 | AI013474 | 91.4160 | 267.2036 | 65.8534 | 105.4438 | 46.7134 |

TABLE 5FF

Norepinephrine--Core Tox Markers
Timepoint(s): 3, 6 hrs

| SEQ ID | GLGC ID | GenBank Accession No. | LDA Score | Mean Tox | SD Tax | Mean Nontox | SD Nontox |
|---|---|---|---|---|---|---|---|
| 103 | 6892 | AA800551 | 99.4813 | 263.3163 | 66.1789 | 66.7882 | 31.0846 |
| 2161 | 6891 | NM_022934 | 99.4295 | 805.9879 | 119.4903 | 250.4163 | 82.8820 |
| 2695 | 8664 | Z75029 | 99.2739 | 1607.5828 | 418.0726 | 112.2090 | 188.2090 |
| 2341 | 17734 | NM_031970 | 98.7033 | 3990.9268 | 581.3210 | 1027.2344 | 428.8438 |
| 1335 | 16518 | AI176546 | 98.6515 | 1977.6365 | 445.9983 | 763.7900 | 253.8228 |
| 2341 | 17736 | NM_031970 | 98.4440 | 2529.2289 | 492.7151 | 608.7162 | 319.5188 |
| 1944 | 21663 | NM_017126 | 98.3921 | 1440.2189 | 312.1577 | 373.7786 | 161.1208 |
| 2499 | 363 | NM_080780 | 98.2365 | 112.7505 | 30.0230 | 44.4177 | 19.3890 |
| 2483 | 1892 | NM_057144 | 98.1328 | 2802.2854 | 341.4428 | 1202.3530 | 371.2073 |
| 1866 | 357 | NM_013086 | 98.0809 | 73.5020 | 15.4920 | 25.2192 | 17.8083 |
| 2173 | 354 | NM_024127 | 98.0809 | 553.4614 | 186.9081 | 160.6835 | 74.3664 |
| 2185 | 17765 | NM_024351 | 98.0809 | 2316.9869 | 210.1469 | 1388.9983 | 275.7749 |
| 1854 | 17401 | NM_013043 | 97.8734 | 1692.6079 | 353.9725 | 599.5431 | 218.5884 |
| 2341 | 17735 | NM_031970 | 97.8216 | 4082.1361 | 1121.4657 | 1084.0936 | 505.1141 |
| 2449 | 385 | NM_053885 | 95.6950 | −0.6526 | 7.8050 | 46.1192 | 22.5750 |
| 2095 | 20204 | NM_022196 | 95.4876 | 9.0690 | 9.4593 | 42.6701 | 13.7144 |
| 1750 | 16026 | NM_012578 | 95.2801 | 78.3944 | 13.6112 | 159.1730 | 46.7838 |
| 272 | 11865 | AA866383 | 93.9315 | 26.5984 | 8.8112 | 64.6395 | 19.3332 |
| 348 | 23058 | AA891733 | 93.6722 | 146.0564 | 35.0956 | 283.2263 | 71.9984 |
| 2342 | 8663 | NM_031971 | 93.2832 | 727.9441 | 520.6358 | −55.1429 | 146.5325 |
| 2342 | 1475 | NM_031971 | 92.7645 | 1938.9946 | 1033.7095 | 94.4565 | 217.4632 |
| 2316 | 18059 | NM_031707 | 92.4533 | 273.4070 | 133.1863 | 27.2551 | 31.3860 |
| 2277 | 20448 | NM_031530 | 92.4015 | 736.0876 | 490.7340 | 74.8256 | 108.9987 |
| 2268 | 11258 | NM_031327 | 92.2977 | 110.7936 | 89.7714 | 7.7077 | 21.7879 |
| 2277 | 20449 | NM_031530 | 92.2459 | 1033.4939 | 521.5685 | 98.5816 | 165.7143 |
| 1759 | 2629 | NM_012603 | 92.0902 | 90.5585 | 40.0410 | 20.9245 | 15.5802 |
| 1931 | 923 | NM_017076 | 92.0384 | 103.1869 | 40.4358 | 16.6868 | 17.6992 |
| 2044 | 17908 | NM_019242 | 92.0384 | 202.9623 | 78.7039 | 43.1288 | 31.1735 |

TABLE 5FF-continued

Norepinephrine--Core Tox Markers
Timepoint(s): 3, 6 hrs

| SEQ ID | GLGC ID | GenBank Accession No. | LDA Score | Mean Tox | SD Tax | Mean Nontox | SD Nontox |
|---|---|---|---|---|---|---|---|
| 1581 | 18259 | AI236601 | 91.9865 | 238.4859 | 97.3566 | 93.3552 | 46.0079 |
| 2005 | 355 | NM_017334 | 91.9346 | 87.8504 | 34.0407 | 9.5089 | 28.1285 |
| 2485 | 15461 | NM_057191 | 91.9346 | 444.1755 | 193.8804 | 106.2839 | 54.2785 |
| 2267 | 18597 | NM_031325 | 91.8309 | 263.7544 | 75.1004 | 93.6741 | 61.8674 |
| 2173 | 353 | NM_024127 | 91.8309 | 435.7853 | 161.9288 | 114.4376 | 63.1917 |
| 1833 | 223 | NM_012945 | 91.7790 | 144.8780 | 67.7257 | 12.5453 | 23.9093 |
| 2528 | 244 | NM_133551 | 91.6753 | 303.9644 | 134.5401 | 61.5793 | 37.4726 |
| 71 | 11531 | AA799773 | 91.4160 | 1886.5684 | 868.1506 | 398.3255 | 256.0735 |
| 1330 | 15191 | AI176456 | 91.4160 | 1323.7188 | 675.7651 | 175.8255 | 552.7855 |
| 1746 | 23868 | NM_012551 | 91.3122 | 894.6340 | 436.2035 | 212.6165 | 220.7827 |
| 71 | 11530 | AA799773 | 91.1566 | 999.6595 | 378.7252 | 205.4721 | 156.9648 |
| 542 | 5167 | AA925529 | 91.0788 | 73.3379 | 26.1360 | 25.7047 | 27.9237 |
| 405 | 19085 | AA892598 | 91.0529 | 92.1740 | 18.5335 | 52.0272 | 13.8484 |
| 312 | 15510 | AA875428 | 91.0270 | 196.0304 | 36.3396 | 281.5123 | 54.2591 |
| 387 | 22868 | AA892391 | 90.9232 | 14.9119 | 4.4812 | 28.6827 | 8.8600 |
| 746 | 3799 | AF002281 | 90.6380 | 750.1286 | 157.2905 | 379.7988 | 110.5086 |
| 2178 | 1742 | NM_024150 | 90.6380 | 104.5040 | 42.1347 | 32.4741 | 21.1420 |
| 2229 | 79 | NM_031079 | 90.6120 | 18.4890 | 9.5247 | 46.8097 | 17.7675 |
| 1944 | 21662 | NM_017126 | 90.4305 | 37.9036 | 11.1011 | 3.7015 | 11.5339 |
| 329 | 18582 | AA891207 | 90.2490 | 168.8623 | 27.1634 | 251.9951 | 55.6036 |
| 2437 | 16173 | NM_053822 | 90.2230 | 67.9840 | 34.6720 | 13.2814 | 26.1690 |
| 2293 | 5496 | NM_031589 | 90.1971 | 45.9714 | 10.2833 | 68.5173 | 13.6940 |
| 1899 | 20728 | NM_013217 | 90.1452 | 606.7143 | 125.8443 | 917.5459 | 201.3214 |
| 2185 | 17764 | NM_024351 | 90.0156 | 3163.5308 | 519.9248 | 1938.2249 | 384.4218 |
| 328 | 11940 | AA891108 | 89.9637 | 45.6983 | 7.5672 | 25.0523 | 8.4310 |
| 2413 | 857 | NM_053633 | 89.9118 | 29.8086 | 7.9906 | 10.3579 | 7.6130 |
| 1607 | 10071 | AI639058 | 89.8081 | 540.8850 | 117.5623 | 263.9332 | 106.1775 |
| 2111 | 22499 | NM_022393 | 89.6006 | 50.9446 | 12.0167 | 20.7009 | 11.8397 |
| 319 | 15617 | AA875620 | 89.5488 | 35.0314 | 14.6256 | 15.0018 | 8.2473 |
| 319 | 15618 | AA875620 | 89.2894 | 146.0054 | 29.2866 | 99.5980 | 20.9977 |
| 2075 | 18715 | NM_020075 | 89.2376 | 256.8166 | 57.9299 | 151.0548 | 40.5827 |
| 1718 | 21400 | M36410 | 89.0560 | 61.2115 | 13.3773 | 106.3284 | 32.1543 |
| 2247 | 19040 | NM_031114 | 89.0301 | 452.5429 | 120.7826 | 253.2807 | 75.3125 |
| 2403 | 21445 | NM_053587 | 88.9782 | 60.1424 | 23.7036 | 10.5246 | 22.9670 |
| 2484 | 19481 | NM_057153 | 88.7967 | 68.2556 | 21.4951 | 130.6260 | 42.5148 |
| 2550 | 15189 | NM_138826 | 88.5114 | 757.2838 | 239.9481 | 336.5505 | 361.6568 |
| 2282 | 18389 | NM_031545 | 88.2521 | 1826.1269 | 641.7089 | 825.5171 | 459.3395 |
| 2172 | 21239 | NM_024125 | 88.2521 | 243.9681 | 83.0284 | 118.3888 | 62.3919 |
| 536 | 16499 | AA925300 | 88.0965 | −1.1534 | 33.3176 | 57.7244 | 33.3571 |
| 2553 | 23166 | NM_138839 | 88.0446 | 170.4068 | 42.1077 | 108.1382 | 29.1160 |
| 2450 | 753 | NM_053897 | 87.9149 | 68.1009 | 5.2162 | 57.5494 | 20.5305 |
| 2556 | 25039 | NM_138877 | 87.6037 | 286.6995 | 44.2026 | 404.9923 | 94.3883 |
| 2419 | 16122 | NM_053698 | 87.5778 | 119.7388 | 37.9603 | 64.7526 | 28.1717 |
| 1834 | 5034 | NM_012966 | 87.5778 | 1164.1774 | 132.1500 | 884.7553 | 148.4135 |
| 1858 | 14997 | NM_013059 | 87.5000 | 555.6661 | 54.0072 | 746.1537 | 155.8718 |
| 1419 | 1377 | AI227715 | 87.5000 | 38.9810 | 5.4946 | 57.5690 | 19.5886 |
| 1868 | 1521 | NM_013091 | 87.4222 | 128.7296 | 49.7904 | 68.1875 | 34.1946 |
| 2673 | 602 | X68101 | 87.3185 | 139.4460 | 48.7242 | 229.9013 | 48.2442 |
| 2342 | 8662 | NM_031971 | 86.9813 | 257.6134 | 185.2497 | −34.8090 | 75.2818 |
| 2342 | 8661 | NM_031971 | 86.9813 | 250.8268 | 154.0243 | 10.2067 | 65.0503 |
| 2089 | 22351 | NM_021835 | 86.7998 | 65.9775 | 18.6803 | 41.1423 | 15.1897 |
| 1971 | 1527 | NM_017220 | 86.7220 | 8.1863 | 6.8239 | 25.1339 | 12.3022 |
| 2359 | 12364 | NM_033351 | 86.6961 | 74.7339 | 33.5477 | 150.7245 | 39.4713 |
| 1633 | 18295 | AI639381 | 86.6961 | 83.1748 | 64.3321 | 173.4615 | 51.1680 |
| 972 | 20983 | AI044900 | 86.4108 | 345.9545 | 55.2211 | 479.1295 | 109.6979 |
| 2273 | 18654 | NM_031358 | 86.3330 | 89.2871 | 44.9318 | 218.8692 | 64.6229 |
| 1840 | 764 | NM_012988 | 86.3330 | 50.5666 | 18.4217 | 101.3529 | 27.5301 |
| 2228 | 6349 | NM_031077 | 86.2033 | 116.8153 | 14.3162 | 151.7734 | 33.0023 |
| 2532 | 1271 | NM_133593 | 86.1255 | 52.7259 | 9.5378 | 80.4345 | 15.6506 |
| 2687 | 12978 | X96437 | 86.0996 | 308.5996 | 230.1202 | 76.3885 | 43.7321 |
| 609 | 22625 | AA945704 | 86.0477 | 188.2085 | 98.2440 | 65.0820 | 29.2058 |
| 260 | 23336 | AA859981 | 85.9959 | 66.5710 | 8.7131 | 93.1635 | 24.9841 |
| 76 | 11422 | AA799812 | 85.9699 | 53.8790 | 22.4691 | 113.2816 | 31.5290 |
| 343 | 4448 | AA891631 | 85.8662 | 17.4248 | 5.1796 | 35.2285 | 10.6554 |
| 1821 | 24431 | NM_012912 | 85.7884 | 425.6855 | 273.1575 | 73.8453 | 65.3863 |
| 1792 | 17257 | NM_012766 | 85.7884 | 242.1913 | 50.2257 | 365.4273 | 115.4767 |
| 29 | 17137 | AA799438 | 85.7624 | 367.5156 | 191.1552 | 857.4529 | 258.2968 |
| 1965 | 5676 | NM_017188 | 85.7365 | 25.5498 | 28.0838 | 76.9172 | 45.5600 |
| 95 | 21069 | AA800200 | 85.6846 | 36.6796 | 3.9627 | 49.5086 | 14.2318 |
| 2485 | 15460 | NM_057191 | 85.6328 | 436.1656 | 264.6770 | 100.3814 | 63.7207 |
| 750 | 19058 | AF054618 | 85.6328 | 19.0441 | 2.7660 | 24.9122 | 12.4186 |
| 253 | 14213 | AA859827 | 85.5809 | 75.0461 | 41.6040 | 6.0349 | 18.8872 |
| 1056 | 8665 | AI071965 | 99.1183 | 3826.7229 | 1669.2221 | 413.1920 | 335.0125 |

TABLE 5FF-continued

Norepinephrine--Core Tox Markers
Timepoint(s): 3, 6 hrs

| SEQ ID | GLGC ID | GenBank Accession No. | LDA Score | Mean Tox | SD Tax | Mean Nontox | SD Nontox |
|---|---|---|---|---|---|---|---|
| 1595 | 8759 | AI237646 | 98.4440 | 339.5654 | 116.1490 | 35.3245 | 57.8247 |
| 669 | 23732 | AA957653 | 98.3921 | 1134.9133 | 214.4420 | 329.8413 | 145.8289 |
| 1445 | 15212 | AI229753 | 98.2884 | 254.2340 | 76.3460 | 55.2676 | 36.1656 |
| 769 | 3808 | AI008643 | 98.1328 | 1556.4444 | 331.4931 | 556.3567 | 199.8705 |
| 663 | 23314 | AA957270 | 98.1328 | 1320.4768 | 670.9375 | 77.5428 | 192.5340 |
| 820 | 3139 | AI010618 | 98.0290 | 3317.1991 | 585.8836 | 1711.6874 | 340.0816 |
| 1046 | 9604 | AI071230 | 97.9772 | 2744.8634 | 1014.6649 | 384.8144 | 345.9048 |
| 1434 | 16053 | AI228596 | 97.9772 | 333.2519 | 75.7808 | 117.3370 | 86.2544 |
| 1493 | 15171 | AI231792 | 97.9253 | 2108.9989 | 591.0550 | 1029.9120 | 260.3607 |
| 1294 | 2331 | AI175045 | 97.7697 | 1845.3030 | 533.8146 | 379.6211 | 333.8526 |
| 1343 | 16124 | AI176963 | 97.7697 | 619.0150 | 169.0273 | 228.5083 | 87.7501 |
| 492 | 14712 | AA900860 | 97.5104 | 324.5103 | 65.6300 | 155.8050 | 42.3838 |
| 579 | 22378 | AA944212 | 97.2510 | 134.3710 | 28.4687 | 272.1390 | 61.5948 |
| 781 | 21632 | AI009167 | 97.1473 | 516.5784 | 118.5630 | 200.9806 | 98.2866 |
| 1503 | 3434 | AI232014 | 97.0436 | 2236.3513 | 500.5160 | 753.5275 | 374.6549 |
| 1483 | 23304 | AI231310 | 96.9398 | 214.1941 | 40.7498 | 123.0396 | 36.3114 |
| 739 | 12664 | AA999110 | 96.1618 | 37.5723 | 14.3677 | 112.9597 | 33.6585 |
| 701 | 2861 | AA996583 | 96.1618 | 83.9905 | 15.7656 | 46.8376 | 15.6812 |
| 1299 | 13460 | AI175375 | 95.5394 | 185.8708 | 40.8718 | 334.6733 | 66.9248 |
| 218 | 21514 | AA851660 | 95.3320 | 108.6159 | 26.3403 | 57.8617 | 20.4835 |
| 723 | 3290 | AA997883 | 95.2282 | 259.4525 | 54.3802 | 444.5074 | 79.6490 |
| 1430 | 6102 | AI228335 | 95.0207 | 68.4524 | 17.6339 | 36.5686 | 14.9042 |
| 728 | 3511 | AA998152 | 94.9689 | 224.9530 | 44.7671 | 91.6020 | 52.8324 |
| 494 | 4790 | AA900875 | 94.9170 | −39.7215 | 33.4762 | 151.9333 | 96.7369 |
| 1427 | 12946 | AI228291 | 94.8651 | 135.0391 | 20.0304 | 218.9686 | 41.9762 |
| 714 | 3207 | AA997466 | 94.7614 | 45.5745 | 48.5801 | 242.4891 | 97.5193 |
| 1034 | 8938 | AI070590 | 94.6058 | 9.0184 | 10.2678 | 71.8879 | 34.7491 |
| 1429 | 8917 | AI228301 | 94.3465 | 85.9886 | 24.2129 | 168.4718 | 38.9581 |
| 909 | 12662 | AI029179 | 93.8797 | 24.1668 | 17.5314 | 85.9064 | 31.0954 |
| 1540 | 14494 | AI234222 | 93.8278 | 146.9951 | 34.1009 | 226.4663 | 37.3047 |
| 1122 | 4873 | AI103531 | 93.6722 | 223.9209 | 72.9117 | 447.2041 | 116.5943 |
| 956 | 5442 | AI044299 | 93.5166 | 224.1333 | 69.1508 | 431.7980 | 112.6526 |
| 226 | 18350 | AA858674 | 93.3091 | 241.2716 | 40.0402 | 140.0376 | 60.8767 |
| 1253 | 16599 | AI171366 | 93.2054 | 335.5149 | 61.8090 | 591.6306 | 143.1488 |
| 1522 | 14088 | AI232982 | 93.0498 | 14.6839 | 16.9187 | 81.9165 | 37.8533 |
| 1099 | 16596 | AI102486 | 92.9979 | 158.2274 | 46.7335 | 315.6517 | 82.3981 |
| 1050 | 22929 | AI071578 | 92.9979 | 278.7673 | 75.8229 | 735.8519 | 314.8335 |
| 1227 | 2729 | AI170363 | 92.8423 | 230.7750 | 70.2194 | 481.2179 | 151.9874 |
| 1575 | 15051 | AI236332 | 92.5311 | 208.6471 | 41.5312 | 120.1176 | 109.4713 |
| 153 | 6054 | AA818658 | 92.4533 | 691.3863 | 298.0596 | 51.1399 | 82.1514 |
| 943 | 7913 | AI043849 | 92.3496 | 159.3261 | 65.7056 | 52.0903 | 38.6015 |
| 1176 | 11238 | AI137410 | 92.2199 | 12.9080 | 5.0509 | 41.7424 | 22.5899 |
| 2493 | 8820 | NM_080399 | 92.1162 | 191.3825 | 68.6766 | 400.2327 | 122.6294 |
| 832 | 24022 | AI011474 | 92.0643 | 56.1263 | 13.4650 | 102.0367 | 26.9371 |
| 635 | 9452 | AA955206 | 92.0384 | 1134.7661 | 463.3626 | 264.4877 | 243.9946 |
| 694 | 2459 | AA964755 | 91.9865 | 1774.2951 | 789.0601 | 116.8937 | 251.3637 |
| 1395 | 4188 | AI179366 | 91.9606 | 0.5915 | 9.1017 | 33.1719 | 22.3639 |
| 1173 | 13291 | AI137286 | 91.9346 | 500.4205 | 228.8126 | 170.4361 | 55.9152 |
| 485 | 4725 | AA900290 | 91.9346 | 500.0794 | 221.4606 | 84.4696 | 93.1704 |
| 905 | 11326 | AI029015 | 91.9087 | 82.5878 | 44.3182 | 192.7032 | 58.3028 |
| 991 | 8012 | AI058330 | 91.9087 | 50.4938 | 7.5181 | 29.4405 | 13.8090 |
| 2517 | 7700 | NM_133386 | 91.7790 | 130.7185 | 44.6686 | 39.2479 | 24.6893 |
| 977 | 5775 | AI045378 | 91.7796 | 286.7219 | 134.6842 | 25.8344 | 40.0816 |
| 1237 | 13365 | AI170676 | 91.7531 | 27.3109 | 13.9094 | 80.7765 | 43.8288 |
| 1245 | 17783 | AI171206 | 91.7272 | 686.6200 | 210.1304 | 234.4352 | 89.0104 |
| 1179 | 17402 | AI137553 | 91.6753 | 361.7129 | 84.0620 | 120.8395 | 52.7337 |
| 923 | 10710 | AI030494 | 91.6494 | 64.5291 | 13.7797 | 100.4503 | 23.1614 |
| 1010 | 8290 | AI059312 | 91.5975 | −22.2361 | 13.4745 | 25.3368 | 31.6710 |
| 1063 | 10837 | AI072144 | 91.5716 | 226.3690 | 71.4687 | 84.1778 | 40.4337 |
| 1584 | 22443 | AI236761 | 91.5716 | 114.8048 | 78.8654 | 32.8697 | 23.8497 |
| 973 | 5675 | AI045026 | 91.5197 | 406.3161 | 126.2639 | 157.5955 | 137.4801 |
| 1119 | 11721 | AI103391 | 91.4419 | 34.3244 | 10.5013 | 77.0222 | 30.2750 |
| 497 | 22666 | AA900974 | 91.4160 | 235.1778 | 80.8618 | 77.8863 | 36.8367 |
| 880 | 12233 | AI013474 | 91.4160 | 267.2036 | 65.8534 | 105.4438 | 46.7134 |

TABLE 5GG

PHENYLPROPANOLAMINE
Timepoint(s): 3 hrs

| SEQ ID | GLGC ID | GenBank Accession No. | LDA Score | Mean Tox | SD Tox | Mean Nontox | SD Nontox |
|---|---|---|---|---|---|---|---|
| 416 | 22871 | AA892859 | 100.0000 | 51.0920 | 0.0113 | 77.1323 | 16.8313 |
| 2337 | 8385 | NM_031836 | 100.0000 | 282.1915 | 2.6523 | 120.1104 | 52.9403 |
| 2173 | 353 | NM_024127 | 100.0000 | 381.2930 | 0.5346 | 116.5377 | 69.7068 |
| 254 | 22630 | AA859848 | 100.0000 | 32.0160 | 0.0071 | 42.9443 | 16.6046 |
| 40 | 21120 | AA799526 | 99.9485 | 168.2730 | 0.0042 | 153.2225 | 44.3360 |
| 2060 | 1238 | NM_019333 | 99.9485 | 181.9290 | 0.1174 | 95.7088 | 41.2651 |
| 536 | 16499 | AA925300 | 99.9485 | −2.6195 | 0.7573 | 57.3633 | 33.6868 |
| 1895 | 1693 | NM_013199 | 99.9485 | −10.6570 | 0.0764 | 49.9027 | 32.9342 |
| 1855 | 11113 | NM_013046 | 99.9485 | 36.4690 | 0.0071 | 36.2673 | 19.6709 |
| 1719 | 17145 | M38566 | 99.8969 | 92.9675 | 0.1025 | 172.2985 | 46.1493 |
| 1941 | 20746 | NM_017113 | 99.8969 | 318.6620 | 0.6661 | 492.2122 | 121.5991 |
| 2438 | 17154 | NM_053835 | 99.8969 | 642.6685 | 0.1280 | 863.0957 | 213.5928 |
| 321 | 15638 | AA875633 | 99.8969 | 521.2955 | 0.4179 | 929.6362 | 307.5192 |
| 268 | 17218 | AA866299 | 99.8969 | 441.5540 | 0.2800 | 363.4876 | 95.7355 |
| 1892 | 1970 | NM_013194 | 99.8969 | 172.2320 | 0.1131 | 123.1975 | 40.7748 |
| 2417 | 3455 | NM_053662 | 99.8969 | 163.8175 | 0.0658 | 139.2460 | 43.3411 |
| 2632 | 25638 | U75923 | 99.8454 | 28.0365 | 0.0530 | 17.3435 | 8.9341 |
| 2587 | 20740 | NM_145878 | 99.8454 | 269.2450 | 1.1003 | 451.9244 | 144.8152 |
| 1899 | 20731 | NM_013217 | 99.8454 | 34.5160 | 0.0170 | 28.2257 | 9.8173 |
| 2202 | 1852 | NM_030826 | 99.8454 | 2247.2410 | 0.4765 | 2519.8118 | 502.0537 |
| 1778 | 322 | NM_012715 | 99.8454 | 31.1435 | 0.0191 | 19.1650 | 11.4591 |
| 2141 | 21062 | NM_022585 | 99.8454 | 136.3905 | 0.1068 | 69.9867 | 37.8547 |
| 1718 | 21400 | M36410 | 99.8454 | 51.6450 | 0.2305 | 106.0690 | 32.2390 |
| 1826 | 1625 | NM_012924 | 99.8454 | 35.0385 | 0.1676 | 13.3271 | 12.2350 |
| 1851 | 17894 | NM_013027 | 99.8454 | 146.7080 | 0.0735 | 168.1589 | 37.2733 |
| 1640 | 22763 | A1639474 | 99.7938 | 78.9745 | 0.8167 | 40.9825 | 12.9541 |
| 2384 | 21498 | NM_053474 | 99.7938 | 12.4685 | 0.0205 | 31.5048 | 18.7609 |
| 2649 | 10819 | X51536 | 99.7938 | 1241.1000 | 0.5813 | 1735.3772 | 412.1568 |
| 2620 | 25593 | U26310 | 99.7938 | 237.3455 | 1.0317 | 135.8000 | 39.4852 |
| 1880 | 21682 | NM_013154 | 99.7938 | 30.0825 | 0.7248 | −9.2475 | 55.5637 |
| 2011 | 17202 | NM_017357 | 99.7938 | 49.2600 | 0.0325 | 36.4196 | 10.9219 |
| 2548 | 5283 | NM_138535 | 99.7938 | 117.2625 | 1.1830 | 67.2504 | 18.0698 |
| 2535 | 1463 | NM_134334 | 99.7423 | 263.6415 | 0.3175 | 364.7819 | 135.6430 |
| 1861 | 17181 | NM_013073 | 99.7423 | 317.0000 | 1.9106 | 191.7197 | 62.6368 |
| 94 | 18430 | AA800197 | 99.7423 | 4.4045 | 0.6300 | 208.5937 | 71.2632 |
| 2672 | 436 | X67877 | 99.7423 | 24.2485 | 0.2949 | 58.5359 | 17.3593 |
| 1828 | 18694 | NM_012931 | 99.7423 | 31.5855 | 0.5424 | −7.0364 | 26.3577 |
| 2552 | 16401 | NM_138828 | 99.7423 | 645.7720 | 0.9390 | 1039.6784 | 520.0369 |
| 2475 | 19658 | NM_057103 | 99.7423 | 45.0500 | 0.9518 | 12.5121 | 15.5439 |
| 2125 | 2697 | NM_022515 | 99.7423 | 1502.2910 | 2.2868 | 2254.4653 | 411.6071 |
| 2547 | 4422 | NM_138531 | 99.6907 | 19.8810 | 0.0127 | 25.0508 | 6.7236 |
| 1796 | 1952 | NM_012788 | 99.6907 | 39.0605 | 0.0559 | 21.2590 | 10.8957 |
| 1209 | 22661 | AI169265 | 99.6907 | 2011.6865 | 1.8066 | 2453.7766 | 431.6276 |
| 2608 | 17626 | S78556 | 99.6907 | 639.4775 | 0.1181 | 733.3278 | 139.0769 |
| 1864 | 20242 | NM_013084 | 99.6907 | 25.9245 | 0.0898 | 2.8847 | 14.0621 |
| 2337 | 8384 | NM_031836 | 99.6907 | 208.5360 | 0.4695 | 96.5039 | 53.1497 |
| 2147 | 17661 | NM_022674 | 99.6907 | 191.8995 | 0.0827 | 190.0693 | 49.9046 |
| 243 | 4809 | AA859616 | 99.6907 | 101.6030 | 0.0467 | 79.9599 | 21.4435 |
| 1770 | 16219 | NM_012656 | 99.6907 | 609.0060 | 0.8499 | 786.7393 | 259.2468 |
| 388 | 14754 | AA892414 | 99.6907 | 159.2985 | 0.1549 | 129.1452 | 24.2971 |
| 2214 | 15683 | NM_031011 | 99.6392 | 190.3800 | 1.1116 | 102.5670 | 41.8290 |
| 2351 | 21807 | NM_032067 | 99.6392 | 23.4740 | 0.0679 | 6.9674 | 13.5151 |
| 2006 | 20849 | NM_017343 | 99.6392 | 1044.1320 | 1.9474 | 794.4656 | 153.2125 |
| 437 | 9082 | AA893357 | 99.6392 | 32.6350 | 0.0184 | 37.6016 | 10.2287 |
| 2088 | 17936 | NM_021766 | 99.6392 | 28.5700 | 0.0156 | 28.9933 | 10.7315 |
| 1820 | 16581 | NM_012911 | 99.6392 | 13.9605 | 0.0474 | 25.6337 | 13.9842 |
| 1985 | 15301 | NM_017259 | 99.6392 | 177.3230 | 2.2062 | 100.6605 | 84.9474 |
| 2348 | 18899 | NM_031985 | 99.6392 | 60.6635 | 0.0403 | 46.7844 | 12.2248 |
| 752 | 16006 | AF062594 | 99.6392 | 61.9780 | 0.0523 | 45.2072 | 17.1592 |
| 30 | 18365 | AA799442 | 99.6392 | 125.6865 | 0.1011 | 112.7902 | 77.1278 |
| 2453 | 531 | NM_053951 | 99.6392 | 114.2270 | 4.8437 | 52.4727 | 17.1357 |
| 1731 | 17991 | M96626 | 99.5876 | 38.0675 | 0.0983 | 26.0638 | 9.2630 |
| 1661 | 25278 | D30734 | 99.5876 | 17.9070 | 0.0311 | 20.2940 | 11.9717 |
| 2635 | 25647 | U83119 | 99.5876 | 361.9505 | 0.6894 | 47.9105 | 131.6491 |
| 389 | 23194 | AA892417 | 99.5876 | 133.3105 | 2.0584 | 77.0038 | 20.4188 |
| 1783 | 25264 | NM_012735 | 99.5876 | 41.5630 | 0.5218 | 88.3147 | 40.3559 |
| 307 | 15888 | AA875225 | 99.5361 | 673.6840 | 0.6109 | 790.2653 | 146.7649 |
| 78 | 21002 | AA799832 | 99.5361 | 137.8110 | 0.3861 | 191.4369 | 42.9151 |
| 402 | 18274 | AA892572 | 99.5361 | 348.0135 | 4.7751 | 558.8275 | 137.4852 |
| 2289 | 1918 | NM_031576 | 99.4845 | 20.1245 | 0.1336 | 3.2394 | 14.2576 |
| 1876 | 16649 | NM_013132 | 99.4845 | 216.8705 | 0.2199 | 259.9159 | 56.4421 |
| 2344 | 17075 | NM_031974 | 99.4845 | 211.1840 | 5.8548 | 349.3276 | 65.4254 |
| 2252 | 6525 | NM_031129 | 99.4845 | 483.0040 | 5.6286 | 59.7738 | 135.9332 |

TABLE 5GG-continued

PHENYLPROPANOLAMINE
Timepoint(s): 3 hrs

| SEQ ID | GLGC ID | GenBank Accession No. | LDA Score | Mean Tox | SD Tox | Mean Nontox | SD Nontox |
|---|---|---|---|---|---|---|---|
| 2268 | 11258 | NM_031327 | 99.4845 | 48.4830 | 3.9301 | 8.4739 | 24.7728 |
| 2605 | 25538 | S76466 | 99.4330 | 88.7140 | 1.0974 | 52.1067 | 20.0355 |
| 1710 | 25411 | M18529 | 99.4330 | 7.6315 | 0.0219 | 22.8935 | 102.7940 |
| 468 | 3910 | AA894345 | 99.4330 | 162.1815 | 0.1167 | 145.3141 | 35.4469 |
| 2342 | 8661 | NM_031971 | 99.4330 | 682.6415 | 566.5361 | 10.8047 | 59.9154 |
| 421 | 16482 | AA892940 | 99.4330 | 141.6685 | 0.3387 | 194.3194 | 41.7657 |
| 1617 | 18482 | AI639151 | 99.4330 | 78.0675 | 0.2722 | 44.8844 | 21.6560 |
| 1482 | 24327 | AI231292 | 99.4330 | 987.6825 | 4.8317 | 1627.0752 | 502.0131 |
| 435 | 11935 | AA893328 | 99.4330 | 127.4905 | 2.1729 | 58.1091 | 28.6046 |
| 2121 | 8586 | NM_022505 | 99.4330 | 80.8830 | 0.1343 | 62.5162 | 18.6288 |
| 385 | 3474 | AA892378 | 99.4330 | 342.8520 | 6.1391 | 562.2097 | 105.2426 |
| 2495 | 17958 | NM_080583 | 99.4330 | 73.3915 | 0.6555 | 23.1313 | 41.9797 |
| 1955 | 16954 | NM_017151 | 99.4330 | 60.6575 | 0.4589 | 56.2079 | 85.6285 |
| 1147 | 3802 | AI105044 | 99.3814 | 95.7180 | 0.1739 | 126.6171 | 28.8811 |
| 1628 | 17083 | AI639255 | 99.3814 | 94.0705 | 0.1407 | 68.1044 | 24.9319 |
| 2429 | 1016 | NM_053772 | 99.3814 | 178.2220 | 0.7651 | 94.6033 | 45.4244 |
| 1766 | 25133 | NM_012628 | 99.3814 | 35.4365 | 0.0898 | 19.0683 | 16.3765 |
| 2004 | 24248 | NM_017332 | 99.3814 | 59.5815 | 0.2199 | 84.6218 | 129.8911 |
| 2342 | 8662 | NM_031971 | 99.3814 | 678.8710 | 609.6066 | −33.8688 | 71.7668 |
| 2448 | 20939 | NM_053884 | 99.3814 | 296.6510 | 9.3126 | 469.3736 | 64.3495 |
| 2450 | 753 | NM_053897 | 99.3814 | 90.6215 | 0.3415 | 57.5682 | 20.4389 |
| 1402 | 16081 | AI179610 | 99.3814 | 202.3560 | 7.3978 | 87.7021 | 67.0935 |
| 406 | 2119 | AA892607 | 99.3299 | 19.1290 | 0.0863 | 29.3608 | 8.8368 |
| 2565 | 734 | NM_139094 | 99.3299 | 36.5320 | 0.0750 | 39.1366 | 10.8688 |
| 1989 | 20281 | NM_017274 | 99.3299 | 44.0540 | 0.9164 | 18.6465 | 9.6837 |
| 2342 | 8663 | NM_031971 | 99.3299 | 946.6095 | 661.5373 | −50.7499 | 160.6783 |
| 1797 | 18135 | NM_012791 | 99.3299 | 204.7280 | 2.3278 | 139.0666 | 28.6135 |
| 1325 | 13504 | AI176354 | 100.0000 | −2.8185 | 0.0813 | 23.0195 | 17.4970 |
| 1271 | 12367 | AI172126 | 100.0000 | 122.4790 | 0.5190 | 61.0149 | 15.9967 |
| 1226 | 3486 | AI170313 | 100.0000 | 71.6715 | 0.0092 | 45.3825 | 18.6102 |
| 535 | 23452 | AA925289 | 100.0000 | 87.2960 | 0.1273 | 127.5112 | 27.7784 |
| 568 | 12261 | AA943240 | 100.0000 | 363.4590 | 5.2114 | 188.7848 | 46.6706 |
| 578 | 16447 | AA944188 | 100.0000 | 67.7655 | 0.0969 | 22.2409 | 30.8260 |
| 629 | 9629 | AA946415 | 100.0000 | 236.6695 | 0.2595 | 109.4844 | 36.4261 |
| 968 | 7992 | AI044845 | 100.0000 | 164.3995 | 0.0050 | 139.4257 | 42.5549 |
| 614 | 11256 | AA945898 | 100.0000 | 15.6665 | 0.0049 | 45.2588 | 24.4283 |
| 499 | 4827 | AA901058 | 100.0000 | 368.6650 | 0.0057 | 297.3386 | 72.8624 |
| 589 | 21522 | AA944449 | 100.0000 | −5.6725 | 0.4773 | 281.9593 | 145.1068 |
| 881 | 1906 | AI013477 | 100.0000 | 296.1400 | 0.0721 | 260.3344 | 111.4857 |
| 1157 | 4143 | AI112107 | 99.9485 | 211.6065 | 0.1181 | 163.5920 | 41.4410 |
| 1190 | 6364 | AI145058 | 99.9485 | 130.6750 | 0.0269 | 204.3970 | 58.9655 |
| 1035 | 8965 | AI070660 | 99.9485 | −6.7810 | 0.0523 | 21.9504 | 18.0453 |
| 1269 | 19012 | AI172056 | 99.9485 | 859.4450 | 1.9898 | 456.8430 | 117.1700 |
| 1103 | 4102 | AI102524 | 99.9485 | 45.2145 | 0.0106 | 25.3158 | 23.5775 |
| 2155 | 24346 | NM_022701 | 99.9485 | 22.2060 | 0.0057 | 22.7899 | 13.3460 |
| 1449 | 13886 | AI230116 | 99.9485 | 89.1165 | 0.0219 | 70.9494 | 23.5754 |
| 2431 | 11606 | NM_053795 | 99.9485 | 38.8675 | 0.0389 | 59.8457 | 25.5865 |
| 1046 | 9604 | AI071230 | 99.9485 | 1745.8500 | 7.3115 | 401.4725 | 410.1580 |
| 1051 | 8099 | AI071586 | 99.9485 | −5.3630 | 0.0382 | 23.7230 | 13.6996 |
| 2578 | 23756 | NM_145084 | 99.9485 | 112.8855 | 0.0149 | 488.9448 | 451.6976 |
| 959 | 5486 | AI044397 | 99.9485 | 42.9570 | 0.0933 | −0.6565 | 26.3667 |
| 937 | 7852 | AI043636 | 99.9485 | 218.7985 | 0.1337 | 311.1944 | 72.4066 |
| 940 | 7584 | AI043724 | 99.9485 | −11.1985 | 0.1435 | 52.0467 | 68.1599 |
| 1472 | 23730 | AI230915 | 99.8969 | 38.6280 | 0.0354 | 24.8364 | 14.4108 |
| 1596 | 14720 | AI237648 | 99.8969 | 104.1585 | 0.0884 | 50.4903 | 41.8844 |
| 126 | 12399 | AA801307 | 99.8969 | 215.2455 | 0.1605 | 145.4078 | 40.4092 |
| 1519 | 7285 | AI232731 | 99.8969 | 247.7395 | 0.1167 | 216.2511 | 38.4607 |
| 977 | 5775 | AI045378 | 99.8969 | 152.3685 | 1.5549 | 27.7251 | 47.4649 |
| 921 | 6192 | AI030301 | 99.8969 | −354.8340 | 8.0441 | 237.4106 | 255.7853 |
| 867 | 7193 | AI013033 | 99.8969 | 20.8670 | 0.0311 | 2.5197 | 19.4278 |
| 605 | 22267 | AA945601 | 99.8969 | 130.1385 | 0.0926 | 85.0324 | 51.7028 |
| 830 | 5983 | AI011070 | 99.8969 | 487.2100 | 0.1839 | 583.5955 | 202.5020 |
| 709 | 3162 | AA997289 | 99.8969 | 366.2300 | 1.5005 | 200.6923 | 67.7833 |
| 698 | 2582 | AA965164 | 99.8969 | 171.0265 | 0.5480 | 92.5514 | 34.7755 |
| 2372 | 2674 | NM_053333 | 99.8969 | 224.5095 | 0.0332 | 267.6288 | 131.5045 |
| 2223 | 18188 | NM_031046 | 99.8969 | 39.1870 | 0.0255 | 31.5260 | 17.8793 |
| 799 | 15089 | AI009752 | 99.8969 | 213.8270 | 0.3606 | 131.2459 | 49.1067 |
| 671 | 23644 | AA957808 | 99.8969 | −25.2295 | 0.0983 | 36.3866 | 35.2960 |
| 1506 | 14028 | AI232184 | 99.8454 | 193.4115 | 0.4264 | 123.9913 | 57.6787 |
| 1260 | 6667 | AI171646 | 99.8454 | 71.0770 | 0.0424 | 91.2817 | 19.4419 |
| 1422 | 13673 | AI227763 | 99.8454 | 50.4420 | 0.0255 | 28.8487 | 11.8323 |
| 1132 | 8458 | AI104239 | 99.8454 | 266.1145 | 2.8235 | 166.1049 | 90.2839 |
| 851 | 24200 | AI012356 | 99.8454 | 779.5775 | 0.2510 | 653.9327 | 203.8749 |

TABLE 5GG-continued

PHENYLPROPANOLAMINE
Timepoint(s): 3 hrs

| SEQ ID | GLGC ID | GenBank Accession No. | LDA Score | Mean Tox | SD Tox | Mean Nontox | SD Nontox |
|---|---|---|---|---|---|---|---|
| 917 | 10665 | AI030067 | 99.8454 | 284.4280 | 0.7693 | 162.6899 | 74.5278 |
| 583 | 12289 | AA944383 | 99.8454 | 40.3230 | 0.0792 | 22.4664 | 15.4457 |
| 659 | 23952 | AA957096 | 99.8454 | 15.6945 | 0.0686 | 45.1670 | 23.7826 |
| 949 | 19121 | AI044101 | 99.8454 | 3057.4551 | 0.5289 | 3028.0362 | 555.0941 |
| 896 | 7212 | AI014065 | 99.8454 | 70.1740 | 0.0438 | 74.6855 | 32.5412 |
| 548 | 20345 | AA925938 | 99.8454 | 145.6510 | 1.1215 | 81.5308 | 23.2042 |
| 980 | 10004 | AI045509 | 99.8454 | 77.9140 | 0.0764 | 53.1737 | 27.7288 |
| 1425 | 8109 | AI228147 | 99.7938 | 33.7050 | 0.0269 | 53.8145 | 17.8506 |
| 1090 | 22786 | AI101659 | 99.7938 | 799.4390 | 0.4737 | 625.2440 | 193.9831 |
| 1286 | 17291 | AI172491 | 99.7938 | 4720.8425 | 2.9379 | 4713.7458 | 1125.9869 |
| 603 | 14352 | AA945181 | 99.7938 | 206.7885 | 0.0686 | 188.1594 | 29.9107 |
| 211 | 4163 | AA851210 | 99.7938 | −29.4145 | 0.2722 | 40.4796 | 49.2398 |
| 585 | 21998 | AA944398 | 99.7938 | 134.0315 | 0.2369 | 207.1661 | 96.4055 |
| 1435 | 3557 | AI228672 | 99.7423 | 42.1170 | 0.2828 | 78.1881 | 24.0155 |
| 227 | 12829 | AA858695 | 99.7423 | 174.8815 | 0.2694 | 241.1290 | 56.8656 |
| 178 | 18427 | AA819891 | 99.7423 | 28.6200 | 0.0877 | 9.9802 | 17.7337 |
| 1321 | 12999 | AI176276 | 99.7423 | 857.1445 | 7.8538 | 337.2493 | 308.4064 |
| 1365 | 547 | AI177871 | 99.7423 | 689.5490 | 0.4455 | 676.8199 | 101.5816 |
| 1177 | 7122 | AI137468 | 99.7423 | 344.5180 | 0.5233 | 298.6755 | 105.2170 |
| 1556 | 14722 | AI235284 | 99.7423 | 349.6955 | 0.2581 | 492.6213 | 181.0495 |
| 1319 | 10182 | AI176185 | 99.7423 | 45.7590 | 0.2051 | 33.4329 | 103.8738 |
| 229 | 17236 | AA858903 | 99.7423 | 747.2100 | 2.5428 | 429.2370 | 135.6359 |

TABLE 5HH

PHENYLPROPANOLAMINE
Timepoint(s): 6, 24 hrs

| SEQ ID | GLGC ID | GenBank Accession No. | LDA Score | Mean Tox | SD Tox | Mean Nontox | SD Nontox |
|---|---|---|---|---|---|---|---|
| 2637 | 23282 | U90725 | 96.6321 | 392.8453 | 27.4198 | 265.4111 | 55.2418 |
| 2435 | 15003 | NM_053819 | 96.3731 | 292.5183 | 132.9821 | 95.2474 | 192.4612 |
| 2435 | 15002 | NM_053819 | 95.6477 | 447.0964 | 148.4186 | 208.1232 | 188.5442 |
| 1703 | 11955 | L48209 | 94.7150 | 734.8252 | 26.0833 | 1038.0379 | 272.5287 |
| 2428 | 14017 | NM_053770 | 94.6114 | 437.2094 | 93.6905 | 240.5996 | 73.6904 |
| 402 | 18274 | AA892572 | 94.1451 | 375.4566 | 28.4677 | 559.7208 | 137.2678 |
| 2610 | 25556 | S79939 | 93.2124 | 68.8204 | 5.6114 | 29.7573 | 31.8675 |
| 741 | 11745 | AB006450 | 93.1088 | 404.8954 | 25.9654 | 531.2629 | 83.2120 |
| 349 | 17255 | AA891734 | 92.6425 | 83.6826 | 15.2779 | 51.0805 | 18.0864 |
| 1138 | 23574 | AI104520 | 92.6425 | 1552.3563 | 72.2094 | 2097.5285 | 437.3683 |
| 1139 | 18509 | AI104528 | 92.2798 | 484.3571 | 63.9467 | 694.1347 | 146.5206 |
| 318 | 13051 | AA875559 | 92.2280 | 27.3324 | 3.6170 | 16.1123 | 6.4455 |
| 2199 | 862 | NM_024487 | 92.2280 | 310.8466 | 27.2636 | 418.1332 | 64.9605 |
| 1645 | 20083 | AI639523 | 92.1762 | 48.1340 | 2.6821 | 40.3216 | 21.7037 |
| 36 | 18290 | AA799497 | 92.0207 | 509.1194 | 34.8874 | 332.0679 | 115.9617 |
| 1359 | 17570 | AI177683 | 91.7098 | 307.3379 | 28.6175 | 209.2414 | 61.3221 |
| 1100 | 11953 | AI102505 | 91.6580 | 398.8276 | 77.9296 | 662.3780 | 184.8179 |
| 257 | 15166 | AA859919 | 91.6580 | 514.5230 | 52.5308 | 739.6475 | 145.8042 |
| 1610 | 16514 | AI639093 | 91.6062 | 430.0497 | 48.1219 | 614.0355 | 129.4950 |
| 80 | 18378 | AA799888 | 91.0363 | 128.7649 | 7.9406 | 165.6063 | 31.0429 |
| 2616 | 25589 | U21718 | 90.8290 | 364.5660 | 41.5931 | 255.7049 | 60.3220 |
| 1652 | 18686 | D00729 | 90.8290 | 572.7926 | 104.2364 | 911.7203 | 228.8290 |
| 1100 | 11954 | AI102505 | 90.7772 | 1672.2456 | 175.0063 | 2344.3517 | 494.6533 |
| 752 | 16007 | AF062594 | 90.2073 | 50.4853 | 6.4947 | 29.7826 | 22.9260 |
| 1975 | 24598 | NM_017231 | 90.2073 | 315.7369 | 10.3925 | 264.4997 | 43.0715 |
| 1624 | 25918 | AI639204 | 90.0000 | 80.6966 | 8.3625 | 54.8994 | 39.3756 |
| 428 | 13323 | AA893212 | 89.9482 | 223.7043 | 31.6749 | 139.5109 | 113.3996 |
| 1701 | 25377 | L25387 | 89.8964 | 49.8599 | 12.7428 | 27.0748 | 15.4113 |
| 71 | 11531 | AA799773 | 89.8520 | 1192.2064 | 583.2821 | 404.9046 | 287.4400 |
| 1999 | 18687 | NM_017306 | 89.7927 | 485.6997 | 71.5381 | 738.1348 | 185.6825 |
| 71 | 11530 | AA799773 | 89.6447 | 714.7133 | 319.9269 | 208.3621 | 168.4034 |
| 1705 | 18480 | M13100 | 89.5855 | 466.2059 | 97.7725 | 257.8981 | 127.8104 |
| 2086 | 19710 | NM_021744 | 89.4819 | 69.3371 | 11.2650 | 48.5251 | 23.1099 |
| 1863 | 1529 | NM_013082 | 89.4301 | 61.6946 | 2.7659 | 50.8535 | 13.3227 |
| 395 | 11994 | AA892507 | 89.3264 | 84.3529 | 10.8849 | 121.4100 | 26.2193 |
| 2006 | 20848 | NM_0173431 | 89.0674 | 1955.7463 | 153.6749 | 1610.9763 | 277.7725 |
| 402 | 18275 | AA892572 | 88.9637 | 403.5536 | 32.5152 | 524.5248 | 96.3246 |
| 2143 | 20925 | NM_022594 | 88.9119 | 883.0746 | 122.1168 | 1306.5312 | 334.9510 |
| 619 | 20832 | AA946040 | 88.9119 | 1360.6574 | 100.1177 | 1774.1365 | 387.1552 |

TABLE 5HH-continued

PHENYLPROPANOLAMINE
Timepoint(s): 6, 24 hrs

| SEQ ID | GLGC ID | GenBank Accession No. | LDA Score | Mean Tox | SD Tox | Mean Nontox | SD Nontox |
|---|---|---|---|---|---|---|---|
| 296 | 1190 | AA875089 | 88.9119 | 29.0673 | 3.8404 | 16.4193 | 9.0588 |
| 1922 | 20875 | NM_017050 | 88.4974 | 458.3149 | 46.8834 | 689.7731 | 204.4667 |
| 2106 | 18246 | NM_022300 | 88.3420 | 45.6010 | 9.1258 | 23.0123 | 36.8751 |
| 284 | 22781 | AA874926 | 88.2902 | 190.9210 | 40.6469 | 123.2367 | 56.2668 |
| 117 | 15213 | AA800908 | 88.2902 | 36.7447 | 7.9841 | 18.4398 | 12.8703 |
| 2468 | 16566 | NM_054004 | 88.1347 | 46.9776 | 5.7708 | 33.5268 | 10.0833 |
| 1787 | 8829 | NM_012749 | 88.1347 | 349.8157 | 26.7008 | 268.0625 | 71.0694 |
| 2041 | 20938 | NM_019223 | 88.0311 | 1613.9081 | 152.1232 | 2056.1340 | 353.1722 |
| 1936 | 10888 | NM_017094 | 87.9793 | 71.3309 | 11.1992 | 52.4854 | 31.1755 |
| 1890 | 1258 | NM_013185 | 87.8756 | 33.1121 | 5.3294 | 16.5840 | 15.0523 |
| 551 | 16468 | AA926137 | 87.8238 | 1624.4816 | 97.1392 | 2021.7983 | 356.3830 |
| 1744 | 1763 | NM_0125431 | 87.7202 | 125.3086 | 60.4036 | 109.4191 | 149.6196 |
| 2655 | 25692 | X53581 | 87.7202 | 264.4379 | 46.7915 | 173.7627 | 77.5621 |
| 2488 | 1743 | NM_057210 | 87.6166 | 24.7713 | 2.2076 | 20.7862 | 10.9283 |
| 251 | 2262 | AA859757 | 87.3575 | 118.2704 | 6.9616 | 95.9424 | 26.4851 |
| 1966 | 9124 | NM_017199 | 87.3057 | 223.1137 | 7.9505 | 213.4996 | 42.7349 |
| 1600 | 16340 | AI638955 | 87.2539 | 60.3917 | 9.4543 | 31.0146 | 23.1173 |
| 2566 | 17203 | NM_139099 | 87.2539 | 1772.4377 | 199.6902 | 2512.4899 | 721.4748 |
| 2207 | 1048 | NM_030863 | 87.1058 | 90.5180 | 37.1124 | 31.8054 | 22.7416 |
| 1775 | 425 | NM_012698 | 87.0466 | 35.5210 | 6.0923 | 20.8300 | 11.6333 |
| 2369 | 7207 | NM_053326 | 87.0022 | 67.7761 | 21.4276 | 32.6028 | 15.6886 |
| 1662 | 9029 | D30804 | 86.9948 | 334.8343 | 21.9516 | 444.5613 | 106.2402 |
| 2428 | 14015 | NM_053770 | 86.8986 | 272.5329 | 107.2673 | 101.1813 | 67.1043 |
| 81 | 15011 | AA799893 | 86.8912 | 120.9673 | 17.9317 | 84.6938 | 28.9688 |
| 2037 | 18569 | NM_019212 | 86.8468 | 3045.8633 | 766.5001 | 1593.0368 | 600.0095 |
| 118 | 21416 | AA800962 | 86.8394 | 157.8959 | 22.0795 | 110.5525 | 38.4310 |
| 248 | 20582 | AA859688 | 86.8394 | 361.1994 | 49.1565 | 493.3099 | 97.9212 |
| 2012 | 20417 | NM_017359 | 86.7876 | 307.6200 | 25.0861 | 235.6386 | 62.5571 |
| 1813 | 17305 | NM_012876 | 86.6839 | 3601.7647 | 221.6319 | 4627.6390 | 1378.7428 |
| 1705 | 20628 | M13100 | 86.6321 | 466.5057 | 66.0002 | 316.5499 | 131.9943 |
| 1972 | 11989 | NM_017222 | 86.5803 | 50.2694 | 6.4633 | 35.6511 | 12.9634 |
| 2618 | 25590 | U21720 | 86.5285 | 73.1583 | 5.8480 | 59.0984 | 23.5690 |
| 1896 | 20855 | NM_013200 | 86.5285 | 569.9809 | 39.3160 | 700.8075 | 122.7485 |
| 2378 | 623 | NM_053369 | 86.5285 | 147.8191 | 10.3632 | 164.9374 | 60.4766 |
| 2380 | 14621 | NM_053437 | 86.4249 | 132.9804 | 10.6645 | 169.2472 | 36.9981 |
| 1808 | 18770 | NM_012857 | 86.3731 | 556.1281 | 53.8248 | 688.1387 | 104.3536 |
| 1958 | 17686 | NM_017165 | 86.3212 | 963.0883 | 48.2210 | 1133.9716 | 219.4970 |
| 1896 | 20856 | NM_013200 | 86.3212 | 942.6401 | 51.6837 | 1096.2841 | 187.3694 |
| 2664 | 25716 | X61295 | 86.2176 | 1109.6887 | 150.5948 | 807.0937 | 362.0858 |
| 2208 | 1929 | NM_030872 | 86.1658 | 741.1960 | 62.4841 | 950.6275 | 205.9505 |
| 1927 | 1427 | NM_017063 | 86.0622 | 29.5961 | 5.8026 | 15.8735 | 10.9553 |
| 61 | 17759 | AA799663 | 86.0104 | 49.6866 | 10.8265 | 85.4551 | 36.7873 |
| 1871 | 23710 | NM_013113 | 85.9660 | 529.3191 | 73.5864 | 329.4104 | 100.0248 |
| 1686 | 17159 | J00797 | 85.9585 | 1260.6044 | 101.0225 | 1019.7509 | 246.1818 |
| 356 | 11966 | AA891800 | 85.9585 | 305.8084 | 25.9266 | 381.2756 | 69.6767 |
| 358 | 23011 | AA891803 | 85.8031 | 39.4394 | 4.3848 | 29.7453 | 9.0599 |
| 2456 | 16546 | NM_053965 | 85.7513 | 172.7831 | 38.3790 | 261.2547 | 70.6676 |
| 2512 | 20879 | NM_133295 | 85.7513 | 46.6570 | 7.3709 | 81.3752 | 45.6809 |
| 1795 | 449 | NM_012786 | 85.7513 | 2997.3389 | 246.8743 | 3834.6812 | 1041.0001 |
| 1152 | 15291 | AI111401 | 85.6477 | 47.0491 | 4.1811 | 35.9738 | 9.8753 |
| 69 | 20997 | AA799764 | 85.5959 | 61.9484 | 5.9282 | 45.2079 | 15.5244 |
| 1795 | 450 | NM_012786 | 85.5959 | 3128.0366 | 170.6099 | 3755.0537 | 786.3385 |
| 250 | 22670 | AA859750 | 85.4922 | 73.1264 | 6.9285 | 58.6469 | 22.3076 |
| 2514 | 1061 | NM_133303 | 85.4404 | 86.9340 | 22.3149 | 73.3214 | 45.3425 |
| 2649 | 25686 | X51536 | 85.4404 | 1035.4801 | 46.0477 | 972.7482 | 197.9158 |
| 2510 | 17564 | NM_133283 | 85.4404 | 322.3890 | 27.0546 | 415.0968 | 80.8663 |
| 369 | 17345 | AA892014 | 85.4404 | 189.0813 | 14.8041 | 150.9683 | 38.5857 |
| 97 | 3692 | AA800210 | 85.4404 | 173.2706 | 10.8216 | 175.4433 | 50.7958 |
| 1841 | 17394 | NM_012992 | 85.3886 | 446.1611 | 53.8995 | 355.1608 | 92.2841 |
| 242 | 15150 | AA859562 | 85.3886 | 111.2653 | 16.6139 | 154.2286 | 39.3321 |
| 1679 | 16524 | H33219 | 85.3886 | 27.0314 | 1.4365 | 24.0146 | 6.6058 |
| 818 | 3211 | AI010612 | 98.0311 | 66.6360 | 34.2891 | 5.9667 | 17.9288 |
| 1348 | 22077 | AI177099 | 97.0984 | 363.6396 | 107.5762 | 1163.4551 | 61.1284 |
| 148 | 367 | AA818342 | 96.9430 | 94.7897 | 23.9348 | 27.9197 | 20.3222 |
| 1240 | 21284 | AI170842 | 96.8912 | 62.8293 | 24.6617 | 12.2743 | 17.5318 |
| 179 | 320 | AA819905 | 96.7358 | 1210.3160 | 72.5440 | 1885.0138 | 377.0402 |
| 849 | 6606 | AI012308 | 96.2176 | 3922.3684 | 505.7537 | 1863.5623 | 759.4628 |
| 1313 | 5876 | AI176117 | 96.1140 | 1839.2570 | 114.7470 | 2768.0950 | 622.9893 |
| 1284 | 24209 | AI172423 | 95.8031 | 91.4460 | 34.1551 | 2.7632 | 41.7302 |
| 1550 | 13293 | AI235032 | 95.3886 | 229.8451 | 22.0740 | 116.1949 | 53.1753 |
| 1183 | 13227 | AI137925 | 95.3886 | 81.3164 | 9.6413 | 138.7205 | 35.5848 |
| 1533 | 14871 | AI233743 | 94.8705 | 215.3607 | 41.5905 | 123.1735 | 34.2931 |
| 1585 | 11404 | AI237002 | 94.7668 | 150.3903 | 16.7821 | 104.6500 | 35.2325 |

TABLE 5HH-continued

PHENYLPROPANOLAMINE
Timepoint(s): 6, 24 hrs

| SEQ ID | GLGC ID | GenBank Accession No. | LDA Score | Mean Tox | SD Tox | Mean Nontox | SD Nontox |
|---|---|---|---|---|---|---|---|
| 1534 | 2822 | AI233763 | 94.6114 | 91.8054 | 9.6384 | 135.4241 | 26.8619 |
| 1542 | 2765 | AI234283 | 94.1969 | 183.5886 | 19.0895 | 115.0886 | 33.3684 |
| 1292 | 17679 | AI175025 | 93.8860 | 343.9430 | 34.0654 | 517.0982 | 116.2747 |
| 1192 | 13786 | AI145106 | 93.4715 | 14.4553 | 7.8845 | 74.7719 | 36.6844 |
| 1494 | 2339 | AI231798 | 93.0570 | 306.7930 | 10.9140 | 386.3540 | 75.6052 |
| 1087 | 2292 | AI101362 | 92.7979 | 25.2096 | 13.6850 | −71.6174 | 71.0186 |
| 1367 | 5929 | AI177962 | 92.6943 | 209.0469 | 22.1540 | 137.3411 | 38.7212 |
| 1291 | 7740 | AI175011 | 92.5389 | 428.8254 | 45.4969 | 299.7705 | 66.9086 |
| 1515 | 4891 | AI232402 | 92.4870 | 103.6429 | 19.0689 | 57.8671 | 25.1173 |
| 1535 | 15085 | AI233829 | 92.3834 | 743.4240 | 45.8589 | 973.9295 | 173.8610 |
| 2581 | 6731 | NM_145096 | 92.2798 | 62.2046 | 9.5695 | 36.2936 | 15.2971 |
| 1464 | 23013 | AI230743 | 92.2280 | 444.5369 | 41.6573 | 327.2587 | 66.8489 |
| 1378 | 2479 | AI178384 | 92.1762 | 58.0911 | 6.0372 | 36.3388 | 17.7573 |
| 1374 | 4073 | AI178272 | 91.9689 | 644.9791 | 74.1188 | 1029.5107 | 285.9729 |
| 1276 | 2140 | AI172272 | 91.9689 | 209.0921 | 12.5349 | 304.0739 | 78.0431 |
| 1438 | 2210 | AI228963 | 91.7617 | 2139.1216 | 135.2739 | 2737.1711 | 440.8233 |
| 1508 | 2085 | AI232270 | 91.7098 | 1261.3720 | 78.2204 | 1731.5486 | 370.4574 |
| 1202 | 11363 | AI145997 | 91.3990 | 315.3564 | 23.6801 | 210.2154 | 72.5573 |
| 2456 | 16547 | NM_053965 | 91.3990 | 461.0147 | 64.7025 | 725.5751 | 191.6030 |
| 1214 | 4480 | AI169601 | 91.3990 | 41.1996 | 10.5207 | 7.3608 | 19.7165 |
| 1520 | 3100 | AI232741 | 91.3990 | 794.9033 | 65.6045 | 1097.4930 | 215.4171 |
| 605 | 22266 | AA945601 | 91.2953 | 343.4190 | 13.1320 | 288.1070 | 53.1166 |
| 1283 | 12117 | AI172352 | 91.2435 | 441.3817 | 36.2464 | 591.7778 | 123.9976 |
| 1205 | 17914 | AI169159 | 91.1399 | 202.8573 | 20.2436 | 329.1647 | 103.5805 |
| 1333 | 8609 | AI176505 | 90.8808 | 86.1916 | 8.4037 | 54.0325 | 20.7432 |
| 1329 | 24314 | AI176434 | 90.8290 | 42.9569 | 5.1119 | 27.7019 | 10.7034 |
| 171 | 6281 | AA819517 | 90.7772 | 257.7624 | 27.9984 | 361.0210 | 72.9734 |
| 2276 | 12581 | NM_031514 | 90.6736 | 68.4811 | 11.4932 | 46.8436 | 19.9619 |
| 1448 | 21446 | AI229854 | 90.6218 | 132.5327 | 6.9337 | 103.4067 | 25.3453 |
| 1587 | 18151 | AI237212 | 90.6218 | 257.7351 | 12.2031 | 331.2631 | 71.1854 |
| 2541 | 8692 | NM_134387 | 90.6218 | 134.0539 | 73.2045 | 294.2883 | 95.2647 |
| 1521 | 7147 | AI232948 | 90.5181 | 853.3451 | 41.3161 | 1022.9910 | 159.9812 |
| 632 | 2363 | AA946469 | 90.5181 | 1101.3957 | 92.1394 | 1401.1085 | 254.0833 |
| 1156 | 12887 | AI112095 | 90.4145 | 510.7066 | 47.6326 | 681.5103 | 136.1835 |
| 2253 | 13929 | NM_031131 | 90.3183 | 266.3954 | 67.2132 | 110.0210 | 47.6954 |
| 1541 | 12583 | AI234251 | 90.3109 | 40.6801 | 5.7975 | 28.6403 | 13.1969 |
| 1440 | 13826 | AI229304 | 90.3109 | 1059.8284 | 121.9072 | 1392.5923 | 237.9938 |
| 1536 | 15685 | AI233870 | 90.3109 | 915.3636 | 83.4273 | 1260.3512 | 258.3780 |
| 1415 | 8180 | AI180353 | 90.2591 | 76.0079 | 9.2527 | 43.5807 | 22.4886 |
| 1518 | 13645 | AI232694 | 89.8964 | 142.6637 | 7.1546 | 108.4173 | 27.0982 |
| 1238 | 3973 | AI170687 | 89.8446 | 60.4890 | 4.6992 | 44.4703 | 13.9335 |
| 1223 | 6969 | AI170244 | 89.7927 | 399.7476 | 63.0653 | 581.1672 | 129.8956 |
| 1116 | 2316 | AI103084 | 89.7927 | 164.8530 | 11.1358 | 18.7672 | 37.2458 |
| 1526 | 21948 | AI233191 | 89.7927 | 326.6289 | 16.6420 | 425.4622 | 91.7499 |
| 2574 | 12450 | NM_139337 | 89.7409 | 649.2902 | 71.1500 | 921.7609 | 230.2443 |
| 2271 | 16777 | NM_031354 | 89.7409 | 3862.9322 | 219.1471 | 4933.5552 | 907.8733 |
| 2165 | 18104 | NM_022948 | 89.6373 | 33.0127 | 7.9853 | 14.0382 | 11.4553 |
| 1052 | 11086 | AI071698 | 89.6373 | 33.5664 | 9.1862 | 13.4786 | 13.1159 |
| 1171 | 12878 | AI137114 | 89.6373 | 115.4013 | 12.0559 | 81.3163 | 24.2775 |
| 1502 | 14013 | AI231992 | 89.6373 | 123.651 | 24.3626 | 53.6167 | 52.4413 |
| 1296 | 19118 | AI175281 | 89.6373 | 123.5876 | 6.3026 | 152.9155 | 39.3103 |
| 1529 | 23296 | AI233316 | 89.4301 | 187.5871 | 8.8887 | 231.0563 | 38.7801 |
| 1538 | 3213 | AI234095 | 89.4301 | 232.0496 | 8.8971 | 257.7325 | 57.6724 |
| 1371 | 17847 | AI178214 | 89.3264 | 764.5647 | 65.5905 | 989.3253 | 179.9629 |

TABLE 5II

ROSIGLITAZONE
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 316 | 24472 | AA875523 | 99.7420 | 374.5527 | 1.4637 | 244.0565 | 52.0969 |
| 102 | 12253 | AA800549 | 99.5356 | 67.2170 | 1.6809 | 23.7028 | 22.5981 |
| 2416 | 1316 | NM_053656 | 99.4324 | 220.4330 | 0.6163 | 220.3667 | 67.6377 |
| 302 | 11857 | AA875132 | 99.3292 | 23.4130 | 1.7704 | 97.4638 | 43.8486 |
| 425 | 12022 | AA893105 | 98.8648 | 13.3380 | 1.7736 | 49.2371 | 23.7502 |
| 2135 | 8098 | NM_022536 | 98.7100 | 664.3467 | 13.1359 | 461.1968 | 97.7406 |

TABLE 5II-continued

ROSIGLITAZONE
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 2209 | 21801 | NM_030987 | 98.7100 | 275.7437 | 19.5469 | 159.9897 | 36.2335 |
| 2401 | 24875 | NM_053583 | 98.2972 | 37.8720 | 0.2612 | 30.1976 | 12.9865 |
| 2293 | 5497 | NM_031589 | 98.2972 | 65.3230 | 0.2242 | 64.6593 | 17.3946 |
| 2019 | 15975 | NM_019132 | 98.0908 | 42.0350 | 0.3971 | 56.9127 | 24.7697 |
| 1803 | 21350 | NM_012823 | 97.9360 | 13.7053 | 1.8179 | 45.0369 | 18.3348 |
| 2134 | 7505 | NM_022534 | 97.8844 | 144.1997 | 0.7750 | 125.3235 | 24.6020 |
| 2286 | 18317 | NM_031561 | 97.8844 | 629.8513 | 5.9087 | 634.9720 | 291.6547 |
| 2567 | 17854 | NM_139103 | 97.8844 | 327.4563 | 58.2752 | 161.6262 | 43.1507 |
| 2602 | 951 | S69206 | 97.8844 | 44.4547 | 2.8004 | 17.1017 | 14.0243 |
| 1491 | 18402 | AI231778 | 97.8328 | 54.1813 | 3.2482 | 27.5530 | 9.5239 |
| 451 | 17896 | AA893905 | 97.7812 | 22.5927 | 0.7072 | 19.6479 | 15.6981 |
| 2436 | 20421 | NM_053821 | 97.5232 | 144.1200 | 12.2177 | 86.3885 | 18.1558 |
| 301 | 15311 | AA875124 | 97.3684 | 32.9633 | 0.7168 | 48.1633 | 21.7810 |
| 2556 | 17530 | NM_138877 | 97.3684 | 107.8800 | 0.6250 | 95.1970 | 23.9127 |
| 1952 | 15364 | NM_017147 | 97.3168 | 71.8460 | 0.7089 | 58.6785 | 19.5286 |
| 1630 | 16016 | AI639308 | 97.2652 | 33.4540 | 0.5998 | 22.9672 | 8.1713 |
| 1987 | 20600 | NM_017268 | 97.2652 | 44.5330 | 2.5682 | 21.3412 | 12.9524 |
| 432 | 17752 | AA893244 | 97.2136 | 81.6657 | 14.7103 | 29.7740 | 15.5684 |
| 2195 | 25070 | NM_024392 | 97.0588 | 162.9857 | 1.0567 | 160.2047 | 36.8995 |
| 1776 | 501 | NM_012704 | 97.0072 | 20.1930 | 0.3634 | 25.8435 | 13.9533 |
| 1752 | 1708 | NM_012581 | 96.9040 | 44.4910 | 0.5296 | 54.3027 | 15.9547 |
| 2682 | 1862 | X82669 | 96.8524 | −5.7877 | 1.6834 | 34.6783 | 31.4197 |
| 2377 | 19512 | NM_053365 | 96.8524 | 1588.0173 | 48.5040 | 1082.3959 | 326.4748 |
| 2339 | 15077 | NM_031841 | 96.8524 | 97.6783 | 11.2089 | 49.3145 | 88.6180 |
| 60 | 20982 | AA799657 | 96.8008 | 145.7583 | 7.6887 | 221.6117 | 51.0323 |
| 1450 | 23042 | AI230130 | 96.6460 | 197.3407 | 8.6586 | 106.7764 | 46.1545 |
| 1549 | 18444 | AI234915 | 96.5944 | 20.6473 | 1.0310 | 7.6059 | 66.5132 |
| 303 | 14285 | AA875194 | 96.5944 | 25.4840 | 0.1620 | 23.6379 | 6.4633 |
| 2408 | 11794 | NM_053606 | 96.5944 | 46.2100 | 3.1632 | 21.6649 | 12.3448 |
| 2458 | 15136 | NM_053971 | 96.5428 | 1155.0750 | 12.7427 | 1073.2833 | 274.6143 |
| 1845 | 1467 | NM_013010 | 96.5428 | 61.8283 | 16.5016 | 131.3942 | 30.1303 |
| 1986 | 7594 | NM_017260 | 96.4912 | 28.0340 | 0.5483 | 21.6667 | 9.7468 |
| 2187 | 15353 | NM_024356 | 96.4912 | 28.4327 | 1.0063 | 19.3194 | 16.9895 |
| 333 | 16446 | AA891423 | 96.2848 | 38.8180 | 0.4042 | 34.9380 | 9.2352 |
| 2498 | 23551 | NM_080698 | 96.2848 | 46.8823 | 3.2267 | 18.8815 | 17.5348 |
| 2550 | 15190 | NM_138826 | 96.2332 | 105.7410 | 2.7242 | 244.0274 | 340.9260 |
| 377 | 17350 | AA892240 | 96.2332 | 40.8510 | 2.3119 | 69.9725 | 23.8683 |
| 2290 | 25793 | NM_031577 | 96.1300 | 4.2637 | 0.8715 | 22.9080 | 13.7883 |
| 1997 | 1028 | NM_017304 | 96.0784 | 9.9707 | 0.5105 | 22.7991 | 17.4441 |
| 2233 | 1376 | NM_031094 | 95.9752 | 23.5600 | 0.5183 | 16.9839 | 5.9008 |
| 1643 | 20056 | AI639504 | 95.9752 | 105.1077 | 5.6354 | 153.9815 | 29.3965 |
| 2639 | 20818 | X02904 | 95.9752 | 185.2633 | 5.4172 | 137.3185 | 39.7174 |
| 1844 | 24718 | NM_013003 | 95.9236 | 18.8950 | 0.6354 | 27.9234 | 8.9048 |
| 2067 | 13231 | NM_019371 | 95.9236 | 197.1023 | 4.0302 | 183.9743 | 78.7005 |
| 1917 | 4500 | NM_017037 | 95.8720 | 414.6623 | 43.8882 | 284.2921 | 53.4068 |
| 1811 | 24617 | NM_012870 | 95.8204 | 30.8503 | 15.5449 | −5.4250 | 15.3317 |
| 2288 | 546 | NM_031573 | 95.8204 | 194.8440 | 3.1588 | 230.1816 | 51.1955 |
| 1948 | 1668 | NM_017136 | 95.8204 | 21.6667 | 5.1952 | 2.4465 | 9.8341 |
| 92 | 4832 | AA800190 | 95.7172 | 775.9433 | 8.5998 | 877.0880 | 211.0522 |
| 2636 | 983 | U89745 | 95.6140 | 128.6430 | 1.4157 | 119.2699 | 32.6170 |
| 371 | 8139 | AA892094 | 95.6140 | 23.1377 | 1.3032 | 12.1322 | 7.7866 |
| 2308 | 19909 | NM_031676 | 95.5108 | 21.1263 | 0.8218 | 35.7468 | 22.6303 |
| 2536 | 16456 | NM_134346 | 95.4592 | 255.4150 | 22.1686 | 159.3539 | 43.1845 |
| 2225 | 15957 | NM_031050 | 95.4592 | 556.3827 | 29.7318 | 364.8595 | 103.2332 |
| 25232 | 20890 | NM_133526 | 95.4592 | 118.9190 | 17.5009 | 61.3683 | 29.0677 |
| 2496 | 506 | NM_080586 | 95.4076 | 15.0697 | 0.4476 | 21.5576 | 7.4886 |
| 2652 | 16715 | X53054 | 95.4076 | 38.3687 | 4.2783 | 15.5772 | 12.6152 |
| 2348 | 18898 | NM_031985 | 95.3560 | 54.2523 | 0.8445 | 62.3646 | 14.7063 |
| 453 | 22145 | AA893980 | 95.3560 | 98.1663 | 3.8046 | 62.9135 | 33.4365 |
| 44 | 24628 | AA799542 | 95.2528 | 447.0150 | 41.9194 | 312.6532 | 61.2449 |
| 281 | 18563 | AA874875 | 95.2528 | 49.5193 | 10.3168 | 25.7709 | 8.9952 |
| 1794 | 104 | NM_012779 | 95.2012 | 28.1137 | 0.7287 | 36.4934 | 11.1743 |
| 456 | 22584 | AA894009 | 95.2012 | 57.9050 | 7.0705 | 30.3178 | 13.4558 |
| 443 | 19505 | AA893634 | 95.2012 | 75.6870 | 4.1889 | 49.6742 | 16.3861 |
| 273 | 15980 | AA866426 | 95.0464 | 125.0830 | 19.6528 | 77.0015 | 20.9698 |
| 1954 | 17287 | NM_017149 | 95.0464 | 64.3560 | 11.7193 | 31.8702 | 12.4662 |
| 68 | 4133 | AA799762 | 94.9948 | 143.7777 | 8.5126 | 103.6586 | 20.9762 |
| 2368 | 15748 | NM_053309 | 94.9948 | 41.3827 | 1.3871 | 26.1896 | 12.0762 |
| 381 | 11982 | AA892284 | 94.9948 | 49.1207 | 0.9843 | 38.9172 | 13.5343 |
| 1746 | 23871 | NM_012551 | 94.9432 | 29.7637 | 0.6199 | 42.2141 | 22.8888 |
| 2374 | 18949 | NM_053345 | 94.9432 | 140.1103 | 1.4782 | 151.1395 | 38.5018 |
| 2283 | 1822 | NM_031553 | 94.9432 | 21.5107 | 0.4403 | 23.7649 | 9.6350 |

TABLE 5II-continued

ROSIGLITAZONE
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 609 | 22625 | AA945704 | 94.9432 | 108.8400 | 12.9449 | 65.9630 | 32.1963 |
| 1838 | 957 | NM_012977 | 94.8916 | 17.5493 | 1.1851 | 34.9745 | 22.7440 |
| 1733 | 15511 | NM_012498 | 94.8916 | 526.8320 | 7.8951 | 512.3926 | 127.6345 |
| 1920 | 24697 | NM_017048 | 94.8916 | 190.7280 | 7.0129 | 155.0495 | 43.0660 |
| 51 | 15844 | AA799600 | 94.7368 | 39.7727 | 0.5520 | 39.7593 | 11.8411 |
| 1694 | 17508 | L08814 | 94.7368 | 40.9170 | 1.0277 | 30.7312 | 10.7056 |
| 103 | 6892 | AA800551 | 94.6852 | 80.6820 | 1.5026 | 68.3677 | 36.1805 |
| 2085 | 22916 | NM_021740 | 94.6852 | 898.5600 | 35.8058 | 667.8349 | 138.1971 |
| 411 | 21972 | AA892791 | 94.6336 | 169.8320 | 1.7219 | 166.5296 | 33.5529 |
| 257 | 15165 | AA859919 | 94.6336 | 220.2500 | 6.6959 | 179.3605 | 54.2251 |
| 2114 | 23705 | NM_022396 | 94.5820 | 436.1430 | 70.3843 | 264.3237 | 68.1876 |
| 423 | 19124 | AA893022 | 94.5304 | 80.5830 | 20.9013 | 26.8310 | 22.5233 |
| 2332 | 16155 | NM_031810 | 94.4788 | 20.0507 | 0.4562 | 27.4904 | 16.4814 |
| 282 | 16082 | AA874887 | 94.4788 | 72.9257 | 14.5015 | 37.5357 | 15.8036 |
| 1936 | 10886 | NM_017094 | 94.4788 | 29.2663 | 5.0680 | 89.4606 | 71.7197 |
| 1995 | 82 | NM_017297 | 94.4788 | 8.3277 | 19.7431 | 35.7844 | 13.6356 |
| 2084 | 19667 | NM_021690 | 94.4788 | 23.2083 | 1.2392 | 9.3084 | 14.6636 |
| 316 | 24471 | AA875523 | 94.4272 | 124.0640 | 5.3375 | 89.1225 | 32.4936 |
| 1977 | 15598 | NM_017236 | 94.3756 | 445.8727 | 97.3531 | 769.5472 | 158.9894 |
| 2615 | 16675 | U17565 | 94.3756 | 49.2383 | 8.7158 | 23.6577 | 17.4757 |
| 2260 | 1638 | NM_031143 | 94.3756 | 98.9327 | 5.8472 | 152.7614 | 49.9279 |
| 1635 | 20647 | AI639402 | 94.3756 | 30.8430 | 1.9821 | 15.5861 | 10.3438 |
| 1303 | 9979 | AI175594 | 99.5872 | 9.8250 | 0.0605 | 20.9416 | 12.0624 |
| 1281 | 13266 | AI172326 | 99.4324 | 36.1200 | 0.5561 | 95.0549 | 45.4090 |
| 980 | 10004 | AI045509 | 99.3808 | 44.3577 | 0.1781 | 53.2520 | 27.7615 |
| 1225 | 3547 | AI170279 | 99.1744 | 73.7057 | 4.8615 | 8.1680 | 17.5728 |
| 1421 | 2055 | AI227751 | 99.1744 | 32.4663 | 0.2568 | 47.7918 | 16.5450 |
| 133 | 23828 | AA817823 | 99.0712 | 59.2920 | 0.2020 | 58.3427 | 27.8960 |
| 142 | 5996 | AA818065 | 99.0196 | 85.4693 | 0.1695 | 86.7945 | 25.2704 |
| 865 | 20924 | AI012832 | 99.0196 | 920.4167 | 24.3389 | 556.9585 | 145.0918 |
| 144 | 6014 | AA818153 | 98.9164 | 106.4107 | 0.4908 | 81.6568 | 48.1453 |
| 960 | 5513 | AI044521 | 98.9164 | 26.9637 | 0.0876 | 24.2733 | 19.9713 |
| 1470 | 7520 | AI230830 | 98.8648 | 39.0613 | 0.1274 | 38.8223 | 22.9392 |
| 1340 | 6821 | AI176841 | 98.7616 | 125.9117 | 0.9537 | 181.8108 | 52.3404 |
| 1304 | 2261 | AI175619 | 98.4004 | 4.0707 | 3.0124 | 46.7104 | 24.7259 |
| 951 | 9838 | AI044124 | 98.3488 | 364.5093 | 5.9464 | 226.8268 | 103.4810 |
| 1018 | 10233 | AI059664 | 98.3488 | 46.7777 | 13.2959 | 142.1598 | 44.0484 |
| 1217 | 24146 | AI169668 | 98.2972 | 137.2997 | 2.0674 | 202.1487 | 49.6015 |
| 1067 | 10900 | AI072594 | 98.2972 | 119.5810 | 0.5910 | 118.5750 | 39.4364 |
| 719 | 3257 | AA997766 | 98.2456 | 51.7370 | 12.5226 | 198.1059 | 74.7974 |
| 2036 | 21508 | NM_019208 | 98.1940 | 106.3280 | 2.5616 | 77.0680 | 16.5581 |
| 183 | 11160 | AA848470 | 98.0392 | 48.3053 | 1.3174 | 83.3922 | 56.6098 |
| 1033 | 23277 | AI070508 | 98.0392 | 68.8487 | 2.0289 | 30.8753 | 23.4431 |
| 1287 | 12043 | AI172567 | 97.9876 | 308.3733 | 44.4038 | 128.5108 | 79.4231 |
| 1346 | 3969 | AI177055 | 97.9360 | 504.4400 | 8.5411 | 361.7481 | 93.5438 |
| 577 | 11412 | AA943981 | 97.9360 | 159.9210 | 3.9050 | 85.4271 | 40.4729 |
| 925 | 7715 | AI030599 | 97.8844 | 13.0380 | 1.1861 | 33.6916 | 11.9323 |
| 954 | 6745 | AI044258 | 97.8844 | 53.2420 | 8.7023 | −0.2863 | 34.9115 |
| 1233 | 18811 | AI170525 | 97.7812 | 43.8537 | 0.5556 | 54.5499 | 22.4362 |
| 737 | 22737 | AA998660 | 97.7812 | 1095.0910 | 10.4442 | 1368.8336 | 415.2679 |
| 727 | 3353 | AA998053 | 97.7296 | 130.9480 | 1.4366 | 93.8077 | 27.0583 |
| 1392 | 4080 | AI179227 | 97.6780 | 258.0857 | 1.5790 | 209.6585 | 63.3883 |
| 902 | 3625 | AI028954 | 97.6264 | 512.6547 | 10.0059 | 344.9622 | 125.2036 |
| 1578 | 14901 | AI236481 | 97.5748 | 7.2960 | 0.8259 | 38.1981 | 31.5191 |
| 1460 | 23998 | AI230578 | 97.5748 | 60.1213 | 1.2333 | 37.6604 | 14.2978 |
| 807 | 3316 | AI010237 | 97.5748 | 81.3407 | 1.4270 | 55.7346 | 29.2755 |
| 1544 | 17664 | AI234496 | 97.5232 | 64.0910 | 0.4108 | 68.5611 | 29.4583 |
| 160 | 12690 | AA818820 | 97.4716 | 41.8730 | 0.3260 | 51.9646 | 16.9768 |
| 1456 | 23937 | AI230430 | 97.4716 | 14.6573 | 0.3017 | 21.4351 | 24.0086 |
| 138 | 14101 | AA817867 | 97.4716 | 71.3150 | 0.8348 | 94.0315 | 25.2719 |
| 2586 | 20106 | NM_145784 | 97.4716 | 108.5207 | 2.6341 | 198.3327 | 102.5249 |
| 624 | 23237 | AA946224 | 97.4200 | 551.6417 | 19.8714 | 865.9790 | 172.2860 |
| 2570 | 14463 | NM_139110 | 97.4200 | 500.6007 | 12.7741 | 356.3683 | 79.5826 |
| 942 | 7903 | AI043805 | 97.4200 | 44.3393 | 3.9227 | 17.2892 | 12.8793 |
| 675 | 23289 | AA963173 | 97.3684 | 68.7267 | 0.5748 | 77.1676 | 23.8858 |
| 206 | 21754 | AA850824 | 97.3684 | 1274.0653 | 329.9235 | 636.6764 | 170.1959 |
| 1387 | 13592 | AI178914 | 97.2652 | 55.3620 | 0.7405 | 38.8405 | 31.8436 |
| 1047 | 11024 | AI071285 | 97.2652 | 23.1620 | 1.0596 | 14.5000 | 53.2536 |
| 512 | 17231 | AA924107 | 97.2652 | 145.6970 | 1.5258 | 161.5773 | 76.3897 |
| 189 | 12102 | AA848902 | 97.2652 | 19.9853 | 20.1603 | 162.0343 | 112.7268 |
| 1404 | 6251 | AI179854 | 97.2136 | 528.9010 | 2.2359 | 509.5125 | 98.0853 |
| 627 | 22755 | AA946323 | 97.2136 | 69.1977 | 0.8980 | 94.8261 | 33.3201 |

TABLE 5II-continued

ROSIGLITAZONE
Timepoint(s): 24 hrs

| SEQ ID | GLGC ID | GenBank Accession No. | LDA Score | Mean Tox | SD Tox | Mean Nontox | SD Nontox |
|---|---|---|---|---|---|---|---|
| 939 | 7880 | AI043714 | 97.2136 | 203.4163 | 15.0982 | 73.9560 | 59.7649 |
| 1145 | 8273 | AI104908 | 97.1620 | 2325.4020 | 280.9567 | 1458.7760 | 282.3528 |
| 2577 | 13712 | NM_144744 | 97.1104 | 42.3873 | 3.3615 | 49.5530 | 176.8279 |
| 1306 | 19005 | AI175875 | 97.0588 | 81.4817 | 13.5572 | 32.57031 | 21.4578 |
| 490 | 4774 | AA900762 | 97.0588 | 298.2953 | 23.5386 | 179.01551 | 45.9753 |
| 1235 | 2534 | AI170632 | 96.9556 | 59.4027 | 0.6839 | 47.0757 | 113.7709 |
| 1424 | 194741 | AI22796 | 96.8524 | 482.7043 | 4.7665 | 451.10351 | 171.2731 |
| 1372 | 23929 | AI178222 | 96.8524 | 119.9370 | 3.0490 | 84.1205 | 26.0640 |
| 157 | 6829 | AA818784 | 96.8524 | 71.9370 | 2.2959 | 47.3094 | 17.4432 |
| 628 | 884 | AA946362 | 96.8524 | 157.9607 | 1.5650 | 149.8314 | 41.4744 |
| 1385 | 16668 | AI178751 | 96.8008 | 126.9523 | 2.9561 | 85.1508 | 27.2459 |
| 1115 | 8124 | AI103071 | 96.8008 | 82.3080 | 7.0661 | 40.3686 | 17.8861 |
| 855 | 2456 | AI012423 | 96.8008 | 113.5797 | 6.5179 | 71.7085 | 22.5480 |
| 524 | 5002 | AA924689 | 96.7492 | 106.6370 | 1.0650 | 127.3864 | 25.2245 |
| 893 | 21604 | AI013913 | 96.7492 | 555.9780 | 80.8008 | 321.7814 | 84.0405 |
| 877 | 19467 | AI013397 | 96.7492 | 189.9040 | 11.3668 | 298.0918 | 72.6472 |
| 636 | 22439 | AA955213 | 96.7492 | 127.7150 | 17.7419 | 55.7336 | 52.2231 |
| 545 | 3997 | AA925771 | 96.6460 | 50.1093 | 14.4782 | 139.3108 | 40.4989 |
| 792 | 10532 | AI009602 | 96.6460 | 97.7030 | 3.1952 | 70.9501 | 20.2826 |

TABLE 5JJ

GENERAL
Timepoint(s): All

| SEQ ID | GLGC ID | GenBank Accession No. | LDA Score | Mean Tox | SD Tox | Mean Nontox | SD Nontox |
|---|---|---|---|---|---|---|---|
| 2111 | 24499 | NM_022393 | 75.6185 | 34.2595 | 16.8535 | 18.2323 | 9.4155 |
| 2542 | 1530 | NM_134397 | 74.2041 | 156.4787 | 33.4574 | 199.8098 | 39.7345 |
| 76 | 11422 | AA799812 | 73.1898 | 85.9764 | 29.2380 | 118.9154 | 30.0944 |
| 308 | 15402 | AA875261 | 72.8374 | 285.6013 | 59.4143 | 340.2954 | 57.4511 |
| 268 | 17217 | AA866299 | 71.9823 | 350.7624 | 83.8685 | 419.1402 | 72.1336 |
| 1868 | 1521 | NM_013091 | 70.7964 | 98.4309 | 43.5447 | 63.7035 | 29.5109 |
| 365 | 4473 | AA891965 | 70.4132 | 90.9636 | 22.7675 | 114.9192 | 25.6330 |
| 1962 | 9378 | NM_017174 | 70.2415 | 100.9102 | 39.0637 | 135.8928 | 38.9239 |
| 1629 | 17215 | AI639268 | 70.1358 | 140.3519 | 46.7323 | 173.9482 | 36.5854 |
| 1653 | 5049 | D10655 | 69.4194 | 653.5915 | 198.0143 | 761.5973 | 154.5657 |
| 2586 | 19976 | NM_145784 | 69.3990 | 40.2866 | 10.3838 | 50.3488 | 12.1908 |
| 2401 | 24875 | NM_053583 | 69.2614 | 21.6493 | 10.7901 | 32.1978 | 12.7463 |
| 76 | 11423 | AA799812 | 69.1954 | 157.6573 | 49.6884 | 214.8633 | 66.0918 |
| 348 | 23058 | AA891733 | 69.0237 | 232.9766 | 65.6118 | 295.2279 | 67.8701 |
| 48 | 20972 | AA799580 | 69.0010 | 845.8319 | 228.4433 | 1028.8737 | 206.7711 |
| 2579 | 15761 | NM_145091 | 68.9464 | 23.3670 | 16.7164 | 34.5911 | 14.8369 |
| 2273 | 18655 | NM_031358 | 68.7418 | 107.6260 | 62.1282 | 167.7966 | 57.8838 |
| 748 | 19650 | AF016387 | 68.4950 | 263.9817 | 56.8728 | 325.8264 | 64.7982 |
| 2600 | 8210 | S61960 | 68.3631 | 57.4586 | 22.8477 | 80.0516 | 27.4342 |
| 2050 | 21444 | NM_019262 | 68.3597 | 136.5334 | 82.1857 | 71.1793 | 38.0707 |
| 2320 | 1340 | NM_031715 | 68.2733 | 1100.5494 | 220.9089 | 1290.4251 | 198.7156 |
| 2688 | 19279 | Y00350 | 68.2403 | 158.3076 | 24.7864 | 179.0857 | 21.3291 |
| 1725 | 10743 | M64780 | 68.2199 | 139.7771 | 37.2153 | 170.4504 | 42.1306 |
| 2277 | 20448 | NM_031530 | 68.1937 | 200.0502 | 283.8492 | 54.1081 | 31.5035 |
| 29 | 17137 | AA799438 | 68.1414 | 656.8594 | 253.9941 | 892.0875 | 228.5328 |
| 295 | 16342 | AA875060 | 68.1414 | 28.4823 | 13.5937 | 36.5884 | 11.7237 |
| 2006 | 20848 | NM_017343 | 68.0470 | 1790.4577 | 279.1314 | 1568.6877 | 254.0128 |
| 1800 | 10248 | NM_012797 | 67.9470 | 380.7530 | 114.3829 | 294.6245 | 71.8207 |
| 335 | 13789 | AA891476 | 67.8560 | 35.6846 | 11.4824 | 49.3703 | 14.5261 |
| 1677 | 6980 | H33001 | 67.8105 | 119.7477 | 42.4442 | 154.0515 | 38.5185 |
| 2676 | 16725 | X73371 | 67.8083 | 21.0355 | 12.6859 | 13.3580 | 7.6181 |
| 108 | 23368 | AA800678 | 67.7832 | 342.8849 | 89.3216 | 422.9070 | 86.0283 |
| 374 | 12010 | AA892137 | 67.7571 | 161.2940 | 37.9738 | 198.3717 | 49.9862 |
| 2419 | 16123 | NM_053698 | 67.7093 | 151.7510 | 84.6333 | 97.4968 | 34.5563 |
| 2026 | 24362 | NM_019156 | 67.6127 | 70.1349 | 21.0065 | 83.7830 | 19.9340 |
| 299 | 4339 | AA875121 | 67.5354 | 330.9076 | 59.9258 | 376.9540 | 58.0307 |
| 1619 | 15379 | AI639162 | 67.3819 | 86.2432 | 32.6069 | 115.5606 | 35.7516 |
| 2532 | 1271 | NM_133593 | 67.3750 | 71.4633 | 17.5343 | 82.4708 | 14.7182 |
| 2091 | 20177 | NM_021867 | 67.3102 | 28.9418 | 16.2224 | 45.2501 | 18.6935 |
| 2633 | 17296 | U76206 | 67.2704 | 31.4375 | 8.7784 | 37.8552 | 8.0298 |

TABLE 5JJ-continued

GENERAL
Timepoint(s): All

| SEQ ID | GLGC ID | GenBank Accession No. | LDA Score | Mean Tox | SD Tox | Mean Nontox | SD Nontox |
|---|---|---|---|---|---|---|---|
| 1331 | 24763 | AI176488 | 67.2386 | 145.2555 | 55.4727 | 178.1109 | 61.5849 |
| 2346 | 17601 | NM_031976 | 67.1385 | 177.2865 | 41.5957 | 208.3250 | 38.2134 |
| 2607 | 25545 | S77900 | 67.0726 | 292.3751 | 125.5411 | 360.7596 | 112.0516 |
| 2315 | 16205 | NM031706 | 67.0123 | 1735.3080 | 245.2707 | 1528.1296 | 279.4525 |
| 1936 | 10887 | NM_017094 | 66.9805 | 67.1386 | 21.2123 | 91.3261 | 30.9001 |
| 1899 | 20729 | NM_013217 | 66.9566 | 698.2047 | 127.5898 | 788.2066 | 117.8244 |
| 1335 | 16518 | AI176546 | 66.9543 | 1021.8743 | 506.7264 | 732.4187 | 169.6207 |
| 2309 | 18403 | NM_031677 | 66.9339 | 2385.3237 | 624.8610 | 2798.2098 | 541.7250 |
| 1906 | 64 | NM_016991 | 66.9032 | 97.8079 | 25.3021 | 124.9819 | 33.1042 |
| 1487 | 13092 | AI231547 | 66.7474 | 154.7147 | 56.2731 | 198.6891 | 54.3053 |
| 2299 | 24234 | NM_031614 | 66.7451 | 103.2255 | 54.4972 | 72.8244 | 23.1475 |
| 401 | 13574 | AA892557 | 66.6905 | 114.3515 | 29.1618 | 98.1320 | 20.9062 |
| 97 | 3692 | AA800210 | 66.5893 | 155.3092 | 29.6198 | 181.2876 | 51.8793 |
| 1802 | 15032 | NM_012816 | 66.5382 | 33.1735 | 8.9006 | 39.5999 | 9.7445 |
| 2052 | 20734 | NM_019283 | 66.5132 | 145.0892 | 98.4298 | 87.0347 | 26.7804 |
| 88 | 11352 | AA800036 | 66.4768 | 266.1557 | 69.8218 | 311.6899 | 59.9196 |
| 2315 | 16204 | NM_031706 | 66.4711 | 1406.6185 | 208.4569 | 1244.8317 | 193.7024 |
| 268 | 17218 | AA866299 | 66.4677 | 313.9458 | 79.0318 | 376.5280 | 94.0896 |
| 70 | 18360 | AA799771 | 66.4563 | 346.4218 | 85.2672 | 426.0018 | 103.2818 |
| 2218 | 1719 | NM_031024 | 66.3949 | 156.4190 | 48.4436 | 192.6382 | 46.9362 |
| 2321 | 19048 | NM_031719 | 66.3517 | 52.1643 | 20.6674 | 68.5798 | 24.8104 |
| 1798 | 16947 | NM_012793 | 66.3460 | 64.6320 | 19.0932 | 77.9823 | 20.8584 |
| 1887 | 21722 | NM_013174 | 66.3392 | 78.8460 | 28.5022 | 97.4257 | 24.5642 |
| 748 | 19649 | AF016387 | 66.2733 | 77.2451 | 23.2617 | 99.7705 | 22.8430 |
| 2301 | 15767 | NM_031623 | 66.2687 | 185.6237 | 46.5275 | 222.2000 | 50.5705 |
| 2181 | 561 | NM_024156 | 66.2516 | 430.8957 | 72.4243 | 495.6473 | 76.5463 |
| 2115 | 23300 | NM_022398 | 66.2346 | 952.1552 | 173.8440 | 1085.2464 | 163.2462 |
| 1722 | 24662 | M59786 | 66.1027 | 156.7100 | 39.5070 | 183.0955 | 38.7900 |
| 2549 | 25479 | NM_138549 | 66.0254 | 1722.2655 | 325.7824 | 1991.8786 | 338.8588 |
| 2461 | 15468 | NM_053982 | 66.0083 | 1436.5322 | 229.7038 | 1276.1137 | 212.9131 |
| 71 | 11530 | AA799773 | 65.9230 | 382.9851 | 353.7153 | 177.7582 | 87.6155 |
| 2119 | 8211 | NM_022500 | 65.8912 | 828.4386 | 237.9910 | 659.2601 | 154.1607 |
| 393 | 24873 | AA892498 | 65.8560 | 379.1240 | 64.7791 | 435.5892 | 77.2116 |
| 1674 | 19278 | H31802 | 65.8173 | 90.0442 | 30.9386 | 116.4107 | 38.5619 |
| 18 | 14580 | AA686870 | 65.7684 | 26.6497 | 11.7230 | 32.3422 | 13.6095 |
| 2328 | 1170 | NM_031789 | 65.7479 | 90.3365 | 27.3135 | 72.4629 | 17.7150 |
| 95 | 21069 | AA800200 | 65.6854 | 41.7827 | 10.6361 | 51.4599 | 14.6778 |
| 2395 | 4327 | NM_053563 | 65.5387 | 108.9996 | 31.7510 | 88.2913 | 26.4895 |
| 2362 | 24419 | NM_033539 | 65.5251 | 87.8761 | 57.7349 | 60.3946 | 71.2141 |
| 741 | 11745 | AB006450 | 65.4910 | 479.0887 | 84.5144 | 542.6919 | 79.8628 |
| 2358 | 23715 | NM_033237 | 65.4603 | 32.3760 | 54.2645 | 6.1169 | 14.4939 |
| 1970 | 13938 | NM_017212 | 65.4421 | 77.6296 | 19.5470 | 93.8024 | 22.4060 |
| 2543 | 7164 | NM_134406 | 65.4148 | 75.5764 | 21.5404 | 94.6448 | 27.7397 |
| 2284 | 25795 | NM_031556 | 65.3875 | 278.7450 | 102.4319 | 364.5919 | 132.0502 |
| 309 | 15410 | AA875268 | 65.3750 | 1163.7670 | 225.4294 | 1323.9725 | 212.6852 |
| 319 | 15617 | AA875620 | 65.3625 | 22.0207 | 10.8451 | 13.6338 | 7.1597 |
| 2477 | 15125 | NM_057105 | 65.3568 | 73.4162 | 25.4616 | 55.7064 | 17.4314 |
| 343 | 4448 | AA891631 | 65.3261 | 29.2971 | 10.2480 | 36.2998 | 10.4588 |
| 2362 | 24420 | NM_033539 | 65.3238 | 652.0605 | 361.4076 | 1453.4235 | 277.2366 |
| 444 | 3623 | AA893663 | 65.3034 | 30.9912 | 14.5403 | 40.3320 | 13.1050 |
| 743 | 17963 | AB012231 | 65.2818 | 191.6866 | 68.4033 | 233.2032 | 76.8655 |
| 459 | 16485 | AA894104 | 65.2715 | 193.8563 | 39.4326 | 223.3569 | 43.3008 |
| 1680 | 10185 | H33426 | 65.1976 | 26.7998 | 12.4135 | 32.3165 | 9.7942 |
| 2224 | 1731 | NM_031047 | 65.1874 | 225.8634 | 77.9986 | 280.1050 | 71.4705 |
| 367 | 17374 | AA891978 | 65.1567 | 249.3977 | 41.6200 | 282.5205 | 59.8285 |
| 356 | 11966 | AA891800 | 65.1283 | 340.4083 | 61.8618 | 389.6810 | 68.3133 |
| 2310 | 15041 | NM_031678 | 65.1123 | 20.4580 | 12.9306 | 17.6363 | 22.8917 |
| 1767 | 1841 | NM_012637 | 65.0987 | 80.2937 | 32.1224 | 57.3336 | 25.8529 |
| 2054 | 10016 | NM_019289 | 65.0919 | 240.9787 | 88.2186 | 193.9152 | 52.6454 |
| 2629 | 1715 | U72660 | 65.0816 | 126.6321 | 32.8328 | 108.8386 | 24.9623 |
| 2094 | 23780 | NM_022183 | 65.0680 | 20.9706 | 12.2426 | 31.2656 | 15.8604 |
| 363 | 9826 | AA891950 | 65.0339 | 31.0955 | 14.2829 | 41.2229 | 14.9068 |
| 2054 | 10015 | NM_019289 | 65.0259 | 254.6920 | 86.7035 | 210.1809 | 54.9484 |
| 1614 | 25895 | AI639128 | 65.0237 | 8.6614 | 17.4251 | 20.4931 | 21.4915 |
| 2304 | 1727 | NM_031642 | 65.0214 | 60.2738 | 36.8581 | 41.1555 | 29.0110 |
| 260 | 23336 | AA859981 | 65.0180 | 78.2744 | 21.6816 | 96.2845 | 24.4844 |
| 2519 | 19326 | NM_133419 | 65.0168 | 65.5375 | 20.4478 | 53.0026 | 20.4891 |
| 2298 | 19022 | NM_031609 | 65.0066 | 95.9416 | 26.5834 | 109.1019 | 27.2374 |
| 2432 | 25594 | NM_053799 | 65.0009 | 349.0339 | 62.1185 | 385.2526 | 62.3908 |
| 289 | 16192 | AA874995 | 65.0009 | 34.5344 | 9.0067 | 41.1047 | 9.9814 |
| 1298 | 2448 | AI175348 | 76.8158 | 74.2112 | 19.8277 | 100.7353 | 20.1242 |
| 1583 | 22939 | AI236669 | 75.1842 | 39.3657 | 41.2712 | 86.1641 | 33.9869 |

TABLE 5JJ-continued

GENERAL
Timepoint(s): All

| SEQ ID | GLGC ID | GenBank Accession No. | LDA Score | Mean Tox | SD Tox | Mean Nontox | SD Nontox |
|---|---|---|---|---|---|---|---|
| 1153 | 4479 | AI111599 | 72.7248 | 228.3896 | 100.9083 | 145.1523 | 76.0803 |
| 759 | 9976 | AI007744 | 72.2904 | 491.7338 | 202.1302 | 670.8533 | 145.1039 |
| 1050 | 22930 | AI071578 | 72.1870 | 217.4787 | 140.3171 | 357.4950 | 131.3775 |
| 1249 | 11426 | AI171305 | 71.7788 | 430.7607 | 141.9394 | 576.5768 | 141.7497 |
| 909 | 12662 | AI029179 | 71.6128 | 59.2040 | 32.3768 | 90.8955 | 26.9766 |
| 594 | 22678 | AA944556 | 71.2171 | 240.9209 | 48.3079 | 298.3937 | 55.4801 |
| 672 | 24171 | AA957835 | 70.7100 | 74.3770 | 22.6059 | 97.4837 | 23.2611 |
| 161 | 13428 | AA818861 | 70.6986 | 65.2547 | 20.1172 | 81.4399 | 19.7620 |
| 574 | 19220 | AA943740 | 70.4223 | 343.5755 | 79.9381 | 422.1556 | 68.5468 |
| 511 | 4909 | AA924097 | 70.4177 | 137.6288 | 51.9239 | 192.9884 | 52.6384 |
| 1083 | 7868 | AI101229 | 70.3188 | 100.1702 | 31.4308 | 134.8450 | 36.8073 |
| 2493 | 8820 | NM_080399 | 70.0152 | 306.1685 | 131.6133 | 416.2712 | 114.1028 |
| 582 | 15596 | AA944353 | 69.9209 | 921.6366 | 213.7143 | 1113.8680 | 177.6359 |
| 486 | 4730 | AA900326 | 69.9209 | 938.7402 | 250.0683 | 1105.9844 | 192.0489 |
| 885 | 4253 | AI013566 | 69.8606 | 129.7892 | 40.9456 | 163.8501 | 34.9888 |
| 858 | 3304 | AI012471 | 69.8401 | 246.1395 | 57.3973 | 320.9397 | 79.5986 |
| 1094 | 11399 | AI101924 | 69.8231 | 121.1745 | 49.4948 | 160.5642 | 48.4350 |
| 1294 | 2331 | AI175045 | 69.7207 | 777.1228 | 653.0431 | 317.3893 | 197.5116 |
| 667 | 24051 | AA957452 | 69.6184 | 117.0387 | 31.0186 | 150.0066 | 31.1072 |
| 1141 | 11680 | AI104605 | 69.4967 | 199.3478 | 39.9329 | 226.2258 | 34.2756 |
| 1540 | 14494 | AI234222 | 69.4353 | 196.4649 | 42.6964 | 232.1137 | 32.0114 |
| 528 | 20953 | AA924926 | 69.3035 | 722.8413 | 152.7183 | 865.5185 | 121.5070 |
| 1149 | 2196 | AI105243 | 69.2204 | 369.0324 | 73.7154 | 314.7563 | 52.8844 |
| 543 | 4285 | AA925708 | 69.1932 | 257.5456 | 74.2533 | 312.0967 | 54.7004 |
| 2503 | 9633 | NM_130403 | 69.1932 | 82.8350 | 45.8355 | 112.2171 | 34.7979 |
| 22 | 21997 | AA799325 | 69.1886 | 265.5388 | 73.6475 | 343.0222 | 76.1280 |
| 191 | 8619 | AA849317 | 69.1011 | 52.3146 | 29.2644 | 79.2878 | 29.7707 |
| 1531 | 14095 | AI233468 | 68.9567 | 162.5993 | 39.5793 | 193.2475 | 35.8449 |
| 908 | 9317 | AI029174 | 68.8577 | 589.7563 | 156.9397 | 694.6903 | 135.0163 |
| 1429 | 8917 | AI228301 | 68.8520 | 134.8922 | 40.7874 | 174.6518 | 35.4760 |
| 563 | 22130 | AA943020 | 68.8475 | 180.4303 | 49.2285 | 222.9292 | 52.0793 |
| 1565 | 14776 | AI235950 | 68.7918 | 387.6523 | 82.4764 | 453.2932 | 75.4357 |
| 1497 | 12435 | AI231810 | 68.7202 | 192.5566 | 44.7331 | 237.4061 | 43.5750 |
| 1343 | 16124 | AI176963 | 68.6792 | 324.6097 | 169.9924 | 212.2391 | 55.5821 |
| 140 | 6550 | AA817947 | 68.6099 | 375.4099 | 91.4847 | 69.2689 | 93.3862 |
| 717 | 3043 | AA997694 | 68.5928 | 112.5273 | 35.1563 | 143.1731 | 30.3926 |
| 1440 | 13826 | AI229304 | 68.5325 | 1219.1377 | 228.4679 | 1434.0857 | 217.1109 |
| 167 | 5863 | AA819111 | 68.4939 | 264.4685 | 63.6224 | 311.1134 | 54.0255 |
| 774 | 7785 | AI008758 | 68.4166 | 18.3555 | 25.9962 | 36.4874 | 21.6407 |
| 700 | 2803 | AA996451 | 68.3722 | 138.3072 | 54.9376 | 183.4522 | 45.2714 |
| 1548 | 14700 | AI234852 | 68.3438 | 50.6679 | 20.6625 | 36.6629 | 13.0915 |
| 1263 | 15449 | AI171799 | 68.3245 | 247.8878 | 62.7630 | 308.6923 | 71.0213 |
| 1289 | 11897 | AI172598 | 68.2904 | 33.8856 | 11.4193 | 40.8550 | 10.4420 |
| 2100 | 6263 | NM_022251 | 68.2358 | 172.3906 | 46.0848 | 211.6096 | 45.1407 |
| 1552 | 11246 | AI235222 | 68.2028 | 91.1100 | 26.1558 | 113.3934 | 27.4628 |
| 597 | 22081 | AA944818 | 68.2017 | 196.6991 | 49.8133 | 238.1235 | 42.4566 |
| 821 | 6946 | AI010642 | 68.1960 | 463.8221 | 106.1912 | 523.8894 | 92.4231 |
| 1253 | 16599 | AI171366 | 68.1630 | 481.9139 | 159.4526 | 608.6746 | 132.1457 |
| 1201 | 11346 | AI145991 | 68.1198 | 86.2982 | 59.0297 | 133.2276 | 58.5674 |
| 911 | 12819 | AI029437 | 68.1096 | 432.2876 | 85.9746 | 504.2326 | 92.5986 |
| 617 | 22692 | AA945986 | 68.0971 | 432.0026 | 111.8651 | 519.1002 | 100.0788 |
| 1283 | 12117 | AI172352 | 68.0413 | 517.5391 | 142.7068 | 610.0512 | 111.6380 |
| 186 | 14654 | AA848795 | 67.9811 | 247.5209 | 89.6507 | 300.3160 | 70.1127 |
| 1262 | 11696 | AI171774 | 67.9595 | 112.8963 | 44.9690 | 145.3375 | 40.0203 |
| 979 | 16752 | AI045475 | 67.9492 | 73.7208 | 50.4746 | 115.6206 | 50.0369 |
| 520 | 18251 | AA924548 | 67.9197 | 86.9313 | 23.1752 | 70.5075 | 16.0715 |
| 875 | 6758 | AI013394 | 67.8810 | 23.2318 | 13.6344 | 14.3589 | 9.5633 |
| 205 | 5668 | AA850743 | 67.8765 | 61.2483 | 34.8436 | 86.7686 | 31.1453 |
| 1267 | 6645 | AI171998 | 67.8230 | 126.1081 | 28.5670 | 149.3772 | 32.0343 |
| 1193 | 18206 | AI145282 | 67.8105 | 259.8077 | 52.0249 | 213.7398 | 49.5328 |
| 686 | 2373 | AA964455 | 67.7832 | 315.5731 | 87.4847 | 397.0314 | 82.1406 |
| 1523 | 4855 | AI233024 | 67.7002 | 54.6195 | 21.2220 | 71.0632 | 20.0774 |
| 1315 | 6686 | AI176130 | 67.6457 | 283.0167 | 56.5288 | 346.3295 | 55.6461 |
| 915 | 10650 | AI029942 | 67.6411 | 605.0163 | 199.5154 | 772.0382 | 226.1347 |
| 815 | 17524 | AI010568 | 67.6343 | 1027.3541 | 226.9904 | 1192.6757 | 194.6795 |
| 765 | 4052 | AI008095 | 67.5570 | 395.4532 | 97.6496 | 468.9675 | 87.9716 |
| 2127 | 4145 | NM_022518 | 67.5354 | 1500.2723 | 281.6434 | 1281.0845 | 292.0936 |
| 846 | 11752 | AI012208 | 67.5069 | 1644.3102 | 418.3417 | 1893.5383 | 325.1941 |
| 828 | 11424 | AI010936 | 67.5035 | 474.7738 | 132.3324 | 609.3307 | 161.0273 |

TABLE 5KK

General Core Tax Markers
Timepoint(s): All

| SEQ ID | GLGC ID | GenBank Accession No. | LDA Score | Mean Tox | SD Tox | Mean Nontox | SD Nontox |
|---|---|---|---|---|---|---|---|
| 2111 | 22499 | NM_022393 | 75.6185 | 34.2595 | 16.8535 | 18.2323 | 9.4155 |
| 2335 | 22321 | NM_031832 | 75.1990 | 310.8506 | 167.1420 | 146.9295 | 47.6714 |
| 1631 | 20461 | AI639350 | 75.1842 | 62.7182 | 22.3949 | 88.6019 | 20.7951 |
| 1956 | 21975 | NM_017154 | 74.9238 | 268.8610 | 123.7110 | 162.1553 | 50.7833 |
| 2542 | 1530 | NM_134397 | 74.2041 | 156.4787 | 33.4574 | 199.8098 | 39.7345 |
| 2435 | 15003 | NM_053819 | 74.0688 | 321.4460 | 390.6709 | 46.5067 | 36.3258 |
| 1882 | 3431 | NM_013156 | 73.4582 | 792.2635 | 219.3143 | 591.5221 | 122.8562 |
| 2435 | 15002 | NM_053819 | 73.4241 | 432.4998 | 364.4478 | 159.8612 | 50.3720 |
| 76 | 11422 | AA799812 | 73.1898 | 85.9764 | 29.2380 | 118.9154 | 30.0944 |
| 2273 | 18654 | NM_031358 | 72.9079 | 152.9391 | 71.7638 | 231.9206 | 55.9597 |
| 308 | 15402 | AA875261 | 72.8374 | 285.6013 | 59.4143 | 340.2954 | 57.4511 |
| 268 | 17217 | AA866299 | 71.9823 | 350.7624 | 83.8685 | 419.1402 | 72.1336 |
| 1751 | 16080 | NM_012580 | 71.7594 | 67.3947 | 76.5776 | 7.1628 | 23.8680 |
| 2086 | 19710 | NM_021744 | 71.7106 | 75.2188 | 37.0771 | 44.2077 | 15.7666 |
| 2665 | 21657 | X61381 | 71.5457 | 1185.4910 | 270.7155 | 902.5884 | 167.2371 |
| 1402 | 16081 | AI179610 | 71.401 | 3168.3883 | 130.2839 | 73.2613 | 37.7272 |
| 2420 | 6684 | NM_053703 | 71.3603 | 27.7588 | 16.1172 | 44.4057 | 15.4531 |
| 2483 | 1892 | NM_057144 | 71.3467 | 1642.8702 | 683.5585 | 1116.1400 | 239.3556 |
| 1880 | 21683 | NM_013154 | 71.3410 | 97.1756 | 67.8425 | 40.2851 | 17.0137 |
| 293 | 16312 | AA875032 | 71.1978 | 111.6100 | 72.4940 | 60.1567 | 18.3006 |
| 1900 | 18313 | NM_013220 | 70.9726 | 3376.8495 | 897.5373 | 2652.8504 | 565.6103 |
| 1868 | 1521 | NM_013091 | 70.7964 | 98.4309 | 43.5447 | 63.7035 | 29.5109 |
| 2277 | 20449 | NM_031530 | 70.6133 | 292.2106 | 380.2844 | 64.6547 | 57.5069 |
| 1330 | 15191 | AI176456 | 70.6076 | 788.2982 | 1133.4138 | 61.5220 | 171.1551 |
| 2172 | 21239 | NM_024125 | 70.5974 | 185.6163 | 105.8374 | 109.3490 | 45.4813 |
| 2341 | 117736 | NM_031970 | 70.5474 | 1035.4250 | 693.2538 | 534.5436 | 180.7569 |
| 365 | 4473 | AA891965 | 70.4132 | 90.9636 | 22.7675 | 114.9192 | 25.6330 |
| 99 | 4130 | AA800298 | 70.3734 | 189.3837 | 78.0756 | 255.900 | 168.0301 |
| 1787 | 8829 | NM_012749 | 70.2574 | 317.4360 | 76.4486 | 258.2476 | 63.7526 |
| 1841 | 17394 | NM_012992 | 70.2461 | 427.6224 | 96.3789 | 339.9802 | 85.1111 |
| 1962 | 9378 | NM_017174 | 70.2415 | 100.9102 | 39.0637 | 135.8928 | 38.9239 |
| 1629 | 17215 | AI639268 | 70.1358 | 140.3519 | 46.7323 | 173.9482 | 36.5854 |
| 1880 | 21682 | NM_013154 | 70.1062 | 28.3445 | 64.0469 | −15.4356 | 55.3860 |
| 2063 | 22675 | NM_019358 | 69.9914 | 48.9600 | 30.0366 | 26.0113 | 14.6579 |
| 2449 | 385 | NM_053885 | 69.7503 | 27.3961 | 21.3493 | 49.2124 | 21.8259 |
| 2050 | 21443 | NM_019262 | 69.6662 | 280.4249 | 116.2170 | 189.4061 | 55.3624 |
| 2073 | 574 | NM_019905 | 69.4842 | 742.5717 | 254.3230 | 573.4534 | 112.0019 |
| 1653 | 5049 | D10655 | 69.4194 | 653.5915 | 198.0143 | 761.5973 | 154.5657 |
| 2586 | 19976 | NM_145784 | 69.3990 | 40.2866 | 10.3838 | 50.3488 | 12.1908 |
| 747 | 1097 | AF016296 | 69.3091 | 238.2240 | 114.2269 | 318.9707 | 91.7227 |
| 2401 | 24875 | NM_053583 | 69.2614 | 21.6493 | 10.7901 | 32.1978 | 12.7463 |
| 761 | 11423 | AA799812 | 69.1954 | 157.6573 | 49.6884 | 214.8633 | 66.0918 |
| 2607 | 21583 | S77900 | 69.0397 | 324.4733 | 146.4239 | 375.2011 | 115.5780 |
| 3481 | 23058 | AA891733 | 69.0237 | 232.9766 | 65.6118 | 295.2279 | 67.8701 |
| 1891 | 1714 | NM_013187 | 69.0135 | 148.3219 | 31.1826 | 182.1938 | 40.0553 |
| 48 | 20972 | AA799580 | 69.0010 | 845.8319 | 228.44331 | 1028.8737 | 206.7711 |
| 2579 | 15761 | NM_145091 | 68.9464 | 23.3670 | 16.7164 | 34.5911 | 14.8369 |
| 972 | 20983 | AI044900 | 68.8248 | 398.0834 | 113.6422 | 498.4937 | 99.1120 |
| 2273 | 18655 | NM_031358 | 68.7418 | 107.6260 | 62.1282 | 167.7966 | 57.8838 |
| 746 | 3799 | AF002281 | 68.6906 | 462.7803 | 191.9644 | 364.9625 | 81.7487 |
| 92 | 4832 | AA800190 | 68.5496 | 744.6212 | 207.4810 | 907.2128 | 99.1618 |
| 1943 | 1435 | NM_017125 | 68.5314 | 1107.3409 | 204.2324 | 959.6013 | 134.7527 |
| 748 | 19650 | AF016387 | 68.4950 | 263.9817 | 56.8728 | 325.8264 | 64.7982 |
| 2600 | 8210 | S61960 | 68.3631 | 57.4586 | 22.8477 | 80.0516 | 27.4342 |
| 2050 | 21444 | NM_019262 | 68.3597 | 136.5334 | 82.1857 | 71.1793 | 38.0707 |
| 2260 | 1638 | NM_031143 | 68.2801 | 122.4597 | 39.2649 | 158.8515 | 42.8884 |
| 2320 | 1340 | NM_031715 | 68.2733 | 1100.5494 | 220.9089 | 1290.4251 | 198.7156 |
| 2688 | 19279 | Y00350 | 68.2403 | 158.3076 | 24.7864 | 179.0857 | 21.3291 |
| 1725 | 10743 | M64780 | 68.2199 | 139.7771 | 37.2153 | 170.4504 | 42.1306 |
| 2277 | 20448 | NM_031530 | 68.1937 | 200.0502 | 283.8492 | 54.1081 | 31.5035 |
| 29 | 17137 | AA799438 | 68.1414 | 656.8594 | 253.9941 | 892.0875 | 228.5328 |
| 295 | 16342 | AA875060 | 68.1414 | 28.4823 | 13.5937 | 36.5884 | 11.7237 |
| 1882 | 3430 | NM_013156 | 68.1062 | 139.4883 | 47.9044 | 102.3391 | 20.1371 |
| 2624 | 21654 | U53184 | 68.0948 | 281.9094 | 148.2317 | 188.9304 | 34.6117 |
| 1835 | 2555 | NM_012967 | 68.0675 | 67.1897 | 36.8268 | 42.6112 | 17.2322 |
| 2006 | 20848 | NM_017343 | 68.0470 | 1790.4577 | 279.1314 | 1568.6877 | 254.0128 |
| 2341 | 17735 | NM_031970 | 68.0232 | 1689.5961 | 1092.4495 | 972.3470 | 298.9849 |
| 1800 | 10248 | NM_012797 | 67.9470 | 380.7530 | 114.3829 | 294.6245 | 71.8207 |
| 1855 | 11114 | NM_013046 | 67.9458 | 58.9010 | 70.0447 | 124.7929 | 11.4189 |
| 2299 | 24235 | NM_031614 | 67.8913 | 271.3439 | 126.6928 | 190.0143 | 48.7300 |
| 2440 | 20868 | NM_053843 | 67.8913 | 76.0247 | 42.9611 | 43.2374 | 23.9546 |
| 335 | 13789 | AA891476 | 67.8560 | 35.6846 | 11.4824 | 49.3703 | 14.5261 |
| 84 | 18883 | AA799992 | 67.8196 | 95.9977 | 45.3994 | 63.0582 | 19.1063 |

TABLE 5KK-continued

General Core Tax Markers
Timepoint(s): All

| SEQ ID | GLGC ID | GenBank Accession No. | LDA Score | Mean Tox | SD Tox | Mean Nontox | SD Nontox |
|---|---|---|---|---|---|---|---|
| 1677 | 6980 | H33001 | 67.8105 | 119.7477 | 42.4442 | 154.0515 | 38.5185 |
| 2676 | 16725 | X73371 | 67.8083 | 21.0355 | 12.6859 | 13.3580 | 7.6181 |
| 108 | 23368 | AA800678 | 67.7832 | 342.8849 | 89.3216 | 422.9070 | 86.0283 |
| 374 | 12010 | AA892137 | 67.7571 | 161.2940 | 37.9738 | 198.3717 | 49.9862 |
| 2419 | 16123 | NM_053698 | 67.7093 | 151.7510 | 84.6333 | 97.4968 | 34.5563 |
| 2026 | 24362 | NM_019156 | 67.6127 | 70.1349 | 21.0065 | 83.7830 | 19.9340 |
| 299 | 4339 | AA875121 | 67.5354 | 330.9076 | 59.9258 | 376.9540 | 58.0307 |
| 2660 | 25705 | X59375 | 67.5274 | 483.3095 | 205.7122 | 338.5691 | 79.1325 |
| 2292 | 24219 | NM_031579 | 67.5274 | 362.8953 | 136.9343 | 283.3848 | 55.6203 |
| 1929 | 11153 | NM_017073 | 67.4671 | 592.1088 | 210.2750 | 448.4556 | 122.6381 |
| 1619 | 15379 | AI639162 | 67.3819 | 86.2432 | 32.6069 | 115.5606 | 35.7516 |
| 2532 | 1271 | NM_133593 | 67.3750 | 71.4633 | 17.5343 | 82.4708 | 14.7182 |
| 2042 | 20433 | NM_019232 | 67.3398 | 102.2437 | 66.1840 | 59.7421 | 20.5107 |
| 2091 | 20177 | NM_021867 | 67.3102 | 28.9418 | 16.2224 | 45.2501 | 18.6935 |
| 455 | 23731 | AA894004 | 67.2909 | 196.6788 | 64.7240 | 152.3782 | 36.4458 |
| 2633 | 17296 | U76206 | 67.2704 | 31.4375 | 8.7784 | 37.8552 | 8.0298 |
| 1331 | 24763 | AI176488 | 67.2386 | 145.2555 | 55.4727 | 178.1109 | 61.5849 |
| 2136 | 8597 | NM_022538 | 67.1806 | 198.7026 | 63.6688 | 150.9571 | 30.9868 |
| 2346 | 17601 | NM_031976 | 67.1385 | 177.2865 | 41.5957 | 208.3250 | 38.2134 |
| 272 | 11865 | AA866383 | 67.1056 | 52.4406 | 19.9271 | 67.5548 | 18.2568 |
| 2607 | 25545 | S77900 | 67.0726 | 292.3751 | 125.5411 | 360.7596 | 112.0516 |
| 2667 | 13646 | X62166 | 67.0601 | 683.5205 | 181.4408 | 555.9496 | 143.0688 |
| 2315 | 16205 | NM_031706 | 67.0123 | 1735.3080 | 245.27071 | 1528.1296 | 279.4525 |
| 1936 | 10887 | NM_017094 | 66.9805 | 67.1386 | 21.2123 | 191.3261 | 30.9001 |
| 325 | 5384 | AA891041 | 66.9703 | 102.7054 | 105.1552 | 31.3045 | 36.3468 |
| 1899 | 20729 | NM_013217 | 66.9566 | 698.2047 | 127.5898 | 788.2066 | 117.8244 |
| 1335 | 16518 | AI176546 | 66.9543 | 1021.8743 | 506.7264 | 732.4187 | 169.6207 |
| 362 | 1159 | AA891949 | 66.9521 | 85.6168 | 27.9488 | 111.4484 | 30.7412 |
| 2309 | 18403 | NM_031677 | 66.9339 | 2385.3237 | 624.8610 | 2798.2098 | 541.7250 |
| 2341 | 17734 | NM_031970 | 66.9043 | 1608.1908 | 992.4403 | 936.8658 | 251.9332 |
| 1906 | 64 | NM_016991 | 66.9032 | 97.8079 | 25.3021 | 124.9819 | 33.1042 |
| 2325 | 14185 | NM_031776 | 66.8338 | 625.7184 | 304.2997 | 421.8475 | 190.0477 |
| 1487 | 13092 | AI231547 | 66.7474 | 154.7147 | 56.2731 | 198.6891 | 54.3053 |
| 2299 | 24234 | NM_031614 | 66.7451 | 103.2255 | 54.4972 | 72.8244 | 23.1475 |
| 401 | 13574 | AA892557 | 66.6905 | 114.3515 | 29.1618 | 98.1320 | 20.9062 |
| 2440 | 20869 | NM_053843 | 66.6678 | 99.6105 | 58.7429 | 55.4663 | 29.9272 |
| 1356 | 14989 | AI177366 | 66.6633 | 848.9285 | 202.1613 | 706.7301 | 139.9248 |
| 2591 | 1760 | NM_147211 | 66.6257 | 156.3426 | 43.0133 | 187.7109 | 39.8231 |
| 1637 | 10097 | AI639425 | 66.5984 | 104.9067 | 22.6132 | 123.0126 | 21.7780 |
| 97 | 3692 | AA800210 | 66.5893 | 155.3092 | 29.6198 | 181.2876 | 51.8793 |
| 1854 | 17401 | NM_013043 | 66.5848 | 853.6625 | 441.6559 | 548.8353 | 114.9200 |
| 2550 | 15189 | NM_138826 | 66.5791 | 677.1638 | 755.3909 | 270.6925 | 144.6199 |
| 1802 | 15032 | NM_012816 | 66.5382 | 33.1735 | 8.9006 | 39.5999 | 9.7445 |
| 2052 | 20734 | NM_019283 | 66.5132 | 145.0892 | 98.4298 | 87.0347 | 26.7804 |
| 88 | 11352 | AA800036 | 66.4768 | 266.1557 | 69.8218 | 311.6899 | 59.9196 |
| 2315 | 16204 | NM_031706 | 66.4711 | 1406.6185 | 208.4569 | 1244.8317 | 193.7024 |
| 268 | 17218 | AA866299 | 66.4677 | 313.9458 | 79.0318 | 376.5280 | 94.0896 |
| 70 | 18360 | AA799771 | 66.4563 | 346.4218 | 85.2672 | 426.0018 | 103.2818 |
| 2002 | 1894 | NM_017320 | 66.4427 | 204.3381 | 90.7458 | 137.8497 | 59.8939 |
| 2218 | 1719 | NM_031024 | 66.3949 | 156.4190 | 48.4436 | 192.6382 | 46.9362 |
| 2528 | 244 | NM_133551 | 66.3585 | 111.2471 | 93.3779 | 54.6692 | 21.8570 |
| 2321 | 19048 | NM_031719 | 66.3517 | 52.1643 | 20.6674 | 68.5798 | 24.8104 |
| 1798 | 16947 | NM_012793 | 66.3460 | 64.6320 | 19.0932 | 77.9823 | 20.8584 |
| 1887 | 21722 | NM_013174 | 66.3392 | 78.8460 | 28.5022 | 97.4257 | 24.5642 |
| 1838 | 958 | NM_012977 | 66.3233 | 94.4035 | 32.8317 | 115.1819 | 31.7274 |
| 2587 | 20740 | NM_145878 | 66.3096 | 566.3856 | 242.7529 | 429.8468 | 99.6875 |
| 748 | 19649 | AFO16387 | 66.2733 | 77.2451 | 23.2617 | 99.7705 | 22.8430 |
| 2301 | 15767 | NM_031623 | 66.2687 | 185.6237 | 46.5275 | 222.2000 | 50.5705 |
| 2181 | 561 | NM_024156 | 66.2516 | 430.8957 | 72.4243 | 495.6473 | 76.5463 |
| 2115 | 23300 | NM_022398 | 66.2346 | 952.1552 | 173.8440 | 1085.2464 | 163.2462 |
| 2325 | 14184 | NM_031776 | 66.1891 | 301.6652 | 151.3410 | 207.8567 | 99.5168 |
| 1765 | 15540 | NM_012620 | 66.1050 | 113.0405 | 134.6910 | 43.5299 | 17.5777 |
| 1722 | 24662 | M59786 | 66.1027 | 156.7100 | 39.5070 | 183.0955 | 38.7900 |
| 2105 | 17161 | NM_022298 | 66.0777 | 329.7487 | 257.8396 | 182.3693 | 62.7994 |
| 2549 | 25479 | NM_138549 | 66.0254 | 1722.2655 | 325.7824 | 1991.8786 | 338.8588 |
| 2461 | 15468 | NM_053982 | 66.0083 | 1436.5322 | 229.7038 | 1276.1137 | 212.9131 |
| 2095 | 20204 | NM_022196 | 65.9526 | 33.7880 | 16.9377 | 44.5225 | 12.8927 |
| 71 | 11530 | AA799773 | 65.9230 | 382.9851 | 353.7153 | 177.7582 | 87.6155 |
| 2444 | 1571 | NM_053857 | 65.9128 | 215.1553 | 90.6577 | 165.2073 | 40.6653 |
| 270 | 15935 | AA866345 | 65.8992 | 60.7917 | 15.5263 | 74.6537 | 16.3323 |
| 2119 | 8211 | NM_022500 | 65.8912 | 828.4386 | 237.9910 | 659.2601 | 154.1607 |
| 393 | 24874 | AA892498 | 65.8560 | 379.1240 | 64.7791 | 435.5892 | 77.2116 |
| 1674 | 19278 | H31802 | 65.8173 | 90.0442 | 30.9386 | 116.4107 | 38.5619 |

TABLE 5KK-continued

General Core Tax Markers
Timepoint(s): All

| SEQ ID | GLGC ID | GenBank Accession No. | LDA Score | Mean Tox | SD Tox | Mean Nontox | SD Nontox |
|---|---|---|---|---|---|---|---|
| 18 | 14580 | AA686870 | 65.7684 | 26.6497 | 11.7230 | 32.3422 | 13.6095 |
| 2328 | 1170 | NM_031789 | 65.7479 | 90.3365 | 27.3135 | 72.4629 | 17.7150 |
| 2054 | 20735 | NM_019283 | 65.7195 | 148.3225 | 96.1664 | 92.8798 | 26.7873 |
| 95 | 21069 | AA800200 | 65.6854 | 41.7827 | 10.6361 | 51.4599 | 14.6778 |
| 2119 | 8212 | NM_022500 | 65.6047 | 600.7557 | 164.8662 | 464.3623 | 104.1410 |
| 2122 | 1867 | NM_022510 | 65.5399 | 728.2960 | 130.0766 | 636.9389 | 117.5832 |
| 2395 | 4327 | NM_053563 | 65.5381 | 108.9996 | 31.7510 | 88.2913 | 26.4895 |
| 2362 | 24419 | NM_033539 | 65.5251 | 87.8761 | 57.7349 | 60.3946 | 71.2141 |
| 741 | 11745 | AB006450 | 65.4910 | 479.0887 | 84.5144 | 542.6919 | 79.8628 |
| 2358 | 23715 | NM_0332371 | 65.4603 | 32.3760 | 54.2645 | 6.11691 | 14.4939 |
| 1970 | 13938 | NM_0172121 | 65.4421 | 77.6296 | 19.5470 | 193.8024 | 22.4060 |
| 2118 | 20915 | NM_022407 | 65.4296 | 342.5477 | 102.8241 | 377.7500 | 81.9810 |
| 2553 | 23166 | NM_138839 | 65.4284 | 128.0336 | 40.9484 | 105.3646 | 24.9220 |
| 1849 | 20229 | NM_013018 | 65.4250 | 56.3994 | 20.7035 | 75.9754 | 22.7467 |
| 2543 | 7164 | NM_134406 | 65.4148 | 75.5764 | 21.5404 | 94.6448 | 27.7397 |
| 2284 | 25795 | NM_031556 | 65.3875 | 278.7450 | 102.4319 | 364.5919 | 132.0502 |
| 71 | 11531 | AA799773 | 65.3830 | 699.7980 | 596.1378 | 348.1907 | 133.4042 |
| 3091 | 15410 | AA875268 | 65.3750 | 1163.7670 | 225.4294 | 1323.9725 | 212.6852 |
| 3191 | 15617 | AA875620 | 65.3625 | 22.0207 | 10.8451 | 13.6338 | 7.1597 |
| 2477 | 15125 | NM_057105 | 65.3568 | 73.4162 | 25.4616 | 55.7064 | 17.4314 |
| 3431 | 4448 | AA891631 | 65.3261 | 29.2971 | 10.2480 | 36.2998 | 10.4588 |
| 2362 | 24420 | NM_033539 | 65.3238 | 1652.0605 | 361.4076 | 1453.4235 | 277.2366 |
| 2067 | 1324 | NM_019371 | 65.3204 | 545.2323 | 114.5703 | 620.8049 | 113.7748 |
| 444 | 3623 | AA893663 | 65.3034 | 30.9912 | 14.5403 | 40.3320 | 13.1050 |
| 743 | 17963 | AB012231 | 65.2818 | 191.6866 | 68.4033 | 233.2032 | 76.8655 |
| 4591 | 16485 | AA894104 | 65.2715 | 193.8563 | 39.4326 | 223.3569 | 43.3008 |
| 1882 | 25567 | NM_013156 | 65.2511 | 104.1917 | 68.9794 | 61.4264 | 22.5819 |
| 1680 | 10185 | H33426 | 65.1976 | 26.7998 | 12.41353 | 2.3165 | 9.7942 |
| 1929 | 11152 | NM_017073 | 65.1965 | 292.1286 | 136.9697 | 202.8651 | 65.7325 |
| 2224 | 1731 | NM_031047 | 65.1874 | 225.8634 | 77.9986 | 280.1050 | 71.4705 |
| 405 | 19085 | AA892598 | 65.1851 | 64.1975 | 23.2243 | 49.7426 | 9.5907 |
| 367 | 17374 | AA891978 | 65.1567 | 249.3977 | 41.6200 | 282.5205 | 59.8285 |
| 2527 | 11483 | NM_133546 | 65.1465 | 141.9201 | 75.6824 | 91.5787 | 30.8087 |
| 1822 | 24783 | NM_012914 | 65.1442 | 123.5962 | 30.1164 | 140.7204 | 30.2415 |
| 2311 | 20743 | NM_031684 | 65.1317 | 134.8016 | 31.2461 | 160.3544 | 25.4080 |
| 356 | 11966 | AA891800 | 65.1283 | 340.4083 | 61.8618 | 389.6810 | 68.3133 |
| 2310 | 15041 | NM_031678 | 65.1123 | 20.4580 | 12.9306 | 17.6363 | 22.8917 |
| 1767 | 1841 | NM_012637 | 65.0987 | 80.2937 | 32.1224 | 57.3336 | 25.8529 |
| 1985 | 153001 | NM_017259 | 65.0964 | 362.0063 | 238.6042 | 227.2502 | 112.3115 |
| 1881 | 248671 | NM_013155 | 65.0953 | 41.6273 | 15.5508 | 53.9894 | 18.6980 |
| 2054 | 10016 | NM_019289 | 65.0919 | 240.9787 | 88.2186 | 193.9152 | 52.6454 |
| 2629 | 1715 | U726601 | 65.0816 | 126.6321 | 32.8328 | 108.8386 | 24.9623 |
| 2094 | 23780 | NM_0221831 | 65.0680 | 20.9706 | 12.2426 | 31.2656 | 15.8604 |
| 2005 | 356 | NM_017334 | 65.0418 | 81.3621 | 80.7823 | 33.5443 | 26.6137 |
| 3631 | 98261 | AA8919501 | 65.0339 | 31.0955 | 14.2829 | 41.22291 | 14.9068 |
| 2054 | 110015 | NM_019289 | 65.0259 | 254.6920 | 86.7035 | 210.1809 | 54.9484 |
| 1759 | 126291 | NM_012603 | 65.0248 | 137.6718 | 38.3003 | 18.3119 | 7.1524 |
| 1614 | 25895 | AI639128 | 65.0237 | 8.6614 | 17.4251 | 20.4931 | 21.4915 |
| 2304 | 1727 | NM_031642 | 65.0214 | 60.2738 | 36.8581 | 41.1555 | 29.0110 |
| 260 | 23336 | AA859981 | 65.0180 | 78.2744 | 21.6816 | 96.2845 | 24.4844 |
| 2519 | 19326 | NM_133419 | 65.0168 | 65.5375 | 20.4478 | 153.0026 | 20.4891 |
| 2298 | 19022 | NM_031609 | 65.0066 | 95.9416 | 26.5834 | 109.1019 | 27.2374 |
| 2432 | 25594 | NM_053799 | 65.0009 | 349.0339 | 62.1185 | 385.2526 | 62.3908 |
| 289 | 16192 | AA874995 | 65.0009 | 34.5344 | 9.00671 | 41.1047 | 9.9814 |
| 1546 | 23964 | AI234748 | 78.2144 | 126.5579 | 41.9930 | 77.4694 | 22.1057 |
| 714 | 3207 | AA997466 | 77.0137 | 137.5633 | 99.92632 | 68.1614 | 78.1861 |
| 1298 | 2448 | AI175348 | 76.8158 | 74.2112 | 19.8277 | 100.7353 | 20.1242 |
| 849 | 6606 | AI012308 | 75.2706 | 2778.3866 | 1267.7231 | 1664.3804 | 379.8859 |
| 1583 | 22939 | AI236669 | 75.1842 | 39.3657 | 41.2712 | 86.1641 | 33.9869 |
| 1044 | 9583 | AI0711851 | 74.9068 | 150.7627 | 119.1253 | 63.1029 | 22.4454 |
| 906 | 7362 | AI029026 | 74.8761 | 149.2298 | 45.9850 | 99.9303 | 42.5089 |
| 2430 | 9059 | NM_053783 | 73.8220 | 356.3773 | 96.3852 | 252.4288 | 64.5639 |
| 835 | 3941 | AI011598 | 73.6287 | 254.3828 | 112.6162 | 168.0751 | 45.0735 |
| 973 | 5675 | AI045026 | 73.2808 | 298.0814 | 280.3566 | 127.8580 | 40.4409 |
| 1299 | 13460 | AI175375 | 72.8578 | 262.2853 | 76.3707 | 350.4144 | 56.4241 |
| 1153 | 4479 | AI111599 | 72.7248 | 228.3896 | 100.9083 | 145.1523 | 76.0803 |
| 1427 | 12946 | AI228291 | 72.5713 | 182.2626 | 46.7070 | 225.9337 | 34.5637 |
| 1191 | 14458 | AI145095 | 72.5599 | 65.5700 | 33.0872 | 36.6221 | 24.3487 |
| 2400 | 3049 | NM_053582 | 72.3109 | 405.9825 | 271.7365 | 217.2998 | 57.3264 |
| 759 | 9976 | AI007744 | 72.2904 | 491.7338 | 202.1302 | 670.8533 | 145.1039 |
| 558 | 22677 | AA942718 | 72.1904 | 258.0386 | 131.7064 | 137.4176 | 65.6055 |
| 1050 | 22930 | AI071578 | 72.1870 | 217.4787 | 140.3171 | 357.4950 | 131.3775 |
| 525 | 23123 | AA924794 | 71.9698 | 416.7497 | 150.9988 | 301.3687 | 66.7771 |

TABLE 5KK-continued

General Core Tax Markers
Timepoint(s): All

| SEQ ID | GLGC ID | GenBank Accession No. | LDA Score | Mean Tox | SD Tox | Mean Nontox | SD Nontox |
|---|---|---|---|---|---|---|---|
| 965 | 5596 | AI044747 | 71.9505 | 108.4572 | 44.2477 | 155.3954 | 46.2269 |
| 690 | 2410 | AA964589 | 71.8208 | 37.3707 | 19.5481 | 20.8837 | 8.1009 |
| 1591 | 11208 | AI237586 | 71.7936 | 438.5004 | 156.2798 | 307.8393 | 91.1659 |
| 1249 | 11426 | AI171305 | 71.7788 | 430.7607 | 141.9394 | 576.5768 | 141.7497 |
| 2360 | 11714 | NM_033352 | 71.6628 | 561.7938 | 130.20666 | 90.4253 | 120.9098 |
| 909 | 12662 | AI029179 | 71.6128 | 59.2040 | 32.3768 | 90.8955 | 26.9766 |
| 622 | 22711 | AA946072 | 71.5912 | 190.7472 | 42.9075 | 237.9935 | 40.0049 |
| 1050 | 22929 | AI071578 | 71.5855 | 475.6429 | 332.2278 | 785.2108 | 278.2014 |
| 1447 | 2936 | AI229843 | 71.5855 | 58.5906 | 29.7154 | 77.3066 | 23.4416 |
| 1553 | 15004 | AI235224 | 71.5116 | 639.3778 | 532.0518 | 267.6419 | 79.7785 |
| 547 | 5227 | AA925924 | 71.5070 | 195.6753 | 69.3480 | 141.6417 | 35.4440 |
| 958 | 5461 | AI044338 | 71.3910 | 169.5128 | 68.9620 | 108.3646 | 26.6276 |
| 2400 | 3050 | NM_053582 | 71.2307 | 167.4707 | 129.9994 | 74.5745 | 29.3413 |
| 594 | 22678 | AA944556 | 71.2171 | 240.9209 | 48.3079 | 298.3937 | 55.4801 |
| 1597 | 14840 | AI237698 | 71.1978 | 37.0784 | 27.3592 | 16.2933 | 9.1900 |
| 809 | 15644 | AI010256 | 71.1375 | 1368.0130 | 384.5849 | 1057.4513 | 169.6982 |
| 134 | 1754 | AA817837 | 71.1068 | 142.5430 | 38.2508 | 188.2707 | 40.8210 |
| 1408 | 15892 | AI1799881 | 71.0158 | 116.6990 | 87.7207 | 47.4806 | 32.2038 |
| 1218 | 21660 | AI169751 | 70.9396 | 2084.778 | 602.4824 | 1503.6722 | 418.3801 |
| 672 | 24171 | AA9578351 | 70.7100 | 74.3770 | 22.6059 | 97.4837 | 23.2611 |
| 161 | 13428 | AA8188611 | 70.6986 | 65.2547 | 20.1172 | 81.4399 | 19.7620 |
| 509 | 17644 | AA924036 | 70.6872 | 396.1171 | 99.4881 | 464.4665 | 78.7436 |
| 1339 | 21740 | AI176810 | 70.6690 | 366.4832 | 152.4895 | 260.6575 | 55.1897 |
| 579 | 22378 | AA944212 | 70.5542 | 232.3337 | 83.7080 | 281.5329 | 51.6681 |
| 1295 | 3982 | AI175100 | 70.4507 | 212.0096 | 64.0922 | 278.0007 | 64.0539 |
| 618 | 22697 | AA945996 | 70.4394 | 293.2071 | 178.9767 | 436.8873 | 143.0992 |
| 574 | 19220 | AA943740 | 70.4223 | 343.5755 | 79.9381 | 422.1556 | 68.5468 |
| 511 | 4909 | AA9240971 | 70.4177 | 137.6288 | 51.9239 | 192.98841 | 52.6384 |
| 1102 | 5969 | AI1025201 | 70.3939 | 524.5497 | 159.7548 | 408.35751 | 98.7308 |
| 1083 | 7868 | AI101229 | 70.3188 | 100.1702 | 31.4308 | 134.8450 | 36.8073 |
| 2071 | 16 | NM_0193861 | 70.1790 | 1542.4920 | 400.2563 | 1158.2518 | 239.3993 |
| 1370 | 17320 | AI178069 | 70.1460 | 238.4803 | 68.2936 | 178.0873 | 42.0592 |
| 2493 | 18820 | NM_080399 | 70.0152 | 306.1685 | 131.6133 | 416.2712 | 114.1028 |
| 5821 | 15596 | AA944353 | 69.9209 | 921.6366 | 213.7143 | 1113.8680 | 177.6359 |
| 4861 | 4730 | AA900326 | 69.9209 | 938.7402 | 250.0683 | 1105.9844 | 192.0489 |
| 8851 | 42531 | AI013566 | 69.8606 | 129.7892 | 40.9456 | 163.8501 | 34.9888 |
| 8581 | 3304 | AI0124711 | 69.8401 | 246.1395 | 57.3973 | 320.9397 | 79.5986 |
| 1094 | 11399 | AI1019241 | 69.8231 | 121.1745 | 49.4948 | 160.5642 | 48.4350 |
| 1294 | 2331 | AI175045 | 69.7207 | 777.1228 | 653.0431 | 317.3893 | 197.5116 |
| 1398 | 13029 | AI179391 | 69.6605 | 284.7117 | 151.2432 | 188.3711 | 57.9521 |
| 667 | 24051 | AA957452 | 69.6184 | 117.0387 | 31.0186 | 150.0066 | 31.1072 |
| 1231 | 18744 | AI170407 | 69.5945 | 135.8172 | 51.9894 | 105.7400 | 21.8866 |
| 1411 | 24028 | AI180239 | 69.5240 | 307.6217 | 97.8341 | 392.1102 | 89.7908 |
| 1141 | 11680 | AI104605 | 69.4967 | 199.3478 | 39.9329 | 226.2258 | 34.2756 |
| 1098 | 10227 | AI102248 | 69.4433 | 662.8956 | 151.4879 | 810.0097 | 170.5345 |
| 1540 | 14494 | AI234222 | 69.4353 | 196.4649 | 42.6964 | 232.1137 | 32.0114 |
| 528 | 20953 | AA924926 | 69.3035 | 722.8413 | 152.7183 | 865.5185 | 121.5070 |
| 230 | 5867 | AA858953 | 69.2921 | 149.7650 | 33.7458 | 122.5807 | 27.9332 |
| 1099 | 16596 | AI102486 | 69.2602 | 247.6911 | 77.9596 | 330.0640 | 78.3001 |
| 930 | 7760 | AI030806 | 69.2318 | 302.7767 | 73.0101 | 358.5221 | 59.4807 |
| 1149 | 2196 | AI105243 | 69.2204 | 369.0324 | 73.7154 | 314.7563 | 52.8844 |
| 543 | 4285 | AA925708 | 69.1932 | 257.5456 | 74.2533 | 312.0967 | 54.7004 |
| 2503 | 9633 | NM_130403 | 69.1932 | 82.8350 | 45.8355 | 112.2171 | 34.7979 |
| 22 | 21997 | AA799325 | 69.1886 | 265.5388 | 73.6475 | 343.0222 | 76.1280 |
| 1175 | 9166 | AI137406 | 69.1590 | 113.8603 | 69.0179 | 54.2985 | 30.5793 |
| 232 | 17361 | AA859114 | 69.1340 | 73.5384 | 29.8482 | 101.2109 | 29.2492 |
| 1151 | 15197 | AI105444 | 69.1272 | 257.4820 | 70.1225 | 321.7657 | 55.5452 |
| 1347 | 2852 | AI177059 | 69.1113 | 341.3036 | 143.6284 | 447.7942 | 126.2752 |
| 191 | 8619 | AA849317 | 69.1011 | 52.3146 | 29.2644 | 79.2878 | 29.7707 |
| 1034 | 8938 | AI070590 | 69.0897 | 41.6969 | 30.7637 | 78.2492 | 32.6247 |
| 1531 | 14095 | AI233468 | 68.9567 | 162.5993 | 39.5793 | 193.2475 | 35.8449 |
| 493 | 3822 | AA900863 | 68.9498 | 926.8186 | 312.3629 | 700.4526 | 155.8964 |
| 1573 | 22212 | AI236294 | 68.9191 | 48.6413 | 16.3801 | 34.9544 | 19.9834 |
| 1203 | 18473 | AI168975 | 68.8782 | 262.0640 | 95.1634 | 191.9001 | 58.3264 |
| 501 | 22898 | AA901107 | 68.8611 | 141.4675 | 90.2036 | 77.8919 | 32.2325 |
| 908 | 9317 | AI029174 | 68.8577 | 589.7563 | 156.9397 | 694.6903 | 135.0163 |
| 1429 | 89171 | AI228301 | 68.8520 | 134.8922 | 40.7874 | 174.6518 | 35.4760 |
| 563 | 221301 | AA943020 | 68.8475 | 180.4303 | 49.2285 | 222.9292 | 52.0793 |
| 710 | 3003 | AA997330 | 68.8282 | 3135.2772 | 102.8554 | 58.5761 | 44.5251 |
| 1565 | 14776 | AI235950 | 68.7918 | 3387.6523 | 82.4764 | 453.2932 | 75.4357 |
| 1164 | 6166 | AI136516 | 68.7690 | 250.6880 | 100.7962 | 336.0125 | 83.6622 |
| 506 | 4874 | AA923850 | 68.7361 | 109.2814 | 60.0379 | 152.9358 | 49.1098 |
| 1068 | 6548 | AI072658 | 68.7236 | 3307.2205 | 137.4010 | 199.8153 | 58.2425 |

TABLE 5KK-continued

General Core Tax Markers
Timepoint(s): All

| SEQ ID | GLGC ID | GenBank Accession No. | LDA Score | Mean Tox | SD Tox | Mean Nontox | SD Nontox |
|---|---|---|---|---|---|---|---|
| 1497 | 12435 | AI2318101 | 68.7202 | 192.5566 | 44.7331 | 237.4061 | 43.5750 |
| 1350 | 13310 | AI177119 | 68.6860 | 341.7250 | 99.9780 | 257.6428 | 73.8299 |
| 1343 | 16124 | AI176963 | 68.6792 | 324.6097 | 169.9924 | 212.2391 | 55.5821 |
| 125 | 10549 | 8012551 | 68.6735 | 40.2321 | 22.3612 | 23.7656 | 11.2454 |
| 1143 | 14464 | AI104848 | 68.6599 | 193.1297 | 53.5168 | 143.4925 | 53.6981 |
| 2385 | 15556 | NM_053483 | 68.6371 | 588.6597 | 170.6522 | 733.8417 | 143.5701 |
| 140 | 6550 | AA817947 | 68.6099 | 1375.4099 | 91.4847 | 469.2689 | 93.3862 |
| 717 | 3043 | AA997694 | 68.5928 | 112.5273 | 35.1563 | 143.1731 | 30.3926 |
| 1440 | 13826 | AI229304 | 68.5325 | 1219.1377 | 228.4679 | 1434.0857 | 217.1109 |
| 739 | 12664 | AA999110 | 68.5212 | 84.8834 | 36.9411 | 118.8635 | 29.6834 |
| 208 | 21766 | AA850916 | 68.5200 | 144.2476 | 48.3863 | 101.4527 | 28.6385 |
| 1369 | 19184 | AI178025 | 68.5189 | 45.0610 | 41.2248 | 14.0365 | 19.8994 |
| 167 | 5863 | AA819111 | 68.4939 | 264.4685 | 63.6224 | 311.1134 | 54.0255 |
| 1239 | 6982 | AI170793 | 68.4586 | 45.3718 | 58.1904 | 9.0022 | 11.6442 |
| 841 | 21796 | AI012221 | 68.4370 | 344.1850 | 140.6693 | 254.3082 | 68.7033 |
| 774 | 7785 | AI008758 | 68.4166 | 18.3555 | 25.9962 | 36.4874 | 21.6407 |
| 1301 | 24237 | AA817726 | 68.4041 | 321.6027 | 150.3749 | 212.4182 | 72.2063 |
| 6521 | 22899 | AA956555 | 68.3984 | 71.9333 | 49.5082 | 39.0086 | 26.1443 |
| 700 | 2803 | AA996451 | 68.3722 | 138.3072 | 54.9376 | 183.4522 | 45.2714 |
| 1548 | 14706 | AI234852 | 68.3438 | 50.6679 | 20.6625 | 36.6629 | 13.0915 |
| 2196 | 22626 | NM_024400 | 68.3427 | 155.7964 | 113.5131 | 78.9540 | 32.9215 |
| 539 | 23978 | AA925352 | 68.3279 | 152.6187 | 43.5701 | 171.1043 | 27.8711 |
| 1263 | 15449 | AI171799 | 68.3245 | 247.8878 | 62.7630 | 308.6923 | 71.0213 |
| 1289 | 11897 | AI172598 | 68.2904 | 33.8856 | 11.4193 | 40.8550 | 10.4420 |
| 2100 | 6263 | NM_022251 | 68.2358 | 172.3906 | 46.0848 | 211.6096 | 45.1407 |
| 1552 | 11246 | AI235222 | 68.2028 | 91.1100 | 26.1558 | 113.3934 | 27.4628 |
| 597 | 22081 | AA944818 | 68.2017 | 196.6991 | 49.8133 | 238.1235 | 42.4566 |
| 821 | 6946 | AI010642 | 68.1960 | 463.8221 | 106.1912 | 523.8894 | 92.4231 |
| 1253 | 16599 | AI171366 | 68.1630 | 481.9139 | 159.4526 | 608.6746 | 132.1457 |
| 223 | 15283 | AA858548 | 68.1459 | 350.7587 | 73.8419 | 296.6933 | 65.3340 |
| 899 | 7315 | AI028831 | 68.1448 | 34.1667 | 46.4857 | 6.3470 | 17.7598 |
| 1201 | 11346 | AI145991 | 68.1198 | 86.2982 | 59.0297 | 133.2276 | 58.5674 |
| 911 | 12819 | AI029437 | 68.1096 | 432.2876 | 85.9746 | 504.2326 | 92.5986 |
| 617 | 22692 | AA945986 | 68.0971 | 432.0026 | 111.8651 | 519.1002 | 100.0788 |
| 1302 | 18507 | AI175551 | 68.0686 | 631.2803 | 150.0123 | 485.8802 | 116.3449 |
| 1283 | 12117 | AI172352 | 68.0413 | 517.5391 | 142.7068 | 610.0512 | 111.6380 |
| 186 | 14654 | AA848795 | 67.9811 | 247.5209 | 89.6507 | 300.3160 | 70.1127 |
| 1393 | 11242 | AI179260 | 67.9743 | 60.8831 | 36.0013 | 36.1544 | 16.9937 |
| 1262 | 11696 | AI171774 | 67.9595 | 112.8963 | 44.9690 | 145.3375 | 40.0203 |
| 979 | 16752 | AI045475 | 67.9492 | 73.7208 | 50.4746 | 115.6206 | 50.0369 |
| 729 | 16533 | AA998174 | 67.9356 | 384.8170 | 134.7857 | 291.2660 | 70.3944 |
| 520 | 18251 | AA924548 | 67.9197 | 86.9313 | 23.1752 | 70.5075 | 16.0715 |
| 875 | 6758 | AI013394 | 67.8810 | 23.2318 | 13.6344 | 14.358 | 99.5633 |
| 205 | 5668 | AA850743 | 67.8765 | 61.2483 | 34.8436 | 86.7686 | 31.1453 |
| 503 | 4861 | AA901290 | 67.8321 | 140.7460 | 51.4468 | 180.7381 | 41.4675 |
| 1267 | 6645 | AI171998 | 67.8230 | 126.1081 | 28.5670 | 149.3772 | 32.0343 |
| 1155 | 2539 | AI111960 | 67.8196 | 49.7049 | 46.1090 | 15.8238 | 22.4139 |
| 1193 | 18206 | AI145282 | 67.8105 | 259.8077 | 52.0249 | 213.7398 | 49.5328 |
| 607 | 22615 | AA945643 | 67.7969 | 129.6028 | 185.4675 | 34.7554 | 33.0666 |
| 686 | 2373 | AA964455 | 67.7832 | 315.5731 | 87.4847 | 397.0314 | 82.1406 |
| 187 | 7749 | AA848804 | 67.7764 | 1258.3134 | 278.6021 | 1117.5030 | 188.5951 |
| 1278 | 1287 | AI172299 | 67.7446 | 522.6697 | 143.8574 | 637.2558 | 128.8985 |
| 1523 | 4855 | AI233024 | 67.7002 | 54.6195 | 21.2220 | 71.0632 | 20.0774 |
| 790 | 4154 | AI009467 | 67.6934 | 261.8141 | 94.0689 | 204.3082 | 51.8082 |
| 2101 | 6585 | NM_022266 | 67.6650 | 1146.6529 | 693.6719 | 647.8214 | 276.3213 |
| 661 | 23963 | AA957139 | 67.6604 | 75.4752 | 34.4528 | 55.7581 | 29.7259 |
| 1320 | 22765 | AI176265 | 67.6593 | 48.4804 | 47.6731 | 18.4176 | 11.5782 |
| 1315 | 6686 | AI176130 | 67.6457 | 283.0167 | 56.5288 | 346.3295 | 55.6461 |
| 1326 | 3014 | AI176362 | 67.6445 | 209.8156 | 101.6757 | 259.7456 | 64.8388 |
| 915 | 10650 | AI029942 | 67.6411 | 605.0163 | 199.5154 | 772.0382 | 226.1347 |
| 815 | 17524 | AI010568 | 67.6343 | 1027.3541 | 226.9904 | 1192.6757 | 194.6795 |
| 765 | 4052 | AI008095 | 67.5570 | 395.4532 | 97.6496 | 468.9675 | 87.9716 |
| 991 | 8012 | AI058330 | 67.5558 | 40.1688 | 16.7176 | 27.3498 | 11.2761 |
| 2127 | 4145 | NM_022518 | 67.5354 | 1500.2723 | 281.6434 | 1281.0845 | 292.0936 |
| 1580 | 17950 | AI236590 | 67.5331 | 61.5713 | 28.9890 | 38.8838 | 14.8504 |
| 846 | 1752 | AI012208 | 67.5069 | 1644.3102 | 418.3417 | 1893.5383 | 325.1941 |
| 828 | 1424 | AI010936 | 67.5035 | 474.7738 | 132.33241 | 609.3307 | 161.0273 |

TABLE 5LL

VASCULATURE AGENTS

| SEQ ID | GLGC ID | GenBank Accession No. | LDA Score | Mean Tox | SD Tox | Mean Nontox | SD Nontox |
|---|---|---|---|---|---|---|---|
| 1797 | 18135 | NM_012791 | 85.1153 | 109.7176 | 9.3893 | 139.7580 | 28.6916 |
| 2054 | 10015 | NM_019289 | 84.4864 | 307.2109 | 43.9781 | 216.8248 | 63.9197 |
| 112 | 19101 | AA800787 | 81.7610 | 150.7254 | 26.2971 | 204.9365 | 48.1947 |
| 2073 | 574 | NM_019905 | 81.6038 | 868.6018 | 163.9421 | 601.0181 | 155.2758 |
| 2176 | 24623 | NM_0241461 | 81.4990 | 150.4577 | 33.4726 | 102.4795 | 32.5100 |
| 2054 | 10016 | NM_019289 | 81.4990 | 255.3307 | 40.9017 | 201.4507 | 62.8547 |
| 88 | 11352 | AA800036 | 81.07972 | 38.0028 | 23.7105 | 302.5550 | 63.5805 |
| 2337 | 8386 | NM_031836 | 80.7128 | 191.6506 | 49.3239 | 319.8779 | 112.2708 |
| 255 | 22739 | AA859877 | 80.6604 | 288.6301 | 32.0748 | 361.3413 | 61.5743 |
| 455 | 123731 | AA894004 | 80.5031 | 208.2056 | 35.9154 | 159.3211 | 45.0584 |
| 1973 | 1510 | NM_017224 | 80.1363 | 10.4589 | 25.8256 | 47.1716 | 33.7011 |
| 2569 | 18108 | NM_139105 | 79.9266 | 186.5162 | 19.2195 | 157.6083 | 24.1957 |
| 2050 | 21443 | NM_019262 | 79.4549 | 278.9396 | 65.4947 | 205.5944 | 75.5048 |
| 2259 | 15185 | NM_031140 | 79.2977 | 1191.3623 | 205.4639 | 927.9137 | 185.0006 |
| 2406 | 21709 | NM_053596 | 79.0881 | 379.8018 | 93.7882 | 251.8914 | 56.1212 |
| 320 | 15629 | AA875629 | 79.0356 | 35.2703 | 17.2408 | 60.6819 | 30.0155 |
| 376 | 20917 | AA892238 | 78.5115 | 92.9927 | 17.2303 | 127.6081 | 31.1693 |
| 2527 | 18043 | NM_133546 | 78.4591 | 95.0253 | 23.7170 | 62.4319 | 21.3725 |
| 2340 | 25802 | NM_031969 | 78.3019 | 827.0513 | 147.1717 | 597.0436 | 152.1345 |
| 76 | 11423 | AA799812 | 78.1447 | 137.3237 | 37.3896 | 204.2398 | 66.5344 |
| 1619 | 15379 | AI639162 | 78.1447 | 68.1402 | 20.2105 | 109.5535 | 36.7328 |
| 1818 | 7196 | NM_012904 | 78.0398 | 218.5551 | 37.3309 | 169.1407 | 42.7482 |
| 1896 | 20856 | NM_013200 | 77.9350 | 920.0494 | 90.0732 | 1098.4819 | 186.9935 |
| 1680 | 10185 | H33426 | 77.6730 | 16.8177 | 9.9618 | 31.4369 | 10.3328 |
| 1604 | 17108 | AI639017 | 77.5681 | 108.6139 | 26.7864 | 137.8878 | 27.1458 |
| 2136 | 8597 | NM_022538 | 77.5681 | 196.5452 | 33.9961 | 158.3220 | 41.6170 |
| 2221 | 15886 | NM_031035 | 77.3585 | 473.4446 | 52.3190 | 404.9769 | 96.7858 |
| 2016 | 20778 | NM_019124 | 77.3061 | 52.1464 | 7.7314 | 62.5674 | 13.1215 |
| 245 | 11635 | AA859645 | 77.1488 | 105.4547 | 29.3018 | 135.9076 | 28.7605 |
| 439 | 2689 | AA893515 | 76.8868 | 155.2587 | 17.7492 | 180.5665 | 32.8832 |
| 1738 | 15741 | NM_012520 | 76.7296 | 213.3656 | 39.0040 | 294.8905 | 82.3313 |
| 1994 | 12347 | NM_017290 | 76.5199 | 80.9177 | 15.4050 | 105.6893 | 37.4992 |
| 2625 | 1283 | U617291 | 76.5199 | 67.8683 | 22.4825 | 110.9277 | 40.2613 |
| 2285 | 692 | NM_0315571 | 76.5199 | 184.3874 | 42.8530 | 136.3400 | 35.4832 |
| 2587 | 20740 | NM_145878 | 76.4675 | 767.3149 | 291.8238 | 445.5906 | 133.9981 |
| 345 | 11387 | AA891677 | 76.2579 | 38.4384 | 13.7943 | 60.3757 | 18.4692 |
| 2092 | 243 | NM_021989 | 76.2055 | 773.9058 | 141.3403 | 619.1436 | 112.2056 |
| 1735 | 1745 | NM_012513 | 76.2055 | 15.3793 | 7.6469 | 28.1031 | 13.7895 |
| 1328 | 17920 | AI176422 | 76.1006 | 1159.4769 | 22.2002 | 194.6245 | 58.2811 |
| 2337 | 8384 | NM_031836 | 76.1006 | 51.3825 | 14.2583 | 97.5901 | 53.4359 |
| 1930 | 18957 | NM_017075 | 75.9958 | 757.8179 | 109.3794 | 915.5492 | 163.8856 |
| 2667 | 13646 | X621661 | 75.8910 | 676.2628 | 111.7638 | 577.1817 | 157.9653 |
| 2451 | 15706 | NM_053921 | 75.7862 | 24.5906 | 7.0316 | 36.7932 | 11.9603 |
| 1926 | 1942 | NM_017061 | 75.7338 | 101.1933 | 43.7219 | 44.5242 | 32.3307 |
| 2606 | 24469 | S77858 | 75.7338 | 948.2668 | 237.3070 | 819.7597 | 143.6278 |
| 2354 | 21102 | NM_033021 | 75.7338 | 141.3676 | 41.2766 | 100.6470 | 36.9067 |
| 2097 | 20249 | NM_022205 | 75.6813 | 30.2006 | 20.4935 | 56.9048 | 124.6832 |
| 2525 | 1791 | NM_133541 | 75.6289 | 101.6522 | 14.2226 | 124.6235 | 26.7114 |
| 34 | 11350 | AA799488 | 75.3145 | 34.4875 | 12.3894 | 63.9145 | 29.9663 |
| 746 | 3799 | AF002281 | 75.2621 | 523.5803 | 197.0155 | 380.1915 | 112.2063 |
| 265 | 13974 | AA860030 | 75.2096 | 651.4240 | 118.8780 | 537.7303 | 145.4884 |
| 431 | 20986 | AA893242 | 75.0524 | 82.5788 | 26.3473 | 143.8036 | 78.5875 |
| 287 | 16177 | AA874952 | 75.0000 | 37.5857 | 5.9390 | 47.1518 | 13.6200 |
| 364 | 4472 | AA891962 | 74.9476 | 11.5361 | 5.2972 | 24.1656 | 30.6138 |
| 2119 | 8212 | NM_022500 | 74.7904 | 547.3333 | 71.3061 | 493.9779 | 132.4742 |
| 1946 | 167 | NM_017131 | 74.7904 | 450.3721 | 84.3374 | 587.7048 | 176.1635 |
| 2136 | 8596 | NM_022538 | 74.7904 | 208.7893 | 33.4042 | 156.1137 | 53.9278 |
| 2053 | 8200 | NM_019285 | 74.7379 | 45.1388 | 16.6701 | 32.1794 | 17.4461 |
| 28 | 2882 | AA799423 | 74.7379 | 464.8075 | 63.9311 | 567.8139 | 134.1016 |
| 1815 | 16871 | NM_012887 | 74.6855 | 57.6114 | 18.2495 | 83.2232 | 23.9593 |
| 2040 | 15347 | NM_019222 | 74.5807 | 107.5588 | 32.5574 | 81.7974 | 33.7852 |
| 1883 | 1310 | NM_013159 | 74.5807 | 124.4094 | 25.2817 | 150.5538 | 31.4220 |
| 2477 | 15125 | NM_057105 | 74.5283 | 77.9493 | 21.7589 | 58.5298 | 19.7972 |
| 1704 | 17086 | M13011 | 74.4759 | 258.0716 | 40.7148 | 207.6230 | 48.5107 |
| 1937 | 2150 | NM_017097 | 74.4235 | 124.7298 | 33.6883 | 153.2660 | 33.2243 |
| 1668 | 20984 | D90109 | 74.4235 | 512.0872 | 89.2280 | 660.8973 | 153.9719 |
| 1642 | 5998 | AI639501 | 74.3711 | 80.2265 | 25.9044 | 108.2507 | 32.3720 |
| 2351 | 21809 | NM_032067 | 74.3711 | 47.6884 | 8.9429 | 61.3223 | 17.2978 |
| 2661 | 25710 | X59864 | 74.2138 | 120.7997 | 70.3191 | 66.2559 | 70.0479 |
| 2034 | 21421 | NM_019196 | 74.2138 | 36.1153 | 11.6675 | 47.8754 | 14.3422 |
| 2608 | 25547 | S78556 | 74.1614 | 233.1962 | 107.9455 | 357.9659 | 128.6390 |
| 1934 | 1383 | NM_017088 | 74.1614 | 147.4641 | 19.1658 | 162.2522 | 44.1481 |
| 2201 | 349 | NM_030586 | 74.1090 | 149.7719 | 18.5362 | 177.6972 | 36.2009 |
| 764 | 15849 | AI008074 | 74.0566 | 171.2254 | 58.8615 | 275.9202 | 143.2404 |

TABLE 5LL-continued

VASCULATURE AGENTS

| SEQ ID | GLGC ID | GenBank Accession No. | LDA Score | Mean Tox | SD Tox | Mean Nontox | SD Nontox |
|---|---|---|---|---|---|---|---|
| 2163 | 15697 | NM_022939 | 74.0566 | 91.9489 | 11.0971 | 78.8023 | 25.1081 |
| 1686 | 17159 | J00797 | 74.0566 | 1323.5028 | 203.4722 | 1015.7870 | 243.5127 |
| 37 | 17612 | AA799511 | 73.79451 | 36.9738 | 29.7617 | 184.9652 | 54.2385 |
| 2010 | 24428 | NM_017356 | 73.7421 | 103.1922 | 25.2810 | 79.8971 | 19.9430 |
| 1875 | 21840 | NM_013128 | 73.7421 | 427.7531 | 74.4946 | 526.4060 | 123.2075 |
| 3121 | 15510 | AA875428 | 73.7421 | 231.8466 | 44.2767 | 281.7326 | 54.4460 |
| 891 | 19177 | AA800062 | 73.6897 | 64.8991 | 24.4287 | 89.0352 | 27.9706 |
| 1951 | 24107 | NM_017141 | 73.6373 | 97.4100 | 40.5221 | 110.0648 | 28.1940 |
| 2623 | 14554 | U48828 | 73.5849 | 75.4516 | 13.1010 | 100.9108 | 27.6784 |
| 2421 | 25379 | NM_053713 | 73.5325 | 265.7183 | 60.6464 | 189.6822 | 49.0552 |
| 2301 | 15767 | NM_031623 | 73.5325 | 173.4103 | 26.5105 | 214.5572 | 52.0656 |
| 431 | 20985 | AA893242 | 73.4801 | 86.3309 | 136.4701 | 95.2842 | 22.7042 |
| 2432 | 25594 | NM_053799 | 73.4277 | 309.3353 | 59.2185 | 377.8568 | 64.1453 |
| 2546 | 19894 | NM_138518 | 73.4277 | 310.4214 | 135.1212 | 188.4120 | 63.2929 |
| 1607 | 10071 | AI639058 | 73.3753 | 395.4896 | 137.1970 | 263.7735 | 107.1199 |
| 1809 | 13151 | NM_012862 | 73.3753 | 2714.7755 | 598.6401 | 2181.2875 | 567.1612 |
| 46 | 17212 | AA799571 | 73.3753 | 107.5611 | 17.5468 | 132.2912 | 35.3210 |
| 58 | 20092 | AA799637 | 73.3229 | 20.8556 | 6.3050 | 34.3316 | 18.0096 |
| 2586 | 20515 | NM_145784 | 73.2704 | 84.0794 | 12.1683 | 101.9885 | 22.0912 |
| 52 | 13926 | AA799601 | 73.2704 | 37.5504 | 8.4762 | 48.6142 | 12.4977 |
| 1737 | 25365 | NM_012519 | 73.1656 | 26.6963 | 9.5167 | 47.8513 | 34.0213 |
| 1616 | 5065 | AI639139 | 73.1656 | 35.7989 | 9.9797 | 47.9983 | 13.0662 |
| 2059 | 16330 | NM_019331 | 73.1132 | 203.4242 | 27.4716 | 172.4242 | 33.3735 |
| 2237 | 23854 | NM_031101 | 73.0608 | 846.9536 | 120.8130 | 708.7908 | 174.9077 |
| 2362 | 24420 | NM_033539 | 73.0084 | 1707.2664 | 471.1667 | 1500.5725 | 304.1412 |
| 2033 | 15244 | NM_019191 | 73.0084 | 15.81281 | 4.8813 | 23.6694 | 9.2592 |
| 722 | 2757 | AA997851 | 90.4612 | 1394.3556 | 259.9027 | 804.5697 | 235.2406 |
| 1068 | 6548 | AI072658 | 86.5828 | 482.3749 | 176.7265 | 210.7078 | 73.1549 |
| 672 | 24171 | AA957835 | 85.9539 | 55.8309 | 14.5413 | 93.8863 | 25.5174 |
| 697 | 17232 | AA965161 | 85.0105 | 1029.6436 | 282.6006 | 618.4952 | 216.5173 |
| 936 | 7846 | AI031059 | 83.4382 | 10.8661 | 25.0190 | 45.1187 | 20.7384 |
| 147 | 6037 | AA818288 | 82.9665 | 57.6997 | 16.1603 | 80.4229 | 18.0692 |
| 2421 | 13622 | NM_053713 | 82.9665 | 379.5139 | 76.6283 | 251.7745 | 93.4256 |
| 1481 | 21816 | AI231217 | 82.9140 | 325.1390 | 68.8148 | 239.4026 | 60.7244 |
| 794 | 4168 | AI009654 | 82.7568 | 74.0096 | 24.8449 | 110.7782 | 22.4086 |
| 515 | 22914 | AA924335 | 82.6520 | 1799.6522 | 315.7989 | 2446.7836 | 478.9589 |
| 1418 | 13664 | AI227639 | 82.0755 | 68.2059 | 8.9533 | 69.0762 | 35.2244 |
| 539 | 23978 | AA925352 | 81.4990 | 124.2453 | 24.0576 | 167.6789 | 33.1815 |
| 1075 | 9454 | AI072992 | 81.2893 | 26.4989 | 33.4200 | 40.8179 | 23.9389 |
| 1461 | 22484 | AI230591 | 80.9224 | 74.5881 | 19.8437 | 49.1110 | 19.6706 |
| 1326 | 3014 | AI176362 | 80.9224 | 154.3853 | 48.4023 | 250.2939 | 75.1165 |
| 829 | 13296 | AI011020 | 80.9224 | 120.8284 | 40.0001 | 198.2065 | 56.0612 |
| 810 | 6897 | AI010275 | 79.9790 | 170.1049 | 32.0611 | 232.1324 | 59.2158 |
| 155 | 4330 | AA818747 | 79.8742 | 806.9655 | 381.4427 | 449.5732 | 123.3802 |
| 566 | 23822 | AA943114 | 79.8742 | 133.8473 | 112.7870 | 319.2932 | 145.2744 |
| 1420 | 23015 | AI227724 | 79.7170 | 123.1848 | 48.7067 | 77.3003 | 20.7720 |
| 2540 | 19840 | NM_134353 | 79.7170 | 1671.9778 | 299.7040 | 1348.2181 | 316.5176 |
| 560 | 17003 | AA942930 | 79.5597 | 92.5409 | 49.1633 | 101.8845 | 29.1822 |
| 1427 | 12946 | AI228291 | 79.4025 | 155.2430 | 34.5710 | 219.6471 | 41.7648 |
| 2126 | 3904 | NM_022516 | 79.3501 | 232.2479 | 56.7419 | 134.3438 | 93.9374 |
| 726 | 3332 | AA998006 | 78.8784 | 382.2983 | 62.5836 | 304.7896 | 65.9419 |
| 1077 | 9485 | AI073109 | 78.6164 | 55.9292 | 45.7132 | 54.4030 | 25.9155 |
| 684 | 2321 | AA964265 | 78.6164 | 78.8396 | 29.11361 | 61.0074 | 17.6434 |
| 1158 | 14434 | AI112291 | 78.3543 | 54.1851 | 10.2485 | 72.9447 | 25.9951 |
| 1163 | 23428 | AI113320 | 78.1971 | 715.2545 | 140.8607 | 516.5359 | 137.3348 |
| 865 | 20924 | AI012832 | 78.1447 | 410.4444 | 95.4891 | 560.8658 | 145.6595 |
| 474 | 20038 | AA899797 | 78.1447 | 147.3998 | 30.8322 | 199.9446 | 50.9599 |
| 821 | 6946 | AI010642 | 77.9874 | 381.3689 | 98.9321 | 512.4703 | 102.1374 |
| 832 | 24022 | AI011474 | 77.9874 | 75.2621 | 19.1818 | 102.1569 | 27.0579 |
| 1514 | 6509 | AI232361 | 77.8826 | 130.4987 | 24.7422 | −0.6097 | 30.3192 |
| 862 | 6489 | AI012636 | 77.8826 | 1190.7523 | 40.0632 | 256.2544 | 52.0426 |
| 718 | 3250 | AA997765 | 77.7254 | 670.2989 | 218.5471 | 434.6725 | 153.5243 |
| 533 | 17363 | AA925150 | 77.6730 | 431.3331 | 42.8836 | 527.6242 | 94.1476 |
| 522 | 24310 | AA924578 | 77.6205 | 426.9662 | 135.6242 | 306.1028 | 92.5617 |
| 978 | 5795 | AI045441 | 77.5681 | 415.6309 | 137.6263 | 548.9514 | 130.9881 |
| 143 | 16756 | AA818089 | 77.4109 | 170.4001 | 34.0036 | 135.6609 | 30.9771 |
| 1497 | 12435 | AI231810 | 77.3585 | 163.8264 | 43.3651 | 230.6378 | 47.8400 |
| 126 | 12399 | AA801307 | 77.3061 | 205.5457 | 48.7213 | 144.4195 | 39.4832 |
| 1203 | 18473 | AI168975 | 77.2537 | 321.1359 | 96.9679 | 202.9609 | 69.2027 |
| 909 | 12662 | AI029179 | 76.9916 | 54.9449 | 27.1251 | 85.9728 | 31.3064 |
| 150 | 6226 | AA818521 | 76.8868 | 248.0906 | 60.6504 | 172.4560 | 54.6165 |
| 1327 | 19006 | AI176393 | 76.8344 | 1498.6855 | 335.8005 | 1055.0046 | 326.8376 |
| 1516 | 3143 | AI232408 | 76.8344 | 258.8920 | 63.6545 | 323.6245 | 81.6914 |
| 1295 | 3982 | AI175100 | 76.8344 | 177.5016 | 56.3794 | 268.5876 | 71.5952 |

TABLE 5LL-continued

VASCULATURE AGENTS

| SEQ ID | GLGC ID | GenBank Accession No. | LDA Score | Mean Tox | SD Tox | Mean Nontox | SD Nontox |
|---|---|---|---|---|---|---|---|
| 544 | 5206 | AA925755 | 76.7820 | 93.5909 | 65.7977 | 111.3791 | 39.7002 |
| 1463 | 18529 | AI230716 | 76.6771 | 408.7730 | 80.3108 | 289.0741 | 76.2198 |
| 1563 | 4770 | AI235915 | 76.6771 | 231.7275 | 47.6269 | 171.2552 | 44.3775 |
| 2340 | 19195 | NM_031969 | 76.4675 | 2261.7617 | 542.8825 | 1640.1981 | 380.3353 |
| 1417 | 7117 | AI227612 | 76.4675 | 112.8620 | 21.9993 | 142.7610 | 28.4806 |
| 478 | 21639 | AA899911 | 76.4151 | 608.7199 | 92.4545 | 519.8072 | 103.6568 |
| 1571 | 14884 | AI236212 | 76.2055 | 50.1086 | 17.2257 | 74.0682 | 26.0532 |
| 2102 | 13758 | NM_022289 | 76.1530 | 30.3706 | 11.4064 | 44.7867 | 12.0964 |
| 199 | 11355 | AA849957 | 76.1006 | 102.1580 | 76.3592 | 110.7182 | 42.9662 |
| 1194 | 5732 | AI145362 | 75.9958 | 123.6594 | 33.4845 | 153.8469 | 30.0792 |
| 1952 | 15365 | NM_017147 | 75.8910 | 1198.6604 | 348.4301 | 1027.8836 | 213.4106 |

TABLE 6

Toxin Administration and Animal Sacrifice Shedules

| Toxin and Group | Treatment and Compound | Dose Level (mg/kg) | Conc. (mg/ml) | No. of Males | Sacrifice |
|---|---|---|---|---|---|
| Adriamycin (Doxorubicin HCl) | 1 Intravenous Injection on Day 1 | | | | |
| 1 | Saline | 0 | 0 | 5 | 6 hours post-dose |
| 2 | Doxorubicin HCl | 1.3 | 0.64 | 5 | 6 hours post-dose |
| 3 | Doxorubicin HCl | 12.8 | 6.4 | 5 | 6 hours post-dose |
| 4 | Saline | 0 | 0 | 5 | 24 hours post-dose |
| 5 | Doxorubicin HCl | 1.3 | 0.64 | 5 | 24 hours post-dose |
| 6 | Doxorubicin HCl | 12.8 | 6.4 | 5 | 24 hours post-dose |
| 7 | Saline | 0 | 0 | 5 | Day 6 |
| 8 | Doxorubicin HCl | 1.3 | 0.64 | 5 | Day 6 |
| 9 | Doxorubicin HCl | 12.8 | 6.4 | 5 | Day 6 |
| 10 | Saline | 0 | 0 | 5 | Day 8 |
| 11 | Doxorubicin HCl | 1.3 | 0.64 | 5 | Day 8 |
| 12 | Doxorubicin HCl | 12.8 | 6.4 | 5 | Day 8 |
| Amphotericin B | Intravenous Bolus on Day 1 | | | | |
| 1 | Saline | 0 | 0 | 5 | 3 hrs post-dose |
| 2 | Amphotericin B | 0.25 | 0.125 | 5 | 3 hrs post-dose |
| 3 | Amphotericin B | 2.5 | 1.25 | 7 | 3 hrs post-dose |
| 4 | Saline | 0 | 0 | 5 | 6 hrs post-dose |
| 5 | Amphotericin B | 0.25 | 0.125 | 5 | 6 hrs post-dose |
| 6 | Amphotericin B | 2.5 | 1.25 | 7 | 6 hrs post-dose |
| 7 | Saline | 0 | 0 | 5 | 24 hrs post-dose |
| 8 | Amphotericin B | 0.25 | 0.125 | 5 | 24 hrs post-dose |
| 9 | Amphotericin B | 2.5 | 1.25 | 7 | 24 hrs post-dose |
| Epirubicin | Intravenous Injection on Day 1 | | | | |
| 1 | Saline | 0 | 0 | 5 | 6 hours post-dose |
| 2 | Epirubicin | 1.2 | 0.6 | 5 | 6 hours post-dose |
| 3 | Epirubicin | 12 | 6 | 5 | 6 hours post-dose |
| 4 | Saline | 0 | 0 | 5 | 24 hours post-dose |
| 5 | Epirubicin | 1.2 | 0.6 | 5 | 24 hours post-dose |
| 6 | Epirubicin | 12 | 6 | 5 | 24 hours post-dose |
| 7 | Saline | 0 | 0 | 5 | Day 6 |
| 8 | Epirubicin | 1.2 | 0.6 | 5 | Day 6 |
| 9 | Epirubicin | 12 | 6 | 5 | Day 6 |
| 10 | Saline | 0 | 0 | 5 | Day 8 |
| 11 | Epirubicin | 1.2 | 0.6 | 5 | Day 8 |
| 12 | Epirubicin | 12 | 6 | 5 | Day 8 |
| Phenylpropanolamine | Intrapeitoneal Injection on Day 1 | | | | |
| 1 | Saline | 0 | 0 | 5 | 3 hrs post-dose |
| 2 | Phenylpropanolamine | 8 | 0.8 | 5 | 3 hrs post-dose |
| 3 | Phenylpropanolamine | 80 | 8 | 5 | 3 hrs post-dose |
| 4 | Saline | 0 | 0 | 5 | 6 hrs post-dose |
| 5 | Phenylpropanolamine | 8 | 0.8 | 5 | 6 hrs post-dose |
| 6 | Phenylpropanolamine | 80 | 8 | 5 | 6 hrs post-dose |

TABLE 6-continued

Toxin Administration and Animal Sacrifice Shedules

| Toxin and Group | Treatment and Compound | Dose Level (mg/kg) | Conc. (mg/ml) | No. of Males | Sacrifice |
|---|---|---|---|---|---|
| 7 | Saline | 0 | 0 | 5 | 24 hrs post-dose |
| 8 | Phenylpropanolamine | 8 | 0.8 | 5 | 24 hrs post-dose |
| 9 | Phenylpropanolamine | 80 | 8 | 5 | 24 hrs post-dose |
| Rosiglitazone | 5 Daily Doses of Oral Gavage | | | | |
| 1 | 1% methylcellulose | 0 | 0 | 5 | 6 hours post-dose |
| 2 | Rosiglitazone | 18 | 1.8 | 5 | 6 hours post-dose |
| 3 | Rosiglitazone | 180 | 18 | 5 | 6 hours post-dose |
| 4 | 1% methylcellulose | 0 | 0 | 5 | 24 hours post-dose |
| 5 | Rosiglitazone | 18 | 1.8 | 5 | 24 hours post-dose |
| 6 | Rosiglitazone | 180 | 18 | 5 | 24 hours post-dose |
| 7 | 1% methylcellulose | 0 | 0 | 5 | Day 8 |
| 8 | Rosiglitazone | 18 | 1.8 | 5 | Day 8 |
| 9 | Rosiglitazone | 180 | 18 | 5 | Day 8 |
| 10 | 1% methylcellulose | 0 | 0 | 5 | Day 15 |
| 11 | Rosiglitazone | 18 | 1.8 | 5 | Day 15 |
| 12 | Rosiglitazone | 180 | 18 | 5 | Day 15 |

SEQUENCE LISTING (2696 sequences)

SEQ ID NO: 1 - DNA, 496 bp, Rattus norvegicus
  Genbank Accession No. AA850922
ggaaacagacacggtgctctttatttgcattgttcaaaatactgtacaaagggagtaaaaatcctattcacactttgcttaaaaagaccagaaggtgaaagttccctatgatacatggggttcaaaaggagggtcaaggggaaatgtttggggaaaaaaccctaaaaaggtgggttaacccataaatataattagggatacaattattagggctcaagttcgtccttttggggtgtggattaacattatttgtttgatgataagtttgattagtcagtgttgaaatgagtgtagtcggttgctgattaggcgttctgatgatgggaatagaattgatgggaacataataatggtcacaacaattggtagacctattattgtgggggtaatgaaagaggcaaatagattttcgttcattttgattctcaagggttattccttttttctgtggctaaagttttgggtgagggaagtgcaagaaaggtttgggaagaaa

SEQ ID NO: 2 - DNA, 450 bp, Rattus norvegicus
  Genbank Accession No. AA875531
tctttttttttttttttctttttggaaaaccaaacatgctttattttattcttcacaatttatttaaacatctcacaggacacaataggtacaattcaattttttttctgcttgtccaagaaacaggacttcttcggaaccacggggaggaacgaaaatgaggctggcaaagaaacgaatgctgaatctagagaggagagaatctggggcaagtgttcttcattcctttagttggggataaggtgaacgagagggccgctaagtcaaattaagaatcccactcactgcacatcactatggaggatcgagtcttctgtaattcttctagctccatccacattctcctagtaggtctgggaagaatagtactagggttattaggaataatagtaatataaatacacctaggaggtctttaattgtataatatggatggaatgggattttgtc

SEQ ID NO: 3 - DNA, 720 bp, Rattus norvegicus
  Genbank Accession No. AA945152
aggatcctcatcaatagatagaaacgtataggaatagtcaaactacatctacgaagtgtcagtatcatgctgcggcttcaaatccgaaatgatgttttgatgtgaagtggaattttagttgtcgtagtagacagacaattaggaaagttgagccaataattacgtggaggccatgaaatcccgttgctatgaagaatgttgagccgtaaattccgtctgagatagaaaatgatgtttcgaaatactctgaggcttgtaagatcgtgaaatataatcctaagagaatggtgattagtagggcttggtttatatggtttcggttgccttctattaggctgtgatgggctcatgtaattgagactcctgatgctaagaggactgatgtatttagaaggggtacttctaggggatttaaaggggtaattcctgttgggggtcagcaaccgcctaggtcgtgggtaggaactaggctggaatgataaaatgctcagaaaaatccggcaaagaagaatacttcggagacaataaacaggattattccgtatcggaggcctttttgtacaataggggtgtggtggccttggtatgttccttcacggatgatatctcgtcatcattgatatatagttaggatgtttgtcaggaggcctaatgataggagaattgtggagttgtaatggaatcatattactaagccggatgtgagtagaagagctgata

SEQ ID NO: 4 - DNA, 569 bp, Rattus norvegicus
  Genbank Accession No. AI007824
cctcactatagggaataagcttgcggacgctaaagttttttttttttttttttttttttttttttagtattactttgacttgtgagtctaggttaaaatcattcggaggattttttattctccgaggtcaccccaaccgaaattttttagttcatatttattttgttttagcccattaggttgtttttatataagttgaactagtaaattgaagctccatagggtcttctcgtcttattgggagattccagcctcttcactggaaggtcaatttcactgattgaaagtaagagacagttgaaccctcgtttagccattcattctagtccctaattaaggaacaagtgattatgctacctttgcacggtcaggataccgcggccgtttaactttagtcactgggcaggcaatgcctctaatacttgttatgctagaggtgatgtttttggtaaacaggcggggttcgtgtttgccgagttccttttactttttttaatctttccttaaagcacgcctgtgttgggctaacgagttagggataagtaattttattgttgggttagtaccta

SEQ ID NO: 5 - DNA, 196 bp, Rattus norvegicus
  Genbank Accession No. AI011177
aaccctcactaaagggaataagcttgcggccgctcacttttttttttttttttttgttttagggctttttatggagttggtagtgttctacttgtttagtttgaataataaggtggagttagttgattttgatagtctaggcgattgattaatgtatgagattgatgatgttggggttatgttggagggggggatt

SEQ ID NO: 6 - DNA, 410 bp, Rattus norvegicus
  Genbank Accession No. AI014135
agaacaacaaatcaaaatgtaaacttaaaatataaccaaaagagggacagctctttaggaaaaggaaaaaaccttaaatagtgaataaacaactacaaccacttaaccattgtaggcttaaaagcagccatcaataaagaaagcgttcaagctcaacatacatacttacacacactaattccacaaacctcaataaattcctatattacaaattgggctaatctatagacccatagatgaaatactgttaatatgagtaacaagaaccaattctcctagcacaagtgtatgacaacccggataaccattgtcaattatcgaatcataggtactaacccaacaataaaattacctatccctaactcgttagcccaacacaggcgtgctttaaggaaagattaacaaaaaaa

SEQ ID NO: 7 - DNA, 443 bp, Rattus norvegicus
  Genbank Accession No. AI103396
attaatttcattttaacattttgtcttcaacaattccagagattggtatgagaatgaggataattgaaaagtagctgatggaggctagttggccaataatgataaatgggtgttctactggttggcctccgattcatgttaagactaggaggttggctactaggattcagtaaaggatttgggtgattgggcggaatgttaagctgcgttgttttgaagtatgcaggaatggtaggaaggctaagattaggattgataagattagggctacgactcctcctagtttgttgggaatggagcgtagaatagcggccgcaaaggtccttgtcctttttatcactttttaaaaacccgtgagatgggatcaacattgaaagtggggatttttttttctaaagcaatcattacatgagaaataaatttatataacccctcctcgtgcc

SEQ ID NO: 8 - DNA, 513 bp, Rattus norvegicus
  Genbank Accession No. AI179150
attaatttcattttaacattttgtcttcaacaattccagagattggtatgagaatgaggataattgaaaagtagctgatggaggctagttggccaataatgataaatgggtgttctactggttggcctccgattcatgttaagactaggaggttggctactaggattcagtaaaggatttgggtgattgggcggaatgttaagctgcgttgttttgaagtatgcaggaatggtaggaaggctaagattaggattgataagattagggctacgactcctcctagtttgttgggaatggagcgtagaatagcgtaggcaaagagaaaatatcattctggtttgatgtggggtggggtgttgagggggttagcgggtgtataattgtctgggtctcctagtaagtctgggaagaatagtactagggttattatgaataatagtaatataaatacacctaggaagtctttaattgtataatatggatggaatgggattttgtctgcgttggagttta

SEQ ID NO: 9 - DNA, 6849 bp, Rattus norvegicus
  Genbank Accession No. J01435
  misc_feature (1)..(6849): n = a or c or g or t
ccctcacagtattaagtacccttaccctaccgctttcctcccaactaatcacatagaagtttaggatatacagttcaagagccttcaaagcccttagaaaacaaacaagtttaacttctgataaggactgtaagactatatcttacatctgttaaatgcaaatcaactgctttaattaagctaaatcctcaactagattggaaggattcaaacctacgaaaatttagttaacaactaaataccctacttactggcttcaatctacttctcccgcctatcagaaaagaggcgggagaagccttagtagaggagattctctacaccttccaatttgcaattcgacatgataatcaccttaaggctttttggtaaaaagggggctcaacccctgtctttagatttacagtctaatgcttactcagccattttacctatgttcgtaaacggttgactcttttcaactaaccctaaagatatcggaaccctctacctattatttggagcctgagcaggaatagtagggacagctttaagtattctaattcgagctgaactaggacagctaggcgcactcctaggagatgaccaaatctataatgtcctcgtcacagcccatgcattcgtaataattttctttatagtaatacctataataattggaggcttcggaaactgacttgtaccactaataattggagcccctgatatagcattcccacgaataaataacataagcttttgactgcttcctccatcatttctactccttttagcatcctccatagtagaagctggagctggaacaggatgaacagtatatccccccttagccggaaacctagcccatgctggggtatccgtagatttaactattttttccctccacctagccggggtgtcttctatcttaggagctatcaactttatcaccactatcattaatataaaaccccctgctataacccaatatcagacacctctctttgtatgatccgtactaattacagccgtcctactacttctctcactgccagtattagcagcaggtatcactatactccttacagaccgaaatctaaatactactttcttcgaccccgctggaggcggaggcccaattctttatcaacacctattctgattcttcggccacccagaagtgtacatcttaattcttctagggtttgaaattatttcacatgtagttacctattactctggaaaaaaagaacccttcggatatataggtatggtatgaaccataatatctattggcttcctaggatttattgtatgagcacatcacatattcactgtaggcctggatgtagacacccgagcctactttacatctgccactataattatcgcaattcctacaggcgtaaaagtattcagctgactcgctacactacatggaggaaatatcaaatgatcccccgccatattatgagccttagggtttatcttcttattcacagtagggggcctaacagggatcgtactatctaactcatcccttgacattgtacttcatgatacatactacgtagtagctcacttccactatgtcttatctataggagcagtattcgccatcatagcttgcttcgtccactgattcccactattctcaggctataccctaaatgacacatgagcaaaagccctctttgccattatatttgtaggtgtaaacataacattttttcctcaacacttcctaggattagcagggatacctcgtcgttactctgattatccagatgcttataccacatgaaatacagtctcctctataggctcattcatctcacttacggccgtccttgtaatgatcttcatgatttgagaagccttcgcatcaaaacgagaagtgctctcaatttcctactcttcaactaacctagaatgactgcatggatgccccccaccttaccacacattcgaagaaccttcctatgtaaaagttaaataagaaaggaaggattcgaaccccctacaactggtttcaagccaatttcataaccattatgtctttctcaatgagatattagtaaaataattacataaccttgtcaaggttaagttatagacttaaatctatatatcttacatggcttacccatttcaacttggcttacaagacgccacatcaccaatcatagaagaacttacaaactttcatgaccacaccctaataattgtattcctcatcagctccctagtactttatattatttcactaatactaacaacaaaactaacacacacaagcacaatagacgcccangaagtagaaacaatttgaacaattctcccagctgtcattcttattctaatcgcccttccctccctacgaattctatacataatagacgagattaataacccagttctaacagtaaaaactataggacaccaatgatactgaagctatgaatatactgactatgaagacctatgctttgactcctacataatcccaaccaatgacctaaaactaggtgaacttcgcttattagaagttgataatcgggtagtcttaccaatagaacttccaattcgtatactaatctcatccgaagacgtcctgcactcatgacccatcccttcactagggttaaaaaccgacgcaatccccggccgcctaaaccaagctacagtcacatcaaaccgactaggtctattctatggccaatgctctgaaatttgcggctcaaatcacagcttcatactcattgtactagaaatagtgcctctaaaatatttcgaaaactgatcagcttctataatttaaactcattgcgaagcttagagcgttaaccttttaagttaaagttagagacaacaaatctccacattgacatgccacaactagacacatccacatgatttattacaatcatctcctcaatagccacactatttaatttatttcaattaaaaatttcttcccaaacctttcctgcacctccctcacccaaaactatagccacagaaaaaacgaataacccttgagaatcaaaatgaacgaaaatctatttccctctttcattacccccacaataataggtctaccaattgttgtgaccattattatgttcccatcaattctattcccatcatcagaacgcctaatcagcaaccgactacactcatttcaacactgactaatcaaacttatcatcaaacaaataatgttaattcacacaccaaaaggacgaacctgagccctaataattgtatccctaattatatttatcggctcaaccaaccttctagggcttcttccccatacatttacccctaccactcagctatctataaacctaagcatagccatccccctatgagcaggagccgtaattctaggcttccgacacaaactaaaaaattctttagcccacttcttaccgcaaggaacccccatctcactaattcccatactaatcatcatcgaaactatcagcctatttattcaaccgatagcactagcagtacgactaacagcaaacattacagcaggccatctattaatgcatctaatcggaggagctaccctagtacttatagacatcagcccaccaaccgctacaattacatttattattctacttctacttacagtacttgaatttgtcgtagccttaattcaagcctatgtattcacccttctagtaagcctgtacctacatgataacacataatgacccaccaaacccatgcataccatatagtaaacccaagcccatgaccactaacaggagccctatcagctcttctactcacatccggcttagtaatatgattccattacaactccacaattctcctatcattaggcctcctgacaaacatcctaactatatatcaatgatgacgagatatcatccgtgaaggaacataccaaggccaccacacccctattgtacaaaaaggcctccgatacggaataatcctgtttattgtctccgaagtattcttctttgccggatttttctgagcattttatcattccagcctagttcctacccacgacctaggcggttgctgacccccaacaggaatcacccctttaaatcccctagaagtaccccttctaaatacatcagtcctcttagcatcaggagtctcaattacatgagcccatcacagcctaatagaaggcaaccgaaaccatataaaccaagccctactaatcaccattctcttaggattatatttcactatcttacaagcctcagagtatttcgaaacatcattttctatctcagacggaatttacggctcaacattcttcatagcaacgggatttcatggccttcacgtaattattggctcaactttcctaattgtctgtctactacgacaactaaaattccacttcacatcaaaacatcatttcggatttgaagccgcagcatgatactgacacttcgtagatgtagtttgactattcctatacgtttctatctattgatgaggatcctactcccttagtataaacaatacaactgacttccaatcagttaattctgaaaaaactcagaagagagtaattaacctacccattatcatcacaattaacatcaccttatcttttatcctcatttcaattgcattctgattgcctcaaataaacttatactccgaaaaagcaaacccatatgaatgtggcttcgacccaacaagttctgcacgccttcctttttcaataaaatttttcttagtagccattacatttctactattcgacctagaaatcgccttactacttcccctcccatgagcgattcaaacaaccaataccgctacaataatagcaactgcctttattttagtcactattttagctcttggcctaagctacgaatgaacacaaaaaggactagaatgaacagaataattggtaattagtttaaataaaattaatgatttcgactcattagattatgataataatcataattaccaacaatgacatctgctttcctaaatttaactatagcctttacattatctctactaggtacttttatatttcgctcccacttaatatctactctcctctgcctagaaggaataatactatcactatttgtcataacttcaacatccacattaaactccaactccataatctccataaccatcccaattaccattctagtttttgcagcctgcgaagtagcagtaggtttagccttactagtaaaaatttcaaatacccacggaacagactacgtacaaaacctcaaccttctacaatgttaaaaatcattttcccatctatcatactcctcccactaacatgactctcagccaacaaaaaaatctgaaccaatgtcacctcctacagctttctagtgagcctattaagcttatcactcctatgacaaaatgacgaaaattacctaaatttctcagttatattctcctccgatccattatccaccccactaatcattctaacaacttgactcctcccactaataatgctcgctagccaaaatcacataaaaaaagaaaatataatgcatcaaaaactttacatctcaatacttattagcctccaaattttactcatcataacattctccgcaacagaactaattttattttatatcctgttcgaagccactctaatcccaacactaattatcattacacgatgaggcaaccaaacagaacgcttaaatgcaggaatttatttcctgttttatacactaattggctccatcccactcttaattgccctcatttcaatccaaaactcaataggaacactcaacttcctaatcctctccctcacaacacaccccctaccctcaacatgatccaacaccattctatgactagcatgtataatagcatttataatcaaaataccattatacggagtccatctatgattaccaaaagcccacgtagaagctccaattgcaggctctataattttagcagcaattctcctaaagctagggggttatgggataatacgagtttccatcattctagaccccctaacaaaatctttagcctacccattcatcatcctctcattatgaggcataattataactagctcggtctgcctacgccaaacagatctaaaatcattaattgcttactcatcagtaagccatatagccctagtcatcacagccattataatccagacaccatgaagcttcatgggagctacaatactaataatcgcccacggcttaacctcatcactcttattctgcctagcaaacaccaactacgaacgaattcacagccgaactataattatagctcgaggattacaaataatcttttcattgatagcaacatgatgattattagcaagcttagccaacctagcactaccacccctaattaacctcataggcgagttattcattgttatagcaacattttcctgatcgaacccctctatcatccttatagcaactaacattgtcactacaggaatatactcaatatatatgattatcacaacccaacgaggaaaactaaccagccacataaacaacctccaaccttcccacacacgagaattaacactcatagctctacacattattcccctcatactattaacaatcaaccctaaactcatcacaggcctaacaatatgtagatatagtttacaaaaaacattagactgtgaatctaacaacaggaaatcaaattccttatttaccaagaaagtatgcaagaactgctaattcatgcacccatacctaaaacatatggctttcttacttttataggatagaagtaatccattggtcttaggaaccaaaaaccttggtgcaactccaaataaaagtaata

SEQ ID NO: 10 - DNA, 1912 bp, Rattus norvegicus
  Genbank Accession No. J01436
ccggtactcctcagtagccatagcagttgtatacccaaatacaaccaacatcccacccaaataaattaaaaatactattaaacctaaaaacgaacccccaaaccctaaaactattaagcacccaatacatccactaacaatcaatccaaacccaccataaataggtgaaggcttcaacgccaaccctagacaaccagtcaaaaacagtaaacttaaaataaacatataatttgtcattatttctacacagcatttaactgtgactaatgacatgaaaaatcatcgttgtaattcaactatagaaacacctaatgacaaatatccgaaaatctcaccccctattcaaaatcatcaaccactcctttatcgacctccccgccccatctaacatctcatcatgatgaaacttcggttctctactaggagtatgcctcatagtacaaatcctcacaggcttattcctagcaatacactacacgtctgataccataacagcattctcatcagtcacccacatctgccgagacgtaaactacggctgactaatccgatacctacacgccaacggcgcctcaatatttttcatctgcctattcctccatgtgggacgaggactatactatggatcctacactttcctagaaacctgaaacattgggatcatcctactatttgcagtcatagcaactgcattcatgggctatgtactcccatgaggacaaatatcattctgaggagctacagtaattacaaacctattatcagctaccccttacattgggactaccctagtcgaatgaatctgaggaggcttctcagtagacaaagcaaccctaacacgcttcttcgcattccacttcatcctcccattcattatcgccgcccttgcaattgtacatcttcttttcctccacgaaacaggatcaaataaccccacaggattaaactccgacgcagacaaaatcccattccatccatattatacaattaaagacctcctaggtgtatttatattactattattcctaataaccctagtactattcttcccagacctactaggagacccagacaattatacacccgctaaccccctcaacaccccaccccacatcaaaccagaatgatattttctctttgcctacgctattctacgctccattcccaacaaactaggaggggtcgtagccctaatcttatcaatcctaatcttagccttcctaccattcctgcatacctcaaaacaacgcagcttaacattccgcccaatcacccaaatcctttactgaatcctagtagccaacctcctagtcttaacatgaatcggaggccaaccagtagaacacccatttatcattattggtcaactagcctccatcagctatttttcaattatcctcattctcataccaatctctggaattgttgaagacaaaatgttaaaatgaaattaatgtcccgatagtataaaaattactctggtcttgtaaaccaaaaatgaagagtcagtcttctcaggacaatcaagaagaaggaactacctccccaccatcaacacccaaagctgatattctacttaaactacttcttgtcagtacataaaatgatatggacattaaaaaacatttatgtatatcgtacattaaattattttcccaagcatataagcatgtaatatatatctaatgatttaggacatagatttaaactcaactataaattcacaacaacatgtctattctcaaatacattagataatgtctattagacatatctgtgttattagacatgcaccattaagtcataaacctttctcttccatatgactatccctgtccccaattggtctctatttctaccatcctccgtgaaatcaacaacccgcccactcgtccccctcttctcgctccgg

SEQ ID NO: 11 - DNA, 946 bp, Rattus norvegicus
  Genbank Accession No. M35826
attaatatcctaacactcctaatcccaatcttaattgccataggccttctcaccctagtagaacggaaaatcctaggctacatacaattacgcaaaggccccaacaacgaaggcccatatggtaaactacaaccatttgcagatgccataaaactattcataaaagaacccatacgccctctaaccacctcaatatcactatttattatcgccccaaccctctcccttacactagctctaagcctatgaattcccttaccaataccccacccccttatcaacctcaacctaggcataccatttattctagccacatccagcctttcggtctactccattctatgatcgggatgagcctcaaattcaaaatactccctattcggagccctacgagccgttgcccaaaccatctcttacgaagtcacaatagccttatacctcttatccgtcctcctaataagcggctccttctccctacaaatacttatcactacacaagaacatatctgactattaatccccgcctgaccaatagccataatatgatacatttcaaccctcgcagaaacaaatcgagctcccttcgacttaacagaaggagaatcagaattagtctcaggctttaacgtcgaatacgccgcaggaccattcgccctattcttcatagccgagtacaccaacattattctaataaacgccctaacatcaattgtattcctaggccccttatatcatatcaattaccctgaattatactcaaccagcttcataacagaaacactacttctatccacaactttcctatgaattcgagcatcctacccccgttttcgatatgaccaactaatgcacctcctatgaaaaaatttcctcccactaacactagcattctgcatatgatacatttccctgccaattttcctagcaggaattccaccctacacat

SEQ ID NO: 12 - DNA, 16300 bp, Rattus norvegicus
  Genbank Accession No. X14848
gttaatgtagcttataataaagcaaagcactgaaaatgcttagatggattcaaaaatcccataaacacaaaggtttggtcctggccttataattaattggaggtaagattacacatgcaaacatccataaaccggtgtaaaatcccttaaagatttgcctaaaacttaaggagagggcatcaagcacataatatagctcaagacgccttgcctagccacacccccacgggactcagcagtgataaatattaagcaatgaacgaaagtttgactaagctagtacctctcagggttggtaaatttcgtgccagccaccgcggtcatacgattaacccaaactaattattttcggcgtaaaacgtgccaactataaatctcataatagaattaaaatccaacttatatgtgaaaattcattgttaggacctaagcccaataacgaaagtaattctaatcatttatataatgcacgatagctaagacccaaactgggattagataccccactatgcttagccctaaaccttaataattaaacctacaaaattatttgccagagaactactagctacagcttaaaactcaaaggacttggcggtactttatatccatctagaggagcctgttctataatcgataaaccccgttctaccttaccccttctcgctaattcagcctatataccgccatcttcagcaaaccctaaaaaggcactaaagtaagcacaagaacaaacataaaaacgttaggtcaaggtgtagccaatgaagcggaaagaaatgggctacattttcttttcccagagaacattacgaaacctttatgaaactaaaggacaaaggaggatttagtagtaaattaagaatagagagcttaattgaatagagcaatgaagtacgcacacaccgcccgtcaccctcctcaaattagattgacattcacatatacataatttcactaacaaatttatgagaggagataagtcgtaacaaggtaagcatactggaaagtgtgcttggaataatcacagtgtagcttaatcacaaagcatctggcctacacccagaagaattcataaaaaatgaacactttgaactaaccctagccctacaaccaaccaacataactaaacccccacataaactaaaacatttaactcaaaaagtattggagaaagaaatttacttaccaagagctatagagaaagtaccgcaagggaaatgatgaaagactaatttaaagtaaaaacaagacaaagattaaacctgtaccttttgcataatgaattaactagaaaatccttaacaaaaagaatttaagctaagaaccccgaaaccaaacgagctacctaaaaacaatttcatgaatcaacccgtctatgtagcaaaatagtgggaagatttttaggtagaggtgaaaagcctatcgagcttggtgatagctggttgcccaaaaaagaatttcagttcaaactttaagcttccatcagaacaacaaatcaaaatgtaaacttaaaatatagccaaaagagggacagctctttaggaaacggaaaaaaccttaaatagtgaataaacaactacaatcacttaaccattgtaggcttaaaagcaagccatcaataaagaaagcgtcaagccacatcatcttacacacacactaattccacaaacctcaaaaattccaaaattacaaattgggctaaatctatgatcctagtgaatactgttaatatgtgaacaagaaccaatccaccaagcacaagtgctaagacaaccggataaccattgttaattattgaatcataggcataacccaacaatagaattacctatccctaactcgttagcccaacacaggcgtgctttaaggaaagtttaaaaaagtaaaggaactcggcaaacacgaaccccgcctgtttaccaaaaacatctcctctagcataacaagtattagtggcatcgcctgcccagtgactaaagttccacggccgcggtatcccgaccgtgcaaaggtaggataatcacttgttccttaattagggactagaatgaatggctaaacgagggtccaaccgtctcttacttgcaatcagtgaaattgaccttccagtgaaggggcggactcataataaaagacgagaagaccctatggagctttaatttactaatttcaatttatataaaaaaacctaatgggcgaaaacaacaaaattatgaactaccaaatttcggttggggtgacctcggagaataaaaaatcctccgaatgattataaccgagtcggtaaccgtgtccgacccagtcaagtaatactaatatcttattgacccaattattgatcaacggaccaagttaccctagggtaacagcgcgacctatttaagagttcatatcgacaattagggtttacgacctcgatgttggatcaggacatcccaatggtgcagaagctattaatggttcgtttgttcaacgattaaagtcctacgtgatctaagtccggcaatccaggtcggtttctatctatttacaatttctcccagttacgaaaggacaagagaaatggagaccaaccaatcctaggcttccaaccaatttagaaaaacttaataaagtatatatgtacaataaataaccttagacccaagttattagggtggcagagccaagtaattgcgtaagacttaaaaccttgttcccagaggttcaaatcctctccctaatagtgtactttattaatatcctaacactcctaatcccaatcttaattgccataggccttctcaccctagtagaacggaaaatcctaggctacatacaattacgcaaaggccccaacaacgaaggcccatatggtaaactacaaccatttgcagatgccataaaactattcataaaagaacccatacgccctctaaccacctcaatatcactatttattatcgccccaaccctctcccttacactagctctaagcctatgaattcccttaccaataccccacccccttatcaacctcaacctaggcataccatttattctagccacatccagcctttcggtctactccattctatgatcgggatgagcctcaaattcaaaatactccctattcggagccctacgagccgttgcccaaaccatctcttacgaagtcacaatagccttatacctcttatccgtcctcctaataagcggctccttctccctacaaatacttatcactacacaagaacatatctgactattaatccccgcctgaccaatagccataatatgatacatttcaaccctcgcagaaacaaatcgagctcccttcgacttaacagaaggagaatcagaattagtctcaggctttaacgtcgaatacgccgcaggaccattcgccctattcttcatagccgagtacaccaacattattctaataaacgccctaacatcaattgtattcctaggccccttatatcatatcaattaccctgaattatactcaaccagcttcataacagaaacactacttctatccacaactttcctatggattcgagcatcctacccccgttttcgatatgaccaactaatgcacctcctatgaaaaaatttcctcccactaacactagcattctgcatatgatacatttccctgccaattttcctagcaggaattccaccctacacatagaaatatgtctgacaaaagagttactttgatagagtaaataatagaggtttaaatcctcttatttctaggacaataggaattgaacctacacctaagaattcaaaattctccgtgccaccaatacaccctatcctacatagtaaggtcagctaactaagctatcgggcccataccccgaaaatgttggttaaacccttcccgtactaataaatccaattaccctaaccattatttacttaaccacctttaaaggccgcctaatcacgacacttagcaccaacttaccaccaatatgagtaggattggaaataagccttttagctatcatcccacttctagccaacaaaaaaagcccacgatcaactgaagcagcaacaaaatattttctaacccaagctacagcctcaataattatcctactagtcatcatcctcaactacaaacaatcaggaatatgaacccttcaacaacaaaccaataacatactactcaacataatactcatttcactggccataaaacttggactagccccattccactactgactacccgaagtcacccaaggaattcccctacacattggattaatcttactaacatgacaaaaaattgctccactatcaattctataccaattttatcaactcctaaacccaactatcaccaccattctcgcaatttcatcagtctttgttggcgcctgaggaggacttaaccagacccaaacacgaaaaatcatagcatactcatcaattgcccacataggatgaataacagcaatccttccatacaaccctaacttaaccctcctaaacttaacaatttacatcctacttactgttccaatattcaattacatcataacaaactcagcaacaacaatcaacacactctcactcgcatgaaataaaactcccataatcctaaccatagcatccatcatcctcctatcactaggaggactcccccctctcacaggatttttaccaaaatgagcaattatctccgagcttctaaaaaacaactgctcaaccctatcaacactaatagctatcatagccctattaagcctattcttctatactcgactaatttactctatatccctcaccacattcccaaccaacaacaactccaaaataatctcccaccaccaaaacccaaaacataattttatcctcccaaccctcacagtattaagtaccctaaccctaccgctttcctcccaactaatcacatagaagtttaggatatacagttcaagagccttcaaagcccttagaaaacaaacaagtttaacttctgataaggactgtaagactatatcttacatctgttaaatgcaaatcaactgctttaattaagctaaatcctcaactagattggaaggaatcaaattcctacgaaaatttagttaacagctaaataccctacttactggcttcaatctacttctcccgcctatcagaaaagaggcgggagaagccttagtagaggagattctctacaccttcgaacttgcaattcgacatgataatcaccttaaggctttttggtaaaaagggggctcaacccctgtctttagatttacagtctaatgcttactcagccattttacctatgttcgtaaaccgttgactcttttcaactaaccacaaagatatcggaaccctctacctattatttggagcctgagcaggaatagtagggacagctttgagtattctaattcgagctgaactaggacagccaggcgcactcctaggagatgaccaaatctataatgtcatcgtcacagcccatgcattcgtaataattttctttatagtaatacctataataattggaggcttcggaaactgacttgtaccactaataattggagcccctgatatagcattcccacgaataaataacataagcttttgactgcttcctccatcatttctactccttttagcatcctccatagtagaagctggagctggaacaggatgaacagtatatccccccttagccggaaacctagcccatgctggggtatccgtagatttaactattttttccctccacctagccggggtgtcttctatcttaggagctatcaactttatcaccactatcattaatataaaaccccctgctataacccaatatcagacacctctctttgtatgatccgtactaattacagccgtcctactacttctctcactgccagtattagcagcaggtatcactatactccttacagaccgaaatctaaatactactttcttcgaccccgctggaggtggagacccaattctttatcaacacctattctgattcttcggccacccagaagtgtacatcttaattcttccagggtttggaattatttcacatgtagttacctattactctggaaaaaaagaacccttcggatatataggtatggtatgaaccataatatctattggcttcctaggatttattgtatgagcacatcacatattcacagtaggcctagatgtagacacccgagcctactttacatctgccactataattatcgcaattcctacaggcgtaaaagtattcagctgactcgctacactacatggaggaaatatcaaatgatcccccgccatattatgagccttagggtttatcttcttattcacagtagggggcctaacagggatcgtactatctaactcatcccttgacattgtacttcatgatacatactacgtagtagctcacttccactatgtcttatctataggagcagtattcgccatcatagctggcttcgtccactgattcccactattctcaggctataccctaaatgacacatgagcaaaagcccactttgccattatatttgtaggtgtaaacataacattttttcctcaacacttcctaggattagcagggatacctcgtcgttactctgattatccagatgcttataccacatgaaatacagtctcctctataggctcattcatctcacttacggccgtccttgtaatgatcttcatgatttgagaagccttcgcatcaaaacgagaagtgctctcaatttcctactcttcaactaacctagaatgactgcatggatgccccccaccttaccacacattcgaagaaccttcctatgtaaaagttaaataagaaaggaaggaatcgaccccctacaactggtttcaagccaatttcataaccattatgtctttctcaatgagatattagtaaaataattacataaccttgtcaaggttaagttatagacctaatcctatatatcttacatggcttacccatttcaacttggcttacaagacgctacatcacctatcatagaagaacttacaaactttcatgaccacaccctaataattgtattcctcatcagctccctagtactttatattatttcactaatactaacaacaaaactaacacacacaagcacaatagacgcccaagaagtagaaacaatttgaacaattctcccagctgtcattcttattctaattgcccttccctccctacgaattctatacataatagacgagattaataacccagttctaacagtaaaaactataggacaccaatgatactgaagctatgaatatactgactatgaagacctatgctttgactcctacataatcccaaccaatgacctaaaaccaggtgaacttcgtctattagaagttgataatcgggtagtcttaccaatagaacttccaattcgtatactaatctcatccgaagacgtcctgcactcatgagccatcccttcactagggttaaaaaccgacgcaatccccggccgcctaaaccaagctacagtcacatcaaaccgaccaggtctattctatggccaatgctctgaaatttgcggctcaaatcacagcttcatacccattgtactagaaatagtgcctctaaaatatttcgaaaactgatcagcttctataatttaaactcattgcgaagcttagagcgttaaccttttaagttaaagttagagacaacaaatctccacaatgacatgccacaactagacacatccacatgatttattacaatcatctcctcaatagccacactatttattttatttcaattaaaaatttcttcccaaacctttcctgcacctccctcacccaaaactatagccacagaaaaaacgaataacccttgagaatcaaaatgaacgaaaatctatttgcctctttcattacccccacaataataggtctaccaattgttgtgaccattattatgttcccatcaattctattcccatcatcagaacgcctaatcagcaaccgactacactcatttcaacactgactaatcaaacttatcatcaaacaaataatgttaattcacacaccaaaaggacgaacctgagccctaataattgtatccctaattatatttattggctcaaccaaccttctagggcttcttccccatacatttacccctaccactcagctatctatagacctaagcatagccatccccctatgagcaggagccgtaattctaggtttccgacacaaactaaaaaattctttagcccacttctcaccgcaaggaacccccatctcactaattcccatactaatcatcatcgaaactatcagcctatttattcaaccgatagcactagcagtacgactaacagcaaacattacagcaggccatctattaatgcatctaatcggaggagctaccctagtacttatagacatcagcccaccaaccgctacaattacatttattattctacttctacttacagtacttgaatttgccgtagccttaattcaagcctatgtattcacccttctagtcagcctgtacctacatgataacacataatgacccaccaaacccatgcataccatatagtaaacccaagcccatgaccactaacaggagccctatcagctcttctactcacatccggcttagtaatatgattccattacaactccacaattctcctatcattaggcctcctgacaaacatcctaactatatatcaatgatgacgagatatcatccgtgaaggaacataccaaggccaccacacccctattgtacaaaaaggcctccgatacggaataatcctgtttattgtctccgaagtattcttctttgccggatttttctgagcattttatcattccagcctagttcctacccacgacctaggcggttgctgacccccaacaggaatcacccctttaaatcccctagaagtaccccttctaaatacatcagtcctcttagcatcaggagtctcaattacatgagcccatcacagcctaatagaaggcaaccgaaaccatataaaccaagccctactaatcaccattctcttaggattatatttcactatcttacaagcctcagagtatttcgaaacatcattttctatctcagacggaatttacggctcaacattcttcatagcaacgggatttcatggcctccacgtaattattggctcaactttcctaattgtctgtctactacgacaactaaaattccacttcacatcaaaacatcatttcggatttgaagccgcagcatgatactgacacttcgtagatgtagtttgactattcctatacgtttctatctattgatgaggatcctactcccttagtataaacaatacaactgacttccaatcagttaattctgaaaaaactcagaagagagtaattaacctacccattatcatcacaattaacatcaccttatcctttatcctcatttcaattgcattctgattgcctcaaataaacttatactccgaaaaagcaaacccatatgaatgtggcttcgacccaacaagttctgcacgccttcctttttcaataaaatttttcttagtagccattacatttctactattcgacctagaaatcgccttactacttcccctcccatgagcgattcaaacaaccaataccactacaataatagcaactgcctttattttagtcactattttgtctcttggcctagcctacgaatgaacacaaaaaggactagaatgaacagaataattggtaattagtttaaataaaattaatgatttcgactcattagattatgataataatcataattaccaacaatgacatctgctttcctaaatttaactatagcctttacattatctctactaggtacttttatatttcgctcccacctaatatccactctcctctgcctagaaggaataatactatcactatttgtcataacttcaacatccacattaaactccaactccataatctccataaccatcccaattaccattctagtttttgcagcctgcgaagcagcagtaggtttagccttactagtaaaaatttcaaatacttacggaacagactacgtacaaaacctcaaccttctacaatgttaaaaattattttcccatctatcatactcctcccactaacatgactctcagccaacaaaaaaatctgaaccaatgtcacctcctacagctttctagtgagcctattaagcttatcactcctatgacaaaatgacgaaaattacctaaatttctcagttatattctcctccgatccattatccaccccactaatcattctaacaacttgactcctcccactaataatgctcgctagccaaaatcacataaaaaaagaaaatataatgcatcaaaaactttacatctcaatacttattagcctccaaattttactcatcataacattctccgcaacagaactaattttattttatatcctgttcgaggccactctaatcccaacactaattatcattacacgatgaggcaaccaaacagaacgcttaaatgcaggaatttatttcctgttttatacactaattggctccatcccactcttaattgccctcatttcaatccaaaactcaataggaacactcaacttcctaatcctttccctcacaacacaccccctaccctcaacatgatccaacaccattctatgactagcatgtataatagcatttataatcaaaataccattatacggagtccatctatgattaccaaaagcccacgtagaagctccaattgcaggctctataattttagcagcaattctcctaaagctagggggttatgggataatacgagtttccatcattctagaccccctaacaaaatctttagcctacccattcatcatcctctcattatgaggcataattataactagctcaatctgcctacgccaaacagatctaaaatcattaattgcttactcatcagtaagccatatagccctagtcatcacagccattataatccagacaccatgaagcttcatgggagccacaatactaataatcgcccacggcttaacctcatcactcttattctgcctagcaaacaccaactacgaacgaattcacagccgaactataattatagctcgaggattacaaataatctttccattgatagcaacatgatgactattagcaagcttagccaacctagcactaccacccctaattaacctcataggcgagttattcattgttatagcaacattttcctgatcgaacccctctatcatccttatagcaactaacattgtcatcacaggaatatactcaatatatatgattatcacaacccaacgaggaaaactaaccagccacataaacaacctccaaccttcccacacacgagaattaacactcatagctctacacattattcccctcatactattaacaatcaaccctaaactcatcacaggcctaacaatatgtagatatagtttacaaaaaacattagactgtgaatctaacaacaggaaatcaaattccttatttaccaagaaagtatgcaagaactgctaattcatgcacccatacctaaaacatatggctttcttacttttataggatagaagtaatccattggtcttaggaaccaaaaaccttggtgcaactccaaataaaagtaataaatataataacaatcctaatcctcataattcttgatttacttacaacaccaatcacattttcaataacaatcttaaccaaacttatgtacttccgtcatatgctcattacatcaattaaattctcattcctccttagcctcttacctttactactattcttccaccacaacacagaatacataattactaactgacattgactaactattaattctattaaacttactataagtttcaaaattgactatttctcaatcctattcctatcagtatccctattcgtaacatgatcaattatacaattctcttcatgatatatacactctgacccccacattaaccgattcattaagtacttaataatattcctgaataacatactaatcctaacctcagctaacaatctattccaactctttattggatgagaaggggtaggaattatatccttcttattaatcggatgatgatatggccttgcagacgccaacacagcggccctccaagcaatcctctacaaccgagtcggagacattggtttcatcctagctataacctgattctgcctaaacataaactcctgagaactccaacaaattttcttaaccaacaccaacaacaatctagtccctctcacaggactactaattgcagccacaggaaaatccgcccaattcggacttcatccatgactcccatcagctatagaaggcccaactcccgtctctgccctactacactcaagcacaatagttgtagcagggatcttcctaataatccgattccaccccctaacctcaaacaatagtactattataacagccatactatgtcttggtgcaatcaccacattattcacagcaatctgtgctctcacccaaaacgacatcaaaaaaatcgtagctttctcaacatccagccaactaggccttataatagtcacattagggattaaccaaccctaccttgctttcctccacatttgcacccatgcattcttcaaagccatattattcatatgctccggatcaatcatccatatcctcaacgatgaacaagacattcgaaaaataggcaatataataaaagcaataccattcacatcatcttgtctcattatcggaagcctagcccttaccggaatacctttcctcacaggattctattcaaaagatctcatcatcgaagccatcaacacgtgtaacaccaacgcctgagccctaataatcactttaatcgccacatccataactgctgtgtacagcatacggatcatctacttcgtcaccatgacaaaaccacgatactccccactaattactattaatgaaaacaacccaaacctcattaatccaatcaaacgcctagcattaggaagcatcctagcaggcttccttatctcactaaatattcctccaactaacattcaaattctcacaataccctgacatttaaaaataacagccctacttattacaatcctaggatttgccattgccctagaacttaacaatttaacactaaatctatcaataagcaaacccaccaaactatcatcattctcaacctccctaggctactacccaccaattataccccgaattattcctcaaaaaactctaaattctagctacaaattatccttaaacctactagacctaatctgatcagaaaagacaatcccaaaatcaacctcaatcacccaaacccaactatctaaaataatatccaaccaaaaaggactaatcaaactatatttcctatcatttctcatcactatttcactaatttttatcttacacacacttaatcccgagtgatttcaataataataaaaatccccgcaaacaatgaccacccagccaccactatcattcaagtagcacaactataaatagccgcaaccccaatccccccctccaacataaccccaacatcatcaatctcatacattaatcaatcgcctagactatcaaaatcaactaactccaccttattattcaaactaaacaagtagaacactaccaactccataaaaagccctaaaacaaaaaaactaaaaataaaccaattagaccctcaagtttccggatattcctcagtagccatagcagttgtatacccaaatacaaccaacatcccacccaaataaattaaaaatactattaaacctaaaaacgaacccccaaaccctaaaactattaagcacccaatacatccactaacaatcaatccaaacccaccataaataggtgaaggcttcaacgccaaccctagacaaccagtcaaaaacagtaaacttaaaataaacatataatttgtcattatttctacacagcatttaactgtgactaatgacatgaaaaatcatcgttgtaattcaactatagaaacatctaatgacaaacatccgaaaatctcaccccctattcaaaatcatcaaccactcctttatcgacctaccggccccatctaacatctcatcatgatgaaacttcggttctctactaggagtatgcctcatagtacaaatcctcacaggcttattcctagcaatacactacacgtctgataccataacagcattctcatcagtcacccacatctgccgagacgtaaactacggctgactaatccgatacctacaagccaacggcgcctcaatatttttcatctgcctattcctccatgtgggacgaggactatactatggatcctacactttcctagaaacctgaaacattgggatcatcctactatttgcagtcatagcaactgcattcatgggctatgtactcccatgaggacaaatatcattctgaggagctacagtaattacaaacctattatcagctatcccttacattgggactaccctagtcgaatgaatctgaggaggcttctcagtagacaaagcaaccctaacacgcttcttcgcattccacttcatcctcccattcattatcgccgcccttgcaattgtacatcttcttttcctccacgaaacaggatcaaataaccccacaggattaaactccgacgcagacaaaatcccattccatccatattatacaattaaagacctcctaggtgtatttatattactattattcctaataaccctagtactattcttcccagacctactaggagacccagacaattatacacccgctaaccccctcaacaccccaccccacatcaaaccagaatgatactttctctttgcctacgctattctacgctccattcccaacaaactaggaggggtcgtagccctaatcttatcaatcctaatcttagccttcctaccattcctgcatacctcaaaacaacgcagcttaacattccgcccaatcacccaaatcctttactgaatcctagtagccaacctcctagtcttaacatgaatcggaggccaaccagtagaacacccatttatcattattggtcaactagcctccatcagttatttttcaattatcctcattctcataccaatctctggaattgttgaagacaaaatgttaaaatgaaattaatgtcccgatagtataaaaattactctggtcttgtaaaccaaaaatgaagagtcagtcttctcaggacaatcaagaagaaggaactacctccccaccatcaacacccaaagctgatattctacttaaactacttcttgtcagtacataaaatgatatggacattaaaacatttatgtatatcgtacattaaattattttccccaagcatataagcatgtaatatatatctaatgatttaggacatacatttaaactcaactataaattcacaacaacatgtctattctcaaatacattaagataatgcttattagacatatctgtgttattagacatgcaccattaagtcataaacctttctcttccatatgactatccctgtccccaattggtctctatttctaccatcctccgtgaaatcaacaacccgcccactcgtccccctcttctcgctccgggcccattcgtcctgggggtgactatactgaaactttaccaggcatctggttcttacttcagggccatcaattggttcatcgtccatacgttccccttaaataagacatctcgatggtaacgggtctaatcagcccatgatcaacataactgtggtgatatacatttggtattttttaattttcggatgccttcctcaacatagccgtcaaggcatgaaggtcagcacaaagtcctgtggaaccttttagttaagggtcatttatcctcatagacaaagctcgaaagactattttattcatgtttgtaagacataaatatttataaatactgaaaaatctgtcaacaaacccccccaccccctacacctgaaacttcaatgccaaaccccaaaaacattaaagcaagaattaaataaaacaaaaagctacttaattcttaaaaggcttctccattctagtagaccacaaaattttaacttaaatcttagcattggtaaaatttcccgacacaaaatctttcctcctaactaaaccctctttacttgcctaccctcagaaaattccacatacaccaaa

SEQ ID NO: 13 - DNA, 1194 bp, Rattus norvegicus
  Genbank Accession No. A03913
atgaattggcattttcccttcttcatcttgaccacagtgactttatcctctgtgtactcccagctcaactctctgtcactcgaggaactaggctctgacacagggatccaggttttcaatcagatcatcaaatcacagcctcatgagaacgttgtcatttctccgcacgggattgcgtccatcttgggcatgctgcagctgggggctgacggcaggacgaagaagcagctctcaacggtgatgcgatacaatgtgaacggagtcggaaaagtgctgaagaagatcaacaaggctatagtctccaaaaagaataaagacatagtgaccgtggccaatgctgtgtttgtcaggaatggctttaaagtggaagtgccttttgcagcaaggaacaaagaggtgtttcagtgtgaagtacagagtgtgaacttccaggacccggcctctgcttgtgatgccatcaatttttgggtcaaaaatgagacgaggggcatgattgacaacctactttccccaaatctgatcgatagtgtccttaccaaactggtcctcgttaacgcagtgtatttcaagggtttgtggaaatcccggtttcaacctgagaacacgaagaaacggaccttcgtggcaggtgatggaaaatcctaccaagtacccatgctagcccagctctccgtgttccgctctgggtctaccaaaaccccaaatggcttatggtacaacttcattgagctaccctaccatggtgagagcatcagcatgttgatcgccctgccaacagagagctccaccccactgtccgccatcatccctcacatcagtaccaagaccatcaatagctggatgaacaccatggtacccaagaggatgcagctggtcctgcccaagttcacagctctggcacaaacagatctgaaggagccactgaaagcccttggcattactgagatctttgaaccgtcaaaggcaaattttgcaaaaataacaaggtcagagagccttcacgtctctcacatcttgcagaaagcaaaaattgaagtcagcgaagatgggaccaaagccgcagtagtgacaactgcaatcctaattgcaaggtcatcgcctccctggtttatagtagacaggcctttcctgttctgcatccgacacaatcccacaggtgccatcttgttcctggggcaggtgaacaagccctga

SEQ ID NO: 14 - DNA, 233 bp, Rattus norvegicus
  Genbank Accession No. AA012709
ttttttttttcgcattttgtacatgaatgtttatttctcaattaaacattccctttaaacacaaggaatgaattctaaatcttcataaagatgaataaaaaatgatatccctccagtatagcgtgtataatcactgtccttggtcactactggcatttactgtttaacatcaaaaaacaaaggttatttaaaaatcatgctactggatttctaccccctccgctatgaccgaa

SEQ ID NO: 15 - DNA, 158 bp, Rattus norvegicus
  Genbank Accession No. AA108277
accctttgaactagaagctttctattctgaccctcaagcagttccatatccagaagcaaaaatcggccgttttgtcgttcagaatgtttctgcacagaagatggagaaaatctaaagtgaaagtgcgcgtgacacacatgcatttcacatatccgctc

SEQ ID NO: 16 - DNA, 201 bp, Rattus norvegicus
  Genbank Accession No. AA685876
  misc_feature (1)..(201): n = a or c or g or t
agccgagcccggtnttgctagcctctntgggggtggggctgtttaccctgttcggcctggctctgggtacctacttggttcgaagatcccgccggccacaggtcactntccaggncccggatgagaagtacctgctgcnattnctggacaagacgacagtaagccacaacaccaggaggttccgctttgcccttcccaccg

SEQ ID NO: 17 - DNA, 302 bp, Rattus norvegicus
  Genbank Accession No. AA685903
  misc_feature (1)..(302): n = a or c or g or t
gtcaacttccgaactgatcggccagtttggtgtcggtttttattctgccttccttgtagcagataaggtcattgtcacgtcgaaacacaacaatgntacccagcacatctgggaatccgactctaatgaattctctgtgattgctgacccaagaggaaacacactaggtcgtggaacaacgattactcttgtcttaaaagaagaagcatctgattaccttgaattggatacaattaaaaatctcgtcagaaagtattctcagttcatcaactttccccatctatgtnttggagtagcaaaga

SEQ ID NO: 18 - DNA, 240 bp, Rattus norvegicus
  Genbank Accession No. AA686870
  misc_feature (1)..(240): n = a or c or g or t
ctggaaccgcatgantcccaatgaccagtacaagttccttgctttttccaccgactacaagaagctgaagaaggaccggcctganttctaaggcgggggtggggggtgttccatctaaatcactcccttccaccccttgccccagaccctagggcatccgtntagcaacatggtcaagcttttgctttctgcttacanaggccanattcccacgaagaaggaaggcggctccaccnncac

SEQ ID NO: 19 - DNA, 619 bp, Rattus norvegicus
  Genbank Accession No. AA799279
cccaagattaaatgattattaaaaaagcgtgccactgtatagaaatcaacattctctcccataattctgtgcattgggactatagaaatgtcactgtccctgctccacatcttcaaattaacattctcaggtcacaatagtaagtcttcccacaaggaaccttccggaaaaacaagctgtttcctcggctcatatttcccgctttttgtagcatgcaccagcaatctatccaagaagtatatattggggagtaaggaggagatccaccagcaagcccacagttgttaacagccataagattagatacaagcacaaagggatatgtcaacatactggcaaagaatcctgtgacagcttgggaataacttttcatttcattcatggtagagaccccactgtccagtgcataggtattgatgagataagccagtgagttacacagccacaaagaaatgatgtcacctaggaggcgaggaatgaggcccgcaaaaaatcctacgatgccttcttcccggtagatggttactatggagtcacacagtccgcagtacttagactctctgccgataaactgtaccatggacctcagagtaatcaccttgaagggatgtgtaatgag

SEQ ID NO: 20 - DNA, 496 bp, Rattus norvegicus
  Genbank Accession No. AA799294
atctgtgtagaccacaggcaggtgtttgtttctggcatggccacattccagatacaagaacgtagagagacccagcaaggcaccacaccctctcatggcagagagggagcagtggggcagggtgagggccagctaataaagcctcccctcccccccttaactttgttcatagggcaaatggctgacggaaggagaaggtgggtaggttgagagggtatgcgtcaagacttggggagaggtagcagatagccgtcttgaggctctgttttcaatgagtagtcctagtcgaccttaaccaaagctccatccgattgtattcttgccaaaacacaacagacacatgcacgaacatggggcgtaagcaataatgtcctctcgtgttctccacggctgctcgaaccaagtggctggttcatttggttgacactgattcgcctttaaccatgacggttcctgttttttatttcacagaaagccaataaaattgtttagctat

SEQ ID NO: 21 - DNA, 545 bp, Rattus norvegicus
  Genbank Accession No. AA799301
gcaaaagttgaaaatgctcatatcagttaccagctcagaacctgggttcccatgggatccactgcataaaatgagtctgtcacttcttgccaggtttgggggccttttctaggccttggatgtattttccagggagccgatactcttcaagcaatagctggccgaggtggtggatctggtttccctggacctgcacctgcagactatctttggccccaggggcaggagagacgatggtgctggcctgacatcgctgctggagaatggcggccactgagcatggatctagaccataggtctccaagttccggaccacagtcacctttttattataagtcttcagtacaagggtgatatcaattggacagagtttccctttctttataatgggttcctggcctggaaatgtcacttggtatgcaggctgcagatttttcaaacacctggtcaggagagagtcccacggaagcttcatgaccaagtgctgctcatttttctctaagatacagtcacataagatgggatccaacttcaccagattcctg

SEQ ID NO: 22 - DNA, 685 bp, Rattus norvegicus
  Genbank Accession No. AA799325
gctgaagttagaatttaatcctggggaattaaaattattcatgtctgctgagtagatggcaagacaaatgtcacatgaccatgctttttaaatcttacttgggagttttgtttgcacaaactttctttgggctccttttaaagatttcttttccgtaagaaatcacgtcacatattgttcctttttgttctttggggtaacttagtcctgtcctttatcatacaatttaaggaaagataacataaaggtaaaaagacatcaaattctcatatacacaagtaacattctcctttggtcacattagcatcacgtgacttgaggtcgcagacagactcttctgtatctttgtccacgtgtcacacagacagcaagcacagggttcaggatgatagactagaaggcaccttttactttctgtgtaaacacgtgtgtgctggtttccttaccttgcgtattggtggttttcctgtctttgtttttaagtgttgtaatgtggtgcttagcttttctccttattaaataccatctccagaaactcgtcttggagtttagaaaacacttttgactgttcatttcctttttctttctcttaaaaatcttctagtccttattaccggaatttctgttaacagaattatgccagtgtcattgaagacttaaataatggaagatgtaactttcacat

SEQ ID NO: 23 - DNA, 617 bp, Rattus norvegicus
  Genbank Accession No. AA799330
tatttaattggaatacatgtcctgccaaccaaaccataaaacacttcatgggaacccatcacacatgaaaccccagcaggaccaacaagtgcggccttgcacttgtcaaggatgctgtagaagaagaaactattgagtttccgtcttaatcctcttcagaacttgaatcatcctcttggtcagaaagttccggcacagggaagcggagaatggcagctactccagtcagctgaccaagctgttccccagacacgtggagactggagaatatccttacggtgcccgcattctctttcacactgtccaccagcctgacataccggctccgggtggccacatcctgatgccggaagagctcatcactgatgagcaaggtgtcaatcgccaaggcttcattggccctctccacctgcttgagtccatagaatgctcggtcaggttcgtgctgtaacattttgtagaagtcatccaaggcttttacttccccggcagctttcgtgtctgaaaggcggctcgctacagtaggatcacataggacctctttcagggagtacctgtgtccagaggaggcgtgtacctgaaggaatttggagccgttttccaggagcaccttgttt

SEQ ID NO: 24 - DNA, 637 bp, Rattus norvegicus
  Genbank Accession No. AA799396
ggaacaccagcaaatccggtactttattaagacatcttaggcttccctgcattttcaaaaacaggaatgctctattgactgaacacatcaaagggtctctgcagagtccttgggggccagccacaggaggtgtcatgtgattctgcagtcccagagcatggcagctagtgcttgcaatcacaggaagcaggcagtcggttctccatctgcctaggggagggtatccttcattcttttgaaggactgccttcaagtcacagctcaattccagtgtgtagactcggtctctaggactggggacaaaggcagctgccaggtgcaacagtttatgaggctccgccttttatatatgccacgggagcccgggctctgggagccagaagcccaagctggaccaaccgctgctgtgggctgatggccttagcagccacataatcttccctttgatgtccagggtcaatgcagtcctggccccaccagggctaggagaaggtgtatgaaagagaatctcactgtgatctgtcctgtgaaggaaacagcaataaaatttattacccagtcaccacagtcattctgacaggagttctcctagcctctgacctccacttgagagggaactttcagggaggacagggac

SEQ ID NO: 25 - DNA, 573 bp, Rattus norvegicus
  Genbank Accession No. AA799397
  misc_feature (1)..(573): n = a or c or g or t
cacggacaagaagatgaagggccttgagtgtctggtaccagacccaacagcagtggtatccctctgtatgtgctcttgaggtggggatttatagagtgcagatcaaactttggaaagattgcattccctagaagtaaggcagagcagaagccgagcgtttgccatgtgtttgagacagagcacaccctgttgtctgctgccttgagcagtgtgaatgctgtcttaagggctttctgtagagccgccttccattgaatctctctgggcttcacagccctgcatggcctatgctgtgactgtgcaccccaggtcgaggattgtgaggcgtggcttcagtcttgtccctgtcctccctgaaagttccctctcaagtggaggtcagaggctangagaactcctgtcagaatgactgtggtgactgggtaataaattttattgctgtttccttcacaggacagatcacagtgagattctctttcatacaccttctcctagccctggtggggccaggactgcattgaccctggacatcaaagggaagattatgtggctgctaaggccatcagcccacag

SEQ ID NO: 26 - DNA, 495 bp, Rattus norvegicus
  Genbank Accession No. AA799412
catgaaaggttcaaaaccaaaagcggtttctctttgcagcaaatatacattaaaatagagtctctgtacagccaagggctctgggccctggcttgccccatggccctgcgcctccctggccaaacccaaaaataaatatagtgttattgctctgcagggcgtagaggcagtgctgtcccccatcccttgaggtgggagctgatagggggccctggccaccccagggcctcaagcatttccaaaaacagcttgtgcatggagtcagagttggcaagggccagagctttcagcaggacgtactcctcccgctccagccgtagggcttgcagccgccgaaccagctgcagcaaggctgcccccagatcccccagaccagcagcccgtgccccctcttcatccaggaccaggtcctcagcaaaggccaactcatcctgcaatggcagtgagcgctgggccacacccagcaccagcacctccatccacatactctgcagt

SEQ ID NO: 27 - DNA, 480 bp, Rattus norvegicus
  Genbank Accession No. AA799420
agaaacatctttatttgggtaatatgtcccaaaacaggtcagttagtaaaatagattctacagagtacagccctatgcacagccctccctccccaaaaataatcctgggggtggggggaatctgtctccccaccccgggctcctcagatataaagttttggcaggttattgttattatctaggtttggcccaccatgtccactttctgtagtggctggtatcagtacctacttttctcattccagaccagttcagcaaacatttctgccccaccccaaattgtggggcctaaataaagagcaaataggtctcctccactgacccatcacctcatcactgtgctttcagaaaaggggcaggtgagcaacccatggtgctgcacacctttaatcccagtgctcaggaggcagaggcagtcagagctctgagtttgaggccaggacaaccagagctatacagagaaatcctggcggggggggg

SEQ ID NO: 28 - DNA, 625 bp, Rattus norvegicus
  Genbank Accession No. AA799423
aatgcacaggtaactttattaggggggcacaacacgttttccagaaaattaaatataaaaccacccaatattagaacataataggcttttatttacagacatgtgttgttataggaaccagggtaacagggtctcaactatgtaattctggctgccctgtagaccttgctgcctcctgtgtgctgggattaaggcctgcaacacaacacttgacatttacaaacttatttttaaagctagaaatttaaatcaaaatcgcatttttcaaatctactaatcattccactttaattgtcaatcagtggctagttataaaatctattcatgcaaactatgctataaatagggaaaatataaagcttttgttttaggttatggcagaatgtgtacatttatttcccttttctgtcagctgcattttgactttgcacagcatggtaataaaactgataggcattggaaatggtgttctttagatgagctatttggaagatgtgggaaaagattaagtcaacagagtggcgcctctggtctcctttttggcccctcctcagagatgtatcaagagagttggagagagtgagatccaagtaaagaaggaaacctaatagtcatccactaaaaa

SEQ ID NO: 29 - DNA, 469 bp, Rattus norvegicus
  Genbank Accession No. AA799438
ccgtatacaatgtttattgtactcaatgatgtactcaggcggggctccccctcccagcctgaaagctcagagtccagtgaggatccctaggtgaactcattcctagaagttctccagcgtgaggccaagattcctgcctgggccaccttgcccagagcagctcttccctgaccccaggttgacggtccctggctacggccaggagagcaggtctgccatccacagaacagtttgaaagctgaggcgccatctccactccgcacatcggctcttacttccagcgaagctctagtagagacccaggaggaccacacttgttctgaccccagcggggcctggaggcaggccgcctggggtgtcgaggaaacagtctgaaggccacaccttctctccaggctggttactgtgtaatctcgtatttcaggtatctgattagcctgcccgggaggggcagtgtgtccaggagttt

SEQ ID NO: 30 - DNA, 649 bp, Rattus norvegicus
  Genbank Accession No. AA799442
  misc_feature (1)..(649): n = a or c or g or t
actgaggatctcataatgctaggtgaaagtagcagagttccttttcacttttacaccagtgccaaagaccttttataaagaggttcattctactgaactagcctccactgattcttgggttaatcatcaggcacaattcttgcatatgctttttcacatacagcatagtgatataagccattaaacactccaatattatctgaaacaacagaggaacggccattgctttcatcccagtttgacaaaggagtaaccaatggagcataactcttccctttggcggcactggaacagtgtgatacttaactgctaagcgtccatttttataaaaagccaaagcactgggataggagaccccacaggctacgccgatcagtgagcttctcagaacacagctttcctggcttatattacctgattgcagagcatcagtcacaaagagcttgtaagtaacggcggtagccacaaatggaagggtantcagggatgcataggtcctcaaagcttcatacntaaccttgaaactgtatctgaatactagtttgcccatacgcagacaactactactaatcaanngataagttcacgtanatttaaatctggtcgttnantagatcaaacttctctcaaagattcaacgatatgggct

SEQ ID NO: 31 - DNA, 250 bp, Rattus norvegicus
  Genbank Accession No. AA799448
aagcattttcaaactttatttacaactgtcacagtgacaaaaagtagtttggaaaaaaaaaatgctagtttctccctgagcctcgatacagaacagacagaagtcacaggaggttcatctcacaacaggcatgtcactgaaatactaggattttttttttcaatacgatcagttagaaatacacacaaattacttaaagaaagaagaggaggaagaggaagaggaggggaggaggaggagagggaagagg

SEQ ID NO: 32 - DNA, 656 bp, Rattus norvegicus
  Genbank Accession No. AA799471
  misc_feature (1)..(656): n = a or c or g or t
catggctgagcgtttattgcagtgctaacagagggtgctgggggcctgccctgctttcaccctctttacatccccctccttccggtctccaagcatccttccggagcattctacatccttccttctcctactccatcgctgtaaccgcacaggcgtgttccagggcctctcacggggcctctggctctcaacagaatctcttgtcccttcttctggggctgagggtactcagctctccactcctagtgtccaccatccttgttcccctccctgtggggacccaggacacctaggcatcctggcctctggctccctcctcccatggcccgcacctctgggcaaactacaaagcagccttggccagcagctctcccccatcgtcctaggcaggaagtgcccagcccaaggcagacacatcagagtctgcatcggtcgcagtcatctcagcctctctgagcttcctgagacatggaccgagacagggtacgccgcangggcccaagtttgctgactggcacaccggnggaagctgcttggtgatctcagccacgtcctggcgctccacgcactggccgcccanggctgtcttcagggcagcagctccgcagctgaatggggtctctcgcgtcctcctgntggnncccactggtaggggg

SEQ ID NO: 33 - DNA, 548 bp, Rattus norvegicus
  Genbank Accession No. AA799472
acaggaaggctggggtaggtatgtaccatagcatgtggtgatttctctcaccgacagctagagtttacgctcgttcctagaacataaatccacccttccacgttctgtgattctcatagcttagtcactgaaggaagactcactcgctgaactttcttctatggctttttcactttcgccacttggcaccggagcatctggcttctccagtagctctgggtctagtccttctgagatcatcttgtctctgattgccatcatcgggacacccacttgaaccatcttgaggtatctggcatatcgtgggtccttggctacagttacgacattttctgatggcgcttcaccttgttgtactccggagtcttgcgtgctgttctgcagttgctcagcagtgggttcagaatgtgattcatttgtgacagcagtgacacttagatgagacatgtcaactgtgacatcctctaggtctgcgatacatgacagcttcacatctaaacatatgacagctgtttcaacttgttgcatccgaagagaaaggtctgcca

SEQ ID NO: 34 - DNA, 654 bp, Rattus norvegicus
  Genbank Accession No. AA799488
acaaaggattttaattcattccacttaaaaaataaaggtagtctcctcaccccccataatgagtacattaagcacatattcacatacagaaaatgtacgtacattcaattgtttacaagatttgtcaccatgtaatccattgacattcaagtgaagtagatgaacttatctacatgtatatatttggaacttctgtaccccatccatccctttttaaacaaccaagataatacgtctattctctagaagtcagttcatagaggatgatttaaggttagaagtctcttttgaagaattacaatgaagtatttatacaataagggctcagaacttctaaacacaagcttgaagctacagctcactaccttaagttacatcacatccagtgtctgggatttttttttagcaggctgtttagtttgtaagccatttcaaatgtttcaaacaattacttgtgcatcaaggagaaaaagtacaaagagaatgattccttccttttttttttatattagataaaataacatatcatctaatccttctcaaatccaacattgtaacacattactacgcaatgttcaacttgagtttctgggaatcaagatcactaactagatgaaaacagaatttcatggtaccaaacaaagccgcctttaa

SEQ ID NO: 35 - DNA, 453 bp, Rattus norvegicus
  Genbank Accession No. AA799494
aagagtttatagaaattctttattattacacaaaaatagactctctcttccctctgtttatgtgaccccactctggtctctgtttagaggggaggcaggaagctcccaagcctctcccctctccctccatgatgggccctgcaagctgggtggagctggcagggtcattcccctccagggctccacttactgatgcctcctcacccctcacacctgtctctgccatccgctcacgtgccaggtcatctcaggggcccattcattagcttagcagtcaaagggcaggaaagagcagtggccccactgctgccactctttctcataggggccaggccagggtagtgagggctgtgatgctgggagggtgcagtgttgatgtggacttggagctggtggcttcattttctctggcccagtagaactttggtgatgaaggtgacaatggcacttgca

SEQ ID NO: 36 - DNA, 513 bp, Rattus norvegicus
  Genbank Accession No. AA799497
aaagccatacatggatggtgagagtaagcagctgtacagaggggacagcatcagtgtacatacattcatgtccagaacacttagcatacatcagggtttatacaaggtggcagaggctataggcacaatgatacaaaatataaagtatatttccatctataaatacacagccggggacttccctaggcaccaatcctggctccatcagtgcccttctctgccatctcacctccaacctcagatcttccgagtggccggaggctgtttgtacctgggctgttcctaaggggtcttgttaagggcatcactggccgccatgttctcctgtcacccctccccctctttcattcctgtctaagaatggacaacactctccctgttgatatagagattcaacaataaacaacaacatgacagatcattcacaaaagagcagtgggtaaaagtgctctcgtttaaaggaagtctttggcaagaatacagagttgcatacggagtgctctgcctcgtgcc

SEQ ID NO: 37 - DNA, 731 bp, Rattus norvegicus
  Genbank Accession No. AA799511
  misc_feature (1)..(731): n = a or c or g or t
gggtacaaaagtatttattttataaaacttgtatttaaaatagagcttatctgtcaactcacaaatcctaatttaaaacataacacattacccttagctaatctgatgttaacctttacaatcaacacccatttttggaattttattaagaacctgtactaaatgaagtttttaatcagaaaacattcccttttaccttaaaagtgcttcttaaatgaaggcaccaacaagaactactttcagatggtacagaatttcttatttcttgaagactctgtggttgaccacttcttcattagttacctgcagcaagacaccttccattttactaccaacaccactgaaggaagcaagaaaagctttattaatgatcacttggcttgcctcagctgttgaaatgaagcactttacagtctttgtggcaccagaatatacttgtccatggttcatatcaatgccatgggaagtgggaaaaactcaatacgggttcctccaccataaccccaattcctccactcctccaggacatagttcctccaacataggtccccccagtccggaacaacaaagttcaccctcatgacccttgtaaaggtgcgctcngccgctcggccaatctggcccaggcaaatcccaaaggggccataatccaacaggcaacgttccggggaatgttccgccaatccaaaaatacgggcaaagtaaccggggccaaagtgcaccacaatgtg

SEQ ID NO: 38 - DNA, 637 bp, Rattus norvegicus
  Genbank Accession No. AA799518
  misc_feature (1)..(637): n = a or c or g or t
cataccagctcaattttaattttaaagtgaaaaatgtacaggtgggaaagttaagcaacgccctgcagattcataacaaggagctgacctagttgtcccactacaagctgacagctctccagcagtgattgatttgtcacagcacagaaatgccaccctggacttgtggtccgcttactaactggaggaagcagttttaagtcttaccacggcctgtgctcaaagtgagcactgcactttgagaaagttgtttgaccagtcagcaatgtctgctagctgacttacccgactggccatgagtctcatctgcacgttgactcgcctaggggagggtcctggtctgtgtcaaactctctggtaccataaaaaccaagtaacggtggatctgacaggttaccctgagagcttaagaagcagagtatttaacttcatttgtaganaagaagggagtagtacaggctataggctgaggtagccttcatttaaagtgcaatctacttgcgataaatatagtaactaggacccgttccaagcagctatcatagtcatgttgatgctagctaactagaacctggttggtcagttctcacacacatcacaagcagaagcccttgcagtaagctatcagtgagaagag

SEQ ID NO: 39 - DNA, 589 bp, Rattus norvegicus
  Genbank Accession No. AA799520
  misc_feature (1)..(589): n = a or c or g or t
gagatgaagagacagtgaagccctgtttgctacttacatgaaaagatttaaaaaacaatcactgcacaaaatacaaaggggcagggtatgctgtggcattgaatttctcctcactttttttcttgacgtctcaagaacaaattaaagtttccacagcaaatttgttctcaaaatgccgaatggtgaaacagttactggcttcacgcttctgaatacctctaatggtttccctgcgctgcagtttgtaggtttccttgtcgtgacacagtcggtaaatgaagaagcccaggtggtccacgttttcgatgcggtcggtgatcaccatgtgctcatggatgaggtatgactgaggcaagtangtcccggccttgatgttaataagaagctccaacaggtttctgggtggcataacaatggaggtgttcagaggaatcacgtagcacttgtccagattaaggtcanataagcatgagtttcttgttaaatcatgcacaatgttggcaagatcgctgtccgcaaactctggtacagcacactgatgaattcactgcgtcttctcaaagatctaanaatctcttcattgtctgtg

SEQ ID NO: 40 - DNA, 626 bp, Rattus norvegicus
  Genbank Accession No. AA799526
aaacacaaaaccaaattttatttagcttaacagtttctccaatacaaagagaaatattaaaacccaggacatatgcacatataaccccccgccccacccccaaagcccaaaaacctaagagaagacaggacaaagttctcttcaatggagagcactatcttcgcttctggaaaatgtttccacgccccattccacgtcctcttcctcttgcagccacttgggccttcaggatagcagcttttcctcggccagcccctgagccttggtttttatttttcatgctctttaacatgggtgcatttttcagcatgtcaggcaaaatcagaaaccggatcttgctgccacgtatgtacacctgttccagctgtgccactcggccgtctctgtatgtgactgtgatgttggacatctggcagttcatgttgtcctctgcctcaatgagcttcccccgatacacttcaccagtgttggtctcacatgtcactatgtggccttccgcttcgtgcaggactttaattggcacaccgatagacatcttggcaggactcttccagctaactgcaggcgtgtttttttgtttcggtcccgggacaaacgttagaaggcgaaagcttgaagcgatggaa

SEQ ID NO: 41 - DNA, 570 bp, Rattus norvegicus
  Genbank Accession No. AA799531
  misc_feature (1)..(570): n = a or c or g or t
aaggcggcagctgtttattttgaggtaactgtcacacagtactgttatatggtagaatagtcattatgtaatcttgagagaggttgtctaaggtaggatttggagccttccacacttatcagatgccttctcattagtttcttctagttttgcaattctagatccaaattgtatggcccgtttgggcagaagggcagaggatgagagaccaagttccacagctgcaaggcgtaaaatgagcttctcaccaactccacggggcaaagccaggtctaccttttcccaaactggcagagaattcaggaaagatacaacattttcatccagaaaaggaaatcttgcttcctttccatgatcagcaataactctatcatcacgaccaaggtttctagaagaaatgcgacccaattccattgctatttcctcattcaatccttctaggccaagagactgaaagcgggcacgatgacgggaataacctgccaactgctcatctgcnacaatcccagtgagaatcacctttgcactgctcttgntagactgcacagcatcctcggttcacaacaaaac

SEQ ID NO: 42 - DNA, 512 bp, Rattus norvegicus
  Genbank Accession No. AA799538
  misc_feature (1)..(512): n = a or c or g or t
ggccaagaatcacacatatctgaacgtgctggtggtaccctttggaaaaactcccatttgggccttttaaaactgataatggccaggtggaaccttctgtaacccacttgtttcaccagagccttagtaagtacatgcctgatactgaaaccaaaaccatgcgcactttggtgcctttgtagtagtggaaagtaactgaacctctttcttttcaaacctagatggatcggcaagccgcttaacagaggactttgggggaaaggaccacaaactcagtccatcggtccgtggaagagtccttggaacaagcaactggctattaaaaaggttattttgtaacatttgtctaactttttacttgttttaatctgcctcaagtggcaaacttcattttatgtgccattttgttgctgttattcaaatttcttgtaatttagtgaggtgagcgacttcagatttcattattggattggatattgaggtaaaatttcatttntgtttatagtgctgac

SEQ ID NO: 43 - DNA, 615 bp, Rattus norvegicus
  Genbank Accession No. AA799539
  misc_feature (1)..(615): n = a or c or g or t
actgcaaagtacctttaatgtgtttgcatctgcagcaagcattagatttgctcatttgggcaccataaattaggtgtagcactacacagacaccgagtcaccccaaccagtcaatccaggtgagtaagaaagctgaacaaaacacttctgaaaaggggtgcagtcacaaacccagtacagtttaattgtttcaatcaaaggcttccacttacaattgtttggttagtgataaataaagacagtttaaatgtttcagtaagtcagtaattcatcaaacctgggtttgaattattactgttactattcaactccatccaaataaacatcgatactgcactctcaaacagaaaagaaaaagggacagctgcggcaaatgctaagtttgcgttctgagcatttaaaagaaacaccccactctgcatcctttcctctgccactctgctttgataacgtgaatctgtcacattttacttcaacagataaagcactctgctgagaatataaaaagttataaaaatgtaatcataaaagactaattatggtacgcatgtgaacttttcttttantagaaacaaaaatagtcattgttatctagttaactaagtatcttggtat

SEQ ID NO: 44 - DNA, 553 bp, Rattus norvegicus
  Genbank Accession No. AA799542
caaggatttattaagtcatacatgcaaaacatactgctaactgcattagcaaaagatcaatgtaaaaacactccacaattctgcaactgtcaattgaaaaaagtttgttctagaggtcgaaaggcccaacactgtgttcttgccagtgagttaggttgtacagaacggcgttagcactaccgcttgacagaacctcacagacccaaaggtacgggaagcatgtgtccgcgtgggtgaggtctaaagggggcggcatcaatcacatgacagtgttggtactctggcaagacagtgatgtttcagaatatctaaaatagtttacaaactgtaaagccgcatcacgtgatttctacacccagttactacaaaacgacgggaagcactactcagctgattaaaggaaggtgaaaacaggaacgcacttctactatctaccagaaaatctccgaatgcattatcagaaagatcttatagaacaggtcagacatattgctcgttaagaagaggtcctaaagaaaacacttgctaagttagcaactgtgagggatggcac

SEQ ID NO: 45 - DNA, 491 bp, Rattus norvegicus
  Genbank Accession No. AA799569
  misc_feature (1)..(491): n = a or c or g or t
aacaaaagtttattatgatgtacaaaggactagctattcagggcgtggtgggagatggcacaccagagaacccaggaactcacaaaggatcaggatgcaacggcaccatcacgtcccccctgcccgtggtcccactgtgccaccctgtctggccttgccgatttcttaactttacctattggccaagcaccttttcttacagcttttggctccttgagtttcttctgctcctgtgtgtatcttcctcatccaccttcttggttcttggtttgctcatgccaccttcaaggctgggcatgacactgctgtcccctctcccaattattattaaccccttcctgaactgttctgaggcaccatgtacaaaacgcccatagtacaggttctcacgtttcatttgccacaagttgtaccgtgagcacaccttagagcagcagcagttggcccctggcttccttgacaatggcatanaaatttctgaaaaaccttca

SEQ ID NO: 46 - DNA, 541 bp, Rattus norvegicus
  Genbank Accession No. AA799571
  misc_feature (1)..(541): n = a or c or g or t
cgtcgtctcaggccttgactgcgtacttgcgcagtgggtacagccgctccttccgctgctgcttcttggtcttcagcttctcttcatgcttggtgagccggcggcgcatggctcttgtcttcttgggtcgcaggtccaggggcttgtacttctttcccttgtagaatttcctgaggttttccttttgagtctgattaatgacagtgaggacacgggcgatgtatttgcgtacgactcgtatcttgaagataaaaagtccatgaagaggttatgaagctctgtgcagagtccatcatgtcgctccagaaggacctcaccagagtcagagggaagaggaggtgcatccttggcatcagggacatgagttgttcttgtctcagttcagcanatggcaactggtcctggcagccgagatggcacgcatactgctcgtcaggctgggaatacgcttctgtgcacgcagattcacattccagtttggttcgatttanatcaatttcatcatccacgaactggcaaattgaaaacagcctgcagcctc

SEQ ID NO: 47 - DNA, 541 bp, Rattus norvegicus
  Genbank Accession No. AA799576
  misc_feature (1)..(541): n = a or c or g or t
aacagacaataaaagggctttctttttaattcaaaggtatagccagataagtagatttgtttagaaccattcttgtgaaatactttttaaaaaaatacgaccaacttctttgcaaattacagacaaatacctcaactatgatgatctaatttttggtgaataatatacatgattagacagaaataggcaagctcacactggaagattaactatcaaacactcagtcaaaactccgtttatggcccccacttcttgatcgatttctgttcccacttcgtcttctaccgtcttgccgacttcctgaacgactcccctgtcgactctgtctacctgatcggccaccagatcgaccaccagatcggcctgaacggcctgacctgccgccagaccagccgctcctctgtctgggattagaagatgtgtttccatcataatattcttcaatttcaggtaacttggctggcactgagagtatccagtctgagtcantgcactctgcctgtaatctttctgactcacttgtaggaacatcaaacaaaca

SEQ ID NO: 48 - DNA, 602 bp, Rattus norvegicus
  Genbank Accession No. AA799580
gagcatatgcggatttattttggcacagacttggcatcctgaaccctaacccttcaacccatatcccctaaaacagctctgatagctctgacagtgacaagcttgttctcgggcctggaccgcacccagagtggagagcaatgacctcagaaccaaggccgagggcctgtcatccccttactccctagaatccaggaaaacccaaccagaggcagagccctgcctacgctggcaggtacaagagcatccgcaggctcctgtcagtagaaaagcaattccaaccagaccaccaggccccagcagagctaggagcagccagtgtgactctagaggagaaggtgcccgtggactgagaagaaaaggaagctgacccccaatatgtaggttcaacgttgccctgggaggatacctggcttccatgctcaagtccgagaggtccaaagtcagaggacaaatagcttcctccagctcagcgtggatcccgtcgcctcttcttccctaaactcaaggggcctgcgactgttcctttcacccccggggaaggggagcacttgtcctgagctgccatgcataccagaaagctgagggcgggataaaagttg

SEQ ID NO: 49 - DNA, 506 bp, Rattus norvegicus
  Genbank Accession No. AA799598
acattactatacaataaaacaaaattggaatctttataggtggaacagagaacccaccaccccatgacggactgggaaccaacagagagcttatagactggttgcagctacaaggagtggatgcaaatacaatagaaaaggtaaatttctaaatcaaaggattcctatgatactgttgaaaagctgcttatgttgttgaatgtatgttgaatctttcagattgttgaagaagattacacactttctggatattctcaatgatatcactaaggaagacctaaggtgcctcagactacggtaagagagcctgcaaacaatttaaataataaaatggggcttttttatgtgaatacttttatttttaatgctggtagtttccccgatctttgaaatttatctttcctaggttgtaacaagcacagctcattttctcaggttggcaaggcatgaagtgccagacctttctttacattgtttaaatgccaaacctctacccagatcaccaa

SEQ ID NO: 50 - DNA, 590 bp, Rattus norvegicus
  Genbank Accession No. AA799599
  misc_feature (1)..(590): n = a or c or g or t
aacggccacaatagtttatttacaattgaactctttataagatatttacaagacagccgactttacacatcagaaatggtatcaaaagtatgaattacagcacagacaacgatatgaaacaggcataaaacaaagctgaggtggagagacaagcactttctcttttaatttattaacactagcttaaactttgttaaagaaagagtaaggaactatgttttaggagaactgcagggcctctctttctgttgaaggctgaatctcacacagtgttgtatcccatgtaggggaaaataaaattaattccccacacactccacacactgtgctctcgctcctggaactttgctccaacctcctcctcaaccaacctcagcatctccaaaccanaagacagctaggagaggacataatcaaatattaggtcctcagggaaaggagaaccaaagcaatagaatccacttcagtcctgccagatagcacctcatggattcctctcagtctagcanaaacaggatatgaggactcctctgaatagggcagaaactggcggttagtctattaacccataccaaattaggaatcgacaa

SEQ ID NO: 51 - DNA, 591 bp, Rattus norvegicus
  Genbank Accession No. AA799600
cacagtctgtgcagcttttatttcaacagggaagtaataagatctatatacagtctaaaaccactagaaaaggtgagtaaaaaggacccatggtccatctgggtccaaccaggggcggtggcacatgcctttactcccatcacttgggaggtggaggcaggcagatctgtgagtttgaggccagcctggttgacagtgagttccaggcaagccagagctacatactgagaccctgtctcaaaacaaaagtctatggagtgatatgaatggtggggccgggcaagcatcgtacctggcgtccagagcagggcctgggcatttctctggtacatgtaggagtgaggccttatgaaagaccccgcactgagcagaggcacagaggacactgcctacctgtttgagctgtctacctgtctccacaggacaggcggacattccaatgccatcatcgtaggtccagcctgacttacacacccagaagggatcaagcctggcctgcattctgtaaggatgttcagaacttcacggtgctattcagagcccccgagaatagccggtcgcgggagatcaccagtggagtgtaaatgtcct

SEQ ID NO: 52 - DNA, 687 bp, Rattus norvegicus
  Genbank Accession No. AA799601
  misc_feature (1)..(687): n = a or c or g or t
aaaagcatgtttatgtgactgcacataaatgtctgtgtaaaaagggcattatgacagttgataccacaaagattacagtaagaaaagcactttatgacaatatttcacaaattcacaaggatcactttaatatacaaagtaactgctaccattctgaacacaaagcagccagtatgtacatagtgttaataaaatgcatggtgtcttggtacttttattctttacacataaagcacaaaaagatttaggtaaaaaatttaaacagggacatttctagattgtgggaacgttattagaaatgtatgtcccttctcatagttattagtattcttctccaataggaacatcagagttaaagctcataccctgttttgtgctaacagttccggggaggtattttctactccagtactcaaggaaaacccaaaaagccaaacaccattctaggacttccctggttattttgtttttcaaaagtttcaagtgacatgtctaggttggaaatgatcccttccactggggcattataaccgatgtgtacagatcagttgaagacagctttacacagaaaactgctaactagcacacttcttcaccatcctaataaatctacacacacagaaaaatgttgacaaaatttcccacnttntatataaataattttattacatacacattgaagtggca

SEQ ID NO: 53 - DNA, 668 bp, Rattus norvegicus
  Genbank Accession No. AA799607
aaagtgatgactttattaataaatatacatccatatgatgatgtagatacaaatcatgaacactactccattccatacacataactgcacacgagtagcttaagttcatggacatggaaacatacacagtatctattcagactttttacagcagaggacaacgtgcttattatcagttaactggtaattgtttctcataattgtctgtggaaaaaggaaactgtgaatcaaagaatcaagagtggcctgattaaatcacacaactgacttactacagcatcacttctaaaaacttaaatacattgtatgtgagagcacaggtctgtctacttggaaggaaaagggagaaaagcaaatatttagatacatcttaagagtttgaacgcagtcattatgctagaacagacagattaaaagagcatcaaaactttttatgcccaagactgttgtgaactgttacactgctgtaacggatcataaagttttactgcatatagacaaggaactgacagagcaatcatcttagtatcccctgaactgttctcttaaagcttcttaaagcatgaagaagttcaccatttaaacttacacactgtggttattattacactggatgaagcgtctttaacctgataataaatggattcagattttacctcaaagaaatc

SEQ ID NO: 54 - DNA, 708 bp, Rattus norvegicus
  Genbank Accession No. AA799612
  misc_feature (1)..(708): n = a or c or g or t
caagaggttcaacagaatttacttgtatattttccattttctatactacttgaaggcataggatagcttcatcttagctttctacaatactgtgttttaagtctacccagtaaactaagaggcagtacaacttgaatacaactgaggaggtgagaagcaactcggcaggccctggtgctcaacagttccggaataaacaggtagcgcgcagccgcattaaaaggtagtttgcaaatattcaagttacaccgagattccttccaaacctctgccttgctcaaaccagcgcacctggccactgctaacaccgcggcacggcatttggtgaatggtgatggttttactttcttcttaatcaaaagcctgtggaggtgctgccacgcagcagagtaagtcagctctgctcgaggacgaggtgccaattgtgaagtcacaaaaggtacagtttacatgagaaacgcacattaacaagtggcccaaatacagagctggacagaaccagaccagtaagtctatagttactcaactgaactaacataagtacattcaaaataaagccggagatcagaataggttttagaatcaaatttgcagactttcttgataaaacagaagagtgaccttctgcagttggaaatgaggctctcacctggcgaanagcanagacttggcagtccctcctgcacaggtaaggaaataagtgacaaa

SEQ ID NO: 55 - DNA, 556 bp, Rattus norvegicus
  Genbank Accession No. AA799614
  misc_feature (1)..(556): n = a or c or g or t
aatcaacttgccctccggcttgcccaccatggcaggcgcgtggggccccggggaagggagccactttgttggaggcagagcctggcagtcctcagaccccaccgggccccagcccctgcgtgaagttgtatttggagggtccagcccctatgcagggtaggttaacttgatttagctgagtccccactgaaaacaatagagaaatgccttattctggcacagttagggtaactgctctctgggaatagttagacattaggggaggaggctgcttcttgccctaggtggttggaggctgtgtgtgggctgtggttagagactgcacaggcctcgtcccttaggtatattagaactttctgggattgagttggggaccctggtttcaagaaagtgggtaagagaatgaagggtcaatgagctcacacaagctgcatgttagagggaccagtgctggctgggactcagctgtcctgcatgggagacagtggttactagtgttcctctttctctttggtcctggccgcctccttggcaggaggtggggactttctanggg

SEQ ID NO: 56 - DNA, 539 bp, Rattus norvegicus
  Genbank Accession No. AA799633
gactgcaaacaaagacatctgctttatttgttttccatcagtagcacatactgtttcttgagcatggcagccccatgctcagaggcatatgggtgctcagtcagagactgcagggcatggggaccatggtctgtggtctcatgatcggtcccttcttcaaggctccaggaaggatgctgctcctcagcccttgcgggcggtgctcacacagtgctggtatgccttggccaggtcggagcatagaagtacctcatgcagatggtcacggtagcagcggaggatctgggcctgtaggccagagcatacaggctccactctgcggggctttattgtgctctctgcttttgaagccgcctcgtggaattgttgagaagacagtttatacagctcagcattcttctcttggatgcgttcctgctgctccttgtagtaagtgtcacggcggctgagctcggcctctctgttcttcagttccctggtctgtcaagtggagcaaagaaacaacttgggtccccagaggttgaagaatccaaaaatcc

SEQ ID NO: 57 - DNA, 591 bp, Rattus norvegicus
  Genbank Accession No. AA799636
ccacatgaaaatgaaattacaattataagcatgaactaggaaacaaactgtaagcatgaactaaaaattacaaggtaacttgctacataaccatgataagacaacgattacataccccgtaagttctagattttacaattccaacacaatgttggtactttatatatagacaaatggcatatttaaaagtctttcttctctttctctttcgtgcatctacaagtactgtgtgcatgtgcacaccaaagccacaatgtacattgagaaggtcagaggaaaatttacagattattggttctttccttttaccatgcaggtcccagggatagaactcaggtcatcaaactccaacaagcaccattagctgccaagtcatcttacccacacggatgttggaatcttaaaaatattttttcacatttttcagttgattttcaaaataaaaaaagtttagtatacaattacaggcactgactttttaaatagagattcacagtaactttaagatacatttacacggaaatatatagacaaaatagtttgctgagtcaaaaaggacttttcccccaaaattaataaaattgagattga

SEQ ID NO: 58 - DNA, 571 bp, Rattus norvegicus
  Genbank Accession No. AA799637
aagcaaaagtagatgagggtggatcaggttaagtaatattggttaaaagaaagagaaaaaagacaccaaaagttatttccttcctaaggtctcagatagtttcttaagtcttttcttcagctccaaaggaaatttctcgtagcacttcttacagactggtttcatgtcaaactccacaaatttattccacagagaagcagtgagaatggtgtggaagggatagaacggttacagacacactggctttctctttctctgcttctctttatcccttgcttctctctcccgtctggcaagtcgcctcttaagctcttctggcattttctcataacagtatttgcagactggctttagatcaattgcaacaaacttatccttgagtgttagtttggtattgcaagtggaacaggcaaagcagctcacacaccaagccttgttgagggcagagaccacgtcaccttctatgacacggttgcaatggaaacaaacatcaccaaatagctgattatagtgagtctcacaataggccaagcccttcctctcataatggcgatgtccaagaaatgggttt

SEQ ID NO: 59 - DNA, 665 bp, Rattus norvegicus
  Genbank Accession No. AA799641
gaatcagataaggcaaagaatgggaactgttttgaaatttaggacttttagaggtaaccatggtcccctactgttaaaaacaggtatttgtctctcacggttttaagattaagggccagaactatctgcttcacaaatccttgttactctgatttccacatatgatcctaaaggttggacagtggtcccaacagcccgtcaggcccagcttcccgagcctccaactctacttagctgtccatattacgattatcagcttaattctctaagatgtaataaactgacatgcctttgacttctacacactcattaacaagatcattacataacactgcagtgtttcccaagtcaagtgttctttttaatcagatctacaaagcatttactgggatgacatttctgacaaagccacagacttctatcaagcagcatcagtgtagtataaaaagtaagcaaaggaacaaaatagccttcttctttcagcctcatgagcagctgcatttctggggaaggacctacacacatagtaattccttgccaagaaccaggacctctgaaggagggaaatgtggattaatgcattcctttttggtttttaaggagactgtaatagaaatatattaaagatagccttaaatatccaacaatcttctgacttacaactt

SEQ ID NO: 60 - DNA, 502 bp, Rattus norvegicus
  Genbank Accession No. AA799657
gctgggcaaacgacctttatttataaaggaaacagtttccgcgtcattataaacagtaagccacatggtgtgaaggcacttggttggggagatgggggcctcacacaggccccaaggcttctgggagaaatggaggctgctgggaagaacggggacttccaggtgagaggaagaaaggactcagagagaaatgaaggggtgggtagcctcccaggctcagctgggatagtgcagtggcttgctgccagtaggaggcacttagaaccagatctgatttggcaagtgtgtgtgttgggggtggggtgggagttcctgcccccaaatgtccccagcccaacctcaccccaatgcttaaggcagcttcataatcttcagtctggggctgccctcccttgagccgcccttgagcagagaatttccggtgcaggcagaacctctgaagaatagccgcatattacttagatggatccggcaggtctgggtggcaagcatgctggcggtg

SEQ ID NO: 61 - DNA, 478 bp, Rattus norvegicus
  Genbank Accession No. AA799663
ccagcctcaaagttttattatcaactgtgcacattcgagttcacatcccatggtgtacagcttataacacggacagtgagagacggcaggggctgcgtgagccatttggtgaaatggtcttgctcagaacccacagtcctgggcaagcaggggcctaagagatcccaggttccacacctcagcattgagcaaatgcacacagagtccttgtgcatacggaactactgaacgcaaacaaatacagggtctccagtttctggtgccataggtggcagagcggacacacacagctgcatacttgctcagtattggctgaatatactcctggccctggtcctcaatggctgggtctggcagctgtgcctcctcattgttgaggacttctaggagctgggtgacaagaatgtccttagggagtgactcgctccgctccactgcttccgtgaagagttgcttgccaaagcacagcttcttccag

SEQ ID NO: 62 - DNA, 400 bp, Rattus norvegicus
  Genbank Accession No. AA799717
ggaaactgggcatttattacaaatggaggaaggaacggtcactcagtccagcggtggccgcagtgtggggcggtgcatacatagtacaggcgcatggcatcctcagctcgggcactgtgtgactggaagaacactgcctccttgtggccacacttctggcacgggtggtcctcggtccggggcaacgtagggtcctgggacacgtctgcgatgatctgggtcagctcgtccacttcgtgcgtgattttgttgacgtacatgcagctgttgtcggcttcctgctggtaatcgcaattccggcacgcgtacagcagaatgcgattctccttgtcctccttggggtacagcatgttattacattcctggcagaaccgaataccgacgaagccagcctcgtgcc

SEQ ID NO: 63 - DNA, 588 bp, Rattus norvegicus
  Genbank Accession No. AA799729
cagctcatataaaagtctcttaagaatgcatttgagcacaatatataatagtaataatattataacatacattgtgagaaacttttgaaaacaatataacgtccacctggaacaacgcagtgttacagacgtaggaacccattggtcatgcacattttgtgccattttctttaactagttgtcacaatgctgaacttgtttgaagccatctcgctgacagagcggtaggtctggatggtctctagctggtctaggcaccagtctagttcctccagcgtctccattgctagtttctgatatgattcttctgcaaacaaacacacagacaggtagttaggctgcagcggctgcaggctggccatagccgagtctcctccgcctcggctgctcccggcgccactgacggtgcccccttgctccttcattgtttgcttgccgactccttgcttccaagctctttctggtgctctgcccgggagggggagtggctggtgccaagttttcaccccctcgccgggatgaggtgtcagtgatctaccaagaaacttcctcagaggaagaaggcgggacctcgtgccgaattcttgg

SEQ ID NO: 64 - DNA, 581 bp, Rattus norvegicus
  Genbank Accession No. AA799735
aacataaataaaggctttattgttcagttcggatgaatgacagactggcataagctcgattaattgttccacacatttaagaccccaggatgacagcaaaagctatgcttattggcaatgggcaacagggagggagggggtgggaaggacctgaaggcctctgaagttcaagaaagctatcgggaccgaaaccaacgtcctagaagcaggtccaggatggaaaagggatcatccaaagctgaagatcttggaggatctggatcacttctggaactgtcatgggcttcttgatgggtcactgtggtctctctccggccctcactgtccaccacagtgcggtgttcctccactgtcccatctggcttagtgatcttggtcacagagatgcttttgaaataggatttaggctggggttgaagaagtggacccagaccttcctgggaaacctgggagtcaagatccttgtcctctctggctctagaatggggactcacaggccatgtatcatccaacctatgaaaaggtccctgggacccccaatctggagctggtttggaggattcaggttttgcatgactctc

SEQ ID NO: 65 - DNA, 616 bp, Rattus norvegicus
  Genbank Accession No. AA799744
caaacaggaaattctttattgcaaagatacaaaagcagtcacggcgacatgtacagcaataaattaggtggtggccatgaggcagggtgcagacggggccaacagtctgtgatcttgatctcttctcaataatttataacatgggggaaaaaaagcacaaaaaaaaaataaatattgaaatgaaattgccaagtggcaggcggctgaggatgccaggcctcggcatgatcggcatgtgtccctgacaccttttgaaatagttaaagcttgctttaagaagtcagaggaacaagacagaaaactcacttttatctttaaataaaaacatccatatattattaagttgtgacaatgaaatttcagtgacacgaagccatggggcatgctcacacccttcccagccccctcctggcaggtgtcctctgcaggtgctccagtggtactgacagccctgtctcccctggccgccaagagtatggggcctccacccaggaggaccaccagaggccaggagcgggcagcaagccagtcagtggtcacctgcctaccctggagaccactcatccagttacccggcctgccagcaccaccacagaaagactgatggaggctgttg

SEQ ID NO: 66 - DNA, 671 bp, Rattus norvegicus
  Genbank Accession No. AA799751
  misc_feature (1)..(671): n = a or c or g or t
acacctaatacatgaaaagaactctgaattgaaatccagccatctagaaataattctggtcataaaatgcacaattatcccatgtgtccaaagtctgctgagtttgctctgaagtttgtatttactccaatatctagaatgtctcaggaccacatgctgatactacacagaacagaagggagctgagcagaaccacacgtaaatgcaaacttaagaactttatggtattgctctggtgccttatgtcttaagcactgaccagagagttaagtgtgagctagaaaagttttcagagaaatgagctgcagaacttcctaccccacccctaggttattcagagcaaggagggctgatgtgggggatgagaacctacagactgaacatcctgctttcttcctacctcagtccgacgctggacatcctggagtgtaaggcactagaactggcctgagaagtgctccaagcttcagttcttggtgtgcaaaagaaattgtggcatagatcttttgaaacataataaaataactcccccctcctcttatattctgttattcacagacaaaaagacaaggaggtanatgtttgcaaagattaaaaaacaggtgaatcaaaatatgaagaaagtgtgtatacntattcagatatggagaaccacttagagggcaanagtc

SEQ ID NO: 67 - DNA, 578 bp, Rattus norvegicus
  Genbank Accession No. AA799755
ggtgtgacgttggcttccttgcctccccaaaggctggcaggtagaaccgggggcttctgcagagactctgcttttggaggcctggtggtaacagggcccacccaggagcatctgatggctatgcgcctgccagcacaggctggggaaatgctgctttagtttgaattgggctagggctttgggaccccagtctcagaagtccccaaagttgactgtgtaggtctccactgttgtgactggaaacgtgaggcctgtgtccatctcctcctcctcctcctcctcctcctccagttcctccacctccaggtcaggcccatactctgtctcaaactctgtcactacctctgtataggtctcagtctctgactcctcccagcccgcagcggtagtgggtagaatttcccagagcctcgaggtactgcctggtgtaggggaaggaggcagcgtaagggcaggagtggggctcgtggcaaggcctgtggtagaattgaagcgccgcagcctcatctgttccctcatcctgagccggtaccgtaaccggcgctgctgcaagcgccgctgctggggtgtcattggtc

SEQ ID NO: 68 - DNA, 419 bp, Rattus norvegicus
  Genbank Accession No. AA799762
ggaagacacagttatggggtcaggaaagctcagtgctgtaaactaataggctctctccagctcctgctcatgtctgtttagccttcctagtttacagggagggttgagagtgtgggctcttgtctagcaccacttaaacttgggcagtctgctgattctgacaggtcaggacggggccctgctgttggtctggctaagatgcatgactggctgcttcttcatggtttcaggagccaggccacaggaaattgggcttctggaggcctggggggattctgccgagctgtagggagagcataagtcgctgggtcagcatttgttttaattggggccacccccacaaccacacggtaagatggactcactgctcaggagactccaacactgcggccatgaatgggagggtggatttcccgaaa

SEQ ID NO: 69 - DNA, 646 bp, Rattus norvegicus
  Genbank Accession No. AA799764
caaactttaattgatagactaatcttacaggataaacaatgacagctagtcaagattacatattaaaaaaaaaatccagcagcgcaaatctaatagactaaatacgtttatctcctcccaaacaggcattttgatttaaaaacaaacaagaacagagtgtacaccacaaggaaacatagtacttacatattgtcaaatactctgtagaagtctgtaggaaaggtaaagaaggttctcagtcaccaagaaagcagaaccacccaccctggcaggtaaatcaccagctgatttgtacactagagcactcctgtccacttttaggcctatgaagaaggaaatgggcctgatcctgactggaagtaacttcattacaaagtctaaagacagagagaccatccttttccaaggaacagggctgaacaatagcaagaagcgagagaaagttggtagatgggtgaaaagaaagcctggccttggcatacatctatctttcccttcccttcttggctcctggtaaataaagggccggccaactgcaacagctcacagcactcctccaggcacattgaagaggaaaaattcctttctgggtgagatatggcaacttttctgagacatggcaatgtaacaaagttcatctctttgg

SEQ ID NO: 70 - DNA, 631 bp, Rattus norvegicus
  Genbank Accession No. AA799771
actagacacctttgataatgatagaatgagtatcttgtcttaaacattctcagcactatgcccttattacatatgacatctaaaaacaagatactcattctatcattatcaaaggtgtctagtaaaaaaggaaagattgacattgaagatgggactagaaacccctacttaggggccttcaaacggtttctcacacacatctgtgaggtaggttattatccacattttgtacaagagaaaactacacaaggttacataccttgtgctgccataatagcaaacagggaattagatccaattagatccggtccttagctttgcatttcttttctttataaactttaaaatataaagactgctagtaattgcattcattttaaaagcataagaaggcagccaaatagtttcccgggtggctttacaaagtgaaacaaatgaacagaaaatgcattcagtgaagacattccaatggtgacgctgtaaggtctggtcaagtggaaccaaaaggcagaagcaaaccacgtgaccgcctgtgggacaggtctcaggaaaacgggggagctgggggcagcagactttgaacacacgtttacggctactctgcaagtatttgagaatgcaccaggtactc

SEQ ID NO: 71 - DNA, 615 bp, Rattus norvegicus
  Genbank Accession No. AA799773
ccacatgtgcaaaagtttcccagagagttgggccccacaatgtgtaaaaaagacccccaatggggcagagctgtgtaaccataaaaaaaaaatagtaagagaaatcagtttcccaggaggcctggcttgggtggagcatgtcactcagggccagtccgcatgcggtgtgctgtttgttctggaactgctttcttctgattgttctttcttttccaagccccttactctagggctatggccaccagacggcctgacagagtcctcaggcatggtggtttgtgaggatgacttctttcacacacagataccccaactcagtgcttgcccactggcatcagccccactatgatccccagggcttccccccaacccgtttaaccccttatatcacagtctcggcccccagcttcaccaagtcttccctcaggacacctttgagggacactgaaacaaaacagataaaggcccggccccccacccaccaagtggcacagtggggtacgggggattgtatcaccccgtcacacctaaggcaggtgttttagtgtctgattctgtgagtgtggataggggggtggcacatctgtgtgggtatgactttggcaggaagtgggg

SEQ ID NO: 72 - DNA, 673 bp, Rattus norvegicus
  Genbank Accession No. AA799784
ggcagcaaaattgtgttaaaaaaaaaaatctagaccatgaacatgttttactgcttcagtttaagaatcccaagccaaataaaaagagcagcacagaaagcagcaagctggttacttccagacaaataaaaaggatcaaatgcaacagcaggaagacaaacactcccccttttccagaaatcacaattccttcaaataaagaatgtgaaccatgtgccatattgaattgatatttatttcaggacatgccatgtcaaaataaaacaaaagagtcaatccctgcttttaacaataatatgtattataaaagcactttacaactctatcccatgtttgagtataagttacagggtatgtgggctaatgattatctgaaagtatttctctattcagatccataatccaagtgctctccaagtgttacaaggtgacagtacgtagaagtggaggaggacagggaggggagtcgggctttccagttaggaattttgttgcaatgaggaggtgaggaagtatgaagttatttttgttaccttttcatctttatactgtgttaagtaatgcttacaacataaaccccgcaggcttcttctgagttagaactcagaattttttccctgcaaataatgtatttacaaatgtgtttattaacttacacagcaatctcaacctc

SEQ ID NO: 73 - DNA, 586 bp, Rattus norvegicus
  Genbank Accession No. AA799788
cagcttctcagaaagctattttatttggatttcacacacaccaaaagcagagaggagactgtggggctggccctctttgggctggagtctctggctcccctgggcagtcggttcccagcctcccaggcttgtcatcctctgaaggctgagtggggtgtctgccctgcaccacagctcttctccaaagccgaggaaaacccatggggaatacagggtaagaggacctaaggatcatgggatgggagcccacattgaacctcggtgaggtagtctgtcgcctgaggcccacacgggtcctgctgaggtaaaatttgtaagtttatttcagggacgtgggtcaggactcctccttggtccccaggacctgcttccggatgatgtccgtgtactcgcggtccttccccttgctctccttccattttctgtacatcaccgaggcgtccacgttggcaggcgaaaaggtgttgggctcattcagcagggagatcacactcaggaggatggtcctgacattctgcgtggggttccaccgctctgagggtagctccccactctgtgggtcatcaactgggggatggaggatgga

SEQ ID NO: 74 - DNA, 556 bp, Rattus norvegicus
  Genbank Accession No. AA799803
gagattatagtaaaagagaatttattctatacactgtctgcctccgtgattttaatatgagaaacgtagtgcttatcaaaaattggttagatacttttttttttttaatatactacacactggattctaacccaatgaatgctggcttcagttttcatctccaatctctttcttgatccagtcaacataattcagtaacttggtgtaaaagccgtatccctcaccacacccaatgccccaggatacgatgcctgtagccacccagatatcacgactgcggtccctgactgcaaaaacacccccactgtccccctggcaggcgtcatgcttgagagttgggtccccagaacagaacatattttgagaaaatacatcattactgtttttcgtccggagccacctctggcatgcctctcgatcggctatgggcagacggacaaacctgagattaaaagctattttatcttctgttatcccgaagccgctgacataacccataaggtctttgtcataaaaggtctcattgtctgggagacagatggggaggaggttggga

SEQ ID NO: 75 - DNA, 582 bp, Rattus norvegicus
  Genbank Accession No. AA799804
aacgatcaaaaaacactttgcacttataaataaacgcttctttgatcaatattaaatgaaaactacccagaaccttacaggcctttcagcaggcggcagacatgatgttcggaagatagatgttagcttgctgtgatcagaaggatagcgctttgctgtaatttatttaaaatgtacctaacagcttccctcacagtaacttgactgaaattacaacaggaaaagaaacccagcatttattcctaggtttagacataacccacacaaagttccaactatatggcttctatactttttcgtgaaggtgcgcaaaagaaattcggatctcactttagaccaagaatttcagatgcaataaggcaacctctgaagtccaaagttcaatgaatgcacaacagttcaagcagcagataccacctcagaggaaatatttagtttgcttctttgtttccctccagtgttaatcctgctaatgtctgctaaggtcaaccatgactggaacacatgctgctgatccagttgttcaagaccagcctgggcaacacggcgagacactgcctcagaacaaggagtgaaaacaga

SEQ ID NO: 76 - DNA, 500 bp, Rattus norvegicus
  Genbank Accession No. AA799812
aaataattcgctacaatcctgccacaaattaaagaaaaaattaacatggtattcacagagcagaattctttaggacaatcaaaatcccagagtacttagaataaattaacatcaaattgtgtttatattcagatagcctgattctctcctctgaaatgaaatggagaccattgtaacctagggtgaacgaacacacttgttcttctgtatagacatgaattctttacataaactcaacattaatttgaatcaagttaggaatcctgagaaagtcacccacctacaggcatacaaagacacacacagacagacacacacacagagacagacagacaggcaggcagacacacacacacacacgcacgcaccactcttgagaagcagtgtttctcatggacacttactagaaggtcatttctcagaagggtctaaaattctgaatatttggatgctatcatccccccgcccccaagaaaatcgtcttgtttcaagtgtgacag

SEQ ID NO: 77 - DNA, 187 bp, Rattus norvegicus
  Genbank Accession No. AA799816
ccctgggatcaactttattgctcatgggtgcagcctcctccccgcacccttggtctctccagtggtccacgccctccctccacaggacagcacatgcagagtgaggagtatcaccatcaccactgtctcgttgacccgggccacgacaccctttctggaaccagcagagccttcagactctgtggac

SEQ ID NO: 78 - DNA, 570 bp, Rattus norvegicus
  Genbank Accession No. AA799832
ggaggttaaaataaggaaattctggtttattggctactaaatatcctagcaagtttttgacagaagcgcggagagaaaacggaaacaaacacctatctgggaatgtttccttgcggcactgaccttgatgacagcgatcatgccttgcttaacagtaaaggggcactaggtcacctcctcaaagggtgtgataagccaacctgcagttcccaagggagacaaacataagcaaacacatcccatgcctggcagaggactctgccctagtccatgtgcctgcaggagctgccaggtccctttccctcaggcaaagagagccagctgtgacaatccacctctctgtcccaaagggcccacaactctcccattaaatactccagccccttcagaatccttcatctgccgctggaaaatccttccccactgcacaagaaatggctacattcagagggatgcagccagcttggcagctaagtggatactacacgcaaaatataagaaaggaaagcaccttcgtgtgtgtcatgttggaggtgtgtcattgtgaatcatagaaaacctataagacta

SEQ ID NO: 79 - DNA, 499 bp, Rattus norvegicus
  Genbank Accession No. AA799861
ggtaacccaaccaattctttattgtaaagatgagtgctacaaaggaggcctagtgtgtagggagtggggggtcaccttctttcaagggactccacaaggtccactagagatgacatatagccaaggaataagcctgagccagggcagcagtggttctgaactctattggaagttggggttctgaatcaagcccactgacccaggtccatgaggaagtgttcaatgtcatcgtagagactattggtgctagacaagcacaggccaagactgctgctgtccagagaggacacaccctcacgctgcacgccttccagatgtgtcttgcacagccatggctccagcttcaccaggatcaggctcttctccttgggcctccctgctgacaagtcttgcccaaaacccaggtagatggtgtaatgtggtgatccttgtcgcctccgggcccggaactcctccagttctcggaagaaatgctgaagtcaaagatgggagtatggca

SEQ ID NO: 80 - DNA, 391 bp, Rattus norvegicus
  Genbank Accession No. AA799888
cctgggatgacttatctgtggaaagtagactttagattacttgtccagactcctagggccagcatgttctgaggatagcagttttcagttctatcttttgaattctacttgtgtgtacaccttggtgatgtcattgtacctgccttcaggggcctggtagttagggacaggcggtgtgtaatgtggcccttctttctcaaaggggaataggctggtgtcccgctttatggcttcggcatagagctctgtagactcaagtttcagctgttccagggcttcctgctgggcttccagcatggctctgatggcgtccctctccatctcatgctcctgctgcttatacagtgcccacctcttcagcagaagagctctccgctcactctcctcaaaa

SEQ ID NO: 81 - DNA, 523 bp, Rattus norvegicus
  Genbank Accession No. AA799893
aaaaagtttattgtaaaaaaagtaagccattcacaaaattgaatgatttttagcagtacagctaaaacccaactgcatggcagtgagaagtagtagagtggcccagaataaaggctcttctcttaaggatgttccttttagccaataacttctgtagcatgttttttaaacaaattttatgacagcagttaagcctcatagcagattccttcctaaaaaagcaaacaacatttagaactagccttttgtggggccaattcccatcattaaactagtcccaccccctcccattaacaatccacccaccctcccaccattttggggaaatgtatctaatattactttgagccattgctttaagaaaatgggtcaaaggaaggttaaataaaattaaagggccaaaacatattgtcacaatagaaatgtattcattcccttcaagtaggacttaataggcattaattaaataaaaacaattcatctccagaaaaaccaagtgcagcttaactggactagttttggc

SEQ ID NO: 82 - DNA, 452 bp, Rattus norvegicus
  Genbank Accession No. AA799964
ggtaaacaaaatttaatgtaaccatatagtcaaataatgtttaaaagacattagatacaacttttaaaaatttaaactacggaagaagtgcaattaaacaaaaacgtaagcatttactatactgcagcggaactgaggacaaggacgtagaaaacattcttttctcactgtgaagattcaaactctaggcaagaggtgtgcggcagttacagtaaagcacatacacttgttcagatctgaaagtcttacctcagctctggaggcttagacactgcagggggtaggggtgggggtggggagatgaagaggaagttgctttctcaaaaagcctagagcagaactattgatataatgacaagcagaaataactacacgtacttttttcactatttcaaatgaccttaggagagcctaatgggtatttaactgagtagtttacagagcacctaggt

SEQ ID NO: 83 - DNA, 712 bp, Rattus norvegicus
  Genbank Accession No. AA799991
  misc_feature (1)..(712): n = a or c or g or t
acaatcagtaatataatcaaatacacaattatatacaaggattatatacattttgcccagacttttacatcacagtacatagtttccattaaaaatattgtttacatttatcaccaaacaataaaacccaacaacagtagtgttacagcacctgttagtacagacagctttttcataaattacatcataagaaaatatacggctgtaaattgggcttttaaaaatgtctttttataaaatctgaacatacaatgtttcattcacagaatgtttttttttttcaatgttctgactgtacccttgtgcataaaacaaccagctggaatatttagtaaatgctaccctccctctaaaactataagcactgtttgaattacttaggctgagctttctttatgatgagtctggcatggagtttggtgagaaaacaacgctggctttgctataanaaagtcatatgatggtaattaaatctaaagattccaggaaataatacatagggaattgattcagaaggcatattttcattagaatactacacgtaagaaaaggaaaggaaatgcaataatgtccaaaagtaaaccttcggaccataaaggttnagaaaaaaacattcaattccgccaaatccagattacatctccattatttaggaaaatcaacagctaattcagggttagggaaacacattcaggaaatttgctanaccgtg

SEQ ID NO: 84 - DNA, 633 bp, Rattus norvegicus
  Genbank Accession No. AA799992
  misc_feature (1)..(633): n = a or c or g or t
agagtgaaatgatggcagtgatgtcaacatcatacggggaacaccaagtccacactttgccccgagtcaactgcaaccacatgcgtcttcttgcttaaggcacctgagcccacagtgacagaataggtccctggatagacttctatgtagaggtccttagagatgttctcaataggccaagatgactcttgagaatgctctgatgtttgatagatgcttcctggaccaacagatgtctctcctctgcagtttctctgtgctcactcctgccatttttgttaagcccctccactccactaccttgagatgactcgagctcaggagagccacctgcctctgtctcccaggtgctangattaaaggcatgcactaccacgcctggctcagaaacagaacctctagaacaacccatttgtagtcccacatgtacaagattatgtggcttttaagcctgctaagacttcagagcacctcgtgccgattcttggctcagggcaaatccctatgtgagtgtataaatcgtaacattcatgctgttccgtgtgattgtaccgccaaattcaaaaaattcaccggacataatgtaagctgcgtgccaaggtggctaccacataatgttggccacgccgcttc

SEQ ID NO: 85 - DNA, 460 bp, Rattus norvegicus
  Genbank Accession No. AA800015
cacaataaagtttattatgaaaacaggctcatgtggggacagaggggaagacaaatacatctgggttgggtggctcaggtgaagtagtgcggcttcttcacattgatgccatactcgctgagggcaggggtcaagtcctccatggttagggtgtacttgcgatccttgctcttgctccgggagctgccagaggctgtacccttcattttgcagtgctgtagggcatcattggcaatatctgagatgaatttctgggcagctagtgagatgagccgaattatgcgtgggtctgaagcttcaaagccagcacggttcaggtagtaaccagtcactgcatccgggatcgtaggtgtataatcctccaactgcatcaagaagtccactagtggtgtgctggacactacgggcttcacttctccgttggccgcgctcggtagggcgtaaaccccgtcctcgtgcc

SEQ ID NO: 86 - DNA, 613 bp, Rattus norvegicus
  Genbank Accession No. AA800016
  misc_feature (1)..(613): n = a or c or g or t
gaaacagtcaaaatctagtcaggtagctcttatgacaataatcaaaattaattttataactttagcaatatatatcgaacacttacattcaagtgtatagaacacaatccattaaatcttgaaaaacactgtaacaaggcttgaaatgactgcacggtggcaatctagcgttcctctgcccattctacagttatgggaaactcagctctgtaaacacagccagcaaatcacagcactggagcggtcagttgctctgacatgccctgccatagttttgacagtagagggaaacaattcttacaacattacttaaaaatagatcttagcgatgactcatccttatgtacacacattatgctaacctgtcacagacagtaaatgtcagatttatacactggactctgtggagcaccctacacatttagaacttactatgaaaataaacaaacggctgtcaaatgtctctggatggtctgctccacctgngaggatgganggctgctctgaagcactgcgctcactgctgcttctcaaaggcaaannacangtaaatgcttgtagctttccagtctgactttactaacgttcccagaggtaaactttactgactggt

SEQ ID NO: 87 - DNA, 613 bp, Rattus norvegicus
  Genbank Accession No. AA800034
  misc_feature (1)..(613): n = a or c or g or t
aaaaacaaagtttaatcatacttattaataacaagactttatataaaaatgcagagtataaattcaacttccattatttcagttaacttccaattatcctttccaaattaaaacaaaataccaaacagggcaaattgtaaatttaaatccaagactattaagttacaaatggagtaaatcacaaaataaaaatgcttaacattaagaatctacctatcacataagagaaaaaacagaagtgtgtgcattctgaatgtcctattttaccagcatgatgtatggggtccttttatgtacaaactctgccacgggatcactgttatgtctcactgaacttcgtaatcctatgtgcaacatgtgcaaggtggagaagagggtccacacttagcatacaggactgacacactgattccttaagggagttgatgatacggctacagacttcacacagagaaatgtatttggtagcacagagagagctaaacattttgagagttaanaacaaagacagtcagtcattgggaaacattcaaggacaaagagaactgcataatcactctcacaacaaactttattactaattaaaattaaaatttgaggtgggaccctagtt

SEQ ID NO: 88 - DNA, 514 bp, Rattus norvegicus
  Genbank Accession No. AA800036
  misc_feature (1)..(514): n = a or c or g or t
acataaaactttcaaggaaccatgtggatccgacagaatgttaatagcacatctaagaataaacctcaggtagtcaacattcacaaaatgttgaaaactgattaaaatatacgtagtatggagagctacgacttcactacgaggcaggcatgtattttgacttgttagcaccgtcatttacagttcctcttcaaagctacagtgaagaatgaaatggtcaatggtaaaatactgctccaacttaaagtttagctaaacaaataaaaataaagttaaaactaccctctgcttatccacggttgttggtggtgtaagtactgtacagttctcgtaacgatattttattaaaaggcctgatagtaagtggagagagtaaaaaaaaaaagaattaaattaaaataaattaagaagcgaaagcagtcacgggacaagaacgtggacattacaatgactaacacgatgtctctttcngagccactttagcacagaatttttacgacacagagcagataat

SEQ ID NO: 89 - DNA, 648 bp, Rattus norvegicus
  Genbank Accession No. AA800062
  misc_feature (1)..(648): n = a or c or g or t
tgctgacatggctgacagtgactgtttattgagcatcatgacacaactgagactgtccaaaactaaatgggtacagtctgccacaaaatacatttcactgtcaattgtgaaaattaggaagataacaagttctgttcgaagttttcataaatacattgatttctgaaaaatattgttaatactatattgtatgaaaatctaaaaaaatatgattagaaggaaaaaacattaaattgattatacatataagaatttaacgggttggggatttagctcagtggtagcgcacttgcctagcaagcgcaaggccctgggtttggtccccagctccgaaaaaaagaaaagaaaagaaaaaaagaatttaaaataatgagtttgtgctaagttcttgaactcaagtttttgaagtgttactggcaggcaaaataattaggaaaaagagaacactattccttaaaaaaaaaatactgcttttataantggtattttatactcctcganaatacaatttcgagagtcagaagtcctatgattggcccattaaatagtgtcaaatatcatcctgaggactccagccaacataatgatactgcactgctgtcactaacagcaaagttgatgacatgggggtctaagaaagaacaagag

SEQ ID NO: 90 - DNA, 599 bp, Rattus norvegicus
  Genbank Accession No. AA800169
aaggtgtcatgaacttcctggtagtaccttagttaggtttccatctctgaccaccatggacaaggcaactcttagacaacacttaaatggggctggtttacaggttcagagtttcagtccattatcatcaagatgggaaacatgggcagtactggcactgctgagagttctacatcttgttccaaaggaaaccagaagactgtcttccaggcagctaggagaaggtctcaaagctcacttccacagtgtcgcacttcttccaacaagtccacactactaatagtgccattctctgggccaagcatattcaaacacatgagtcgatgggggccaaacctcttcaaaccactacaagtagaattctcatgaaatatgacttcatgattgctagactctaatacaggatttttcatcttgtcttttactattctcagtataatcaaacactgaaatatttacttatgtgactatataagtcacacacaaaaatgtaaactaacattaattaggaaaattttcaagataaattacttagaaataatttttataatcccaacacttaggaggcaaaaagcaagtaagtgtaacttttttccccc

SEQ ID NO: 91 - DNA, 562 bp, Rattus norvegicus
  Genbank Accession No. AA800179
caggattataaaaggctacaactgtttaatgggaataacctgggacaagcagggggagctttgatgggcagggttgggcagcacaggactaagaacccaaagcccagatagcccacagctctctctccacagccccgccctgaaggatgccggctgcacccgttccaaggcacacattacagacttgcagcttcccatgggctaacccactatgcctctacatttaaaaatacgctttcatcttctctgtagtggagtctccagtcgtggtccttgtctagcacaggtgtagaactgctttgttgatctctgggtttgtccagtcgctccgaatgtcatccaggtgattatcaaaatctacaagtgtctcataggagcggctgtccaggagcgaagcggagatcctctgagcctccggccaatcttcacagtagtcgtgatgtgggtctcggcaccgccacctgttctcgtgttgctcatacacgtggatcgtgggcgctgcacagtccatcgtgaacttggcgttgtccaccatgatgagtgcagcatcactgaagccctc

SEQ ID NO: 92 - DNA, 693 bp, Rattus norvegicus
  Genbank Accession No. AA800190
atgggtatagaagtttaatccatttctcttacaaggaggtaacagtaaatagtagaggggtgatcatgtattatggcttcaagggacctcatgcacagggcagcagatgaccagccccagaacctgcccacccacccccaaagctaccacagtggttccggtgaattgagtgctgaaaacagacacctcccagtaaacactgccagggttgaggaaagtgaggcgttttcctgcccatcccgaaccagatacagcaatgcaaggtggtgaatctctggaaggagttttatgtagttctctgacaaccctactctgccctcagggaggagcatggctcctgtagtgggtgggcttaaccgctctttctcactatgctgctgtagcagagtgggaaccaggccctactgcaggactagcagctgagtcagccagggcagaaatatccagactgaccaagtacaaggtttacttgcaaaaaaaggaaggctttagctagtttcaattcctcatgaagtgttatttcctgttgaaaaagcaaaggactaagccaaccgtctataaaattgccagtccttaaccaaggcctcaaatatgggataaaggtctctctttagtctcctcttcagggttctggggttccacatgacacccacagggttctacaggtggctacagaggcatggccccatatgg

SEQ ID NO: 93 - DNA, 591 bp, Rattus norvegicus
  Genbank Accession No. AA800191
gattctttattcctctgctgcacagcagtgtacaaggtggacttcgcctgactccatttcttgcagaggccgccttcagtctgcccacttcagccaatgcatgaagcagaatgcttgctcagaaacgttttttttttttttccaagtcattttcacagggatgtggggtcaaggggcaacattacacccaagaacaggaatccaagcctcagaggaaaggcactgcaccagaccccctgcttctagggaagactgatgcagagagggggaactcaacagcagattgtagaaccaaggcagaggaatgtgagtgtgacgctgagtagaaggaacacagcaaggcaaacaccattaggccctttccttcctcagttctgagcataaacttttctagggactaaagtagttttagttccaaggtctggttttgctccagggtgacagaggccacaccaggcaaagatctcacaggtgatacaggcagagaggtgtggtacagacctagagagatgttctcaggaccacgtgcaggtatagcagcttggaggctgaaggccagatcagggtaaaggatgcacttcataactccaa

SEQ ID NO: 94 - DNA, 543 bp, Rattus norvegicus
  Genbank Accession No. AA800197
  misc_feature (1)..(543): n = a or c or g or t
acaaaacaaccatgttaggaaagacacaaaagtagaagtaaatgtctaagtaaaaactaaataaacatgccaagagctatgacttaaaaatcctaatgatgcactcggctacatccagacccaagacacaaatttactttgccacttaacaaaaaagaagcagaatgcccttcatcttcaatgtatttttaaatgtttgcacattgtgtgtctgcaggcaatggcagtatcatcaagtatttaaacaaagtcacctttcaggttgaatgaacaagtcacatcgaaatgtgcaatatattccaggacagccagggctgttacacagacatgctgtcaaaacaatacaaactccccaaacacctcaatataaatgtttaagaaaacaccagtattatataggcaatataattcattacaaaatacttttcttcataaaactatctgctttagacacaaaaggggtatgtggcccttctgtggtgctaacattaccagcttacacagattcgtctaacactgctctangaacagtgctgagaatgt

SEQ ID NO: 95 - DNA, 476 bp, Rattus norvegicus
  Genbank Accession No. AA800200
gagcacttcaacaactttattggctaaatgtttcttccccagtttacagcttgaactatgggcttattcacagggtctgtcttaatccgtactgaatctggggccttagtagaggctaaaagctagaagtgagagtatgagttagaagcctgctgctaactcagctgggcaacggtccctacccactgccgtgttcagcgatctttacatgtaatggatggatacaggcctgggacacacctgccgccagcctgttacaatgcctctgatggagtcatcaccttcctacttcagggatggggtgacactatggcaccctgtgcaatttgcagaagtacatacgtccaaaattggccatgaagtttggtattaccagctccccaacctgtcaggatgggaggaaacagaatgtgtccatgaaaagctttcggaagtgagacaagtcttccacttgaaccttgatgttgtattgattg

SEQ ID NO: 96 - DNA, 543 bp, Rattus norvegicus
  Genbank Accession No. AA800202
gagtgacagtttattggtccttagcattacatcttaatctccaagtgaaattcacagacacaactgcagataaaaacatgtaaaataatataaaaataaattgaaggctacttttatatatttactgaattaagtagtgtaataaatactataagcaaaaagcttcaatcacacaattcagtttcactgaagttatagtagtgtttgtaaatatgaattttagagtttaagttacaaatattaaagcattgaaaaactagtataaaagtgaattttggcacgtaagtgagctcttcattagtatttgacggtgtgggacaatgagaaagccacttcccacctgttttttgaggtacagctatccaactagtcagcagcatggctggaatacttaacagtttacagtctttgaactgaacttttcccttttgagaagccagagcttattactgtgcaaaaattctccaagatcctaacaggattcagagggacgtttttattgatcacagcctgaagggctagtatctaggcctcaggtcagag

SEQ ID NO: 97 - DNA, 582 bp, Rattus norvegicus
  Genbank Accession No. AA800210
ttaaagaccttcatggcacaacttcttcccagcacagttatgtcttagtcataccaattacaatacaattacaaccaataaatcagggaggggaattctgactttaaacttaaagagaggaagggcacacttcaaagcaaagttaaaaaatactttagagtaactgccaacacagctgttttatattggcatccatcccgccgtctaagcaatacagacacaggaagtgctgagaaatagtgtcccaatacaaggtgtacagatgaggtaatttacaacacagaagttgttactctgtaaaccctgaccctccctaccccaacccattcagatcttttaaactctccacatttctgcagtgactccttatttcttttaagctttgatttattttaaaaggctcttaggtggcactccagagtcctctgcactcaccctcagctcttgcacaggtctgatgtgtgaggaggcccagttacctacagctgtccacaccagtctcagacacacctatacttctgagctgtgaacggggtgtggagtcctgatccacaactttcctttccacctcaaaaggaagaa

SEQ ID NO: 98 - DNA, 680 bp, Rattus norvegicus
  Genbank Accession No. AA800222
  misc_feature (1)..(680): n = a or c or g or t
ggacttagcttccactttattttcatgtgcatcatggaaaggtgtcaaggacaaagacaagcccagtgctgcctgctctaagtaaaacacagaagagacaacacctcacccagttcaacagttataaaacccccaacccacagagcagacacgagcagtgtgggagtccaggggtccccacacaacatgacaagattttgctttttattattgttgctttataataaaaacaagttgctatgctttcagcaaaacaaaaacaaaacaaaaaaacccatagaaatttaactaacagcagttcaaggtaaggcttttgaaagatttattgaaataaattatcttcgcctatccgcctgttatccttttctcagttacttgtcaacattctaaaaactttcaggtatgtaaaatacatttaactttgccaataattttagataatactggattttccccaaaaggactaccataaaactatgttttgaaacattaaaaaaaaaaagcttaatccaatgggacataaaactatgtaacctatgattgcatgtttcaaatccttaaatacgtggagaatttgagatctgggaacaagactgcttgaggcatgtggattattcaatgtcctgcttctatttgatgagacccacaggaaccanagcaggagaatgaagggctccggg

SEQ ID NO: 99 - DNA, 579 bp, Rattus norvegicus
  Genbank Accession No. AA800298
acccggaaaaagatgtctttatgttcttacatggaaaaggatatcggggtctatagcatgatgatacagacttttcataaaattcatctcaacgaatctgtttcagctgcagtcataattcaagacttgtcaaatggaaatcttaagatcggcgcaggggatgggaagggggagcgttgggggaaggtcaagattctgtgctgcttcttcctagaattttaacttcccagcgagtcaggcttacatcggcagatgccgcactcaactatgactgggtagacaggcagaaccctacagcatgaaggcaataatgttttaggggaccatattaagtcccgatatcggaggaaacatgagcaggatctttggagcagctctctttctctggatgtatggaaccgtgcgtggtatcgccaggcgcttggttcacacatttcttagggagggagctatgtctcacatatctaaaaggtgatgctgttagcaagcgcaaaggacatcttaccctcgacagccagggttggaaggaaggaatggctttctgaagaacgcacggggcaaccatgccggcccctgttt

SEQ ID NO: 100 - DNA, 556 bp, Rattus norvegicus
  Genbank Accession No. AA800305
ttttacaccactttattccaacctgagcacctcaatataaaactaaacactggtgagctgttctccttactaattttgagttactgtaaaatgtacacattctgctagcagatcaacacttaaatagattaaatcatctgacacatggtagatttcatataatgaaaatacctaaaataattagtgcaatatactgattaaaataaaattgacttcaaaaaacaaggcttcaagattactaataacattgtaatacttatgttacaaattgcaagtacggtgtttattatggttctagcatgtaagaacagcaaagccccttcctttcatagggggagaaagaaataattagctgttttagtaactgtacattttgtatgtttaggcaattcttaaatattacaggaaataataaacatatggagactacaatgcagtactctatttacagtacagctgaatatttaaaataatcaagtttgaatgtacataatggttagtgcactgactaatcatgtccaaagggaagcagagccccctccctgttctagcctcg

SEQ ID NO: 101 - DNA, 560 bp, Rattus norvegicus
  Genbank Accession No. AA800318
gaaagtgtctgcaagttttatttgtagactctgttaagcttgaaccataaaagctgcaaaacagtggtttagagagcatgtcaataccatgggggttggtgggtggaaactgttccttctgccagttcctaaggctggaagtggctagggcaggcagtggcgaggaaatagctggatgagctgaagcttgggtggcagtgcttactcaagcctgactcctgcctgtctcaggccctggggtcatatacacggcccatgaagactgggaacttgtgtcgctggtcccagagcaggaagaggaaaggctgctgcacctcaaagatgagtaagtttcgggccacggagatggtggaggctgcggctgcttccacacctgtctctgtcagttccaacaccgtctcgtgtttcatggaagacacctgaagatctgggtcctcagtcagcccacacaggttgagatcgtaagtgaagtcaaagaattccagtttctccatgattgacagcatgtcttggatgctctttactttaatgcgaggcatcatcacgtaagtgggctgaaa

SEQ ID NO: 102 - DNA, 530 bp, Rattus norvegicus
  Genbank Accession No. AA800549
gttattaaaaggaatttaataatcttaattaaaaatccataacagcgaattccgtcacaggcctcggcagctgggagtaactccagaggtacaggccccttggtgatacggtcagaccccaccttggaggcacgaagctacttcaatacaatatcaaagatccatgagaatattttttttaaaaaagttttaaatatattagactcttttgattgccatttttacagaaagctgctgatacagtatacagagtttttaacttttttttcacataaaatacattttttttcttaagtgttctctgtacatcagtggcttctggtctggtgaattattgcggagggctgggtgtctgcagacttttccagggtgtgcagagccaggccccgcacagtggcattagaagtgcccatgagaaggaggccctctggctaacaagggagaggccttgggctttctagaaaaagagtgggtcacttcagtggagctgtccaccctggccatttgatccttggcttttctgtgccctg

SEQ ID NO: 103 - DNA, 572 bp, Rattus norvegicus
  Genbank Accession No. AA800551
aacactttgtaatcagtatattagacagtcatacatttcagtaactgcttaaattctgataaccagatttaagcatgtaagcatgtgacttcaaaacatacaacaaatctattcataatttgctatactaccaacattaaattgcagttacgttggagcctaagttgaatagaaagcctgtaacagacccaaggaacgcctttcctggactatacatgcaaatcacctctcaacatacagatctcactttaatttgtaagttacttgggctttggaagtcactacacccaagcaagggcctttgggaaggggaaaaaggtgatgttttcagtttatatatatatatttatatttaaaatggcacagcagaagggaatgcaatctagaagagcaagcccttaagcagtagcttatgataaactttaggaatgtatcatttctatcactaatatcacaggcgaaatgtattatgccaccttctagtaatggctgaggcaatacaatgcaaaggcatcacaattagttcacttcaacaactagacagaccaacatgtaactaattgttttctttt

SEQ ID NO: 104 - DNA, 506 bp, Rattus norvegicus
  Genbank Accession No. AA800613
cacactcaagattttatttaaaaattccaaaaaaacccacaaaaatagacttgtacggtaacaatatattacttaatatattatagtatatacttaatacagtatcagttttaacattacaaaaagaaaaacggagtagacgacccaatatatataaatactataaaatcttattacaataaataaagtcgtcataaataaagggtccattggttggggcaggggcgtgggggaaaagggatttggcaatggctttggctatttgctttgggagggaaatttgagcaccaggattctcaggagaggctacaaccaccggacactgaacttcggggtctagtaaaaattaggatactattgtgggagccgggtcttcacagcacttaacattccaggagaccagagtttccgaggggctggtgcatacctgtaaccccagaacttggaaaaggctaaggcaggattatattgagttcaaagccagcctggggtaccctagtaatccc

SEQ ID NO: 105 - DNA, 539 bp, Rattus norvegicus
  Genbank Accession No. AA800651
  misc_feature (1)..(539): n = a or c or g or t
acaaacatagactttattaaatgctgctcaatccccagtgaagatctttcattataaaacggttttccatacaactgcaaggcaagaggttggaatggtactgataacaacaggtgtgaaaaatacccgaccaggtaaaaacatacaaggcttctacgcagtcaattcagagtttgcccactgcatttcccttacacaaagccaggcagtgatagctagcagtccgcatcacactgtgggacccagggcctccttcaccctgcaggcaggcctgggacgggcaggttgaggactgggaaggccctgcctccagccttggaggaatgaaggaggtgagctagggtccacccgccggtgctgctctgcgcacgctctgggtgctgctgctgcaggggatttgggaacagtcaacatttggtttacttccccccagcttttaatactttgtgcttcggaagcctggaaacgcaagatgttgcaaaacccagagtatggcagtatctttaatgaggctgggcctttatctcnccaaccgcctc

SEQ ID NO: 106 - DNA, 590 bp, Rattus norvegicus
  Genbank Accession No. AA800671
acataaaacaattttcaaagaatacatttaaaaaccatctagatactgattttatagcattacaaaaaaattgagaggcacaattgaagtattcaaataaaaggtgaaggtgaaggtgggggtctctacttgctatccactgtgtttcctgggactcctcctacaggagccttcccatgaggcagtagtgcactttgaataaatcgaataaatcacataaaatatatacttttatacagaaagtgttgctgtgtcatcactttcaattgcttataaaaaacttcattttgaattgcacaaaagttctctttaaaaccggtaattcccagaaggcagggcttagaactatatgtctaaataattcattacaaattaattagatctctatttctccacagataaaaaaaaaacaatctgtgaagaattacatcatttaagtgggacatttaaaaattttttttcataggaaaataggtttatacatttgtccctagtcagctcaactttctccccctactttaaaacaaatcacagggcgttcagaacttttcagacggagtacctgtgccacagtactgggtgtgtcccat

SEQ ID NO: 107 - DNA, 698 bp, Rattus norvegicus
  Genbank Accession No. AA800673
  misc_feature (1)..(698): n = a or c or g or t
gggtaaaggaagtatatgtatgcagcgtatatcacatcgtatgcagcgtgtaacatatggtattaattgtctaacagtttttttcctggcacttgtatgcaaacagctttaccaagaggctctgtgcagcttttgtaacatgtcatgaagcatgtaactaaatggtgatctcaaagaatacatacaggctactttgtgtctggctgtgagaaggagaatattcacagtggtgttctactgcagttcttctaacaacccctttactaggatgcagtgggactaaaaaaatggaagaaacctcaggtacacttaaatacagcctggtactccctattaagtaagttccagcaatctacttttctctgttgtggaaagagtaaacctgaacaggtaccaacgtgaaaattcagtgtataaccaagtaactgctaaaataaaagttgtatattcatggaaaatagaaatggtaggaaaactattaggggattaaacacattgtttttgcatttaagttaatctgaactattataatagttattataaataactattttagttcaggttgaagcaataaagttgctttgcangtattttctgatttactgaatgattccatggtgaggacnattgggaacatcccataaactgactaatcatgaggaccgttacaagggtaaacacttcacaaggtgaccttg

SEQ ID NO: 108 - DNA, 452 bp, Rattus norvegicus
  Genbank Accession No. AA800678
aaaacatgattacaagaaaagaatacttcatttacgtgtaacactgtcttcatggacgtaccgtggtcacggagtagaaatacaacatgagtatacaggaaaggagaggagagaccggtgtttggccctggtggccccctcacagagacacagaaagcagcagacacctctgtgcattcaatgggacagtggacacttgtgtttggagcagccagagagtcagggaggatgggcaaagccacctctgggaccctaatttcgtgtggtaaccccaaagagatactggtctgcactggtggaggctggctcctgtcaggttcttcgcagccttcagggacaagctgaggctcctgagtgcccagtggtttgtcgcatagcttgctgggcccatgggctccatggtgtgaagagaaaaaaggccaaagtgggcgactggctgatctctaggtgac

SEQ ID NO: 109 - DNA, 663 bp, Rattus norvegicus
  Genbank Accession No. AA800719
gaaaagcagccttttaatatctaattgaatccagtgagtgggaaagactcaaaacatatgtccccttgagaatacctttacaagaacaacaggccagaggcgtctcttccatgggaaactgacatcccctgtgtgctcacaaaagtgaggtctcaactcatatgcatgccacatagtttccaccccatcccaccctgcccaccctccacaggtgacagattcacacaccgaagggactggtttcttaaaccgtggaacagaatgtttaaaagaagataaatctagccaagtggccagataccagaaataactcaggggcagttttacatacacaataaaagtcaactcatataaaaagggaagttttgctaattggaatcagaggcaaaaattacaaatggcagagaatccagctacccatatgagattatttaagaaaaacaaaaaaccaaaccaaaccaaaaaaaaaaaaaaaaacacccccaaaccccaaaagtccctactggagactcccttcattacaaaagtatgcaaacatctcaatataaacgaagcccaggcccacggctcgctctctctggacaggagagcatagctaaaattccccgtgtggaattcatgcctggaccaatgccccaccctttgggaaagaaagggaaggat

SEQ ID NO: 110 - DNA, 552 bp, Rattus norvegicus
  Genbank Accession No. AA800735
caatgtaaactgatcaatgagttgtgattactctgaaattttatttttgggatcctgtgtcacaaaatgacgtgtgtaatgtttacaatgggtatgagaaattgagatgtttttatctctactgagaataaaactgtagataaggttccaagccggcatcaaaagagcagagcaaacttttctgtatataaactgtacataaaacaaggcactatacacttccgggggggacattaaggtagaaaggttgattcagatagattcttcagagtcacaccgggaagtagtacaaagtctttgctcgctttagcaccggaagcagaactcggcacaagccagacctaaggctgaggaggcagtcctgagcctgggagagactggtggcaggcctaggtcaacagaagtgacacagccctacacttggtaatgtccttttgacaccaaagggaacagttgcaagtgaatgaatacatagcttgttaaatacatagttgctttatatggtgtttatataaatatatatatatatttagaattcacaaactatcaaaa

SEQ ID NO: 111 - DNA, 637 bp, Rattus norvegicus
  Genbank Accession No. AA800749
aagcaccaaaagtacacagcaatggttggtacataaaaagcacaattattgatataatttcttaccatcaagtttacaatctaaaataaaacacaagaatattgtcagcccacatcaaagtttccttattttggaattggctactttggcaaatgaatgaggcaaaatgtcctatttcaggcaaagtattaataaggctttgaatatgacacacaaaatattttttgtgtatccattttccatgttacattatggtaactaaggacaaaaagggcacttagaaatttcataagcacaatgaattacttcagattgttctcagaaactcagagatgttcaatgacaaatgccagcagccagtgaaagcctacaattaataggaactagataaagtctttgtcttggccccatttagacctccatctccttccttactaagggctctaatgttataccccacagtgaaaggcaccatctctagatgaattactacataattatgagatcaagcttactggaatattgtctaaagagaagtgagcaaagccagcagtggggactctggctaagtgatgtcacacaagcaaaggcagtcaggcaaggccacgcacatctaaagagattgggaaagcacagg

SEQ ID NO: 112 - DNA, 520 bp, Rattus norvegicus
  Genbank Accession No. AA800787
ttagaagcaatgttgggcaaacagacaggcaaatatctgagaagagatatcgtacatcaactagcactttaaacagttgaagagaaaacatggaaagtacttacatggaccagtttcttatacaaatactaaagtgtggaaaacatcccaaaccaaatagagtattaccgtcgagaagcaaaaccagtaaaacaaaacaaaaatacaaaaaaaaaaaatacaaagatagtgtgtattgtctataggaaataatagtgtaaatagcagacataaactggcccatgtaaaatacaaaaatatttattgaaatcagatctttctataaaacagtgctttggaggtatcttaatatgaatccaatatatgatctaaatgtaaattcgtttagaaacattaacagcattaagccagtgccacccacttgttccaattagtccttttttaaaagctgttttgttgattcatgacaaatacataagacctatgttcttaaaagcacaatccattcttttagaattaa

SEQ ID NO: 113 - DNA, 528 bp, Rattus norvegicus
  Genbank Accession No. AA800790
acacaacaagaggttagcaactacacaggctgccactttaagtgaccagagccaaacaaaacacaattctttcacatggctttattacaattgcatgttagacacgacacacccacgttttgatgaaaacagtgttcctttggccgttgcacatgatcaatactgagcaatgtttgaacacagaccaacaatagcggtagaaaatttagggagaaaacagactgaattcactcataagtcttttgacctctaacatccctgggaacactatttttttgcattgctatgttaggcagtgtaaatgttagaaactatgctttaaatacgatggtaccttctcttatcttggcttcaattatgcaaagaaagtgtgcatgtttcttaccacgcctgctctgtatgctaaaattttgaataaaaaaaagccactgaatatagttttattgcatatattgcatggatagtgttcttatgccatttcatgatttggcaggatgattattacccatgagtctaacatgatgagag

SEQ ID NO: 114 - DNA, 310 bp, Rattus norvegicus
  Genbank Accession No. AA800844
aagtaagattagaaacaacaagattttttttgaggctgatgagtgcaaagagaaacgctaaacatcagggggccggcaacagacaaaatggtgttgtagaggagacttaggtacaaaacggggtctggcatccagaggccctgtgggtttgggccatgttcactccctgaggccggcggggagggatgccccagcgggcagctgccctcgccctccggctaggcgggtaggcttcttgggggaggcggcctgcaagcaggtcctgcttttcaaggggagacaacgggggctccgtccactgagatcagga

SEQ ID NO: 115 - DNA, 528 bp, Rattus norvegicus
  Genbank Accession No. AA800853
  misc_feature (1)..(528): n = a or c or g or t
gggaaggagagggtttatttcagcttacagttcaacatcacagttcatcactgagagaaaacagggcagaagctaatgctggggtcacagagagtgcatctgtgtaggggatttggcaggtagcctgcagtctggtcactcttgaggacagcattttgctagctcagccacccagccacaactcagccgggcccaggaagcgacccagcgtcattgctatgggtcgtttacacaaaccacaccagcatcaattaacacttttttctgtacctgatgccacagtttaaagaaaaaacaaaacaaaacaaaacaccaacacacgactatacatcatcacagttgggcagcccatgggtgaggtttccacagctactccacaaaggtacccatcctgcgtcaggagatccagcaccttgccacagactgcagctcacaggtgcctgtacactgaatattttggtctaaaatttgacctttatgggatggggagagcnctctttgttcttaaacctggatatccttcaagtc

SEQ ID NO: 116 - DNA, 358 bp, Rattus norvegicus
  Genbank Accession No. AA800855
ccataaacacctagttacaagttgcacaaatcatttatttttataaaggcagagaagggaatagatctacgaggaaaagtaggggtgtatggcaccagggagggattgtgtcgtggtagaggtggctaggcaggggcaaggtagagagagggggatgacaaatggggggaaggggggtggtgcttagaggggacgtgttggttggccgcggggcgtgagccagggctgtgggtgtggggttgggggggtcgtagggagcagccccaccggctctgcctctggtgagcttgggcaggcttcggtacttacagagactgtgagcccagagcgtttctgtcatttcaccctgtgccccgag

SEQ ID NO: 117 - DNA, 297 bp, Rattus norvegicus
  Genbank Accession No. AA800908
aagtaactaaaatcgaacttatttttgcttaagtaaataggctaaaaatgaggaaatacaaccaacaagaaaataaatgttcaaagcactaaaattctactaggtaactctttggttaggttagacgggtattagcaactaagtttaggactcaaaatggctcgatagacttccagctgaagataggtcttttactaaccttgataaaatctaagtttacacgtactgtttcatatttttttaaatgtgcacgtactcaagtggatcatacaaacgtccaactctcaaataataaat

SEQ ID NO: 118 - DNA, 495 bp, Rattus norvegicus
  Genbank Accession No. AA800962
catagagtcacctttattggagcttgacctgttgggtttgtaaccctcaggctccacaggtagctggggcagggatagagtatcaaaaagggatgagttgagctgctgtggctgtggggattggctggaagctgctggcaggttggagcagctggagccctggcagggtaaaactgaggtatggcagcgttaataatactcttggagcgttaatactctggaggggacaggcacttggggccctaaggtgcgaaggcacttggagtcagggagaggacacggcttgcaatgggactgggcaggaccaggcccggggtttggcaggcactttggggagtgctggggttggcagcttgggccctgagcagcccagaaggctttggtagtggcaggcacagtctctgggctgggtctgcattaaatacaggggtttcctcagtgctcgtctcgaagctctgaaggcaagaacttgtactgctgctgccggatctgggc

SEQ ID NO: 119 - DNA, 499 bp, Rattus norvegicus
  Genbank Accession No. AA801058
acagtgctagttgagtcatacactcttccagatggacgtattattaaggttggaggagaaagatttgaagcaccagaagctttatttcagcctcatttgatcaatgttgagggggttggtgttgctgaattgctttttaacacaatccaggcagccgacattgataccagatctgaattttacaagcacattgtgctttctggaggttctaccatgtatcctggcctgccatcgaggttggaacgagagcttagacagctttacctagaacgagttctgaaaggagatgtggagaaactttcgaaatttaagatccgcattgaagacccgcctcgcaggaagcacatggtgttcttgggtggcgcagtcctagcagacatcatgaaagacaaagacaacttctggatgaccagacaagagtaccaagaaaagggtgtccgtgtgctggagaaactcggtgtgactgttcgataaaatagcaggcttgtccccatcacgc

SEQ ID NO: 120 - DNA, 628 bp, Rattus norvegicus
  Genbank Accession No. AA801116
gatgccatgatacactacagcagtagtattagtaatagcgtgttggaggttctccttcatattagtgtccctacgcgtcctttacggttcccacagataacttttagaagtaaagtacttctgtagagaagggccagattttctttggggtttctaaggaacatagtgcttcaacttgtttcatgaagtccatagccagaagaatttcagcccgtactggcaaacagataggctattgcttttcacgggtctcctgggagagcttgaaacttggggcaaaaacactgattttttcacagatcttcccaggtctctcttaggaaagactcaaaaaaacacattgccctctttgctgtgcctgaaacccacccccattgtgtcgagtccttgcagagaaacctgtagatgtggttcataggtatatgagtaagcatctgtgtaaaagcagtgagtgtgtgctatgtaaatacgttaaattattatgctagaaaaataaagttacggaccatgctgccccatgtctgctctgtgattacagtgacccctgttggacgagctgaggaacctctggcaggaggagggaaggacttaatacctaatcagttttcatgagttgtacttgcccact

SEQ ID NO: 121 - DNA, 613 bp, Rattus norvegicus
  Genbank Accession No. AA801130
aagaagtcattggagtttattcacagttaatcactacctaccaaattgctattcgcagaagttagaggcgtaagtacataggtttgtttttttatttaaacactgatctttaaatatatacacacaaaacttagttcagcaaggcttcatgatatacaccaattccaaaataaaacaatcaaatggcccaggtgtaactccagagataaatttttatcatcagcagggaaagaggcagcagaaccaggaggggtgggaacaggctccgcccaggacgcctccggggcctcaggggtgctccgagctgagtccatctcacaaaacagagtccaggggggaccccaccctcaagagtccagcagcccacggacgccgccaactccaagggagagcctgggagtagccatgactctgctgtggggaggaggctgcgtggagagaaacggtggacaggcacatgactacggaggactgagagctcacaggagacaagatttaaaaagctttgcgttgctcttggtcttttctacctcaaaaggcttcatgggatggggcagcagagcagctgcaaacaccactgttgtgcacagagatgcaaccatgcaaccagccc

SEQ ID NO: 122 - DNA, 533 bp, Rattus norvegicus
  Genbank Accession No. AA801165
ccgtctgtttgcgctctcgtgatgtccggccgtggcaagcaaggaggcaaggcccgcgccaaggccaagtcgcggtcgtcccgcgccgggctgcagttcccagtgggtcgcgtgcaccggctgctgcgcaagggcaactacgcggagcgcgtgggcgccggcgcgccggtatacatggcggcggtgctggagtacctgaccgccgagatcctggagctggcgggcaacgcggcccgcgacaacaagaagacccgcatcatcccgcgccacctgcagctggccatccgcaacgacgaagaactcaacaagctgctgggcaaagtgacgatcgcgcagggcggcgtcctgcccaacatccaggccgtgctgctgcccaagaagacggagagccaccataaggcgaagggcaagtgaggcggctgctggcaccggcccgcgtctctacgaacccttccccccccccagagaactctcaaaaaacggctcttttcagagccacccacagaatcagataaagagttgtgtcacggtaa

SEQ ID NO: 123 - DNA, 621 bp, Rattus norvegicus
  Genbank Accession No. AA801181
aaacaaaattcacattttatttagattgaaataaactatacaaaattaattttattcaccaaaaataacagcaatattttctgtattatttttaagataaaccacaaaacatttatttctgtaggttttgctgataaatcaagatgaggcagtagacataatcatgtaaaaagaagaaaacagacaagtcagttgcctattatggatagcctctgggtctgtcttctccaccaagcagagagaataacaaaacgcttatgaaaatgtgggctcagcaaaggaatgtaaacagcaacaatcaaatgaggggccagtgcccggctctgccattcttactttaacttgctcctttgaggctcttctgccctgacagaacctgcgcaggaggctgtccttacttcccgtgactacccatcacaagctgatctgttggttttgcttttgccacaccgaggcaagagcctagggcttgcacatgctaggcaagagctccacactaagctccaccccgggcctcacttgtttctcactatgtgtgcaggctggcctaaaacatgtcatcctcatgcctctgccttccaagtgctgctaccacagattttaaacacctgtaactccaag

SEQ ID NO: 124 - DNA, 608 bp, Rattus norvegicus
  Genbank Accession No. AA801187
acatcaatcagtatcactttatttcaagccaaggttttacattaacaccaacaaactaaattgttcattcacattgacaatgtacatggtttctatttagtttttgaaacttgctgttgctacagcatgagactaatctgaaaccacccgcaagtgtaaatgtgtaccctaagggtgttgacagtggaaatcattatgcaagtttacacagctcatgaccatagtgcaaactcattaatgttgaataagtaatttatctgttttgcaaaggtactgaaaaatattaacaatcatcaaataaatgcccagaattatcaaggaacagctaaaaatgaccaggatccaaataggttatttatattagatttccccataaagaactgacaacactaaaaacacattgaaaaccactgttttaaactttgcatgtgggcttttaaaaaaatatttgtgaccttgagattttcagtaatttttaaccaagtatcatttgactgacaatcctgatataatttacagctgtactattcctgaaaggaacatctacacgcggcctgctaaatataatctgtgtctttgcaaatcaatacaaaagttctccaacatta

SEQ ID NO: 125 - DNA, 437 bp, Rattus norvegicus
  Genbank Accession No. AA801255
gctgggtatcacttgaaaacttgtccctgtttcaagggcgagttacttaagacaccagcttatatatagcttctgtgagtctggcttctgcataaactttgtaatgtttgccatgaggtttagtggaaaatgttcttttgtctcaaacttggatattgctacctgaagtaataaacaccccaagccagaaacttggtcagtgctggcaacattttttgagtgtttgtgatccaggaatcctagagtgaccgcctgccattaagatttttccaaggacagagtcatcccaaactcttgtttaattaccagataaccagattctttatcagaattatggaataaaatatgtactgtaacaaataatttttagaagaaaactgtttaagataatgctcttaacatttttttttgcaaacattgaagattacattgaagaa

SEQ ID NO: 126 - DNA, 543 bp, Rattus norvegicus
  Genbank Accession No. AA801307
aaaaagcaatttaccagggctggggatgtagttcagttggtgacacacttgctcagcacaagtccctgaatgtcattccccagtgctgggggaaaatcagaaaaaaagaaatatttactactaagtccttcctgatatggagagaaaagggagacgcgtgtagaaccaggtcttctccataggcgtttctagaacagttcaggcgagcacttggcccctcggagagcgaagctcgcacttctagtccttcccacccagatgcagcgccccctgtctgtgcctctcagcatgcagttagatttggacaaataagattcccgaggaatgactttctccatgacaccacggtttcagctttatgtaaacacacacacatccccttatagttctagtctggagatgctgctgccatgctggcctcaggtagactgtgtgatgtttttaccactcagaggaggccaagcgtggggctgaggtgtggcctgaaccttccctgtatggagtcttcaataccaactctcaagatgccacgctaccccctgc

SEQ ID NO: 127 - DNA, 572 bp, Rattus norvegicus
  Genbank Accession No. AA801310
cggccccatgggcgggtgcgtgggcgcccagcacgactcctcgggcagcctcaacgagaactcggacggcacgggagttgctctaggtcgaaaccagcctttgaaaaaggaaaaaccaaaatggaaaagcgactatcccatgacagacggccaactgcgcagcaagagggatgaattctgggacactgcgccagcttttgaaggccggaaagaaatctgggatgccttgaaggctgctgcacatgcctttgaaagcaatgatcatgaactggcccaggccatcattgacggtgcaaacataacactaccacacggtgcgctgacagagtgctacgatgagctggggaaccggtaccagctgccagtctattgcctggccccgcccatcaacatgatagaggagaagagtgacatagagactctggacatccccgagccgcctcccagctctgggcacgaatctcagctccgtctgcggctctccacgggcaaagacctcaagctcgtggtccgcagcacagacaccgtgttccacatgaagaggcgcttacacgccacggagggtgtggagc

SEQ ID NO: 128 - DNA, 485 bp, Rattus norvegicus
  Genbank Accession No. AA801346
gctgtgttgtctcctgagcaattcgcaaatgtgccttataaagccacactgggccactgggagcagtggaggcatggcctccccttccgtgcaccagcagcctaccctcctcagatacccctgggtttggcctgtagctaccacagccagttcctggactgtacgtgtctgccagacggaaggagaagagaaagtggtacgatgccttcctgacctcacccggccctcctcgcgggacgcaggcactccaggtggactcgagggccatcgctggctccacctctaaggtcaaactggacgtcagacgtcggggcctgggtgccagagggacccagaaaactgaggtccccgtctcagctgttaaacaggctgtcctggaggccctgcctggatctgggggtgctggagcagcatttcccccagggccacccacccttttttgtaaatcttgattgtaaatccaatacagttgtctttttcactca

SEQ ID NO: 129 - DNA, 465 bp, Rattus norvegicus
  Genbank Accession No. AA801352
gccgcctggggcctacgctggagcctgagccgagctggaacccttgctcccgccgctcgcgcgctgtgctcgccggactctgcacagacaggtgaacggcaccgagttcaagagcatctacagcctggacaagctgtaccccgaatccaagggcgtggataccgcctggaaggtcccggagcatgcagaacaagccagcagtgacatccctctagatcggttgagcatatcttactgtcggagcagcggtcctggagggcagaacgttaacaaagtgaattccaatgccgaagtaaggtttcacttggccagtgcagactggattgcggagcctgtacgccagaagattgccctcacggtacctgccccttctgtccctatgggtccctgaggtgggcataggcttgtgggcctttcgggtgtccctcattttcctccttggcagcatagagataagatcaacaa

SEQ ID NO: 130 - DNA, 522 bp, Rattus norvegicus
  Genbank Accession No. AA817726
ttttttttcttttttttgaaacacaaagtcccatttagtgtttttttctgatgcacaaaggagttcactcaatacattaacaataagcaaatcatacagatactgaggggaaggatgtccccttgactacatacacatatatgtatctattcttaagaacagcaatcaagaggttaacaataatggaaggaagaagtagacaggtaagtcactgccaaataacacaagttcataatgatcggttactcaagtaacctggcaaatgcctgctcagaatttacatttactttcctcattgactttcttgcctttgtgtttcagtgaatttggactaggtccaaaaactagaccttcaaaactccatctctcacattcagtgctgaagatgggcatgaaggtggagtatacttgagaacatgcatggtaacgaatgtcaaagagttttctcacagtgacctttcccctgtctgcttcttcccacacctttagaaatattttcatgcttcctctggagacattaga

SEQ ID NO: 131 - DNA, 557 bp, Rattus norvegicus
  Genbank Accession No. AA817761
tttttttttttttttttcagtcattatttcaggtttttattgaaggaaacaactccatattcattgtccaccaaagggcatagaagcagagcggccatgtgtggtgctgccttttagttcttacaacagagattctccagcttccagcccagctctgtcccctgacctgctgtgggttccttgcacactcacgcctttcataaagaaggaggtacacacagtagaacgggaggggtcgggagaatgagcacatggggtattctgtgtgcatgggggacagaaaggtctgtctgctccactgagtgtcagccactgcgattccaaacagaaaagaatgcaagttgtcaacaagacacactgtcctcaggaggagagatgatctaagtcaatcgaaaaagaacgatggtttagtaccccacagttccccagctgaggtgcgaaagccatagataggattgtaaacatgcggttggaacaggttccatagaaaactcagtttctcacggaaagcttgcacaggtgctttattggctgtgtgtctctgaagagcaaggtta

SEQ ID NO: 132 - DNA, 601 bp, Rattus norvegicus
  Genbank Accession No. AA817816
tttttttttttttttttgaattccagcgttgtttattggacgcaagtgttcaacatgggatggcatcatactgtcccatttccagagtaaccaactggcttggttacatgctacaagttgctgcttccaggtgtgtgaattagtaagctaaattcaaacagtaagatagaaacacttttgtatcaaagttgtgacttaaaaaatacaaaagctaaacccacaggtgtagagaaaaatggcagtcctgagagctgccttgaaatgtcagtcttgaaacttgtggggaggccagcacccattaggggaaatgaagggagtgggagcctgccctcttcatccaggcggccttcatactggcatatgtgggcccatccccaggctgggcaccatcattggggaagcatatggagaggcactgagaaggtgtcagggcagggccatccccttcagccagagcatgctgggaggaaaggggcttacttggcacttacaagctttggcagctcagaggggttttctgcccagcccctgctgtggctgaaccaccacaggtctctggctgggcctatggttactgaagactgggtattactccatgccc

SEQ ID NO: 133 - DNA, 577 bp, Rattus norvegicus
  Genbank Accession No. AA817823
cggccgctattctccacctgactgcaccccagcccaaacggtggcagtcatcatcccctttagacaccgggagcaccacctacgctattggctccactatctgcaccccatgttgaggcgacagcggctgcgctacggtgtctatgtcatcaaccagcatggcgaggagaccttcaaccgagccaagctgctcaacgtgggcttcctagaggcactgaaagaggatgccacctatgactgcttcatcttcagtgatgtggacctggtccctatggatgaccgcaatctgtaccgttgtggtgaccagtgccgccacttcgccattgccatggacaagtttggcttccggttgccctatgccagctactttggaggtgtgtcaggcctgagcaaggcccagtttctgaggattaatggttttcccaacgagtactggggctggggcggcgaggacgatgacatcttcaaccggatctccctgactgggatgaagatctcacgcccagacgtccggataggccgctaccgcatgatcaagcacgaccgggacaaacataacgagcccttctggtatgga

SEQ ID NO: 134 - DNA, 560 bp, Rattus norvegicus
  Genbank Accession No. AA817837
tttttttttttttaattacaaactttatttgtccatccagttcacagtttatgcgtggtacatcccaccacatcagccttcaagaagggctattcaggagatgggtatagctttctctgtaagagagccccacactctaaaattttggttagaatcttcataggtttataaaagtactctctgcaagcgaactggatatatttacatttacagcttaaattcaaatttcggaaaatatgaatcttttcgtgtttttaaacatcctgggtttacttcttaagactttcatctgaatgccacgtgctcacgtaagcccatccctcctcccccagaaggaaaagaaatcggttttgcgattgcaggtagaggactccttttccttctgggctttaaaaattacacagacagtgttcagcaggtgtgagtacagacacggagggaatggtggtggtttactagatgcaggtactgatttttttttctgaatcttgaaacatccaaaaagaattacaggatataaacttaaattataacgagttatcagccttctcttaaaaagt

SEQ ID NO: 135 - DNA, 612 bp, Rattus norvegicus
  Genbank Accession No. AA817841
  misc_feature (1)..(612): n = a or c or g or t
tttttttttttttttttggttttctgctcacatttattggggctaaagagactaaaacagttaattttcttcccaaagaattgggaaacgaaaacatataatacaacagtaatttaagtaagcacatgaccaaaacttcctggatcacgaaccaacaggagatgtgaatagcctgtagatatcaattccaacagctttacaaaatgtcattcatctaaggcatttctgtggttctcacggccacatgttcacatacataaaggcctctattcatggacagagagatacgttctttaggagcagtgggtgcaggaggcgaaagcagttacacgcttagttactgagtaattttaaagaggaaatttggcgttccaagaaacagttttgtacatccaaaaaaaaaaatcaatgataattttccacttggattattttgtgatgcagactacaagaaaatccatgctggattatttgctttccaaaggccactttcaaagtacagatttcgagtccagaacaaatacccacagcgagaacaaacagaacggctaagactctaacatttgcctccatgtggctttcctcctcnctcgattctctgacattttctga

SEQ ID NO: 136 - DNA, 622 bp, Rattus norvegicus
  Genbank Accession No. AA817849
tttttttttttttttttacaaagatttttatttggttcacagacgaagccattcacttggtctgcttaaaaaagtagagacacaatgatttacatcttaaaatagtttccttgctccagttctacttaaagatagcacaggagcagatccgctctgcttgtcttgctggtttatagggtgcaactcatcctcctgggttctggctgctgggtacagggctgagagtggggttaggtttggaaaaaacatggctgtgggtagcacgagttggcttttgttgtgtttctttgcataggtgttaggagccgagagcagctagggtgaggatccagaacacaggcttgacagtccccatcctgtttgcctgccactggcctggggcatcttgcttatctttgaggaagtcctaggaaatagtttctgtaatgcatcctgatttgaaatcagtgaaagtgttttggcagtgggaaaataacaatcccacttcagagatctcacaaacggaaaatttgcctcgcaaaaactcctttaaacgctaactgagacaaatgattccgtgggcaaggagactgtcagccagagctctgtaaaatgcattctgctagttaacagttctttcctt

SEQ ID NO: 137 - DNA, 562 bp, Rattus norvegicus
  Genbank Accession No. AA817864
ttttttttttattttttgagttttattttcattttttttacaagaatataacatgctcaaacagaaaaacagggatttcgtacaccactgataaaggaacccagctccctttgttaacaataaataaatattaacacagtggggagtccccccacccccacccaccgacagccctcagtggttcgcaaggcttgctgaggtaaagtctggtagggaggaggcgcggtcgggcagcagctcccgttgagtttcttcagtacgggcaaacaaatcacagtaaataagaacagcaacaacagcagctgagacaatcagcacaacagaacaacatagtatacttaaaaggattttctcccggagaagcctcaagtgcagagaaaacaatgctggcaacctacatctccacagccatcttagtctctggtgctggaagtcccaacttggaatgtttgttcggtaagacttctctcctttgctcagttgtcggacatgaatgctggtcccggggcttgaagcctccttcctcccacctccctccttagacctcatccaaggaggcgca

SEQ ID NO: 138 - DNA, 568 bp, Rattus norvegicus
  Genbank Accession No. AA817867
tttttttttttttttttagagaaaatgccacatagatctttattgaacaccagtgccagcaccagcctcctcctctctagtcacaggagcacatgggccaggggctttctccccctgcagggaggcagtggaagcctaacccgggaactgctctcttaaggcctcctgggtgctcagtactgctggctcaagtatgctcaaactcctgctcacagtagcccacgctgatgggctgggcctggatgttggggttggacttccagcaggtgaagtcaacttcatctcctcccaggtggagataaaagtcagggaagacagagctgatctccaggaagaatgtgctcatgaagtcgtaggtgctgttgaggctggggttcacaggtccataggtgccagagagacgggacccagagtatcaaggtgttaataatccagggacacctgccccccatgacaaagtgtggccaggagtgtcaaattcagccagcactcggataccccgaagccttgcatattcaatgacctccttcacatcctgtgctgtgtagatgtgggtgacagggttaag

SEQ ID NO: 139 - DNA, 576 bp, Rattus norvegicus
  Genbank Accession No. AA817892
tttttttttttttttttcagagttggaagtggttcctttatggaaaaactgaaaatataataaaaattaaaataaaaccagttaaaaaagccagcccctggagtttccacctcctgcctctggccctccagaggggtgaggccctggccccagggcagcaaagggtgagggctttcctgcccttcctcttcccccattccatccccgacttttatctccacagtgggggccccccgagaggaaccaaacctgggtatgggagcaggacccaaggccctgtatcccagggagggaggcttggcatgtgtgcccagccccaaagctccgggcctgtagtgtgggcatgggcagggctgctccctgcctgggcccatctggggttggggaggttagttccagatcttgaggaaggagtcccaggagcctgtatccacagccatcccatcatctgtgaccccaaggcagctcacacggttatcatggccagcgaggacacctgcacggtcacccttcatggcatcccagatgttgcagttgaagtcgtcatagccagcgagcagcatccggccgctgcgt

SEQ ID NO: 140 - DNA, 386 bp, Rattus norvegicus
  Genbank Accession No. AA817947
tttttatttttttttttgccaaatacacagatcaactgtttattgagttttgttgttgttgttctaaaatactatacatttaaaggagtttccaaacattaagttcttgacagcgtttggtcattctgtaacttaggaacaaggatttctgctggtaagttctcatgacacagccacagcaaaacagcgctcgtgccaaacactgaagaaacacaagttgtgatgtgcaccattgcacactgtccgagctaacaaaataaaagtcctctttgtgcccatccctggggctcataacagtcccactgcacctgaggacagggcaattggaggaacacgtgtgtgtgtgtgtgtgtgtgtgtgtgtgtgtgtgtgtgtgtgtgtttcgg

SEQ ID NO: 141 - DNA, 391 bp, Rattus norvegicus
  Genbank Accession No. AA817999
tttttttttttttttttgcttttgacacatgatcagcttttatttaaaaacatgctaaaaacatggtgttcgttaaagcgggacctgggatggaggaactgcagacaaggcattgcaagcagaaagtgcattcgaaaccaataagcgtgcactcctggctctctggccacccaggggcagcaaggcaagtggaggcccaaaggctcactccttagaatgcccactagggaggggaggccagaactccaccatcgtggaggggagggaaatgagagaacaggaacgtgagaaggggtgccagaccaaggggtcatgggacaaagaacagaccccaagcatctggcacctagctcagtcctgtgccatatccctgctagttagcacctccacc

SEQ ID NO: 142 - DNA, 366 bp, Rattus norvegicus
  Genbank Accession No. AA818065
tttttttttttttttttgaactcataaaagaggtttattgacattttgcttttttacatagaaagtctctaaaatatgaaaattaactgagtaaatgagaaactatacagtaacttggtcagatagacacaggttgagtagccaaactaaagacagcagtaatgtttaagtaataggattagatatttctagacaaaacaaaccaaatgaaacaaaagagatggctcagataaaaatgagagaatgcagataatgaaatgagattgattggaaaaatgtaagcacaaccagacaactgtgcagcttcaagaatggaggtgagcatcaagcacagaaaaagggaatttcaaagaccagcttgactgg

SEQ ID NO: 143 - DNA, 525 bp, Rattus norvegicus
  Genbank Accession No. AA818089
ttttttttttttttttgattgtaaatttgttcagaattccttcaactttaattgtgggggtaaaatcaagcagccactgaggaaaaatagtccctggaagcagtcgaaacgtttgtgtagtggacacgatgagttatttattagcacaggttgtcacaagtcgccagctgttctcattcttccactgtctccttcttgccagtctcttgcccttcaaagagggggtacctggcctccacatcagcccaagtgatgttgccattggccagatcacggaccacactgggcagttcagagacctctgcccttatctgtctcatggagtctcggtccctcagagttgcagtgtggggggtcttgttcactgtatcaaagtcaatggtgatgccaaacgccacgccaatctcatcagttcttgcatatcgccttccaatagacccagaggaatcgtcaactttatgagacacgccatttcgagtcagagcttccgataattccttgacaaatggcataaactcttggttt

SEQ ID NO: 144 - DNA, 365 bp, Rattus norvegicus
  Genbank Accession No. AA818153
tttttttttttttccttagtatcaggagagctttgcattttttattacatttatttgtatgtggatacatgtgggtgtatgcatgccacatgtatgtagtggtcagggaacttgtggaaatagattctttcctcccactgcatgagtcttgggtttacactcaggtcattaggcttggcttcactgaattctgtccccaaattcaagtggcagaaacccagggctggaagcttcgtggtagagcactttcctgggatgtggaagatcatggagcccatgtccacaactacacacttcagtgatgagtacccaattagaggtttccaactttcctgacgctgcagctcctcattctgtggtgatct

SEQ ID NO: 145 - DNA, 363 bp, Rattus norvegicus
  Genbank Accession No. AA818158
tttttttttttttttctgattaaaacaatacaacattctaagatgtcttttgtttattttattgtttatcttctaatagcccacagaagagactgaaaatagttgtgggctaatcttaaacatgaagtagagaataagcactaaacactaaaaaaaaaataaaataaaataaaacttttaccttacttattaaactaggaagaattttcctgaaacgcacctgttaaattagtctataatatattaatgaatggaggacatgtatttcctagtaaatattttaaacatgaagtatacgcttgggggaaaaaaaacttctcaggatatgaaatttttcaagtctcaatcccctgaacagactaa

SEQ ID NO: 146 - DNA, 425 bp, Rattus norvegicus
  Genbank Accession No. AA818261
tttttttttttttttttggatccaatctctttattgtcagccctccctaccccccgtgccgcccttcacaaccccctttactttcaaacctatagaaaaaccccaagcctgggaatgtcctgggaaaaaaagagcagagtgcttctgcccctttactttcaaacctatagaaaaaccccaagcctgggaatgtcctgggaaaaaaagagcagagtgcttctgccccttggcccaggcagtgcagacaggaagagtgcgtgggataagggtaggccagtaactccacttgcaaaggatgtagcactcactggctgggatgcaatggggagagaagttactgctgccagccttcctctggtactctctctagactggcatccagagatgggtgcctggcttgaggcctgagcctcgtgccgaattct

SEQ ID NO: 147 - DNA, 554 bp, Rattus norvegicus
  Genbank Accession No. AA818288
tttttttttttttttttgagttttcacattaggacgattttatttataatctgattttctacccacccccttcattacatataaaaacatcatcaggcttgtcacagaataaaacactaggaaaaatgaaaaacacattttaaaaggtgcttcatttttcattccattagtaaagccttgacaggctcttgaaacgtcagtcaagtccaggaagaactagaaatgcctgagacatttccatttcagtgattattgcaaataaaaattcctcattgtgtcttcaaaaaaatccctgagaggccagcaagcccattgtgcagacggagagactgaggtcagaactccttagtctcctcatgggagactggagcatgtcagtgaagttattgctttaaagttttagcaaggtttcgcaagcattcctctgctctccactgtgtttctctggtccatggagaagtgaggacggtactggggtctgctctttgaagaacccagtgtgctgctgggtggccccagaagcagcagagctcggtgtgtcctcccaactcact

SEQ ID NO: 148 - DNA, 637 bp, Rattus norvegicus
  Genbank Accession No. AA818342
tttttttttttttttttacttttagagatatttaatgatctgtttttcaaatcagtacaaaaatttaaatacaaaatcgatttgccattacgtctcaaatctattcatggaaactcaagcaagttaccagtcttctcatcattctttgtttctgtaaaatatctgaggacaattgtcctctacagacatttttccccctgtgggatgtcatactgctttaaaactctctgtttaaatagaacaatgccagtttggtccatttcacatggagaagctctagttaagtttgaattaaatagggatcatagtactgtccctagaaagtagaacatatacttgattcacctgctttcacaccactgaggacataatgaccaggactcagaagggaaacaggtacatagataattatttaaaactcttctttaaattaaatggagtatcatttagctctgatattagcaccatggtagaatatacagtatctggcatagattttgctcctcctccatttaaaagcttagaagcatatgcctgataatacagacacacacacacacacacacacacacacacacacacacacacacacacatgcacgcacgcacaggcatttgagtaacaaccaataaataag

SEQ ID NO: 149 - DNA, 522 bp, Rattus norvegicus
  Genbank Accession No. AA818475
tttttttttttttttttaacttgaagagtcatttatttctgctcctttcaaacaccacgttgtccaggaaacaagtcccccatgtgcatctgaagtggcagagtagcccacacgccgtttcaaggcaaagcaccgctgcagaactggccagtcgtccaaattatctcagctctcatgatacacttctcgatttgcattaatttctgaaaatcagaaatatcatgtccaaaaactatgatgggtttataaaaaaataatcattgtattcaataccaaagttttaggaggagtatattttctttaagaaataaaaaactaagaaaaaatgccatttaacacagctggtacactgggataggtcatcaggaaaaatactgtagtgcacttgtctctgacaccacgacttccagcctagctgtgctgtgcttgctagggtgtcactcactccatgcaatggttacgccactctccaatcttttccacattgcacagggagtggttcagcctttacaacttaattaa

SEQ ID NO: 150 - DNA, 507 bp, Rattus norvegicus
  Genbank Accession No. AA818521
tttttttttttttttttacattgtaatctatttattttatacacgtgacgtcataagcaaaggctttgcttgtgttctagctaaactccaataaataaatatgtacagatatgctgagcctacaaaacagtaaagaaaaccttttcttcacaaaagatacacatatgatacatttgttccttacactgacatatgaactcattcctagcttacttaaaacaaaacccttctggactctgtatgccaatatctagaggcatgtacctggtccttttattttatccagaaagcaaagctatgcagagaaaattcctcagtttctttattaaaaaatggcctgcatatggcctgctacttattattaagtgacatttaaatgttctcaagaagttggaaactctttagaccagttgtcctgaaatgactggacaatgccctgtggatgttgtcaaaatgcagcttcttatgaactggctcactggggtgggagtggggtatggtgggggt

SEQ ID NO: 151 - DNA, 470 bp, Rattus norvegicus
  Genbank Accession No. AA818615
tttttttttttttttttaaagataaaaacatttcttttaattggtcttggctttgatttgtaccgccaagccctggagacaccgatacaatttgatggtaaacaaacagaactgcggcagttagagagaacacagacccacttcccaggcaggcaactgtttcccaatccccctcatgctacttctgtgcttctgttcagaaaggtgatactgtgtcccagccctagcaaggctgaggcaggaggaccaccagtgtgggaccagtatgggataggatacataaggaaaccttggttcttgttgtttttaaagggaaagaaaaaggtaagtttgaaaccgaattgtgcagaaccgatcacaactcatactaaggatggagatagtcttttaccaaaaaccaacccggtcaccagcactaagatttgtttctctggatttgaagaaggaattgagaaaatgatctgcaccaa

SEQ ID NO: 152 - DNA, 533 bp, Rattus norvegicus
  Genbank Accession No. AA818655
tttttttttttttttttagagtcaaaacatttttattacttttttgtatcatttcgcacacttctgtacaaatacaagaataaaagcagtatttacaggtattgaaaagaactctggatatttaaactcagcacctaaacacagtagcttgaagcagggacttcaaggctctggtaggggagtaaatggtctttcctgcatgttgctctttgaagaattcccttagagctaaggtacttatacacagaatattaaataggaaaagcaatctcatttgcttgttttcagcacttcctccataagattattttacaagcatgaaataaacataatgccatctattttagggagcaaaattatagagtattctgtatttcttaaaaaacatttacagtcccaagttttaaaactaacttaagactaaatagaacaagaaaaataaggagtcctgctggttctttggggaagatttttctaacagatttatcacaaccccatgtggtgaagagcagtaaatattcactttttaaata

SEQ ID NO: 153 - DNA, 448 bp, Rattus norvegicus
  Genbank Accession No. AA818658
tttttttttttttttttggagtaagagttatatttatttggatcacgaagtataaatatgaaccaggttttggaaatataggttgtaacagttcagaaatggcactagaaacttccatggggtctgtgacagcacacatcacagttttggtgagaccgtggtctccttacccaaaaccttccctcccgccaaccttctctgtactaagtgataggtatcagttaccaagaatagtcaactccaaaattccctgttcttcctcagcctttttctttactaatgccttctccaaactgttctgtgctctaccaacccctgcatggagtagcaccagaagaatggcaggataagggaaatgtcttgatacaaagggagtgacacggggtgatggaggaccgggaagctgcaggaatgggcgcccaatctttctgcctcgtgccgaattctt

SEQ ID NO: 154 - DNA, 566 bp, Rattus norvegicus
  Genbank Accession No. AA818717
tttttttttttgtttttcgatctttatattttatataattaataaaacagtgcttgtataaaaattcacacaaagttgctagagagcatacaagttccaaaaaatgtcctgggtttgtggtacattcagttttctaagggtgcactcagatcagtgtaacaggcagacatgacgtggtatctcgttctctttggtaaaactattcttgttatatcactcctcacagtagtcactctgatatccactttgtgcagggtctgcgcttcctgggatgtcagacattaaggctggatctacaagaggcaagggctgcccacagcggtgagtgacagccccggggccctcaccccatccccacttcagaatgacccagtgacctccaaccgggggggtctccaggtccccctggatcaggtaagaagcaatggctgggggaatggtagaaactgaggcaatctctaccagaacccgagtggcccacactgtggcgtgatcaagccaaatccagtcgccactaagtagatcccattggtcagttgatgattgctgctgatgtgaacccctca

SEQ ID NO: 155 - DNA, 544 bp, Rattus norvegicus
  Genbank Accession No. AA818747
tttttttttttttttttgggttttacattcgaatacagaactttattaggaaaaattgtaggtgaagatacatcatttttcattgatatgacttcaaagtagaaatggcctctcaaataactgtcatatattaaaaacgagaataagaaagcacacactgcgtataggaagctgccttctcctggaccattttcacattatctgggagacagaactgaaacaaaatacagtattcaccacatgcaacactgaaaccatcgctgcgtagacactgcaagctctgcggaggaatgacttctgtgaggaagcccctggtgacgccgccgagataatcacccatgagaagataaacagaactcgatggagaggcctaaaggcctcatgccaagtcccacagaggaatgcagccttttgctctccaaaccctccctcaaagccgaccaagcaatgaatcagaggggtctgccacctcggctgcacttccttcccactgtccccgaatagcaagcagcacagtgtaaacacaaggtacaaatctgggttt

SEQ ID NO: 156 - DNA, 368 bp, Rattus norvegicus
  Genbank Accession No. AA818761
tttttttttttttttttacaccgatggacgttccctttcctagctgacattgtaaaactccaggtagttgggagttaaacacaacccaccgtgggaaaagtaaacagactttcttaaattcgctggtaaaaaattctatcttgcccgaagaggtcgtgtctaagacagcaaatgagaccacccacccaccctttccgcggtagtccacgccaggcgatcagtctaggctgaccagtcccggggtctccagccacttcaatcaactctgatcgcagcaagatttgatttgttcagttctggatctcagccgaaggccggctcgcccacagcagcctgtgggggcgaggtgactcaagtcacttcccagt

SEQ ID NO: 157 - DNA, 536 bp, Rattus norvegicus
  Genbank Accession No. AA818784
tttttttttttttttttaagtcacatcaatttattttcttgatttccctctttgtcctgcatgcactgtaagcgcagagctgaggctgatctcccctgcctggaagggacagtagagtcacctcaagagcctcctcaatggtggcccgggaatccagaccttcaaaacactgctagtgacctacgcggtgctcgtgggaaacacgccgaatatcctgtttaatgtaaacaaggcaggaggccgacagagcatcagtgacagactttacagggcccagaagtgggactatctaggcgttacgatgacatgcatattttactttattgctcaacccaaaatgtaaaattaccatagtttgtgggtttagcatttcaccgtaacttcttctgttacacggtaaacgtcataattaaatggtaagtatacagtaatgtaataacttatggagacattaccatgaaaagaatgaagtaattctataatttgtgccctgtaaaattaaatgtaacaatatttacactagcgacagcgtgagc

SEQ ID NO: 158 - DNA, 537 bp, Rattus norvegicus
  Genbank Accession No. AA818798
ttttttttttttttggtgacgccagatactttactcatctcaggcagtctggactagttcccctcccgtggactccagggtaacaccagaactgtcctagaccatagctgtcctctctggcggctggaggtaggcctgcagggcacggtggaggaggaagcaggtctgtgggtggagggaagcaggtctgaaggtggagggttccagtgtagttgtggctcatcctttcctatcacctctcggggtgcagcccacactctggtcctcgtgtccacatgagggccactgtttctagctgaatggacatatccagtgtcgataatcacccctcctcatcatggttcacagtgttgcttccagggacatctacctagacaatggggtccccaaatgtgcaggcctcctcaatggcgaggttgtagctggaacctgtccctcccttataggtgctggtcacaattctcatccagcctcgctcaccccagggctcgccccatgaattgcggacaatccaatactcgatgccatcattgctga

SEQ ID NO: 159 - DNA, 562 bp, Rattus norvegicus
  Genbank Accession No. AA818818
tttttttttttttttttacttgatcttttaatgtttaacactttagagacataaattacattaattattttacaaatgttaatgttgtgaaacacttacagtgataatatcagtatttcagaattctttttagtagatgctatgttgtgcctccatgaggtccgggaaggtagtcaccggcgcgctggggcatggcgggatgtagagcctcctaaccctaggatggctgaatctccaggtactcggcaaaactacccagaactggaagtatgcagcagagggctgctggcccgcttctccagccggctgctctgaaggaagaagcccaggctcaggcccaggctatgctaaagggacccaaaaatcacacccttctgcccattaagaccccaactgcattctggccttctctgtatgaagaatgctggcgcccacacgagctgcttcctatgctgtgcacactggtgccctgtgcaccgatcgctactccggggacattgtctgaggaagtctctgttttcccagcactggctcatggcttggactcaggaagcttgacctt

SEQ ID NO: 160 - DNA, 561 bp, Rattus norvegicus
  Genbank Accession No. AA818820
tttttttttttttttttaccagaattaactttatgtagcttgggtgatttgctactcgcaaatgatgtgaggcaggcagcttcccacaccagacccaaccaattccattcccctcatatcaccctatgtccaccaaatcaaggactccttcattctggggatgtgccactttcggtgagggttcttcctccatgttcagacttcctgacttttgactttttgtgtgttcaacaaccccatggcctcaccccaagtctctgacctcatctacctgtggctgctctatcaggcacaagacccggctatctcccttgcttccctagctccgagatgtcctgttacctaactaccaagtagttttcatgtccacttgaggacaaagcaacccaggagggctccccaaacctaaggtctatcagttctgcaaagaaccgtgaacccccatggtggggcaagcactagaaccttatggcccagacagctcaacaccagaaagtacgagcaaacatgacagacacacaaaccacagaacttcaggtcatgcactgctggtcaaactga

SEQ ID NO: 161 - DNA, 432 bp, Rattus norvegicus
  Genbank Accession No. AA818861
tttttttttttttttttggtttttttttacacaaaaatccttttattaagtggaagttagacttatttcatggtaattaaccagttacaagtgcatctaaattcatgtgtgtgaacatcatagaaatcagaatggtctttctgaaagacttgtgttctggcttggttcgtgccagtgcaagccaagggtagaaccatacacagagtcagtacaggatgacaatgaagtcagactagattggcaacaccatattcattgttacggctaagcattacaaaacatgaaagtccaaagaccagaagactatttctaaagggttgactctacacccttccttctactacatgctttgaggactacccagcaaatcctcctctctggggggacaaggactccttgctgtaggacacatcaatgggccatcaatactgt

SEQ ID NO: 162 - DNA, 386 bp, Rattus norvegicus
  Genbank Accession No. AA818897
tttttttttttttttttaacagttttaaagatttatttatatatgtggccgtggtagggtgcacacatgtggagggaagaggatagtttgttgagagagttaattctctacttccaccgagtgtgttcaactcaggtcatcaggcttggttgatggcagtcacctttacctgataaaccaggtcactacaccaataaaaaataatttttagaaatcaccgctcatttaaaagtcttgctttttcaattttcctatgaatatattttgttgatctaagtagactataatctcagtagcatggatagcccttaggagtctgtctactccttctgtggagtattcgagtcctctgaaaatgaaatggaactctagcacgaatctaaaag

SEQ ID NO: 163 - DNA, 612 bp, Rattus norvegicus
  Genbank Accession No. AA818910
tttttttttttttttctctttttttacaaaaaaaagaaaaaaaaaaaacacttttattttccacaaggaagagcaataggaaaagtcaaatcatttcccacatggttttcttaaaacagagcctacaaggacatattcagcaccaaataaaagattacaacagccatagaatataatctataaagcaaacatttaatattgcactttgtttcgcaaacattttggattttacttttcctaaatgaaaaattaggaattcaagatagcttgaatactagagcgcaactgtgaccctcagatgttatgtcaggaattgaccaatatttagaatagtgtaatgcctcaaaagagtaaagaaatacttaatgggaaaaataaaactttacttcaccaactcttaaaataattttgtcaccaatgccaattatcagaatattggtcattcttgcttaataaagtattttgtagaacatggtagtgagcgccccgaggccatgcacaccaacaattgttccctagtcagacataacacagagtcaggtgtttttacacaatccctcccaacaaaaacaaatccaccaaatgccctttatgccaaatatcccatcagct

SEQ ID NO: 164 - DNA, 613 bp, Rattus norvegicus
  Genbank Accession No. AA818911
tttttttttttttttttcagtataagtttttattaaaaagtgcattttgattaatttatgatttaggtaagttgtaagattatcagtatactctctggaataataactttacaaagatttaaaacaaacaaaaatttaaaagcctttttatttccttcaccattattgttttacaatacaaatatcaccttgtgagtagacactacacacacacatacacacgcacacatacacgcacacacacacacgcacacatacatgcacgcgcatacacacactcttgcacgcgcgtgcacacacacgaaacctacagaaggtaatcctgctgcacataaaatacagaaaggatattatatttatatttatatttatatatatatatacttcttcactcttagaaaactattttgttctccacgttggcaagtatagagtagaatacttccccaaacatacgtatgtcaggagtaaaactcagagttacatgcgctttctgcacaaatatattgtaaagaaatagctctctttttgctgttgttgcccaccagcaaacctgtcatgagagtgtggataactaatttatagctttcaagtttcaggtaagtgatcattt

SEQ ID NO: 165 - DNA, 395 bp, Rattus norvegicus
  Genbank Accession No. AA818935
tttttttttttttttctggcataaaaacagtttatttggtgttttcattgttacagcttttatgagttacaggacatacattgtgagcaggggtagtggttttctgtttgttattgtttaaggatctcactatatagcctggaacttgctgtttagatcaggctagcatcaaacttatagaaataagcctgcctctgcctcgtgggtttaaatgattataccaccacacccagaaatatatatatttttatctctgataaagggtcccaggtagccctaggtcagatgacctaaacttgctacttgggtgggactgatcttgagtcctgatctttccgtctacaatctccaagttgtaagattgccgtgatgtgtctgtccactttccagttttc

SEQ ID NO: 166 - DNA, 606 bp, Rattus norvegicus
  Genbank Accession No. AA819086
tttttttttttttttttgagggctgaacaggattttatttaataaaggtgtaataaagactctattgttctttgacatcgataagtttgaacacacacattcctagcagttcctagagagatcctcacagcacatacacaccttacagcattcacaaagtattgcttatcagtgagaaagctgcaactgttcaaatgtccgccaaagggaaaatgtataaacagaatcatggtgtgcttgtagaatacagtagaatacagtagtggaaagagatagaactatacatattaaatatgcatgaattataaaaatagagactttaaaaaccatggtatatatgagttaaatttatacaaagctcaaaaataggcatatgcaggagataaaaccatcaagaaaaagaagaccaaagggacaatgtacacaaacttcaggatgttggttcctcttctggtggaaggaagagtagtaatgggggaagggcctagacatgttctccaggtctgttatctaagctgagtggtgggtacaggatgctgttcattccatcgtcctttaaatggttcacatacattatatacagcctttctccacgcccttactttt

SEQ ID NO: 167 - DNA, 281 bp, Rattus norvegicus
  Genbank Accession No. AA819111
tttttttttttttttttagcattagcaatttgttttattttttccttttctgttgcataggaaatgcagtacttgcttccagtaattgtattgtgatgtgagaaggtggtagcactaacggttgaatacaagagttaaactaatccacaccagctcaaaaaccctgtggagacttagttgataagaatggacgcccacagtgattctcaaccaattacaagttttcacagaacacagtaaacgaaaagggtaactatgagagtcagtacaaatatgctaga

SEQ ID NO: 168 - DNA, 562 bp, Rattus norvegicus
  Genbank Accession No. AA819220
  misc_feature (1)..(562): n = a or c or g or t
tttttttttttttttttaagctcaacaccaggatgaactttactcagtcctggggcatggtctgtagggaagagattattggttctccttggcaggagtggactcggcgttgccagggtcattctctgaatcatcattgggtctgggcacgggctggaacttgagcagaacaggcggagtgaagatggaggctttcacaggaggagatggcgtcttgtcagtgttggtgggcccactacaggctgtcgtccagggaaaggcagggcaatggagcttgtgtgcactgtttcctgccaaatatgagaaatggaagcctccggggttgaggaccaagggggtcagatcaaccatgtggctctttgacgttgatgaaagaccattccagtttaatttcacctatactttctagaatattcagaagctctggtgtgcagaaactgtgattcncacatggtctgctgtccgcaaagaagacaatcaaagaccataaggaaaagcccacggaggatgggctcatcacgctcgtctgtgcgaagctatgccacacaagaacaagctcacc

SEQ ID NO: 169 - DNA, 599 bp, Rattus norvegicus
  Genbank Accession No. AA819332
tttttttttttttttctgtttgttcatttattttttcatcgaaggtacatttttttccatatcacaggaagaccaaagatacaaaattccttgtatatatgaaaactcataaatttctaaaccaaatggcaggtgagataactccttgtaaaagaaatacaaaaccaccaacattccttaataggtttctttctggatgtttttagagagtttgcctgtactcgacttgtcagtttctggtttgaattcattaacatgtactctgctgtatttatgaatagtaacagacagtctatatacatagatccaacagcactgcccaaggcgctcgacactgaagtgagctctcatctagattaatcacagctccttcaattgagaacttcgcttagtcttcagtatccccaatctgaatcatgccccactccaggactgtcgggcacatcatgtcagctctaccaaggttgtcttgagacccttagcagttttgtcctcctctcagtttctaagggccagagcacaattatcagttgagctatatggaagtgacgtccgcaaataacaccacaatctgttttacatgggatatacaagttagc

SEQ ID NO: 170 - DNA, 550 bp, Rattus norvegicus
  Genbank Accession No. AA819367
tttttttttttttttttcgttttttaaaaaatgtttattttttcaaagaaaaatggcaatagccaattggaaacctacttattcttcaactccaattttgttttctttaaatttagaagtgacttactgatttactatttaaagcaaacccccccttttcccctttaaatgtttaccatctactcgtgctgaatccttccaaggagattgctccagcgtatatctccaggtcctcgctttgctccttttaccaaaaaatgcaaaacacaattccatcgtgcatcttaagggctccaatcgtcaaaaataggaaaaaaattctttggaatagccaattaagttgaatgaaaaaaaatccacacgaatgcggtttggttggggcaggaaggaatccactcctatgttcctggtaatctgatcccgctccatgaatcctggtaattcatcctccctatcctatccacattatgatttgaatccaatgatccagctccaaggattgggatccagtgagccctctccaatccaaacctttataaccagcaaaacc

SEQ ID NO: 171 - DNA, 462 bp, Rattus norvegicus
  Genbank Accession No. AA819517
  misc_feature (1)..(462): n = a or c or g or t
tttttttttttttttgtggcatctgggactcgctttattggacacatagctgtccaaaccttgctctgagggctggggcctgaggcccaggcaccaagtctctgaggaagcctagtagtcagggctgcttggatcgaggccacaggcggctggtgagtgagccaaagaagaggccctgcttgttggacttggagagctccgccaggcgctgctgctcctcctgttcaagccggctctgccgctgtttgaatgcctccaatgggtcatcctctagagcatagtgctccagcacagtccggacgtcctctacttggttcagcgcgatggtcttgaggaaggcagacaggtccagcaagacccggtcatctgagttgccatcccaaggccgcaaggcgacaccattgaagggctgtangcggaaagcttccttcttgcagtccacgactactactcgggctgggt

SEQ ID NO: 172 - DNA, 516 bp, Rattus norvegicus
  Genbank Accession No. AA819523
tttttttttttttttttcagtttagaggcttgtgtttattttaacttagacaaaaatcaggagtaaaacgtacgctcttaacctgactctggcatgaaactggtaccacctgttctaaggtctgctttattcaaggattgtcagaccttcatgaaaagattcctggatgttctgctttgtaaaagtaactgggaaaccatcctagtagatgcagaataaattaaccccaagcggaggtgtagagcaagatgcccacactgcctccttccgtgcctcagcttctagtctccacctttgaaacgtgcatgacgtaaagccatgctatgctggccaaggaagatcgtgtcagaagtagggtgacaactggacatagagacacataatatattcatatgtaacataataaatgtacatgagtatcatacatatgtatatataggtagcccagacttgccccacacctctgcacaagcagagcctggagcagtctaccggtttctagactacggcggtata

SEQ ID NO: 173 - DNA, 394 bp, Rattus norvegicus
  Genbank Accession No. AA819606
ttttttttttttaatttgggtttttggtttaattaattttggttttaaggacacaaggccccacggtgtaacccgggctggaatggaacttgcggtgtaacaaaccgggccccggcccccaaagtgaggggaaaaaatttgaaccccacctttaaggaaactgaggccaaaaaaccaaaaagtgtcggacgatttcaaacaaaatgaactttggccaaggtgggcaaaaaaaaaccctgaagacaaaaaaacgcttcccaggttttgaaaggtgttacccaaggcaacctgaccacccgggaaaaaaaagggccaaacccaaatgccctttgaccttggcccaaacccaggagtcaaaaaaaccctttcccttgcccccaacccaggccaaaaa

SEQ ID NO: 174 - DNA, 127 bp, Rattus norvegicus
  Genbank Accession No. AA819657
tttttttttttttttctgatccaaacacgctgctttattcatacccggtcaaactggtcagtgcagaacctggggcctactgaagggcctctatcaatgccttgccggccatccacatggggcccat

SEQ ID NO: 175 - DNA, 462 bp, Rattus norvegicus
  Genbank Accession No. AA819691
tttttttttttttttttccattctttgtcacttttattcagtagtagtttttttttttccttattttcagtgccagacatggcaaggagtgattacagccaactgttattaaaacatttgttcgtaacatagtcccccattaccactgaccccaaactgactcattttgtgtgctttcgttcttcctttttaatacgccaccaccgagacaaggtggaaagggcaaggataagagatggaggggagagtccaggaggccagagaggaggaatgctacaagccacagtaagaatgagctgtatttaatttaaaaaagaggggagggatgtaccccacaaatgatacagtaatgaggatacacaaattccatagcatgactgaaggcgttcactgtgtttgacgtcatcacaatggaaggcataaaaagtggagtacatcaatgctgaccctcgtgccgaattc

SEQ ID NO: 176 - DNA, 463 bp, Rattus norvegicus
  Genbank Accession No. AA819767
tttttttttttttttttgagcttaatgaaatttttattttgaaaatatggcaagagtctaaggcacttcaaacatttaaatacatatacaggacccaagtaaatgccgcggcacggtagaaatacatggagaactacactctgcctccctagacgcaaatctggaacccagtcctctaacccaattcaaacctttgtcaccagacacagacacggttgggcagttgcttaaaccgttacgttacacgtagctctttatgactgtactgtggaatataaaagctgaaaatactgttgtcgatttcatatagaagtcttttatataaaaaaaggcgtataatacatccacctagataaaccaactgaaaatatttcttgtaagtttaaatggtttgagagttccactcttctattgttaatcgggaaattatcagcctgggggtgccaagctgctgctgatcaaa

SEQ ID NO: 177 - DNA, 517 bp, Rattus norvegicus
  Genbank Accession No. AA819788
ttttttttttttttgttagttatcatcaagatttaatcaacactgcttgagaacagtaagtgtgaaagctagtacagacagttcagcaattcaacacagatttgttattggatccattatgtgtgggccatgttttaggccattttcagagcatgcccaggaaagcaggtttattctctatacgatcccacatgaattcactgtcacgttgaaatgacatccattttattgatcaccacgggattaaaacaagatgataaacctattatctaatgaagaaaccaataagggcaagcgcagcgacagacaaaatcactaatagtggtgatgctgcttcaccgggctctctgacttcctgaaaaggcctgttcctaaaacctgtaatctcagtctgaagtaaaggaaggtggctccttgatggagaggaactgtggctctttggtgatggcgatggagatggagatggggatctgggtggcctcactctctgtgcaacggcacaccttccatgggggtg

SEQ ID NO: 178 - DNA, 328 bp, Rattus norvegicus
  Genbank Accession No. AA819891
tttttttttttttgggtagcaaaggctttattggtccagttcaggatcacctgtccccaactgcctggggaggagcttgcagtgggaaaaggcacttgaggtgggggagggccagctgcagacctcagccaagctggtcctcaaacggctttcggaaacagtctccagcagggaaaaagtcccaacacctcccctggtacatcttccagacatatgacccctgaccggtgtgctctgtctcaaccttatttatcaaatacatcaggaaaaacatgtaattggctaggttgtgcccttccaaagtgggggtctcaaacccatgtggggt

SEQ ID NO: 179 - DNA, 632 bp, Rattus norvegicus
  Genbank Accession No. AA819905
tttttttttttttttttcacttgagaataacacactttatttaactcaatcacaatacagttagttcaaggaagccaaacacttgcccagtaaccaacactacaagcctcagtaaatgccaataaggatccacacgtgtgactatcaattatacagaaccaagtttacatttctccagcttgaatttcttgattagattaaaccatttgcaatcctgcactgccgcagcacctcattgaagccctcacagagcttgacatcgctctggttctgagcacactccagaaactgcttgatctctagagagcaaggtccaaaagactgctggttctgcagcggggctccctgaggctcctggtaagtgatgtcaggcctcgcaggctcagcattagcccctccgctgaagcccccagtgatggcgtgacccagggtgtgccccaccgcagaacccacagccacaccggctgcagtggtagccatctgggccatcaggcctggctgccgaggggcagcagcaggtgagccgactgcagatggggcggcagctgtggctggaggctgagctgctggtgctcttctgggagcagccctcatctgaggggcccggctggccggaggagtcacccgggaag

SEQ ID NO: 180 - DNA, 447 bp, Rattus norvegicus
  Genbank Accession No. AA848218
  misc_feature (1)..(447): n = a or c or g or t
tctcagctactgtatgcgaagtctgattatattggtgcgtttttacagttagggttttgcaataacttctatattttaatagaaacgaattcctaaaatccctcctctccccaatttcaggaatttaaaattaagtagaacaaaacaaaaacccagcgcacctattacagctgtcatccaccgtcatgggaatcagttttcattaaacttgaagcagttgtggcatcatcggcagtgttttggttcagacacctattcacagaaaagcatgatgggaaaatatttcctgacttgagtgttcctttttaaatgtgaatttttatttcgttttaattattttaaaatatttaagccttcttcttgatcttaaagatcgtgtagcttggggttggggacggatgaanggcgagtgagtctaaggataatgaaataatcagtgactgaaac

SEQ ID NO: 181 - DNA, 672 bp, Rattus norvegicus
  Genbank Accession No. AA848306
ggttacaaaagtatttattttataaaacttgtatttaaaatagagcttatctgtctactcacaaatcctaatttaaaacataacacattatccttagctaatctgatgttaacctttacaatcaacactcatttttgtaattttattaagaacctgtactaaatgaagtttttaatcagaaaacattcccttttatcttaaaagtgcttcttaaatgaaggcaccaacaagaactactttcagatggtacagaatttcttatttcttgaagactctgtggttgaccacttcttcattagttacctgcagcaagacaccttcctgccaaaggaaaaaaaaagtatctgaagaagtttatcatgtttgtccaaagaacctaagtaacttcagtggtggttttaggattaaagcagactcactgatgtgtatacgccctgaatatcacatttctggaaaggcagtaaagcctagaaatcagagggcgggcggttttaggaaatttcaatagccaacctacaacattttagggcaggataatgggcaaaaattactaccacattttaacccaattatttagtcagggtacataaagggttttgttgctgctgttgcacagaaatttctactgtccttaacctatcagactcatccctgacaagcaggtaaaggtgg

SEQ ID NO: 182 - DNA, 558 bp, Rattus norvegicus
  Genbank Accession No. AA848407
gaaaaatataaatgctaaaatatctcatcttcttcatctcttaattccataaaagtcacaatagaaagcttcataaaactgtaaaatactatgttataggaattttagatttcatattggaaaaaaaattattagtaatatattgaaatgttttctgttctttatcattttgttccaccatgttgatcctacttcatttaaaataaaaagatgcatcatttctccaaagttaataaagacttaagagaataaaaataagactacctgaaagtgtgtactgattgtgaaacgtaatgtgtacggatatgttccagccgtgaacttggctgcaaggaggcgactctgcagtcgatgcacattgtaggcctgggacaaagttacttcaggttctaaggattcactgggtgactttagccctgagtttcagtatttgcctaggaaacagaattcaggattcttgtgtgtatccacagagcacaatgaaatgagccaggaataagatagatccaaatctctggtcgaaacacagcctgccccattcacatatattacagaagg

SEQ ID NO: 183 - DNA, 507 bp, Rattus norvegicus
  Genbank Accession No. AA848470
  misc_feature (1)..(507): n = a or c or g or t
gaaacaagcccattcttgacagactaaaagttaagttaatacataaaatgtcctgttcacttgaaagaaaaatccactttttaaatggacaccgtcctgttttttaaaaaaaaagttgactttttgtttgttctaagtgccctttgtccggaatgttgagactcggttaagacttgggtattgaggtgaanggtggcaggaaggactgagagagtgggcgcgacagtagtggcaaggggcgtttccagcatcacatacagttccacttttctttggggccatgtcctccatctgcatggacggatgcatgctctgcctggtcagcacttcacacagctcctgctggtgctggccttgaacctctctcctccacgggagagctgcgccttccttcacttaagcactcagcatcatcctcctcagcgcagcctgtggggcaaggtgtgagtccatttgtcctccggttttacangcacangagactgttaacgtctactgctgtagctc

SEQ ID NO: 184 - DNA, 565 bp, Rattus norvegicus
  Genbank Accession No. AA848545
aacagatgtaaactatttattgaatatttgccaccaaatattgttaaatacattatcttgcagcatatcgctttcaagttaaaatgtcagaaacaaacaccaatatttacatttcttgtaaggaatgttatataatgacacattaaggcgtaaattcttttggcttataattcttaaaagaatgataatagcaaaagtgatgcaaaatcttcagtgtgaggttatgattaagctacattttacaaaaatacggtgtaagatggcgataatcccattcaacatcctggattagacccctcaggagggctggtaatttatacagtcagactttaaatttacagataagtgcagtttaatactgccactgagaagtacatctctgaacatatacagcttcaggccacagttttgaaggtctgaagtatcaagttggtttgatgaattagccggttggcacttatgaacacatttattgccttgccatctttaaaatatgtcttcagagtgtcactgaaacttttggagtattttacaaattctttcttttggtttcaagtgccctgcg

SEQ ID NO: 185 - DNA, 438 bp, Rattus norvegicus
  Genbank Accession No. AA848546
  misc_feature (1)..(438): n = a or c or g or t
gaattgatccgggagttgaagagggctccaaaggtgggaagtgaagtccgtgcctcagttactggttgctgttcttttttgtgccccattctttatcgtatacacatacagaaggggagaaattgggcagtgaatgacgcttcctctgcattctagcgttgcttttcctgctctcgctggcctgtgactgaggatgacaatggaagagatgaagactgaagctgaggccgcgtccatggtttccatgcctctctacgcagtcatgtaccctgtgtttaacgagctacaacgagtaaatttgtctgcagctcagactctgagagccgctttcattaacgctgaaaaggaaaatccaggcctcacacaagacatcattatgaaaatcttagagaaaaaaagtgtagaagttaacttcactgagtcncttcttcgtatggc

SEQ ID NO: 186 - DNA, 619 bp, Rattus norvegicus
  Genbank Accession No. AA848795
aaaaggaaaacagtgtctttattgtgtagttctaacaaacattcactgtgtgcacattccagtagaaagagacaaagatctttgttcaaaataagctgaaaccacgtaggtaaacaaaccccaccgttgaattcacaaaaggaatgtagtattagccactcagttgagggcgcaggagaaggcgagttaaggaactgaaaggatgttctacccgagcagttgacctggacagcgcgggcatgggcaaggggcggcccctgcaactcgagagtaagacactgggcgtaaggcaggtgaccgacacgtccctgcttcgtcagcctccctcctggaccactcccactgatcccgaagctggccaaacatgacagagctccccgttacttctggatatttggcaactgaatctcacagcttcaacacttcagtttcttgttgagacacgacatgtctgagtccacttcccctgggggaggaggcaaagaacatttatgcttcagtcatctcaggtcaacggcagccaggcggggatcacctgacacaagcactgccgcctgtgatgacacacctggcttgtacctcacttctcactgctcaccatcagcactaaatgagcccc

SEQ ID NO: 187 - DNA, 651 bp, Rattus norvegicus
  Genbank Accession No. AA848804
actaggcaaagaattttattaaccttttccaaactttattcccaggcgtcttcagcttaatttgctgcaaagaatgaattaggcttaagcgaaactgaaaagagctgcagtgtccggggggcttgggcttaaaaatattagagatctagattttatcagatccataataaacaaaaaatttttaaaaagcagtcatgatataaaacagcagctcctattgtaacttctgccaagtgtcaccttcttcagaagttgcttcgattcagtttgcctcgttcatagcttcatcaaaattctccaccagatctggaacttcatcatcatcatcctctccagtagcaagtggtgcttttccatccacagattgtttgggcagagcttcagccagtctcctcaaactggtcagactgtctgcaccaagctggttgaggatgctgggaagcatttctgtcagctgctttgtctcggcgtggcctgtaatggtgaaggtgtttgctgccaaagacgcctgaactttagggttgttaaaatggatcactgttccttggtttgtaaacatgttcacctcttcaataccagagatattgtttacccctaacttctttaaggagaactgcagttttttatcgtctgctgtggctgttctgtgaa

SEQ ID NO: 188 - DNA, 659 bp, Rattus norvegicus
  Genbank Accession No. AA848828
agcttttaaatttcttttgtttaataatagaaaacaaaaagtaaaaccttctataatttataagctattttctgctatctacattatatataaaatatagactcttttactttataacacacatcttttccctttgataaataactttaaaatatctagtatacatgccttgacttttttttatatataagtttggttttatacatatacatacatatatacccatgtttgtaaaacaataaatatacactagacaaggacaaccaaaccaatgcaattttggctttaaaaaaggaaatgagaacaaatgacagactataaaagcaccaggcagcaaacaaagccataattgctagaaagttccccctcccctaaaccagagacagggcacagggtaaaggaacagatcaggtcgtaggcatttgcttcttcacctgggacatcaagcacactacaaataagccactgaatttcttagaagctgtggggctcattaaacagcctagcccttgtggtggctgcgggggacagcagagagctggacagggcgcaggagacaacagtgacatacatggtggactccatggccatgatgatttctggctctactggctcaagcaaagtttggttgctgcactaagcatcaagcatctcagcta

SEQ ID NO: 189 - DNA, 413 bp, Rattus norvegicus
  Genbank Accession No. AA848902
acccctggctatcctagaactctccttgtagaccaggctggcgcctaacttacagagctatgcctgcctctacctcctgaatgctggaattaaagacacgtgcgaccacgcccagcccgtgaccctatgttttaatcacagctatctggcaagggtgtaactgataaaataatacagtatggtggaaatataacaggtggactttacaaggaaggacatagtgtatttgtaatatcttcatactgaatcaggaaaaggccgtcatgtaaagcacagttctttgaagctgaagcaacactgagttagctgggtgagcaggcgacacacgagcaaactggagagaagagttgactctaacagtgcagtgtcagctctcgggagaaggagacacaagcaacatgcaagtatcatga

SEQ ID NO: 190 - DNA, 657 bp, Rattus norvegicus
  Genbank Accession No. AA849028
aaccgttaagccatctctttaattccccgtgtctactttttaagaaaaatgttctatatgaaccaaaaagacatacatagtaatttacccttcaagggtaaatgatcaaaaaagaacattttaatgttcaaatatacaaagcacaataaatacagttacctattgtgtaacacagttcaagctgaatagacagtggatataaatagacggtaaaacatcttgggttatgagaatgaatgccttttgccctgtaactcttgaaaagtagtcagattatagggagcaagatagcaactagcagtttcatcactatggggttttcagagtattttataaagggtaagaatcggtttctattttctgtctttaatcttgcatgctttgacagttgttaggcaactgaagttgaattagacgtgtatttttgtttttttgaaacagagtttcttttgtgtagccctgcctgtcttggaactaactttataggccagggtgtcctagaactcacagatatacctataagaagcttcttgttaagtaagattctccagatttgcctgaaactcactcactccttatccaaagttgacctctaaattctcctatcttaccttctagagaactagaattacaatgtatgtggcaacatgccttgtc

SEQ ID NO: 191 - DNA, 276 bp, Rattus norvegicus
  Genbank Accession No. AA849317
acaaattacacatgtgtttatgtacatgtgtttatatgtgtgcatggacacttgtgtgactaaaaagcagcaatccatgtagcagcaccttcagatcctttgcacgctgggccaagcaccggaaagccctttgccatacttacatgtctactctaggtgtccactgatgctcggcaagatcgagatttttatcttggttctgacagaggatagcttgtaggttcttcctttggtgccacctaggaaagggtgttcggggcagagagttcaagcaat

SEQ ID NO: 192 - DNA, 466 bp, Rattus norvegicus
  Genbank Accession No. AA849394
  misc_feature (1)..(466): n = a or c or g or t
cagccgcagcagcagccgttccgggcgcagcagcggtgatgggctgctggacggcatagctgtagcccccagtggtcacatagcctgtggcagacgtagtgggcggggatcctgttaagaaatgggaaacaaagtcaggcgacggtcctctcctgtgaaactcttttgctcaagagatggagacaaacttaaatttagtggttgctatcaacatagggttgccataatatgtactcttcggtggtccgttggattgctcccttgagaggaattcatcaacgggcaatggaatgacattctccccggtaagaatttttcactgtgacttcgaaatcatgcagaagcatgcacgccacgtttggaaaatgaatcgcgattagccagggctgtgcttgttaagacaggcttggtagagttcatctaagaaaagtgatgtctagcanatagaaaactccacgccgtgaac

SEQ ID NO: 193 - DNA, 395 bp, Rattus norvegicus
  Genbank Accession No. AA849426
ggcagtccccagcacacttctttattgaatgcaaaggtatgaacgtgtaattacaagacatacaaacaaagagcctatgctgatcccctggggtggggtagtaactacctttcctgggacatgctaaaggcctgctgctcatccagttgtcggccctgcttttaacagggtctgttgtccatggcaaagcagctgcctttttgtctgcactggacagcagcagcagcagcagagtctgcagtgctctcttcccagtcatggaggctgtgggtccctgtccctgcccacatcctgcctctgcttggctgagcctgaaggagggcacgacaccagttagcccggcccaagcctcatctactgcagcccagacttcatcctgcagtaactactgtacg

SEQ ID NO: 194 - DNA, 507 bp, Rattus norvegicus
  Genbank Accession No. AA849518
ggatttcacatttgctttcacttttattgttaggtacagctacgaaaccaagccacacgggctcggggctgtctgcccagttaggggagccacccagacagcaaggtccaggacggctcgctctcagatgtcttgctcgatcccagtctcgggtacgccttcccttctgcctcttcctggcccccacccttttcacttcgaggttttaccatcaagacacagtctggtaaggtctcaaagtgacccatcacaaaaccaaggcagctttaggctgtgaaagcatcggacctttggcaagggttgtcctccactctcgcctgctcactcgctgtcaggggcttctttacagatctgtcttttcttcgtaacgacaccaacacgcagcccgctggctgtccaggtatggcttgcagcctaaatggatgacgctgtcaaagaggagctccacggttgtctcgcatgcctggacgttctgagagagtccgagtgtcttctgcacgtctctgc

SEQ ID NO: 195 - DNA, 608 bp, Rattus norvegicus
  Genbank Accession No. AA849731
  misc_feature (1)..(608): n = a or c or g or t
aaaatgaatcactttattgaactacaggagcaaaaatagtggatttaaccacatttttaagagaccaaacaaaaaaatgctacactgtttcccctttctcctgaaacagaataggctcactggaagcctgtgccaagggtaggatttgtgtcatagtagacttcaattatgtgtgactgaagctactgaccaggtgaccatgaaaacacattatacctcctgatcagaaagatcaaggctccctttacttccattgggaaatgaatcatttgatttagactgaaggttatttttctggtatgatggctataccagcagagcctggagaaactactaacaggtgatcgtatctgcatgttcagtgtgcagtgtttttcttgcaagtgggcagaatgctctggactttgacaggagtccctggttgtttctggcctgccttagcaaccttctctagtgtcctggtctcaaggggcacttcttgcgaaacatangtgcgattttaggaggttctggaactggggtttcttctgtttcctcactgtcttcatggaggagatcatatgaaatgtttccatactctctcaaaaatgggaatatttcaagcagaa

SEQ ID NO: 196 - DNA, 512 bp, Rattus norvegicus
  Genbank Accession No. AA849766
gaacatcatagccttgcctttaggtcaccaggagcctccaagctctctatgctgtcagcatgtgtgctgtagtgtgcgggtgagagtgactgctcatgggatagatggctgggttgtgtgctccctgctagtccccacctctctgtagggaaagctatcgtaaagtagccctctctgcctccagccttcactgctcctgggaagaactttgcagtgagtgagtgtactccttgcttcctggtttccgtgcagtggtgcagtctgggccttcggcttacccaagccagcagctctgcatagttctacttagaaaacaggccctgagactggtgggccacatggctgctacaggcgcagcctcttgatgtcctcattgcggaagtctatgcgcagagccagtacctgtcgcacttcagcaggggtgaggcgccatgtcaaagggccagagttagcaccccagtaatctagtatctcggtcacccgctctagattaaggattgtagccatctggg

SEQ ID NO: 197 - DNA, 582 bp, Rattus norvegicus
  Genbank Accession No. AA849796
gaaacaattcaataaaccatttatttgcaaataaataatgtatgtctaccacacctaaataaacatttaagaactagtaatactaggatataacctcagtattacattgtaaatggggaatcaaagtccagagttaggatgcccaggctgaggcgctgcctccgacttaactgctaaatcatgtggggagtgatctttgatactttaagtcaacttcaatacagaactatcctttggttactccatacagttagggaacttgttttctacacttaggcatgacccttcaattaaaatggaagattcttattatgaatcaagagactcatctacacggttggaggatccacttcatccatgctctgatttagtctttctgaatggactggtttctaacctagactaagtacaggcctgaaacttcaacagccatcaggaaccatggagcgggccatgaaggtgcttcgaagggccacagactttttcaacctgggacagactgcaacactcgtgccacaccccatatgacaaaaagctggaaaacaaggtgtgtgttttcacttatgtatcaccagatgcaac

SEQ ID NO: 198 - DNA, 504 bp, Rattus norvegicus
  Genbank Accession No. AA849917
aaagatagtaaaacttgggatttatttattcagtcataacttaaagcttaactacttcttctccgagcatagacagtcttctgtaccatggtcctatgtaggtatttagtcaggagagtgaagagttaacagatggaaaaggtctctggggcagtccatttgctgagacctcaagtgggacagggcagtgagcagagacatctgaccagggcactgtgggtaaggtaggggtgcctcagacttggccctgctactctcgctcctaaagaactatacccttcaagcctcagcatctcacaccccaatccctcaggctctgcttcctggatgcccaactctcaacagggctgccaaccactaagacagacacagctgctatgtcccacctctcctcagcagttaaaaaggaagagactaacggggagcctcggagtttcacttactggtcacagttcgctatgatgccatcatcagtgtaaacaatgttgctttagctgtgtaaga

SEQ ID NO: 199 - DNA, 556 bp, Rattus norvegicus
  Genbank Accession No. AA849957
gcataataaatacagaaaaaagggtgaaaatgtatgactcacctatctaattaaagctaagtaaactaagctagtcagattttagcttttcaatgagaaataacagtgagtgaatatgaagaaaaacagaaggatctttactttcctatattaatacaggccgaggaccccttctcattaaaagggttgataacaccagttcttagcaataaacataaggcacttgtttagattacaacatcacactgcatttttccaacttgtttatctaaccctgttttcccccacagtatcactggaaattaactcaatatgaatggggtaaatgtgaaatgatccaattgatagatatgctcagagtaaagtacaatgttttaggtgaacccagtcaaggtcctgtgataccagacaatgtatccactatcaaataaacctgaaagaaaataaaagatttattcaatagttccagtaaaattggttggaatacaatatacacgacaggaatttggctcctctcgggtggcatcggcatcagagttctgagtatttctggtta

SEQ ID NO: 200 - DNA, 466 bp, Rattus norvegicus
  Genbank Accession No. AA850060
ggggttgcggctatttatagttgtgctacttgaatgatagtggtggctgggtggtcattgtttgcggggatttttattattattgaaatcactcgggattaagtgtgtgtaagataaaaattagtgaaatagtgatgagaaatgataggaaatatagtttgattagtcctttttggttggatattattttagatagttgggtttgggtgattgaggttgattttgggattgtcttttctagtcagattaggtctagtaggtttaaggataatttgtagctagaatttagagttttttgaggaataattcggtgtataattggtgggggtcagagtgtatatatcatgaagagaattgtataattgatcatgttacgaatagggctactgataggaataggattgagaaatagtcaattttgaaacttatagtaagtttaatagaattaatagttagtcaatgtcag

SEQ ID NO: 201 - DNA, 511 bp, Rattus norvegicus
  Genbank Accession No. AA850247
gggaaaccagctcacgtttaattgtgattttaaaattgtacaagtttttttacatctgccctcccaccccatgtgtcgactcttaaaatgacagaaaaacatcaccaatcacaggttgaatggtttagtaagtttaccccttcagttcctatatgaagcacccagtattccttaaaacacgagtctgacctggcagtggccaacagtaagtttcatcttcagagttgctatgatgcagtggcacttgtccagaactggtaccttcccatagctggggaactttaaatgtaccagtgaaaaaacctgtttccccttcaaggggaacaaagaacatgactcctcagaacccaaccagtttggctgaggtctatctgtcccatctcttaggctcctttcccccattcctttccttttctgcagcagagcagtaaagaccaaaacctaacctgagttacaaaaaaacaagacagtgatggctatagagggagtgacatggagcagctggcgtgct

SEQ ID NO: 202 - DNA, 470 bp, Rattus norvegicus
  Genbank Accession No. AA850524
agccgcgtcccgcgccgccgcaggtgaccactcgccgcgccgccggaggcttcacccgcgtcctccctcaggacgcgcccgcggagctcgggcgccttctccccggacccggaggccgcgctgcgcggggcggcggcgaggccggaagatggcctgggtgctcagtatggacgaggtgatcgagtccgggctggtgcacgacttcgactccagcctgtccggcatcggacaagagctgggcgctggcgcctacagcatgagtgatgtgttggcgctacccattttcaaacaagaagactccagcctttctttggaggctgaggccaagcaccccccattccagtacgtaatgtgtgctgcaacctcaccagccgtgaagctgcatgatgagacgctcacttacttgaaccaaggccagtcttatgaaattcggatgctggataatcgcaaaatgggagatgtggctgaga

SEQ ID NO: 203 - DNA, 426 bp, Rattus norvegicus
  Genbank Accession No. AA850563
ttagttgtacacaaaatagtgctggaaatcagcccataattgctcatacaattcacccgtctacttgcctcccccttccacaataacttaagcctgcagaggagacacagaactggtggtgtcctcaggggtttctcaatcctggttcttcagttcacagatcagcctcgaggccctggcccccatagtccccaacaggagccctggggttagcatcagagctaagaacctgctgtgtcctgtctccaagcctcgcccagccccctcagcccaagatctcagaagctctgaccagagccatgaggcaggtgaagctaacggcaggccacactgagagggacaagaaagaccagtcaccttccgttctcccacagtgtttgggtgtgaggagaaggcatatcatatgaggaaatgtatttaatacag

SEQ ID NO: 204 - DNA, 649 bp, Rattus norvegicus
  Genbank Accession No. AA850735
cattattaataacgcttcaatttattcaaagcaatgcagtttcaaaaacttaagttacagcagtcaggaaaaaaaaaaccaaaatagtcagaaacacatgatcagtactgcctgtccttgtgtttaacactgtggtggctttattcaaaatacagttgcacaaaagtattaactgcaaagtctctaaggacttaacatattgtatacacacgcacagtacagagagggttagaacagaacccagaacttctacagaatagaaaacccacccttgcctatttgcatgaaaataccacccacagagctaataagtcttacagttatccggaggccctatgtgctgtttttaaactcaagaactctaattttgattgcacaatagatgattgataaaaagtcaatatatagatttcatttttaaaaataagcatttattttgaacctggcatagtttgcaaagagaattcttagggactggagcaggaattccaattactgaactaaggggacaaagttagtcctttggagatccctgctctcactgagttcatcaaccatttatttcagtcaggcatatgactttgtcagtttctctacaaataagttcatacttcttattttcaaacaccaggtcagacatcttaccttg

SEQ ID NO: 205 - DNA, 612 bp, Rattus norvegicus
  Genbank Accession No. AA850743
agcaaatcctagcacattattaacaacaacaacaaaaaaatctgtacatttgccatgatacacttggaggtgaaacaaataagatataaatacagatatggatgtaacatgaaaaagccccaaaaaaacccaaaacaaacaccacccaatctgggggcgcagggaccatgcgtgtgaactatcttggtggttgattgttttcagagcacttctctcttccgaacgttgttagcagtgtcctggttggggggtctataaagttctaatttgccttcctttaaagtgtgagtttccataagggtggcagagaaaggaacaatagatgtaggagacaaacctgctgattacctgcacaggtgttgaaaagctagttgtgagccatagataaggctagcccaggccatctgtgggcacccggtccgcacagcacatgagtgcacctggaaagcgcctgtccagcagaggaaggagcagcttgccaggaagcaggaagtcaggtgaggatcttaggcaacgttctgaactgtccagttacagtggggcagagaatgccagagcaaggccttcctaactgcatcaggcatgggagggagttcacctacgtaacctggc

SEQ ID NO: 206 - DNA, 481 bp, Rattus norvegicus
  Genbank Accession No. AA850824
tttcaagaggtctttatttagatataaaaaaaaggtacagtacatctcatgcaccagggtgactaatagatagtcattatccttacagcaattactacaaaaggaaatcgaaactttcgggaattgttcatctaactaagaaacctgaatcaaaaaattgttagcctaaatagcaaactgcttattatgcaacaagccttattctatgtttgtgagaactagagacttataagtgtcgttagtaaaaaaaaattaagagaaactaattattgattagacaaatgtcagtgctatctatagtcccctgcagagaggccttgttgggggaagggtccacaaaggagggtgagtgaccaggcgaggcaggtacctcccacaggtaacccgggcaggtcttagctcttctgggatctttctggtgagtgggttggaggctatccttgctctatgaccctgtcacctatggtctccactgtccttc

SEQ ID NO: 207 - DNA, 431 bp, Rattus norvegicus
  Genbank Accession No. AA850872
  misc_feature (1)..(431): n = a or c or g or t
gacaagaatgagactttaatcagttttaagtggagtttataacactaagagataagggttgttaacaaacacagtaacaaatggacatctgattggtttgaggcattatcctgtacacgtcgtatttgtgtatcctcagtgcatagcatttacacagagccactgccgcacagcacgagagtatctgaagaggctgggtcagggtaaggctgttgtacagactggattgttttagtatatatattctatatgaaaacagatcgaacttttgaactggcaggtaggagtcaactctgccaaatactagagtccaagcgcccggtttagtgcacagacccaccccttccgcctgcatgcangacacattaacagtatttaaaggcaaacgaggcacttgtggcaaccacagccgtcgttatccacatattgca

SEQ ID NO: 208 - DNA, 496 bp, Rattus norvegicus
  Genbank Accession No. AA850916
caggatacaggcaagctgtcgtgggttttagagaagactatttaagtgagaaggtggtcgctatgacaactgcagaaacaactgtagtttctcaaagctgactcctgctggttctctgaggaaatgcaggtagaagctgatctgtgtatgccacagcattgactagatatctaatagggtctcttctcctggaggcatcgtagcctgggactccttagctacaagggacgctgccccaggtaggacctaagtactctctcatttcccagggcctggttaacccacgggcaatagggacctaccaagatcacttgtctattccaaccctgactttattccatcctgaccctagcttcccctagccttcctaaggggctctagatcaccctgatatgtgggtaaatctattaattatccccaaatcgcatcatcccttacctttaacaacatcctggtacttttttccccacctacatatatgcgtgcctcatcaaac

SEQ ID NO: 209 - DNA, 195 bp, Rattus norvegicus
  Genbank Accession No. AA851034
caagccagaagaggaagagagtccagtagctttattcaccacttatatacccaagttcaccaggtagaaaatatctgggaagcacagtgggaaaccctggctcgtgactttggtaacaaaagacagacaacgtgacctgaattaattagtgagaaatccgggaagactagcctaaatctcaaggacaaaggccga

SEQ ID NO: 210 - DNA, 412 bp, Rattus norvegicus
  Genbank Accession No. AA851184
ggtgacgccagatactttactcatctcaggcagtctggactagttcccctcccgtggactccagggtaacaccagaactgtcctagaccatagctgtcctctctggcggctggaggtaggcctgcagggcacggtggaggaggaagcaggtctgtgggtggagggaagcaggtctgaaggtggagggttccagtgtagttgtggctcatcctttcctatcacctctcatcatggttcacagtgttgcttccagggacatctacctagacaatggggtccccaaatgtgcaggcctcctcaatggcgaggttgtagctggaacctgtccctcccttataggtgctggtcacaattctcatccagcctcgctcaccccaaggctcgccccatgaattgcggacaatccaatact

SEQ ID NO: 211 - DNA, 464 bp, Rattus norvegicus
  Genbank Accession No. AA851210
  misc_feature (1)..(464): n = a or c or g or t
agcagctgacacaaaatagtttattaagggaacaagggaagaggtgccctatgggaaagtgctggaatgtgaagactccacccttttgttcaggaactggagcaggtctggcgttgcctgaggctgcccagagtctcaggggcgagggcagacgttgaggcttcggtcagcaaagcagcatcttcccaggagccgtcactagcctctggctcctgctccccttctccattcagaggctgcttctctggtttctcttcctcagacagctgaccctctgttcctgagggatcctcagggctctcgccatcctctgtcacatctgactgctgggtagacgcctgacctggctgatggcgagagatccgacgctgggccccgtgtcctgaattatccctttgtcggatattaacctgcaaagagaatcggtgtcggngccagacagcactccacacccactgcatata

SEQ ID NO: 212 - DNA, 680 bp, Rattus norvegicus
  Genbank Accession No. AA851239
  misc_feature (1)..(680): n = a or c or g or t
aatactcacaagatagcctctgctttaataataaagatctttgatactatgtctttaaatttctgctagcttctatttaaccgctctttcagaagttatttatacatatttactcaacacattctggaaaatataagaactaatgtcgattctcaaggtcacacacggtggcaggttacaggagcacactgactccttgttgcatataagttgcatctaagaaacatggcgggcacattttagtgatccatgcagagtaggttcacgaaaacaaacaaacaaacaaaaccccaaacaattaaacaatagtcagccatgaaaacttaacactcccagtcacgacaggcataacagcaaaaacaccagcactgacggctttgtccaaaccatgctgggcttagtcaattctgcttagaggggccagaaaggacactggcaaccaggaatgttcctgattctcaacactgggttcagactaaactctcctcacatggcttttccctatactgcaggcatttcaggcttcanataaaaacaatcaaccttcactgaaaagttgaaaattgtctcttttgagtctctggaagcagctcgctgtaagtccataaggcaaatgccagggctcaaacaaaagcagcctcgagatgtaaacaataatattaccgccaaaggaattacaa

SEQ ID NO: 213 - DNA, 499 bp, Rattus norvegicus
  Genbank Accession No. AA851273
ggaaaggaacagttttattagcctggagttgaaagtctttgggaggccatatggtgggtaccgccacggctgtacaggaagtaagatgaaaccctgtccaaggcttatttggattgtagagccctggagaaggcaaactgcccaaggaagaagtagatgcgggagtcctcgccggcctgtgctatcttactgcactgggattcctgaggctcctgctgaggcccttgcttcagtattgggcactggaccatccggcctagaactttacccttggggtccagtttgatgcaggccaggcatttccgcttcctcccatttggtttgattgtacactccggctttttccagtccttcttcaggcagctggtctgctggagcttaaattccagcctcacaaaggtgccagctgataagaacaggtcatcagcactgtccacaccgatctcctggaaggcccactgcacaagcgggtgtctgtggaactcctccagagccacct

SEQ ID NO: 214 - DNA, 609 bp, Rattus norvegicus
  Genbank Accession No. AA851364
acacgttttaaaatccaaggcctttaattcaccttttggtaatgaccataaatgcctccacaaaacctcttttccactgtaaatagaaggcactaggcattacataacaccctaaaagcactgaatccttctgatgctggtggagacaacacattaaacggcagggtttgaatactaaactctttaaaaacagagaaagagacaattctgaaaatcacataaaaatttaagttactgttcagtcttccttgggtttccaatgcaaccttaagctattcttgcacagacataatttgaaattaagagataaagtaggagaatatgatttcgttttcaacatgtgttgagtttctgttatatgtggtaaatgtaaagacagcattttcatgctaattgatattttatgtttttctttaggtgtgcaaaataaacttcaaatgatatatcctgtagaaatatatttcaaaaatccttgatataacactaatgatttccatattcatgtcacaaactgcatataaattgtgaaattattaaaatacatttatttgaaaaataataagatggccatttctacctaaataaagtttcccagaaagttatgaagta

SEQ ID NO: 215 - DNA, 393 bp, Rattus norvegicus
  Genbank Accession No. AA851403
aaggtgaaacctctaggaacaaggagtcccattcagagggcacgagagcccacggagcctcctcagatctcatagtgaaccacgggctcaggttctttggaaggatcaccgcctcgctccaggtacagattattgtacgggtactgcttcggaccctaaggaaggacacaagagaagagaaggtgcacgtgtcagcaagaacaatagccagccagtcagccaatacctgactacaccctacttgagttcacaatcacgcagagcaaaagggggtacagtagcctctggtcagactccgaggagctaaactggcagaaggatgctcttgccctgctcaacccacagcagagagcgcctcagttatgagagaagtagtgtctgccggcaagtgag

SEQ ID NO: 216 - DNA, 449 bp, Rattus norvegicus
  Genbank Accession No. AA851493
agagctattcctctccccacatggccacttctgtcagatggagagctgtcagatgagcagcttgctcctccctctggggccagcttcgttgttttttttttttttttttttttttgcgcgggggggggggggagtggttccagttccatgtccctggggccaagtgcactgatgtcactgctggaggtaaatgaagaaggtccggatttccttggggtacacagtgatgatggagcctcctggtgaccttggtggagaggtagggtgcccttttagctggccaatctttgtcctccagtgccagcgctgcagcgtctgcacatcccaggtccctgtgagtgagcgttcctccacggccactacagaccctagtcctcgaagtgcaatcttgagatccactgtagcaggccgagacagtacggggtcctcccctgcttcatacacgtggt

SEQ ID NO: 217 - DNA, 337 bp, Rattus norvegicus
  Genbank Accession No. AA851637
ccacgtgacagacagcatttatttcagagtccagtgttcacaaatgatgggctgaggatgaaggcagggaaggggtgggttggggactccagtgtcagactacacagcagggtatcaggtggggggtagtgcccagcaagggagacaggaggtaaaaataaccccggcctgccgaccctcagcgctgtgtcccaggccgggccctgggcttgggtccaggagctattctggggcctgggagagttacattccctggaggaaggccccctcccagcccccacctccctctttccctccccaaggccgctggccactgtgggtccctgcccagcaggca

SEQ ID NO: 218 - DNA, 318 bp, Rattus norvegicus
  Genbank Accession No. AA851660
aaaaaaatagtttaataaaaacgcactaggtaggttctacaggcagctttcatggtcacttctgaaactcgctcaccatcctccaaggaaacaatgctatgtcctcctgttaaaaatggagtccttgtgtcacagagaagtagctgacagtcaccgggcacatctccctgtgtgcatatcgtcaatatctctcagcaccatcggccttggaggatgttgcggtggaggtgagaaacgtcctcatgctgacagaagctcatcttcgctaccacggggtctgcgtgagagcttgacagagaattctaatgtcggagtcag

SEQ ID NO: 219 - DNA, 477 bp, Rattus norvegicus
  Genbank Accession No. AA851788
aaagaagctgtttgtcattctttgtttaagagattacaacacatacaagtgaattttatcaaaatacagcacatttcttctactatattcataaaaatcaattcctatgtaaaagtactgaaaatcaactaaaaatgagttaaaatttacaaagagttgttaaagggtttcaatcaaaattattaaaactatacagtacaatacccaattgataacagcttgaaagaagtgcaatattgaagttcaaatatttttaaaagtgctgactattttgactagaaatggaaatgagtccgactcatttgtaaaaataatgtaggtggtgctttagctagtcctgtaagaacaaccaatcaaggttgaagaaaagagcataacacattagaaatacccaaattatgcttctctgaaattaaaaaaaaatggattaaagaactgagtattgctttaataagagttttcagactagcttctact

SEQ ID NO: 220 - DNA, 409 bp, Rattus norvegicus
  Genbank Accession No. AA851820
ccttcagggtaggaaggggtccggtgttaaattctaatcttggttacccctggctaggtgtttccagaaggtgttccaagtttgccgtccgtggaggcaagacatttactaatcctgcgtctctcaaattagatgccgatgggaaactgagtgtgaagtttggggtcctcttccaagacgacagatgtgccaatctctttgaagcgttggtgggaactctgcggatctcatcaactgaggttgagctggagggaccagggatttggggccagcctgcggtccgtatggagattctgtctaaggccatttaaggccgtagggatctgggtcatccttctctgcctcggtcttgggttttctctccctagtttctccccttaccaaaactctgtcccccccttaattttta

SEQ ID NO: 221 - DNA, 591 bp, Rattus norvegicus
  Genbank Accession No. AA851953
aagcataattaaaatcaatgcagaaaaatattagctacattgggtaaaagtagtgattgttgcagtatttgcctgtaatccagtgaagacggtgtaggaaacagcatcactaaatgaaagacagaatggagggtgaactgcgaaggtcctgcatgctctactggcttccaaaggcattcagagggtcatcaaaaatgttggacactttgttctcagaccttaattcagatgctgcctcagcagattggcttttgggtttagatgctttagcctggaggccagaggagaaaatatcatctgtatcatcgtcaaacatggacttggctgtgactttctttttgggcttttctttgggtttcacagtcaagtcagcgaagatatcaatattatcatcaaataagttgggttccaaagttctctccttctctcttttttttggaaaaggcttcttaattgcttccgtagcaaatatatcatcctcaaagatgtcttgagtttttgacacaacgtcctgatggctgtcagatttccactgattctttttgcctttctgatctgcaaagaggtcctcctcatcttcaaggaggggga

SEQ ID NO: 222 - DNA, 566 bp, Rattus norvegicus
  Genbank Accession No. AA858518
  misc_feature (1)..(566): n = a or c or g or t
tttttttttttttttttgaggtaggaaaggctattttaataaattatcttaattgtagacaatttcccaaaattaaacagacaaaatgataaaccatgccttggatgagtcccagaggccacacaccattccctctatctgaaggtgaatccctggagtgtcaagtctgtccagtgacttggtgacaaggttgtccagggtcacccaccgcaccaggagagcctctgccggctctcacttgccgattctttggaccacccagtcctgctggcacagagggcagcggttgttctgcttcacccacagggacatgcagcagttgtggaaggagtggttacattctccccagaccacaacacagtcctcttgtttgttttcagcttgacatctaagacaggcatccatcacctggaccctgcagatggcgcaggtatcgcactcaacgtcncagctccacatggctaccgcgttccacttcttgagggagaacatcttgtcgcctcccgacttggagcctgcgctcccagaatgcgaggaaaggacccaaggttcctcgccgtcctcca

SEQ ID NO: 223 - DNA, 522 bp, Rattus norvegicus
  Genbank Accession No. AA858548
cggccgaaattgttttatttttttggttttttttttgaccactcagacacggatttaataattgtagaaatccaaagaataagcatcaaatctcgaagtcagagtgaactcttgcctgcgggttggcttgactacgcccagccactgagctgcctcaaccagccagggatctatgaggctgacttctgttttcatgatgtcaccatatgtagtatgtattttgtctcaataaagcatttgtaccgatggctctggagcttggaggaagactaaaggaatgtgtagtgattctgagtaaggtgtggacctacacggcagaactatctgggggagggaaaaacaaaggcctttcttcccgtgtcaggacagtcttgagtggctgaactaagcacatgggccactggggctacactgtctgaactccgacaggtcctgctcctctagggagagcttgcagttgggagttttagcagataagcaccgaaacaggtttccgattccttcctgcagctgttgtgcctc

SEQ ID NO: 224 - DNA, 453 bp, Rattus norvegicus
  Genbank Accession No. AA858572
tttttttttttttttttctgtttgggggcgttccactttattgtttctgagacagggtttcatggagctctggctggccaacgatgaccttaaacttctacttttccaacatgtacatcctgggttctgggattacaggtgcgagccactgtgagtgatttatgtggttagggatggaatccgggactttgatgcagtccctattaactgaatcccggccctggccctatgtctgtgtacactggcagacacgttcagaggtccatgtgcagatgggtacacgtgcaggtagaagccagaggttcttcgggagtcatcaccttgttatttgagatgggatcctccactgccctggaactcaccaggcagatcaggttccctaactaggaagccctagggaccctcctgactctccgtcctaagcactgggattacaagtgcctgaagccacac

SEQ ID NO: 225 - DNA, 522 bp, Rattus norvegicus
  Genbank Accession No. AA858636
tttttttttttttttttggcagtcaaaacactttattggcagaataaaaaagtgcagcatgggaagtattgacctgccagacatttagctcctcatattcatccagagctgcctggaactgggctggtgtgaagccacgtgatatgcagcgctgttcagcctcagaaaagcggacactccgtccccctgataccaactcacggacggtagcaaatatcacatctgctggcctctgggtcctagccgtttgtcccttttcacccagaagggagtcctttgacatctccatcaaccttatggcttcattcacatcttccttctccacaatgtctaccatccgaaggcgagccagagcagtagaaagtcggagaatggccagcagggtccgggcagaagtgtaggtggcatccttactggcccgggcctctcgcctcatctccacatacgctgcagtgatgtagtcagccagagagtcaggcactgtgggctgcctctcgcggcacatggcaatgtaccgtctca

SEQ ID NO: 226 - DNA, 275 bp, Rattus norvegicus
  Genbank Accession No. AA858674
tttttttttttttttttcaaacaggaaattctttattgcaaagatacaaaagcagtcacggggacatgtacagcaataaattaggtgggggccatgaggcagggtgcaaacggggccaaaagtctgtgatcttgatcccttcccaataatttataacatgggggaaaaaaagcacaaaaaaaaaataaatattgaaatgaaattgccaagtggaaggcggctgaggatgccaggcctcggaatgatcggcatgtgtccctgaaaccctcgtgccg

SEQ ID NO: 227 - DNA, 609 bp, Rattus norvegicus
  Genbank Accession No. AA858695
tttttttttttttttttccaatcttaaacaaatcactcaacgatagtttatttattccattacagaattaggcacgcttcagattacaaaaccaagctcattataatcctgaaggattagagtatcttcaagaaaccagtcacagctcaactgaagtgaacatggacacagggttggtgtctactgagggaaatcatgttcctccaatacacggaaagataatgagatgcattttcttagtcaccgaggaaggcagtttcttccttgataagctgaaactatttcttttttgtagctcttttcccttctcctttccttggcttccccttcccccggagcttctttagacgtctttgctcatccttaaagtcctgatgctcatctctgtaaaggccaagaaaacggagggtgcccatgagcgcaaaatacgtgttgtgattcgggtaccagtcgtacgtctctttcttcttggccaggggctgctcgctgaacaggtttaccactttcatggactttgagtcagtaggcctggccacttcaccaaagatacgggcactcagacgggacatgcgcactgcatattctgaaagcgacatttccccagcagta

SEQ ID NO: 228 - DNA, 515 bp, Rattus norvegicus
  Genbank Accession No. AA858853
ttttttttttttttattagaaagacttttattaggaaggatgttttatgaagtgaatgggtcgagggatctggcattccccaggctttgcctcatccttcccctcagcattcctaacaagctagagggagcaccttcacagggtaccctgctgtgattcagaagctcaggcagcagagggaagagtctcctacactccagatgtgtaggtagcagctcacagaggttgaggtcctgtatccctttgcagtgtggctgtgggagaccctggagtcgactgttcctgggagtcatggtggtttgatgtcaggtgggcatggagcaatgcagccacctcatcctgttcagcctccagtgcaatggccaaggcacttgtgccctcattgtctaagatggttaggtcacaacctggctgggccaacaacaactgaactgtatcaaggcgtccatactcgctggcacacatgagtgctgtagccccatcagcatcctgtacattgacatcagccccacatt

SEQ ID NO: 229 - DNA, 496 bp, Rattus norvegicus
  Genbank Accession No. AA858903
tttttttttttttttttagaaataaaaccactttactgtttagaataaaggacacactataaaaagtgaacattatgcaacattacaagacaatatacattcacggaatataaaattcataaataacatggaggaaaactgtaaacagtgctacaaaatttagcaacaaatacattccttctagatgggtttttctctggctggagtctcttcatcactactgggcttcagcacagctgacttgttagaagaaaagtagacagagaatctaaggtatccctgtccccagagcatggtcttttcatcaggtcctctcctcctcagtcccaacagccaacttaaatctgttgagaccattctctcctgccttctcccatttgattatgtttctgtgacttttctttttttttttttttgagtttctatgatacaaatattagagtgattaattttaactttaagtagctaggagccaaatacctgaatggcaccttga

SEQ ID NO: 230 - DNA, 511 bp, Rattus norvegicus
  Genbank Accession No. AA858953
tttttttttttttttttggtttttagcgactgttcgtttattggttagtgggagtacagcccatcggaacacacgacatgcatttgggggagagcaactgtgcactgcagccgctgtaaacctgctgagtgtgcgagcagcgcagacggcacccacggaaaaggcagggatgacttagctgtctacggtggctaagtgcaaagtctttgggaacagatttactttttgttactcaggaattacatcaaagaggaaagccctaactgccccccgttcttaaactaaaggctaagggggttggaatcatttgataacccaccatccaaatcacgttcattgcaaactgtaatccaattccccttcattaagttttccctgtcaacccatacccctcaggattatacacactgtatgagttcagaaaagattaatgtgaatgtaaggggtatgtattcgactccagcatctttgtcacatagccaatttcttttaaatgtctgctataacagat

SEQ ID NO: 231 - DNA, 438 bp, Rattus norvegicus
  Genbank Accession No. AA858955
tttttttttttttttttcccaaatttaaaattttaaaaccggggttcccccaacgggcaaaaagggcccaaaaaaaatttttttaaaatttcaaacaaaaaaaattaaccttcaattggaaaccccagtaaaaaatttttttccaattcaacaagccaccccaagaatttaaaaaataacaacccggggggaaggccaaacaaccccccaaacccaatccaaaaataacccaaattacttcaaaaccccggaaaaggcgttaacctgaaccggaaaaaagggacctttgaacccgccgggaaatttaagattcccaaagcccccaaaaagttcccccacaaaaactaaaccccccctttaacccaagccggaaattgcccaaaaccttcaaaggggaccaattggcattaaaagcctttaagccattttaaccaaccc

SEQ ID NO: 232 - DNA, 147 bp, Rattus norvegicus
  Genbank Accession No. AA859114
tttttttttttttttttgggttttaatttaattttatttttgtcacatgggcagtataggatggtgttagcccatccttactccgcttgcattgactgtgcctcgggtcttaagacgctaaagtgtcatttagaactcactcccaga

SEQ ID NO: 233 - DNA, 545 bp, Rattus norvegicus
  Genbank Accession No. AA859284
  misc_feature (1)..(545): n = a or c or g or t
tttttttttttttttttggaaaaccaaacatgctttattttattcttcacaatttatttaaacatctcacatatacacaataggtacaattcaattttttttctgcttgtccaagaaacaggacttcttcggaaccacggggaggaacgaaaatgaggctggcaaagaaacgaatgctgaatctagagaggagagaatctggggcaagtgttcttcattcctttagttggggataaggtgaacgagagggccgctaagtcaaattaagaatcccactcactgcacatcactatggaggatcgagtcttctgtaattcttctagctccatccacattcttcaagtgtctgaaatactactaattagcacctttgtgtcgaaagcaaaacaagtacctcagttcatgactgtctgcatcaacccccattggggtggtctacactcacgggaacgtgtcttgaggtanttcanacctttggaagtttgggttttaaacttccctttgtggaagatagtcagaagccacaagtggtgcaaatgttcatg

SEQ ID NO: 234 - DNA, 511 bp, Rattus norvegicus
  Genbank Accession No. AA859319
tttttttttttttttgtggatctacagtgtgcatgtgctacctagtcaggtaggaacccaccatcttagctctgactcagggtgccagcagtgggtcattttatctctgatgaggtagaaggggccttgtgctcgcggcaagctttcattcccacagatgagggacacttgcaaagtgccagcaaggttagatctttgccacttctttgattatttttttattaatttgggcttttaaagggctgttaaaaaaaaaaaaaaaaaaagaggccgggaacctttgagtaggcacgctgcgtaccgagctccctagaacctttaactagagttcatcctggttcagtgtatgtacttgaagaagcactattataatcaatgagaatctattcgagtctgccatttaatttaaaccttttctgttgcagattgctttatttcagggaaatgattttccagtttttgctacattctgcaaataaaaaccgtgtgtttcctttcttccacctaaact

SEQ ID NO: 235 - DNA, 568 bp, Rattus norvegicus
  Genbank Accession No. AA859343
tttttttttttttttttgttattaaatactctgtttattgatcggcttgtgaggacacaaacatcgcactcagtagaaagaatataaaacacatcaggactgtacctgtacccaggagccaacagcagtcctgcagcagacctggcctccatggcatctgctgttcagcctagctcaggagccacgggagggcagcttctgcccctgcctccttcccctcacccaggttctctgctcctcacttaagcagcagggggaaagcccttatttggtgggacttatttccggaatgaagtgccagggtctccccccattaaaatttcccatggagtcaatgattaaaacaggcctgctgttggcttgtgtttcttggttaggtcaccttaatgtcactaggattcctataatcccacaactgagatttgctgagacgcagtttcaggtctgctattgctttagatgtcagcacagttgacaaccccgagtggattggaactgctgtaggatttccctgccgttgtgtgatgtcatctgctctctgttcttgataggtacacagatagcctga

SEQ ID NO: 236 - DNA, 481 bp, Rattus norvegicus
  Genbank Accession No. AA859346
  misc_feature (1)..(481): n = a or c or g or t
tttttttttttttttttaagagcatatgcagcacacctggctttatttgtgtcaacgcttatttagaccacatacttgcacgaagtggcagggtcacacagaactactttgaggggtttttactcttgggtggtttccttatcttactcgggttaggaacgagtctctttattttcaggggttgtagtgttgcagctggagcttgtccaccttcagcaagcttcctcttaagtcttgtaaggtcatcaaatgaagtgtccaaaacctctttgtcctggctttccaaagactccgtctccaaactgtctgtgagaccttgggttccgtctggaagccagggcacatttaagctgggcaccctgggaatgatggcttctacttcatcagcaaagtccatggtgttctttctgaagcccaaggctancacacattttaagccaatgactggagcaattctctcgctgagctgaggtacctgaca

SEQ ID NO: 237 - DNA, 558 bp, Rattus norvegicus
  Genbank Accession No. AA859348
tttttttttttttttttaaggatcatcctactgctaagtcagtgtctcctcttgattctagtgttttggccacgcctcaccaaatgtctgcaatgatccagtactcacaacatgttcaggaggagctgggtcagattttgacagagggtatgggaagggaaaggggagaagaaatcgacatttattttattatttattttaaatgtttacatttctttgtgttgttccaagcctgaatagaaacagatagcattaaaggactctgttcccaccccttctctgtctctctctcccccacttgtgctaacttaggataacactctctatttcgttttgtttctaaagtgatttgtggacttgtgccgtgtgaactgcattaaaaaggttctgttttcaaagatcgattgtcgttcctgtggggacagtggctcctaagaaatctgcattgtaggagaagacaatgaaagaccctggccctgtctctcaaaacttaactctctgtatgatttaaaaaaaaattccatttactttactttgtggttacttgattttgaggaa

SEQ ID NO: 238 - DNA, 604 bp, Rattus norvegicus
  Genbank Accession No. AA859447
tttttttttttttttttcaatagaaaaaaataacttctttttatttacaaaaacaaaaatccaaatattggatgctgtaaacaaaattcacaatctgttccctctagcactgatacgaacatgtcagttttaaagagtccattttccgtcaactccttttaccgcctgtgacacacaattgtcaaaacattccaagagtgacccagggtgcagcttgctgtagtaggacaactcagagcaggcaatggttgtagggaggtgggagagagagtcaacagtaaacatagcctcttacattctgtgaagccttgcagcaagcattcccaagcccctcgccaccgcccactttgtaaggttatcacttttatctcagcaagtcattaccatgacaacacgtgacacggagatccctccacagcactgaaatggtgatgctaaaagaaattattaaagaaagagtatattcaaatagatgctatatatgaaaacaggatttttttttttggcttttttgttttgttttttatctaacacacatttttctttcacaacaaaagcttatttttggacagctgctgacagcttttaacataatacatttcat

SEQ ID NO: 239 - DNA, 458 bp, Rattus norvegicus
  Genbank Accession No. AA859479
tttttttttttttttttggagctggggaccgaacccagactactgttttttttttaatttgttaatttattctgagtaaacatttgctcataacactttctcagaactacaaatgaatgccagagaattatctccgtaggtaaagttggttgttgctaaacctaataatctgagttcaatccctgaaatgcccatcttattcctacaaatttttctcttcttttaacacttgggctgtggcatatacacaatacacaccagcacatacataaatgatttttaaacccaagtaaggacctgtggagagccgcaataacattcaccaccacaagatggcgctggcttccactgtgccccacgtggaaagccgggatagcttttgccattacaagatggcgctggcctccgccgcgccagccgacttcctttcaggaagttaactgtgtgcgcatgtgcaa

SEQ ID NO: 240 - DNA, 551 bp, Rattus norvegicus
  Genbank Accession No. AA859508
  misc_feature (1)..(551): n = a or c or g or t
tttttttttttttttttgtaaggaggccctttatttccaaaggaagattttaacagaattggctgagacggtggcttggcacacaacagggaaaagggagtggattccttgagaggttcatagaaggcacccgagaacgagctcgtcaaatcttcctttaaagactaaggttgtagcatgagagggtgtttttggggccaacaagcagattctgcaagccacatggagaagcaacctctgtcttctatggccaaatctcgagtgcacatttttgtgtgacagtcgtgctccggcagccaggctctcattaggatgcagccagcgagatgctcgctagggagaggtgcagggtgtggggcactcggagttacattccatgaaagcattagcctgtgagagattaggaaggtcctgattgtccacagtggggggagaactgaatcgaatgcgcacacatgtcagcgtgaaatagctgctgacaattacggagcgaacatgtgcaatcctttaaaaggtggtactgcatancgggccaaccgccacccctctcg

SEQ ID NO: 241 - DNA, 425 bp, Rattus norvegicus
  Genbank Accession No. AA859519
tttttttttttttttttacagtgtaaaagagtaaaacacattttattatatatttttttttctttgaggaaaacagatgtgtgatagaggctgttatgaagtcttgaagggatcaaaactgggcaaggtgttttcaagccagcaagctccagttttgcagaacagctggatgacagtcgccaccagtgaagaccgcattaatacccacaagacagattgcagccgccatcacacacccgagacacagcctcagcagaactgccgggacttccagccctgggaagtaacctcggacggagggagccatcgcatctgggcatgcagtgaagcgggataggtgaaagcggcaggaggaggaagagcatgcgctaactccgctgggtacagagggtacggggcccacacttcacggctactggggtaaa

SEQ ID NO: 242 - DNA, 139 bp, Rattus norvegicus
  Genbank Accession No. AA859562
  misc_feature (1)..(139): n = a or c or g or t
tttttttttttttttttgagataggaaaataaggagtttaataattggagggggcagcacacacactgcagcagtcacaccggtgcggtctgccagcaccggctcctgcagtgtcgcagggaangangggttggcatga

SEQ ID NO: 243 - DNA, 530 bp, Rattus norvegicus
  Genbank Accession No. AA859616
tttttttttttttttttgtggtaaatagtaggtatttatttgaaatgaaaaaaatacttaagtacctggactattgcatttagcacgggctgcgactgcctacctttatgcatcagacagagatacagtgaacacccagaccacagactgcacatggtaggaattcctcagcctttacacaaccaccagagaaacagagatcggattttgcaatacagtacaaaagtccacaatcaatccagtcttagccagtatcttcggtttacttctgttgctgtacaaacgattagccgttactagggcttacaagttaatgacaggacagaaatatacatggcactgacacaaaaagtcagttgtgttaatggtcatgcaacaagtaagcaaacttgctgaaattaaaaatactttctaaaaacagctttaacagcgtaaatattttatacacagttgtttaccaagaacaaaatgtatttaaatgatacaaagcaaaaataagtttctaccacctttatacataagaaagtgca

SEQ ID NO: 244 - DNA, 499 bp, Rattus norvegicus
  Genbank Accession No. AA859643
tttttttttttttttttcactttgtagttaacggctcccctgcccctgtaaacagttttatttaattttaagaatcatgcagcaatccataaatattgcatcttgatgtccccactgtaatgtgcccacaagtgtactccagggagtgtgaggggtacacagatggcacacacacacacacacacacacacacacacacaccccaggtgtgcaggccctaaaacaaagtgagcaaccagcagccaacaccaggtggacaggactagctccccagtgagatggcttagtgttcaggtttgtgcccggcagatgccacagcaggtaaaaactctggtgggatgaaattaggtaaagcaaaaggctccttgaggagactgagatcactacagtaccacgtatagaaaggtgtggtgtggtgaggagccaaaggcaccaagagaacgtgcttgccctttcgcttggaccctgacaaaggaactgtttccaaatggactgggta

SEQ ID NO: 245 - DNA, 545 bp, Rattus norvegicus
  Genbank Accession No. AA859645
tttttttttttttttttgagaaaaggtcttcctatggtctcaaactcagggtgatcctcctgcgttggtcttccacatcctgggattacaaaagtgtactaccttgcatagcttccaacatgtttttaaaagtgctctgaaactttcttcaccagaatattttctctgagtgtatgtgagtgaagttatacatatgtacacatgcatacagaagccagaggtcatgaatgtcttcctcagttactctctatcttattttttgagacagggtgtctaactgaatctagagctcacagatgcagcttctggctggccagcaagccccagggatcttgatgtctcctgcttcccagtctggagtggcaggcacacactgcatgtcccgttttttatgacagtgctgcgagtgcaaatccaggtccttgtgcttgggtagcaatcgctccatctactgagcatctctccgacctataaccacactcctgcgctactcacagtctcatggcaaaggcaaagaacaccggatctttccgtcaacacagatt

SEQ ID NO: 246 - DNA, 283 bp, Rattus norvegicus
  Genbank Accession No. AA859648
tttttttttttttttttgcgactttgaaagattgtaatatattctgtggaaaacattcggcagagcaaaagccctccctgggccctcccgcagtatgcaaccagtggaacggtctggaaatctgcagctctggaaaggtccctggctcagtccttgaggaatgcaggcagctatatgggaagaacctgctccaggatggttctggatgagatggggatcctatcagggaagatgacttcaaattcgataacaaggtctccacgtttctcaggtgttttgggga

SEQ ID NO: 247 - DNA, 454 bp, Rattus norvegicus
  Genbank Accession No. AA859680
tttttttttttttttttaagttttatttaaaaaaccttcggtgcaatattaaaaagcaatacagccaggtggaacagtcgacagacagaaagggaaggagctagaggacccaaggtcctttacctcacctgttccccagaagctgggggtcaagggggagggtctgggggtggtgggacgaggaaaaaccaccaccaggatgaataggtagaacaaaacacatataagatacatctggctgaactgaagaggggtttggggccacaggaagctcccctggtttttgttgttcaaaaatgtcctggtttggggagaaagggtgacccctggcaaatgagccagccaagtcgtccgaccccacactccactgctgtggagaggggtgaactaaggtcacgggtgtgagaaaagggggaaaatggagaagggaatcccctcactggagtctgttagg

SEQ ID NO: 248 - DNA, 455 bp, Rattus norvegicus
  Genbank Accession No. AA859688
  misc_feature (1)..(455): n = a or c or g or t
tttttttttttttttttgggatacagaaatagttttattttcttaatgcagcacagtagacatacaatcgattattccctagagtgtgcaatataaattattcacattaaaaaattaacgacaaagcctgatatgcgggaaatattaaaaacatacacctaatttttatgtgttctgactgcggacatggctagctttataaatctgaataaataggacatggcgcacagtggcttgagtatagacgggcctgctccaggtgtagtgagaacccactctccactttggtcatcgagattccccgtggcagcgtggggcggctctgaaacacttctggcactccagggagggcgtctcgggcgctccccctactctcccttgtancgagggggtcttttctccttgaaagcaagaagaccttccagtctgtccttcgttgagatggtctgagcata

SEQ ID NO: 249 - DNA, 531 bp, Rattus norvegicus
  Genbank Accession No. AA859719
tttttttttttttttttggtagtatagcaactcatttactctgaacatttattacacatttacgccaaatatattttagtaattgttgatagggaaagttcttaaaaaacaaaatgacaacaaaaacccaagagatgcagcaaagatagaattataaactcattacaattcttaacaaaaacagatccgtgccacacaacaatcattgaaatgtctaagccactaggcaacaggtaagctttaaatgttggttcctcacaactaacttgggatccagtgccttcctcttgccttcagtaccaggcccagaccacacggagcacaggtttacatgcatataaaacactgataacgcattaatgggaaattttaaaggatgaaacaactatttagcagttctttaattcactgtcacataaagttgaccctaaatatttagaatattctgtttaactctccatctattgttatccaaaaagtgatagtaactgcagaccagggacactaagctagctcaagaatatagcatag

SEQ ID NO: 250 - DNA, 458 bp, Rattus norvegicus
  Genbank Accession No. AA859750
tttttttttttttttctgaagtaaatagagacatgtagagtcttccctccatgtcaggctgcacttcattagccccagctcagtaatgcagggaaccctagtgacccatcggccaagaaactcccagaagcattaaaaaaaaagttatattccgctgccaagtggatagtcatttagctgtttgtcccttgttttttatttattccataattatgtttgtgctttttcttgtgtgaacagtagtgaggcgtatgtttttatgtggctttagagaaaacttcagtcttcaaagaactgttctaattagttccttctcggaaaaagttatgcgttaatttgtttcaaaatatttaggcattctttgaattataaacttgtgatgcagggatttgtgaacgagacgttcacaagtgaagatgacttcacttagcatctgtgtaaacagaataagatgtgta

SEQ ID NO: 251 - DNA, 455 bp, Rattus norvegicus
  Genbank Accession No. AA859757
ttttttttttttttgctgactgggcgaatttccaatttattgcacattcttgtggggtttggggttaaggagatgccctctaccgagagccggatgtaagcccatgcgggtgccttgtcccagctgcccgctttccccatgggcctgaggctgggtttccatgcaagactgaaagccaggcacacttaacatttataacaatacaatacaaatatttacttaaaattctcacaaaaacataagcacctttaatccatcggaaaggcacatgtggaatgacatttggcctctgagtggatatgttgagggttggttttttttttttttcttttttaaatggaggctttggtgacctttacaagaccacctcagaacatcttttgaaggtcagggggaatacatatcttcaagttgaatttttttaaaaagtgattttcaaatactgtcccgcccca

SEQ ID NO: 252 - DNA, 450 bp, Rattus norvegicus
  Genbank Accession No. AA859805
tttttttttttttttttgactagaaaacccttgttttattaagcacccgggcaatcttgctgtgtgggatggccaaaacatcaaaattaaaaccaacaacagacaaaatggtgttgtagaggagacttaggtacaaaacggggtctggcatccagaatccctgtgggtttggtccatgttcactccctgaggccggcagggagggatgccccagcggccagctgccctcgccctccggctaggcggctatgcttcttgggggaggctgcctggaagcaggtcctgcttttcaaggggagacaaggggggctccgtccactgagatcaggactggacgattttgcagtttgttgtagagacgaagcgacctgtgtagtggatgttgcatctcaccacgttgttggtgaagtcagactccagaacaatgtacttggggttcacgtgcacctt

SEQ ID NO: 253 - DNA, 517 bp, Rattus norvegicus
  Genbank Accession No. AA859827
tttttttttttttttttatatatatgtatgtatgtgtgtatttataactggttacacgttggattcataattaggcatcaccagtactagttggcacagtttgtcacttaagctcagggtcaagttcggtcaagatttgctgttccaaagtacaaaagggcagaaaggaaaatcaaggcatttcatctccgtggtgttttcttaaatacagtaatttcagaggaggcatatgtacaggtgaccaaagcctctcgacccctcctgcgtcttggagctgggggctggggtatggagtcagggcacgggggggtcaatgtggccggctgctggactctgacgcctgcctcttgcgggaaggggtatagccgttgagatagccgttcgtctgccgcttggagagcccgccgttcaggatgtcctgtatatgctgcacgatgaggttgatggccacgagattgtctgcacctctaggaatgatcacatcagcatatttctttgttggcaagcagaactcctc

SEQ ID NO: 254 - DNA, 566 bp, Rattus norvegicus
  Genbank Accession No. AA859848
tttttttttttttttttaaacagtgtggtcctatgttttcaaagtaaaaatagttctctatgaccaagtacttaaatataatttaatactcatctaaagcctttgcagcttcagaagtggagaaagttttagccgcgtatctttatatctcctggtttctcactgaattggcttgagttgcctatgctggcagaaggttgacattgggcgaccaattgctttgggctcatcagtgcgttgaattagttgttgaatggcgagagatttgctggggcagccctgtgaatgtgttctatgactgagcaacctccttagccttcaaaatagaatttttgatgttggaaattccatactaaaaggaagccttaagtaagaatagcttgttaattatgtcctcattaagtaatgttcatggctaatgtcacattgttaacagttgttactttggaattatatggcatgtggtttaaggcttagttaattctctagacttcaaaaactgtattattgatgtattataagaaattacagtaccactttgattagtctgaatgtttgcagacctt

SEQ ID NO: 255 - DNA, 426 bp, Rattus norvegicus
  Genbank Accession No. AA859877
tttttttttttttttttgctggttcaactatttattgtggagtactttacatgcaagaacacaaattagagacagtgtttggaagcagaaccagtggggtagggagacacaatagttgtcactctgagccaccctccagaagcagctctacccacagaaacaggacagggacaagaatctgactcgtgagacaacagaataacaaactcaacaccatcttttcagcagctccaaagatcctcagatcctcacaaaggaagtgcaaactttaggaagaaactacccagctctcccagagagcctgagggcatgagtgtggcaggagggagcagtcaggacagaggattgacagttattcttgggagctaggggaagcctagcttagaccccatgaacgtgaagggctggggatgcgcactgggctaa

SEQ ID NO: 256 - DNA, 554 bp, Rattus norvegicus
  Genbank Accession No. AA859885
tttttttttttttttttgttttacctttatttattaatagtaacaaaaatcagaaataacaaaaaccagttaaatgaaatatggaagcacagtaaatacaaacgcatcttcataaccacacgggcagcagaaatctgttgaaactgttttctgaagtttaactgtttaggtcattggcgtcaccaaggcattcagagtgctcacatggacttcgctgccggtggacgagcctgcttcccaagactgacagtagcatccagagccctggcatatgcaaagacctccctgggtcctagatcttgagagatactgatgttaacaaaaccaaaccaaaccacagagcaagcccagggagcctgcagtcttggcctaaaggtttctagaggacactaggaactgaagtagatgttatcctgcttgttggccccatgcaaacctcaacccaagtcttcccaaaccaggttacttagcttttcatgaatggttcaagggtcacaggaatctgtggtggttcagacaacagctgccctagttacacagaagcagcagaactt

SEQ ID NO: 257 - DNA, 491 bp, Rattus norvegicus
  Genbank Accession No. AA859919
tttttttttttttttttcattattagccaaacctttaggcctgttatattttaaagcaacccaatatagttacaacagaattgcaggaggcttagaataacagagccatttgtcgggggtcatcagggagaatactgatagtatcttcggctttgccacacaacagacacagcatggtatattcctgaaattcatccatgatgctgaatgtatactcatgtctggctatgacatgatgacaattcttacacaaatggtcataggtaactatttcttctccatcttcctctttcagggatctgtttgtgatcagcataaagtcccgcttactgcacacggcgcatcctgcaaagttcagtaagaacgagccattctccagacaggtgttccccttatttggatggaaaatactgcatccccattcctgatcagtcttccttttcacatcgattaaatagcactctgtcaatcatacttcccaaactgcaagt

SEQ ID NO: 258 - DNA, 390 bp, Rattus norvegicus
  Genbank Accession No. AA859922
tttttttttttttttttacatttgtataaaaaatactttatttctccatgttttcagtacaaatgtccaaagagaattccatcaaagaggttttcaaacttgttactacgttggctgcagggcaaatgaggcagtggggatataactggagagactggtgagaggtcgcagaatgttaacaaactccaacaaactcctttctcctggaaccagtgttctcaccctgtacattcgtgttattttcggaggttcctgtttttatttggcatgtaacacattaaaaacctatgacaccacagaactcagctccgttcactgtttccaaagctatcccagacacaggtaaccttttctttcttgtatggtgggggagagaggtaaagggggaga

SEQ ID NO: 259 - DNA, 409 bp, Rattus norvegicus
  Genbank Accession No. AA859966
tttttttttttttttttcaactttattccagtaatttaagagaagattaaaataatagataatatgaaacagatgaagataaccgagctggtacaggtccaggccagcctagtataaagttaaggaggcatggagaatggtgaggcaggggagtggagatctctgttgcaatggcggaaagcagcttggagtatggttgatggtactgtctccttctacacgtgtgttcaatgtgttaacaaatgggaaacggaatcctgcctcattctaaaccagatggtaagagaaatatggcagaacgaggttgtggtatccaggcggctcgggcctgctttgaacactctaattttttcaaagtaaacgcttcgggccccgcgggacactcagctaagagcatcgagggggcgcc

SEQ ID NO: 260 - DNA, 487 bp, Rattus norvegicus
  Genbank Accession No. AA859981
tttttttttttttttttaaagttctgatttattgcattctgtatcaccacgggcaggggagggcctgagagctcgttctaaagctttattacctgagatttgcattccgaacaaccaggatgggtgactaacacacctcacaagatttgggtttggctctgatgaaagaccatgtaccgacctggaaaggggctacccgagattagagaggatcagctaagcaccgaggtccggggacagctatggtagactatcccggaactcaagcccccggacagctctttcccagggagctgctcatgtcagccttagagctctgtacggctcacttctcatcgtcccggccgtagttaatggtttgtagggcctgagctatgagcactgccatctctctggtgccagcagccaccactctgcacgacatgaggtcaaggggtccacctgaggtgtcaatcacaatgccacctgcttctctgatgatgactgt

SEQ ID NO: 261 - DNA, 591 bp, Rattus norvegicus
  Genbank Accession No. AA859994
tttttttttttttttttaagaaaaaaagaagtatggcttattatgcattcttcatcgagggcattgaagttgcatggactgataaaagttgatgcaaaatgagaaagaaacaaaaaaacaaaaacaaaaaaaaaaaaacaaaaaacaaaaaaaccagcaaaatgtttaccaaaaaactcaaacaaatgagcagtgcctgttcaatttcacagtctctgttgagttcagttgtaaatatgtttcaaatgacattttcttgggaaaaaaaaaatctctacaacattgtggaatgtgaggggcaactgtctcccgggcataggcgtctcaaagctgcagtagattgcgccttgatcaggtggttaatttgtgcttttatcacggagaactttgagcatcctgggaagaggtgcccccacctcaatgatatttctctgagaacaacttttgtaggactgtgtttctttagatacatttagtacaactgtaggtgacgagtagtcagtgattgcttgctagctacacaccagggttgatccattttaaaacttttggcattttgtcctcgtgggccataaatacagaaccttgtgt

SEQ ID NO: 262 - DNA, 607 bp, Rattus norvegicus
  Genbank Accession No. AA860015
  misc_feature (1)..(607): n = a or c or g or t
tttttttttttttttttgcatttcattttttattaccaatcaaaaataaattccatatattgtttagcaaatattataattgttttgtgacaaaagacacaagagtcataacaacaaaactccccgagagtcaaactcataacaatgccaaaataaatcacaaaaatatacagattaaaatcttaatgcaaaataaataggagtcatctgctatggcggctgtgacttgcctacccacttggacgccgtctgtggagtcctcccctgctgggaagacacgcagaccaggccagttccagggtatggctctgcccaggaaccagaggttggaagaagtgaaaaattgcactatgaggaggaagtcatcagaacagtaatatttggaaataattatgaccctctgcaagaagtgattctaagtgaggaagggaggggcggggcccggctgtcggtgactgtgtatgcacagaggtanctgtggaagtgtgtgcacctgctacgtttgcctcacacccaccacagggttttgctctacctggcacttaggtctcacagtaacacagctatgcacctcatctacagactcaggagcatgccgcacctacag

SEQ ID NO: 263 - DNA, 550 bp, Rattus norvegicus
  Genbank Accession No. AA860024
tttttttttttttttttcaatgttcagtttcctttaatgacccccatctcccttgaaggataggtgcaggcagctaggtgactggcaagacatgttcacttgaagatcttgccttgattgacggctttgccaacgtgctggaaggccccctcccaggaaaagtactctcgaacgagggtctgggtctcctcgctaccaggatccagtttccgccatgtatatgactcatagtccacctgccaatctggactcagcggaaaggcaagatcttggcctcggaagacccaaaccccagaaatggagctgctgttgttggttccaaacaggataacactagcaaaggcattctttctcagtttgtccaatcgctgaaacatcccagtgatgaggttacagctcatgaaggtctgggtgagctcttcagggaagcggtactcagcataccacagggaccagccatccttatcaaaatgctcccaaaaatatggcagcgccacagagagggtgtcctcattggagtactttcgcttaaactcatccaacacaaagg

SEQ ID NO: 264 - DNA, 515 bp, Rattus norvegicus
  Genbank Accession No. AA860029
tatttttttttttttttgagggaggtgcataataactttattaataaggcagatgaaccagttctttgatcttctgacccaacatgcaggtacagcatagctgtatggctttaatactccgaagagtcacgtgtgaggggacacgcctaacgccccattctcacttatccagagagcctttcacagatgcaacaaagcgtcctacctaaaacagcacttgaccacagtcacagataaaaatctcactttcacagactcaagctgacagcgaagtgatttattggaggatggagtccttgcctggggaagagcctgttggatgcggactatcgagaaggtcaggatggcgcaggatgggacgctatagcacgctggggctcagctccttcagcttgacagtaactaaaggctctggtcagcaggtgaacagatgtaagttctagggggtcccccaggatctgtgcatgtctcctgggggcatgggatcgcgcccgcagcggctgccagctatactt

SEQ ID NO: 265 - DNA, 442 bp, Rattus norvegicus
  Genbank Accession No. AA860030
tttttttttttttttttgacattccacaaagaaatatttattgagcgcctgccacgtgccaggcaccgtttaccccccaatgagaaaacaaaacggaacaaaaacaggacagaggcagcagaaagaaacaaagggcagttggaaaaaagctaagggaactaagcgcttgaagagctcctggatggccgtgctgtttccgatgaaggtgactgccatcttgaggcctcgcggtgggatgtcacagacagccgtcttgacgttgttggggatccattccacgaagtagctgctattcttattctgcacgttgagcatttgctcatctacctccttcatggacatccgtccacggaagacagccgcaaccgtgaggtaccggccgtggcgtgggtcacaggcggccatcatgttcttggcgtcgaagacctgctgggtgagttca

SEQ ID NO: 266 - DNA, 407 bp, Rattus norvegicus
  Genbank Accession No. AA866250
tttttttttttttttttggaggtgtcagagcttcgtttattggctcatccagtgccaaggtccagtgggcaccatgaaattgggagcctcagctcctgcatttctttcccttcacaggttccacttggccccattgaggctggcagaaccggggccaggggttggttctgacaggggtttgcttggcacaggaaggggaccccgtggcaaggtgggatgggtcccctttacaggagaggaaagaagccagcttggcagggcctctgcagtggagcctaggagtagaggagtccaacctgtgggcatgaatgtgtgaaagggatcaagggtggaagggtatcacttcacgaaaccgctgacctgcccctcacctcaggccctgaccctcaccctcgtgccgaattctt

SEQ ID NO: 267 - DNA, 493 bp, Rattus norvegicus
  Genbank Accession No. AA866276
tttttttttttttttttcatctttatattgagattttttctcttaaaaaaaagaacattatagatgtgaggggtgggaaaggatgactgacagcaggtgctatagaaacccaaagctccagaaaattaaaaaaaaataaaatatatatttatacatttatatatatatatataccaagtaatgcatgtgagtcccagagaagcagaaagcagcagcaagaagcaactagcacacaaggacctgggttcatgtacagcacacacaagccattccaatcctgataacccaccccaagcccagcccccacccccaagaaaagatgtttaagaaacttccctcttaaatggggctgcacaactggggtactgtggcacatctgtaatctcagcacctggacggtggagacgttaagataagggttcaatggaagccttagcgacacaattaagtttgagaccagcttgggctacattaagaacatctccaaagctat

SEQ ID NO: 268 - DNA, 412 bp, Rattus norvegicus
  Genbank Accession No. AA866299
tttttttttttttttttcatacatataacgactttattttgtttggcaacgggaaaacaagtcatgcaccatctctactcaaacactttcaaagccaagcaaatgatatatgaattagttttgctatcttctttcttccttttttctttaacatttgaacagtatagtaacagataaggtagttacagggaaatgtacagaattttatagtttgattaccttggcaattatgctgtgaaaccttcctttcattaaataattagttcagtgattctcaacctctgggttgaactcgaaacccctttcacaggggccgcataacggattatcagctatttacatcatgattaataatagcaaaattatagttatgaagtagtaaataattttatggtggggtcaccacaatgtg

SEQ ID NO: 269 - DNA, 405 bp, Rattus norvegicus
  Genbank Accession No. AA866302
tttttttttttttttctgggaaggcatctttactcgaaacggatcaggagaagccttgccgtagagggggcgtggccatggtgtgggtggagccctgaggtccagcctttcagccagttggagctgattgacttgtccagcgccttgcgcggtctgggtgtgggtggagcttacattccagacctcacaccgttggtctccaggtcagtgaggttaccccgtagggcttgctcctcttcgaaagctttgaacagagagttgaagttacctgctccaaagccctgtggcgatagaaggcaagtatgagctggaaacttagcaagcagttggtgctacctgttgggtgcaggctgtacctggtggttgtggcgttggatgacttccaagaagagcgtgggccggtcc

SEQ ID NO: 270 - DNA, 471 bp, Rattus norvegicus
  Genbank Accession No. AA866345
tttttttttttttttttagctttgaaaattaataaaatggttttatttcatatatgcaaagtgaaaatctctttgatcacttacatttttacaaataaaaacaacaatactgctccatataaacttctgtataaacagcgaagaaaatatacatattattttttccttttagtgcttccaaagcacaaacatgtacaagtccacctgaaggctttctgttgtcacatgcaggaacagatgtcagaggttagtgcagcctcagacagagtggaagagcactcgaggtagacggtttgctgactcccctgccctttcccagagagaagtaagttaccgaaatagcagcttttcactctttcattccaactatcctgaatattgcatggtttaaaaggcacagctagggattgttgaaaagttcattgagcacatgatcaccacgtggactctctatgcttatgagttctatag

SEQ ID NO: 271 - DNA, 422 bp, Rattus norvegicus
  Genbank Accession No. AA866364
tttttttttttttttttcttttttccttttttacttacattaaatacatcgataaatcagcagttgcattctgttaccacgattgttatgttaggagagtgaaagaaaggcaaacactttcttaggaaaaaaaatataaaggcagaaaagatgagccctcccctaaaaactgatcagaagaaaaagggtgacagggaggtggggagagaaccaaacccctcaagcccaacagagctcaaacaaaggcagaagagctggcaggaggagagggaaggcagcagacaggccccggaactaaggccaatactgttcctaagaagggaggaatggaggaagtgaaagcctgggagatgggttcccagccccaaggcaataaaacatcttcatttttgcacaggagttaagttttcaagagacttaga

SEQ ID NO: 272 - DNA, 462 bp, Rattus norvegicus
  Genbank Accession No. AA866383
tttttttttttttttttaaaaatagtttatttatttttaaaaccattaaggcaaaactgtaccctgaaattaactctttacattcctcagcttacagtaggatgttccaaacatacaggttcccataaattcaggatataaatcaatgcatacagtcagttcggtctcctacggagaaaacgaagactcgattttttttttttaaattaagattaagttatagccattttctaattgcccggaaccaatcagctcatgtgactagaaaattctatttgcccttctgtgttcaccctgattcctgatgtcctggcgagccctgtatccacaacaagctgggggttggggtgtgtgtgtgaggatgctggtaccggctcgacaagtcttattcaggcctgttagtatcacaggggtgaagggctgcaagctcccaggtctgataggatggcaccaaggacatta

SEQ ID NO: 273 - DNA, 519 bp, Rattus norvegicus
  Genbank Accession No. AA866426
ttattttttttttttttggaagtagaaatatttattcagaatataagaacgtttgtaaaatattataaatgtctctgtataaataaatggcgtttttttttttaaacaattctatatcaaataacacaaattagctattttacagcagctaaaaactaaaggcatctggaaacatttaaagctacaagtgaatctaaaactgacaaggtatagtacagtgtgtagtagccactttaaaatgacactttccatacaagcagaacagtactgacagatgcagcagacagatgtgctttaagaacagtgcattcaagcaggattttctaattcaagtggtataaaaaacattttcaattaataaaaaagttaaatttcatgcaaagtaagttaatatgtctaaaagcaaattagaaatagaagtgaacatttgtagttgttgcatcaggaaggtaagtgccccaacaggagcactgcagaagaacgctgcggactctacagaatcccttccacatctcaacc

SEQ ID NO: 274 - DNA, 265 bp, Rattus norvegicus
  Genbank Accession No. AA866439
ttttttttattttttttagatgacatactttatttccagtctacaaccattaaaaacactttgtaagtttacactgttcagttctcatatctgaaataagacacagggcaaagacagctggtggactagatgccgtcctaccacccaatatgtcctgagaaggagcctttaaagatagaaaggcggacgggggtagtggaatgcagaggagtacgataccccagccgtatggagatgtgtctaaattttgcacagggacccttag

SEQ ID NO: 275 - DNA, 541 bp, Rattus norvegicus
  Genbank Accession No. AA866452
tttttttttttttttttaggttgcaagtcctggtctggtttatttataaagcaataaatatttgaagcacaaacaaactgcacgtgtgtaaacaaactgtacaatgactgatgggagatgggagagggcctcagaggattccaagcacaatactgtcgtcctgagtgtaaggtagccgcctcagaagcacttgcggtggacaatggagggcccggcctcatcgtactcttgcttgctgatccacatttgttggaaggtagacagagtatttacgctcagggggagcaataatcttaatcttcatggtgctgggagccagtgcagttatttccttttgcatacgatcagcaatcccagggtacatggtggtgcctccagacaggacattgttggcgtacaggtctttgcggatatcgatgtcacacttcatgatgctgttataagtagtttcgtgaatgccggcagactccataccaatgaaagagggctggaagagagtctcaggacagcggaaacgctcgttgccaatggtgatgacctg

SEQ ID NO: 276 - DNA, 551 bp, Rattus norvegicus
  Genbank Accession No. AA866460
tttttttttttttttttgtttttaaaaagaattgtttatttactgaacttggggcatattagatacacaaccgattttaaatttacatcttttaattcaattctgaagtgttttcacacatacacacacaaaaaaattggcatgcaacagctgccctagggtgacagagtcaccaaccaactgttgcaagatatcatcgaaggttgaaaaattatttgtcctgaacatgaaaacctgtaacaaatttaaattaaatttataaaacttacttgtagttttccccttgcaagatccaaaaataaaaataaaatatccaggtaactaacagacattagtcaccacataatcctggaccgcccacacccaaagcagagtgcctttcattaagcccatcatcagagagacagtctcttcatcttttataaacaaaactgacatgtgccaaaaaagaaagaccccagaggacaaataaaccctattgctgacactgaagaccagggcacgaaggccactgactaaaaagacaacagtggctgccatcactgcaagca

SEQ ID NO: 277 - DNA, 505 bp, Rattus norvegicus
  Genbank Accession No. AA866477
tttttttttttttttttgaaggtttcaaaggtactttatttctttattttttttcttcaatatgccatgttttaatgagtacatgattctttgacttggcattcatttatgagttggttttttgaaacaattccttgattattgtatcagctggcatgactactgatctctccattcctttggggtgactctgccaacaggggacaggttccattctattccaatttgtgtggctgtatatgtccatgcagaaatacagaagatgcttccacctgctaatacagcatttccatatttgtcatggaaagtaggtgtcttcttctgatggctctgccttgccaccacttgctgaatgcttcgaacttggagacgacttagtgcgtttttggccaagggcaacatcgcggagacaaggatggaactgcggtgactacagctgctacctgggtgcaaattcaccccagctacccttgcagagtcctgaaaaacaaataaaaaaaacctc

SEQ ID NO: 278 - DNA, 541 bp, Rattus norvegicus
  Genbank Accession No. AA874803
tttttttttttttttttggtaacttcaaatatatttttattactttctttttcatcttagaaagaacatgaaacccgcatgcagcactcatgaatctcagcacttacatagcagattcacagccgtccagtgcggcctctactgaggggcagcgtgtggcaggggcgggtactgaagcaatatgtacacaggagagggtgcagggtcatcctaactccaaaagaggacctcgctgtttgcatatgcaccgaagggggagtgcgctttctgtgggggcgaggggaacagagctacgtgggtctccccatgccagtaggatgtgtagctctggctggatgtcatgcattgagtcctgaattttccccttttcctccacacagttttctcacgctgccgggggcttctgatgcttcagaagcatcatctaccaaagcagtgagcctttcagaaaccctcagaggttgcgagagaaagacccagctcctttaaggatcgcttgcctggttgggataggggaatgagctggggtgggggtggggct

SEQ ID NO: 279 - DNA, 585 bp, Rattus norvegicus
  Genbank Accession No. AA874873
tttttttttttttttttcaattttgccaattttattgaaccaataaaattcctactaataacaatgaaataaattctgcaggtataaacgtgatacagtttaacaaaacccattgttctgtacctataaatagattttcaaaatgtcatagaaagtgcagttatgaattgttaacatgttaatacacagctcctttatttcaggtgtgtttgtcttgattcattaacagttccttctttatctgttcaaataatattacccatccctcgaaaaacaaaaggacagccgcagaacgaggaacaacgcttctttctggtttgcaggagctgagccaagcggcaaggccaggtttcccaggtgacctaacagggttctcatctcattcaccttgaccagactgtgcgtgtgcccgttcaattcatagaaagatgccgccaggtggcctgggatttgcttccaatgttcatcttgctttgggtaaaaagagtaaatgtgaagaggaaggaaaaatcctacttcctctctcgcagagacatccaaatgcaaaggaaatgtgtgcactagatgtagatcaccatccttggt

SEQ ID NO: 280 - DNA, 530 bp, Rattus norvegicus
  Genbank Accession No. AA874874
tttttttttttttttttcacacaaacacagagtgtatttttattacgtaaaacgttgcattggtgagcaacaattatttgtgtggagagctcagaaaggcacggcgaccagttgcctcattcatgattgcagccacgattttgcaccttccttctagtgggtcctgaagtctaagtggcagttaagcttgtaaatcctgtcggtttctattcaatcacaggaaagagtgcaggatgggcagtactctcttcagaatttacatctttagaacagttcgaatgctgtttcccgagtgcatcagatcaaaggctttgttaatctggtcgaaggacagattgccagtcacaaattcgtcaacttttacctttttggacatatattcagacaccagcttcgggacactctccacactcttccagcctccaaaggcagtgcctttccacgtgcgtcctgtcaccagttggaacggacgattggagatttcttcacctgaagcggccacaccaacatcagaatggtaaccctcgtgc

SEQ ID NO: 281 - DNA, 473 bp, Rattus norvegicus
  Genbank Accession No. AA874875
tttttttttttttttttaatcaaggtaaaatttttaatgacttttttaaaaaataaactattctacgtattaaatactctttactagttatacatacttaagatacatatttaggcttaaaatcttaggaagaaaaacatacacatttcaaaagcaatatcaaataacatatttaaagcttttaaattttttttaaggtaaaacaaagcaagagatgagatatttaaaaagatgagatggtcatgtcgtcttagttcttgtcctccattttactaattataataattccttcttcttggattgtttttattcccccagagctgaggaccgaacccaggcacctgcgcttgctaggcaagcgctataccactgcgttaaatccccaacccatgttcttttctttaaaatgtatttctttgcaaataaaaattacaacaaaaaacacccaagttttttgagcaaactagacagaa

SEQ ID NO: 282 - DNA, 495 bp, Rattus norvegicus
  Genbank Accession No. AA874887
tttttttttaattttttacgttttagaaaaatttattttatatacaacttatttgaaaattttcagtatgaacaatttcaacagagtcctttagatgcaatttcttttgggttcactgcaacactttttgtaatattatatgttttatagatgccaataagtctatctgaaatctcaaacatattatttcgaagagagattattatgaactgtgcattttttgtttgctcgtatatatagaatgcaacaatagacacgtttttaaaatccagagcggcatcaatctcatccatgaagtacaggggagtgggtttgtagtggtgaagggcaaacaccaaggccaatgagctaagggttttctcgcctcctgaaaggttaaagatcttcttccaacttttcttaggtggtcgaacactgaacatgattccttcagaaaaaggatctaaactatccacaagctccagttcagcatcccctcccaaagtgagcatttgc

SEQ ID NO: 283 - DNA, 504 bp, Rattus norvegicus
  Genbank Accession No. AA874889
tttttttttttttttttatagactaggaaatataatttatttcataaaaattaattttgttacaagaggaatgctaaaggttatttacaagttgtttacagaatgaacgggtggggctgggactatccccagtggatcagaacccacagacacacagccatgttcacagcctgacatccaagctcccacacacccgacctctactagagtcccagaggagtgtgggaacctaaggggcctcgtggagcatcccaggataaaaggacacttaagcccagagaaagcggttatgtgcctgaagtcacacagcatagctacaacttggttcccgggcttcccatttctatgtgcgggctaacagtgaccagcaagagtatgcccacggggatgagcatctttggcaggaggagctgaggacactctatgaggcaccattcacctagatgccaggagcacctcggtctcagtcttagagtcccacttcaggagccactgcggaaaccc

SEQ ID NO: 284 - DNA, 494 bp, Rattus norvegicus
  Genbank Accession No. AA874926
tttttttttttttttttaaattagcttctcaatcatcatctggaaagaaaacattctgagcaacatcattaaaaacagctctgataaagcacggtcactactacgtatcataaagcaggtacaagctattttacatccacagaggtatgatacagtactgtcctacatctataatactagaggatacaatttaaaaggcattatttgagacttgattctacttttccagcagagggcccaaaggatggtgtgtgacacagctttgtaaagaaacatactctagacaggatttcctttcactagtggcacagttctaaggattcattctctccatgaatgtcagctaaaaccgttattaaaaaaatgaaatatccctaaaacaaaaccgtataaccaccggattcacatgaagatgacctagtggagacaagctggacctcaccttaccaacaagctatcaaatctgttacgtttaaacagtgagacctccaagg

SEQ ID NO: 285 - DNA, 492 bp, Rattus norvegicus
  Genbank Accession No. AA874927
tttttttttttttttttagcaatataacatcaattttattttaaaaaacaaaacccaatccacctgacctgtctgtccctcaagggacctaatagagacctcaggaagggctagctctggccaagcaggggtaggttgtcaggtgtcaaagaagacactgtgctcatggactctgctccctctctcagcccttgtcttttgctcctgacaagaggaacaactgatctgtggtcctacgagctctgctgtacttgaggaagacagcacgcccatcctcctggtctctttgctcccccttcaacggatactatccttctctccgccaccctgagcagatggtgaggactaaagtggtggccggggacaccaagtgtctacggagcccacagggctcagaccgtctgccccagtgacctctagtcactaccatcgggcaggatgcctgtggtgccaggcactgactgaattcctctctcacgccagccacactaa

SEQ ID NO: 286 - DNA, 536 bp, Rattus norvegicus
  Genbank Accession No. AA874928
tttttttttttttttttggaaataaacacaacacttcctttattatataagtttggcaaacagcacaaaaatccagcaacattttaaacatgtaaaaaagtcaaatgtcaaacagtactgagtatagtttgaaacattagaaagaatgagtgcagagttaggattctgaagctagcagagcaaggcttggtttctgaacatgtacatgaaacacacattaaaacacaacaacataatttatctttacaaaacccacagccaggcaataggaaagcacatcagtggggaaggttctggcccacgtgtgttcactgagtctcacatatggaagctacatctaccctgaaataccatgtgcacagggccaggcagggaaccgaggctgctactgaagttaacaattatttgagaataataatgctcaattaaatccttctgtatagcaatttctattataataatgaatttattccgctgcaaatctgagaagctgagacttatttgttggcagtataaaatttctgaccagtatcaaa

SEQ ID NO: 287 - DNA, 555 bp, Rattus norvegicus
  Genbank Accession No. AA874952
ttttttttttttttaaagtgtttctgatggtttattggtgacttatcgacaggccaaccgccttcctccaaccaatcgaggtctggaaggaagacgtttccccatcagaaacgacaacacagatggaattaatcatacagactagggcagatttacttctttcacacaattttagtaacaaaaaggatatttgttacaagcagagggacggaaccacaagtacacaatgtcaaaggcccatcttaaagttctgttgtatttaaatgacttttatttgtttaaaaaaaacaaaacaaacaagttgctactcccacctataacatgggacatactgaagttttaagatgacactttggagaagcttatgacttctctcagttctgctgtaagctcagattaacttcaattaaagaagctaagtaattatccaacattattaaaagcttgattcaaaattttgtaggaaagaaactgagaatggagatgcgggagacagcctggtaatgtcacatacacctaggccttgcaatcctcatgaactaagacagctagaat

SEQ ID NO: 288 - DNA, 569 bp, Rattus norvegicus
  Genbank Accession No. AA874990
cgaccgcttcgccgcagaagtatctccggatggagccttcccccttcggcgacgtctcctcccgtctcaccacagaacaaattctgtacaacataaaacaggaatataaacgtatgcagaagaggagacatttagaagctagttttcagcagacagacccaggttgtagttccgattcacagccacatgcatttctcatcagtggaccagcatcaccagggacttcatctgcaacatcctcaccattaaaaaaagaacagcccttatttactctaaggcaggttgggatgatctgtgaacgtttgttgaaagaacgggaagagaaggttcgagaagaatatgaagaaatactgaacacaaaacttgcagaacaatacgatgcatttgtgaagtttacgcatgatcagataatgcggcgatatggagaacagcctgctagttatgtttcatgaatcacgctttttgcatttgtgggctgccttgttccttgttgagttgttgcaggaggtcccagctgtgacatacagcaatgccagcgcccatctgtgaaccaggttatttcaagcttt

SEQ ID NO: 289 - DNA, 542 bp, Rattus norvegicus
  Genbank Accession No. AA874995
  misc_feature (1)..(542): n = a or c or g or t
tttttttttttttttttcagagtgctatacccaatcatgtaggtgtaatttatttatgttggaaatacatagatcacaattcttaaggaaagagatgtgccccccaaagtttgcatttgcacacatcagctacgctgagggcattgtcctcgggtttaacattaagacccagtgggaaagcttatggtcttatacactgggtattagccatgctaggtatggccatctgtcagacaaaggggcctagtctcctcccacaagtcatgtcctaagtcatctgcgtattatggcaacaggagcagcagggctggctanagagaggtatggtttggccagttagtattgacatcttagaatcctgggggtacatgtgttgtaagaagccaccttcagaaggctgacggtactatactggagaagctgtggaacaggctgcactgaccagggcaggctttcttagagaagcctcagctattggtttcatacagtttccatttccaaggaggcaagggcctgtttggtatgcanagagactaacaagg

SEQ ID NO: 290 - DNA, 516 bp, Rattus norvegicus
  Genbank Accession No. AA874999
tttttttttttttttttataaagcaattccaaagtttattgccatagaaaaaactgatttctcaaagtcaattcttattctctgtaaaataatacacatgaacagaaatcactatacttttggtccaagatatgttgggtttttccttcttcttcagatgatggatagatgcagccaaaatctatgaacgcgtgtacttgccccaaatgtgcagcataaacacagaagcgatgaacagaagactcatcaccagtactgggacagggccaactttgagccctggggaatcttctgtgtagaatcgccacatccccccagtccctgcagaggtggtgcggcctgcactccgggttccgcagctggcattttttctctgccggacagtggatcccgccgcccgtgcggccactgctttgctaggagaacgcccagaggagcccacgttggtggcactaggcgttggacccggcatgctgatgtctaagaacagtaggcacaagagatatgaagatgaaa

SEQ ID NO: 291 - DNA, 530 bp, Rattus norvegicus
  Genbank Accession No. AA875019
tttttttttttttttttggctttatagtgaaagtttattgtttttaatccaagtacaatcagctactagttacatacagtaaaaaacaaaacggccaccaagcaatgatgatagtctgtgacaggtgcagaggagggaatcttgttgggagtcctgtggatccacacctgacttcagcacttaagctgaccctccctccccagatcagttaaaaaaaatattaacagtgtcttgcttgggtagagcaagattctaaattttcttggggacactggagaacttttaaaaatgaaagtggtaaaacaagattgaaacgtggagacacaagaagcttcctgacaaagaagcttcaggaggtcttggcttcaggtcacctcaaatcgaatcagcttagaggagtgactccattcaaaccaaggctcatatgtatttggtccggttgagggctctctcagccaggtggccgctctcatccgtgatcttctcccagtcagtctgcccgaccacaaaacctatggcccttcaacatc

SEQ ID NO: 292 - DNA, 536 bp, Rattus norvegicus
  Genbank Accession No. AA875023
tttttttttttttttttaacatttttgtattttattatttttagggaagaaacacagtttcacaagaaacaatgatttttctcaaacaatagaaaaaagatctttttgaaaaaatccactgtcctagatgaaaagtctacccagcaagcactgggccagttttgagagtaaaaaccagtgaggtggaagttacctataggaaattcagtgcagaggtctccacaagtcctgatcagttctgtaaggctccaatgggccagctcggcggcagcggcgaaacagtgggaatgagctcacagacaaaggcccagtccctctgactgactgggatgcaggctggctcactccccggggggctgcatctgcttacagaactcatcaaactgctgctgctccagctccgtcatgactctgttgagagcatagatctctgctctttgtctttgcttcagctcctgctgggcagatttctgtttaaccttctccactctgaaagcaggttctttaactttggatttttctttccgcctcgtgcc

SEQ ID NO: 293 - DNA, 580 bp, Rattus norvegicus
  Genbank Accession No. AA875032
tttttttttttttttttctgatcttaattcattttattctacaaaatgctactcagtggaaagtaggaaagccaacaagacaacaagaacataaaacgagaacaaaccccgagggaaaataagttttaatatgttcttccctccatagcagcaagctctaaacagctttccttagtgcaaatactgtaggcttgtgtcacacacagtacacagaacaacgcaacacacaccaccacagatgcttctgagcagagatactcctcaaaaatttaaaactatacaaagattttttgagcacgtggtcctgcctggagaattcgactagagagaccctcctaggaccatttcaccattactgtaaaaacgggacaaaaggtccccagaaaggaaattagaattccccatggagccataaaaccttgtacaactcgtttgcctccagggtctaatagcaaatttcactgcacgtcattgacatatcccaaatacggatgcataaagcttgagtttctacgatataccaaaatacgatatatatacaactcccactgcaaaagaaaccctgatacctagtctttat

SEQ ID NO: 294 - DNA, 549 bp, Rattus norvegicus
  Genbank Accession No. AA875047
tttttttttttttttacaagagtgcagaagagagagagaaactagtaaaggctgaaagaaaattcattgaagatagagttaaaaaaatcgtagaactgaagaagaaagtctgtggtgattcagataaaggatttgtcgttattaatcaaaaggggattgaccccttctctttagatgccctcgcgaaagaaggcatcgtagctctgcgcagagccaagaggagaaacatggagaggctgactcttgcttgtggtgggatagctctgaactcctttgatgacctgaatcctgactgtttgggacatgcagggcttgtctatgagtatacattgggtgaggagaagttcacctttattgagaaatgtaacaatccccgttctgtcactttactggttaaaggaccaaacaagcacacgctgactcagattaaggatgcaatcagagatggcttgagggctgtcaaaaatgctattgatgatggctgtgttgtcccgggtgcaggtgcagttgaagtggcactggcagaggctctgattaaatacaagccca

SEQ ID NO: 295 - DNA, 565 bp, Rattus norvegicus
  Genbank Accession No. AA875060
tttttttttttttttttagatttttataaactattttaatacaagattaatagcaattttctatccaaatcagaagtgaaaaagaaaatcttaacccaaataatagtcatttgacagtcacgtaaagttttaggtttgatcggtgcacacatttctcctgcatatgtgttctgtatatgcacacagagactgcactgtggtaccctccttaaggtgttactcatgaagtaagtccttcttacaaggcaacaccaaagacttcagtatcccctccactgtcagtgaagtcccaagcatgcccgtgctaagctgggtctgggctatggcaaattatgacatagcaagtctccagaatgcgtacaaatcaatactctatttgtatactttggcctaaaaccaagcactggctaatatcgtcaccaaggaggaactcactgaagattgataagcgatggactccattgctcttcaggtagcaaggctctcaattttgttttgaatttaaatgtctggtagtgactgtaagtcaatgagtatgggcgtgagtatctgcaagcttttggag

SEQ ID NO: 296 - DNA, 580 bp, Rattus norvegicus
  Genbank Accession No. AA875089
ttttttttttttttaatttttggtgctcccaaggtttacctgggttatctatcattaatttattattagcatctccaaaggagttatacacccaaagtacaatattccacatttgacttatcaacattaacccaaagatacatcaaagcccaagaaaaagacataataagaaatcaaaatattgacaaactataagagcattatattgcaattgctaaaaaaattgggtgtaaaccaaaattactaatgagttttacaggcactatgtatataatgtgcaaatgtttgcaaaggttttctgggatttttggtgttttaagaaactgtcaaatatattttttacaaatataaagcttccttctcctacctaaaggcaattaaaaatctttgaagtttatcaatactcaatacagaacacagatgaaccagacaaattcttttttgttctggaaaagaatatcaactcaatgtttaaggtgtcaaaagacataacaaatacaactgtctagaagccacccagaaaaattgtcatcaaagcctttgatcttcaaaagtcaccatccaccagctgaagaatttt

SEQ ID NO: 297 - DNA, 511 bp, Rattus norvegicus
  Genbank Accession No. AA875098
tttttttttttttttttcgttagaaagcactatttatttcttcttactcttgtttcgtttctcttctttcagcttctttttggagactctgggtgtgctggcctttttgtataggtgatacccaatcaggcccaggagtgctggcaccatggccatgcctaccagaggcaaaatgcccttcagcagcttttgccagtagttggctcgaatcaaggcgatcagctccacatcatactgcaccactgcatcggctgggatagatggtgggtaccctctctttccataagccaagtgagaaggaatgactgctcttcgcttctcccctacacacatgtccagaaggctctgctccagacctgggatcacctgcttttggccaagttctatgaccagaggatctctggtcagagaagtgtcaataatgcgtccatctgccaagctgcccgtgtagtgtatgtggagcgtgtctccaaaggcagcggattccgtgcacgattcagggggctgcacc

SEQ ID NO: 298 - DNA, 469 bp, Rattus norvegicus
  Genbank Accession No. AA875102
  misc_feature (1)..(469): n = a or c or g or t
tttttttttttttttttaacaaaaacaagctcacatttatttttaccccaatgagaatgtacaagtgaaacaggatgagtaaatgtagtcaccagcagcccctgagccccttctcaacctctcccatgcttggccactgctagttggaaacgctttggagcagagtaatattatctcctttgagcatgatccgacccagttgttttcttgactttgttttagaatgaatttcttctgcatcatctaatacgaggttcatgtactcatcaaagccaataatacaaccctctatccgcatattcacttgttcatacagccacacctgaattcgagatctattttgcaagtatctgaagataaggttgatgggctgcaccatcaccttctgcaccttctggccctggccgcggtacgccatggtggaagtcacaaaanaaaaaaaaaaaaacctttcctcgtgccgaattct

SEQ ID NO: 299 - DNA, 583 bp, Rattus norvegicus
  Genbank Accession No. AA875121
ttttttttttaaatacattaaagattgtgctcatctccatgcagcaatggagatgagcacaatctttaatgtatttaaaaaataaaacagtgggcagaacagtgcacaaagtcctggttctcctggatcttggagagaagggatggggaggaaaccagctctctgtggagaatgagttcatggcccacaggcaagaaatgttcccacatcttctggatgcggaaggctctaggaaaggggcagagaagaatgctggtggaaaagggtctgaccctttctctttttctgagggcagaactggcagagtggaaatcctgtacacccttgggaaggaagagcacaggctgccctgccctttagcagtggtggtgagtgcccaagccaggaaacacacaagagaattatttcttcaaccacacgtttcaagaaaatgccataaatatgttatttaatattctcgtttcatagcattggacacatagctcgatatattgaaatattgattccttggagacaaaaatgaaaaaaaaaaaaaaaaaaaacctttgcggccgctccaacatcagcctcgtgccgaattctt

SEQ ID NO: 300 - DNA, 494 bp, Rattus norvegicus
  Genbank Accession No. AA875123
tttttttttttttttttcctcagaataagatttattaagctgatgtatgtcagtgtctcctcctagtccagtgtagggtgaatcaagcaacattagaagcaaggggatcttattattccgtgacccaaagcattgtatcgcgccagtatgagagagttcttgggaaatggccaacttaaacacgctcttggagaccgctctgtactgcacagagcagtctctctgtgtggtcacagggtgagtgactcctgttctcacaaagtgtaaaactctcagtggagttggtgactcatgcatagtcatcagtgacaccgtctcctctctggtctgtctaatccactgtgagccttacagagcctgcacattcctgatgccaccgcacagccattttccaggcacgttgttgtaagaaatctataattcctgtgacgttaatggcggaaagagcgctggctgggcgtttgatgttcagggaactgggggagacaatggga

SEQ ID NO: 301 - DNA, 136 bp, Rattus norvegicus
  Genbank Accession No. AA875124
tttttttttttttttttaattatttaaaaagaatatttaatgacaacgaaaggaagttcaagaatatctatacatctatgtctataatctatattatatttatgcagtgggaaagcagatattgaaatttgtatag

SEQ ID NO: 302 - DNA, 540 bp, Rattus norvegicus
  Genbank Accession No. AA875132
tttttttttttttttttataaactcaggtaggttttagctaaaccagtgctttcccccaaacccccattttcagaaaaggtaattgtcagtgaagtttttctttttgtctgatcccactgttggttgtctggtggcttactaccaagagcactagataaatctccagcctttcatgatacaaaggcctgtgcagatttcaaagtccttgggtaatctgcattacacattatccaaaactaaataaataaataaaaataaactgaccaaaaatgacaaactgctgttgaacctgggggtccaacctctgggtgtagctgtctctgctactcacacattcttggaattgttagctgcttcccaaggaattcttttctaattgggcccctaggcttaattggcttctgcggtggaatgcagtggtgtggagtcagtgcacaggaaaactgaccctcagcttgactttctagacagaagtggctagctctggagtggagagggtgcttagcagagctggaactgtctatcaccccccccccctt

SEQ ID NO: 303 - DNA, 458 bp, Rattus norvegicus
  Genbank Accession No. AA875194
  misc_feature (1)..(458): n = a or c or g or t
ttttttttttttgtttgtcctgttaaacacaaaaagacaaaaataaattcaatgggcgtctagtctcggaaaagatttatagccctagcagatccggaaagatcgtattgagtctttcctttggctcagttaggtgaccagtaagttcaccgagcttacaaggactctgtcatgttaacatggagaactaccaatccttcttatttaaacatcttgaacagtaaacagagctcgacacaaatcgaaaattaattaaaatctaatgttaatttagaaaaccccagcaaacctccctccgggtgtgggtgcacaccagcatgcccagtgcgtgagaaatgcaggcatgacaatcagtttaaggtgtttataggctacccatcgagttctaggccagcttaggctcctatcttaagacaaaananaaaaaaacctttgcggccccctcgtgccgaattctt

SEQ ID NO: 304 - DNA, 559 bp, Rattus norvegicus
  Genbank Accession No. AA875205
tttttttttttttttttcacacagggttgcttttatttccacatccaacttgagcagaggccctgccacaacctgaacagctgtgaggtgctgggtgcctccagagtttctggcacagtaagtgttgggtgtgcagacttcctgatggccacatgacactggcccacacaggaacagcaagtccatgaatggaaatcccactgagctggaagtggaggctctggaaaccccatgggcagcagcaggagttaaaggagccaccaggaacactgcagtgaggctccaatgcagacagggctgataaaaacccaaacagggcattgtgagagcagaggctcgagtgtccccgctgaggacccggggctgaaggcacagagctgtgtcgggatggaagaaccctgggtgcactcgcagtccagagcacgaaagcacaggtgagaacccagcccgaggctctctgtgaagagtgtggccttggatcttgggcacggcacagtgacacacagtgctgaggtcaatcctgacttcccagaggaatgacctcttcagtgacaaaaaa

SEQ ID NO: 305 - DNA, 462 bp, Rattus norvegicus
  Genbank Accession No. AA875207
tttttttttttttttttcaattttaactctttatttgaaacaattccagagacaagttagttgtgacaacagtttctcactacaacacaagggtaggcatggctcactgaaggaacaggccaggcacctcagtacaatatatacattttaacagtggctaaactgatgacagttataaaaacaccaaaaagaaggctagggaacagcaaagccaacagggaaagaactgggtgctccctctgccagacactaacttttctgggcccacaaaggtaagatggggaagagaagacgtaggcagtaggacaggaccctggcccacagctcctcacctatcttttgaccacaaaccccatcctggatggcctaagagcctgaagttctcaggatccacatgcagcttgtcacagtggagttcactgaggctggcaaaggtgcccttgaggttgtccaagtgtttca

SEQ ID NO: 306 - DNA, 422 bp, Rattus norvegicus
  Genbank Accession No. AA875217
  misc_feature (1)..(422): n = a or c or g or t
tttttttttttttttttcattagaaaataaagtgtttattaagaaactatacactgaacactcctataagtccctgtggaaacacaatgccccattgtcatagcacaaagtgaagaaatgccagaataaaagatgctgtgatggatggagcccgagaggctggaaatgaggtcatgatttacaacaattaaaaacatcatcctcaagcttactccttaaagccacactcaggagtagatctgaacccgagggatcatctgggtgatgagatcactgagaggacaacatggagaccccatgcttccaagcaggaaagtgagactggaacacggctggacttcaggctttctcgtgatggttgggtcaagagaatggctantgtgtttaaaaggtanctcctggtgcttgggtttggattttct

SEQ ID NO: 307 - DNA, 438 bp, Rattus norvegicus
  Genbank Accession No. AA875225
tttttttttttttctttctacattttattatttcaaatcatgtgaacaattccataaaacatgtgaaaaaagcaaggaagtgttcaacgctggaggtcccgggcctggggcgaaggcgtgaggggcctgaccctcagcaggcagcggcggttcctagattagcgctaaggagctacatttaggttaatggagcctgggcccaaggcttcagggcagggccctcagtgacattggcagttgtctggaacagcccttgggatccaattccgtggagggcagggcatggggccgcccaaagagggatgggtgtaaacaggcagacacactcaaggcacggaatcactggaaaggggctgggggcggcgggagggatgctggtcaagacctgacagttttaaataggtttctccaaaaagttttctagatttgcaattttcc

SEQ ID NO: 308 - DNA, 548 bp, Rattus norvegicus
  Genbank Accession No. AA875261
tttttttttttttttttgccaggaaaataggtttaatttttctacgtgcacctcagaagttacaaagcacaaacgtgatttttttctactttacattttatctctattagatgtgtgtgcacagatgtgtatcttggtgtgcaggtgtaaaccagaggacagcttgtgggagttcgttctctccttccttgtgggtcccagagatggaactcgggtcatcagacttggagtcaagggcctctttgatgaccagctgagtcatcaaaaggaagaatgttctaggtgtggcctcacagaggcagtggttttgagcagcctagctgaagagctgaagtgagggctggaagatacaaatgggaggccagagatgtgactttctctggcctcattctggggtgtgtgtgtgtgtgtgtgttcacaaccacacacatgtatgtacttgttgaggccacagtcacagtgaagaagtctggaggaaagaggctcagccccaaatgtgttccctagcaagtcaaaggcacttaatccaagtctgtgagctactccaa

SEQ ID NO: 309 - DNA, 466 bp, Rattus norvegicus
  Genbank Accession No. AA875268
  misc_feature (1)..(466): n = a or c or g or t
tttttttttttttttttggatcagggcgggtttattcacagggattctgggatcctcacgttcggcttggcagctctacctgcggtaccagatcttcagcttctgttcgcgtttgatcttccgctgcagctgcaagatgccgtagagcagcgcctcggccgtgggcgggcagcctggcacatagatgtccactggcacaattcggtcacagccacgaacaaccgagtaggagtagtggtagtagccaccgccattggcacagctccccatggacaccacataccggggttcgggcatctggtcgtacaccttgcggagtgctggagccatcttgttagtgagcgtgccagctacgatcatcacgtcagcctggcgcgggctggcacggaacaccacaccaaagcggtccatgtcatancgcggggcggccatgtgcatcatctccacggcacagcacgccaagccg

SEQ ID NO: 310 - DNA, 467 bp, Rattus norvegicus
  Genbank Accession No. AA875316
tttttttttttttttttaggatttcccaatgactttattgaggtaacatttcccaattttatacacacatatatgcatttacgtatacttaggaaagctaaacaatgttctaaggcacttggaactgtgcacagcggagtatcctattatattacattatactactagatagggtataattttccactttaaataacacaaacaccagtatgaattaaaaaaagataatgcatggtctttcaggttacaattgtggaatacataggcttcggtgtggatactcgcaggggtaatacccacgtactatgatatagtagtgaatcaggaacatgaagagagagaaactgtcgtgttgtccgggtacagttccagttatcaacacccacagatagcacacccatggtaagattagatcacacactagagactcacccagctagtctccccaccatcacagtgtgtaccat

SEQ ID NO: 311 - DNA, 394 bp, Rattus norvegicus
  Genbank Accession No. AA875327
tttttttttttttttttgttatgtaaggttctcttttatttaaaagatcattcacaaaataccatatccatagactcactttctgtcatagaactgaatgtgttaagtgtttggaattccattcttacagagtcagctgggcgcccagcagtgtggatggacgtgcctgttctgtcttttccgcattggagatggattagatcatctgaaagcatcagctttgattacaaccacgcaatgcatgtctccaattctgtgtgctcatcccagctggatacctaccaacaggccaccacagccgcctagctagtggccccagctctttcccagaagccaaggggtggctggcaggaagctgctggctaacgagcaagctgcgcacctcagcccttct

SEQ ID NO: 312 - DNA, 494 bp, Rattus norvegicus
  Genbank Accession No. AA875428
attttttttttttttttgcacttctgtgtttaataagtcacatcttcagttgctcctggggtggaatgtgagaccttgactcttgtagtgatgtcagtgggtgggcatgaggctgtgaagaacatctttctgccacacagatgacatctctggagtaggtacatgtgcacgaggagctccatagtttcacccacagtacacctgctacaaagtccctgtaggcaatggctgccaagtggctatgtgacatctaacaaagacagtggacacctgaggtagctagtagcccagcagagacaggagtacaaccattagaggaggcagatccaagaccacaatgctcttaggaaccatagtgctctcaggatgtggtgttttcatggggacattggccacccacccccttgggggagggtccacaactatctggcttgcagctcactcttactgatagtcctaagggctaaaatgatgctggtggactctcagggcga

SEQ ID NO: 313 - DNA, 497 bp, Rattus norvegicus
  Genbank Accession No. AA875431
tttttttttttttttttgagggtgacaaaaggtttattctgcattgtttacagagtcaagcaggggataaaactggcaaagactctcttgtgaacttcattctcatgacttgaagtcagtgggtggtaggccttcaggttgaagctctgggagacggataggtggaagggctcaaattgcaacaagtgagatgggcccaggcagtcacgggttcttctgaggggtgaggtagatgtgtcagccagctcgagcagagaagaagggcaaagatcggacataggagtctagccgggatcggaagagttcactttgcacagtttgtcccagcgggcacagaggattcttcacaacaaactccacatacagcgcactgtagatatggtgtagaacatctcggatagggcccacgcccaagtcagtattcatgacaaccttgattccagtgggagtctcgtagtaatggagtttgtaacggctagtttggaaagatagaaagc

SEQ ID NO: 314 - DNA, 437 bp, Rattus norvegicus
  Genbank Accession No. AA875470
  misc_feature (1)..(437): n = a or c or g or t
cggccgcagttgtaactttaatggttttcttaaggttggcaacctcactctcgatctgctgcttcaggcccagctgctgctccttgtgcaggttggcacggctgacttgctcttcaatgcctgacagcacaacctcacagcctacgcaccactcttgcagggtttgggcgatggcgctgaggtcctggcgctggatgtcccgtccaatgctgtagtcaacctctagccgctgattgcgctggtccagagatccacgaaggacatcggcatacacttgactttggcagccagagtgacaactgacagatgtcgaagcttgttcttctgagcctcagtaagtggggggaggttcctggcttcagctaagtagtcagcataggtcccatangcaaacactgtgagcagccggaacgtggaggcaaagtcgctgtctgcca

SEQ ID NO: 315 - DNA, 476 bp, Rattus norvegicus
  Genbank Accession No. AA875500
tttttttttttttttttgcaaaaccgttttgggctgatgtatgagcttttacctttgcactgagtgacgttctctccgtctgagcggcagcgtggggggcagctgctccagtgtaaatgtttactcaaggatgttcctaaaggcgtgcgctctctactacgcctcgtgttgcctaccttagtgtggtgtcgtggagttcaagatcaagttgagatactgacgtagggttcttaatgaaagtattgcaccagttttttcatgttgtaaaactaaagaatttcgctctacagtttgagaaactgtggccaccgctgtgacccgcagcccgcctgctgcccaggttgggccctgcactttgaacaggctttccatgttgttttgaaggttcccacggtgaaccttcttgtttacagattttttgtttgttttttgagaaaaaaaatgtttactcttccatcatttaaaaaaaaaaaatt

SEQ ID NO: 316 - DNA, 403 bp, Rattus norvegicus
  Genbank Accession No. AA875523
ttttcttttttttttttcaaagagcaagttttatttggtgaaggcaaacatcatccaaaagaaaccagacaggcaaggtgctgtgattagggagcctctggggccacacaggaatctcacactgggcaaggagcaggctcgagacacgtaaatgtcctcagccattcagcaccatccggacaagctccgccccatgggcccgtcaccccgacaggatatgcctcacaaatgcttcatagttaatgcaaccgttgctgtcctcatgccccgccactagcatctcgacttcttcctctgtcatcttctcccccagtgtgactaggacatgacggatttcagcacccatgacagtgccattcccttctttgtcaaacacacgaaggccttcaacataatcctcgta

SEQ ID NO: 317 - DNA, 547 bp, Rattus norvegicus
  Genbank Accession No. AA875537
ttttttttttttttaacaccaagaaaacactttaatcaaactacagaaacaatggttatagtacagaatattcataagcaaaagatacaccatgttttaagtacttacaaagttacaaaccatttgcttccttaacattttctgttttttttttaagttcacaacacaagtatcagatttaccattttgcgctttttttttttgagggaaggggggtgtatttatcatcagctagatgtgctcactgtatgctccattatttatatgcaaggcccgggtgactggaagtgcagttgtcaggcattttaataaactggacagccatttgtttctgcacgacaaggcatctttacacaggagcaatcaggagaaaacaggaaacagccaagcactctgcactgcaacacgccaccttaacagctaaccagcattactcaactgctacacaactgcgcctagtgcacaaaaatacataagagaagagattagaattgtgtcgggtaaacaatcctttaaaaaaaaaataagtcttttcacctgaaaagtc

SEQ ID NO: 318 - DNA, 481 bp, Rattus norvegicus
  Genbank Accession No. AA875559
ttttttttttttttttccaggcttaaggttttttatttcctttgtaatgtttggaacacaaatgaagatttgataactttattccattatctaaaaagcataaattattcatgcatagtgtatggacttcgttttgtagcaaatcacaggatttgttcaaataacagatattttaagtgtgtgaatgtaaataatcatagatgagaatgtaccttgctgtattttcaaataagtaaccttctcctttttaagacattaagactcgttgatctatcagttgacccgctcctcctgctatgcctggaattctgttgtggtaatgctgactcctgttttccatcaaaaagatggagttttcagaatcatctggcacctgtaaaacatcactaacatagtgtgtaggcctgcggcctaccgatgactctgtacacgtttgttgctaactgtaaattactaataaatcttttttcctcgtgccgaa

SEQ ID NO: 319 - DNA, 404 bp, Rattus norvegicus
  Genbank Accession No. AA875620
tttttttttttttttttgcttttaaaagattttattacaagcaggaaaccatgcacttccattgcaagccattgtaagcagaaagacagatacacttcaggcaaggtaggcttttattacattggctaatgctcatgttcaagtgaggctctggttcagtctgggctgccacctgccatgcctgtgatgtgggacagccagcacccacggctttgcggcctttcacgctcggatagctggcaacaaggcagtagtaaaaaggagtccaacttgtcagttttgagtagcagctaaggccttcccagcacagaggacaaagggcttgttatacaatgagatgatcatgacattctagtcacttgtaggaactccaccttagtctgggtcctaagttagcccacatc

SEQ ID NO: 320 - DNA, 332 bp, Rattus norvegicus
  Genbank Accession No. AA875629
ttcttttttttttttttatttttactttaaaaaattttttattgcacatttattccagtttggcatgctcaagctgtgatgcttgggtagagggcagagaacaatttatgggagtgtgggctttctcctttcactacctcatgggtcgtgagatggaattttaacagggagtgtctttacccactgagccctctcgtggctttaaggtactgtctccactcttcaccttcccagatgcctctgaaagtctcattgccaaccacttttacagaagtgaccaagaaccttagggtaagggcagcgctctagctaggcagagctgatgagtgaag

SEQ ID NO: 321 - DNA, 432 bp, Rattus norvegicus
  Genbank Accession No. AA875633
tttttttttttttttttccttttagaaaagcaggtttattggtccggctgctcaccagaacacagcaactcgaggagcttccctagagcccacaggaaactgtatctgcccacagtgatagcccatcagcacaggggacctaatcctgcatctgcccaccctcctcagcttatctgtcttcaatcggaggagggaaggggaccaagaaaaataaaggaaaattaaaaataaaaaataaaaagcaaagcttcgtattgtataaaaggtttgtggtttccatccccccccaaaaaaaataatcaattagctgcaattctaaaaagcagggaagatgtgtcgttggggagaaggaagtagcctgtagctatcatttgggggaggtgttgcctttgctcctgaccagcctttaaagggggaatcaatgtgtcctca

SEQ ID NO: 322 - DNA, 424 bp, Rattus norvegicus
  Genbank Accession No. AA875639
tttttttttttttttttaccttgtgctatagagagaacttttattcaggcatgttattttcacccccaaggaagggggggggattcattaacactctccttttgtttttaagaagtattaagttcattctaaggcacggagaattcacttctctcctttgacctttgtcattgttctgtagttgattggccgatcacacccaacagacttcagaaaagctgatttttcgtctgaggagcaggttccgacaacatggcacttggctaactttgaaagctgcacagcaaactgacctgtgcccccagcggctgctgtaaccaaaactttcttcccttctgacagctctccaagctctttcaggctgatgtatgcagtggtgccattaaccagcaaggtgagatattcaggtttcactgaaggcata

SEQ ID NO: 323 - DNA, 485 bp, Rattus norvegicus
  Genbank Accession No. AA875664
cagccaccatggccaagtacctggcccagatcattgtgatgggtgtgcaggtggtgggcagagcctttgccagggccctgaggcaggagtttgcagcaagccaggcagccgctgatgctcgaggccgtgctgggcaccagtctgcagctgcatccaatctctctggcctcagcctccaggaagcccagcagattctcaacatctctaagctgagccctgaggaggtgcagaagaattatgaacacctgtttaaggtgaatgataagtccgtgggtggctctttctacctgcagtcaaaggttgtccgtgcaaaggaacgcctagacgaggaactccgaatacaagcccaggaagacagagagaaagggcagacgcccaaaacgtgactgctgggctctccacacccacccattgcctcataatttatagcctagtaataaatgtcttttcgtgtttcaaaaaaaaaaaaaaaaaacctcgtgccg

SEQ ID NO: 324 - DNA, 216 bp, Rattus norvegicus
  Genbank Accession No. AA891032
cccagccccaaagttttattaccaacggggcacattcgagttcacaccccagggggtacagcttaaaacacggacagtgacccgccccgccccacggcttccgtgaagagttgcttgccaaagcacagcttcttccagggggtccccagcagggcattgcttagcccaaaggttccgggggtcaagacaataggctcaggccccccccggtttcca

SEQ ID NO: 325 - DNA, 446 bp, Rattus norvegicus
  Genbank Accession No. AA891041
aaatagattcaataaaaagtcaaacacacacacaaacacatcttaaaatagactttagacacgaagtgcgtgtttcttctccacagtactgtgcagagggggagggcagggggcggaggttcctccctagtatccccacaggctgagtaccaggcggcggggccagctccgccgcgacaacccccttctcccctccctgttaaatacacaaatatattatattcaatatgaattcagtctctttccagaaaaaaaaaacatacaaaatacgctggaagggggccatgtaaacctcgaggtggaaggactgggcgcaggcgggcaggccagagtccagtgtgtgagctgcgccccagacctctgggcgagtgcccatcgcctgcccccctcaccccagtggggggcgggcgcccagccttcaaggctgggggtgtccgtatggagca

SEQ ID NO: 326 - DNA, 455 bp, Rattus norvegicus
  Genbank Accession No. AA891049
gaccaaaacatttaattaacaacaacaaacaaaattacaatagcagaaaaataataataacaataacaaagaaattagaagtgggaatcagggtaaaatagaatgcagaggccttagtccctaagagaccagcacccctgctgagctggacttagccccagctccttctgagttttccttggctgctggcttctcatcttctcccataagacgaatgttgtgcttttcccggaattcattgagttcttttccctttgcctgaagctgctgtgacagtgtctcaatgatcttttgtatctgctccttgttaccctccaaggcaggcagcacctccttgaccgtccgctctaccagcacaccgccaaccatgcggtagcacttgcgggtctcatccacttccttcagcgtatcgatcaccagctatgctcattcagttccatctccagctcagctgc

SEQ ID NO: 327 - DNA, 508 bp, Rattus norvegicus
  Genbank Accession No. AA891054
ctcttgtttcaaagtcttgtcgttcaggtaatctggataatcacctctcctctgtcccaaacactcccaagagagtgattgatgaactcttctttcctagcggtgtggtgtctcttggcggtgcacaccgacaggcacctgtggccacgggcctagatcccaagatgcaggaatcggagcccaaccttgaagggatgtcctctcggagcatgaacttgtcccaggcctacttttgttgctactacgagtctgtgcttttaaggcccgaggggagctcactggactccttctctcaactctgcgtctcttgctgtttgttgttctatgaggaaggggcacgttccggtctcgatccggactttttagactttctgtcaactagcctaacttcccccacattctttaaatccaggtaacttcctaaaaccgcatagatcacatcacgaatggcctcagatcatgaattcatctcaacagcatcgtctcaagaacggtcctcttcctgttg

SEQ ID NO: 328 - DNA, 513 bp, Rattus norvegicus
  Genbank Accession No. AA891108
aacaggacttttattggtagtaaactagagcaaacaatcagaataatacatatgtagtattcagtacacacaataaaagttaaagaaattcaaaacctgtataaaacaaaagagagagagaaatcatacagcttaagagatacaggggtaaaggtcctctccatctttgatcacacttgtctctgtacccaatagaacttactgcacttaataagacatacagacattttagtactgagtgtattaaaagaattaaacacttttctaaaaatctttcaatgacaagttggtaccctttagctaactaaagctaaaaggtgggaggtgggaaaagggaattaactagtattttgtaaccatttttaataatttcttattttccaaacactgcttttataacagaagtgttttacacttgcacagtattaattactttattatacatggaagcctgtggtacgctggttacacaatgagactgcaaactaccagtggtactttcctgacgtcaga

SEQ ID NO: 329 - DNA, 647 bp, Rattus norvegicus
  Genbank Accession No. AA891207
cacagtgaaactttatagaaacgttctttaattagtgaaacagttcattgtattatgggtagaaataaaaccaggtcaggaagcacagcaaacgaaccaacgctgtaagctacacgaagaacattctggtcagcctttttaaagccaggcacaagcgattcacaccagtaacaatgaacgctcagagggcctttcgaagaattcacacggcaaacaacaagttaaaaaattatcccccttaagcaaaaaccccaataggggttagttgtgtagtgcttgtcccatttgaccattagtgatctttgtagaacacaaggatgtaaagcttccgagcctagagcctatgtggaaatgcccatcccccaccctgtgctctcccagtcccctgctaccctgtggtgtgaccacagcctttggggcctgtccaggataatgccctcaaaagagtgaacacagagaacagcttttcagccacacgccgaatggatacatttattgttaatcaacctataattctgactgtgccttgtgggttcgctgcagaccttttagaaagaaaatactaaatgaaccactgcaattaagaaccatggcactaataaagggttaatctggttttgttccccttctctatgtgcgattcggtc

SEQ ID NO: 330 - DNA, 529 bp, Rattus norvegicus
  Genbank Accession No. AA891209
cccatccttctgagtggaggtgccctgtgtggggttaggaagtggtgctgggagggctcagaggagaaaccacaccacgtcttgccttaggaaagccaggatgtccttccatcctacccgcacatgtcctgcaccttccctggtgagatgggcgacggggctcagagagttctgaagagtgacacagtgtcacctgtacagggcaatgccagctcccaaaggaaccagtgccctagacaagcagtccaggccagtgtgcctcaggaaagaggacgtgaaggctcatgacaggtgagggtcacagctccgagtgtgccgccttggctactatcaccagcttggagagctcagctttgaaggccccaggcctgtgagacactgctgtcttggtcacttcaaactcctcgcttttcagggggacatcactctctctctcaaatgcagctttggagtaggccatggcgtactcgatctcagcaccctgcaactcagccttgaactgtgtgaagtagaggtaggatttcccctg

SEQ ID NO: 331 - DNA, 635 bp, Rattus norvegicus
  Genbank Accession No. AA891220
aacatttcactaacagaactaaactttatttccatgtttgttacatgtttgtcttggatgctgagtacatattagaattgacataacatacaacctgggagaaagtctgatattctccactgaatgagttaaaaaggaatgtaaaactacaaaatactactttacgtgtgagttctaaggtatgattaatacaacaacaaacatcttgctatttttctctaattttccgaggtggatttcactataaaagcttttttttctcatttcaagaaaggaagggctactcataaaaaatctttaagtatagggtacaaattagtctcaacacaaaattctactgcctacctaaaagttatgaattgaggggactaatgtcaactgcaaatctagtgtctgaaaggttagtctaatctaaggatgacacgcaaatacaactccatttgtcatttatgttaaccacttggtactcagaacggggtggccaaacactgcttagtgacagagatccaacatgaatctgttccaaggggaccagagccaagagggatgactcattctatctccggacccacactgtacacaaacggaaactactagtttacactacatgtttcaagacaaaattggcatgtgta

SEQ ID NO: 332 - DNA, 406 bp, Rattus norvegicus
  Genbank Accession No. AA891302
  misc_feature (1)..(406): n = a or c or g or t
caagatgacaagactaaagtcaagtttattgggagataaggacatgttgtgaccactagtgtgtcccttagggtctgcaggtgtctgtttctcaatgccctctcaatggttcattcctggatgtagaggttgctgggggcggtagggtcatccctntgccgtgtttccaccactacaggcctcggggagcagagcagacggaaggtgagtgtgggatctctcagctcctgcagcggctgttccgagtctggagcccacacctgaactccgtgcttccagaaggcctggagtcgatctccaaccattgccacagcctcgaccgcttctgtcatggggatctcaggggtgcgaagcccgggagctggtgccccctccggggtcactagcttcagagagccatccatca

SEQ ID NO: 333 - DNA, 484 bp, Rattus norvegicus
  Genbank Accession No. AA891423
  misc_feature (1)..(484): n = a or c or g or t
actgtggctaaacagccacaattagcaactttaatataaagtttttaatacaaagttcaccacaaagaaagcagatgccatgcgtggaggcacgtggactgcagctgcctcatcctcaagtcccgggcttctggtgttttgtcctcggatccagcagttcccatgtggaggctgcatggcctctgtccttaacattgatgccgtgggtcatgaggtcctggcggagtgcgtcacatgcctccagcaagggctgcctctcctggagctgctgtttccgggcctccccggtggccccaggcgtggccagtgcatactggcggaccttaagcctgaagcgcactagttcatctaccacacagtgcanggctactgtgctgctgtctcctgaaacacactgtcgcttggccagagaaatccaacagtctcgaaaaactgctcaacgtaggcaacgatggccccaaacacagtgggacttctcgggcca

SEQ ID NO: 334 - DNA, 446 bp, Rattus norvegicus
  Genbank Accession No. AA891439
cctctgaggaaaaagttttattcaaggtccaacaacagaaagaaagtttgaaatccacaggaagtgaatctgtaatcactgataatggcacgtcatctgtggcccttccactccctgacatcgagagaaggaggacatctgtgatcgctggtcctggtgctccttctccttccagcctgtggctcagtgttgttctcccaggaagagtgggtgatgctgtcctggtacctacgcctcagctgggccgcagaggacccagggatgtactttgaacttgatgtcttcctccctgggacaccaaggatgtcagaagacttccaggcccataactgcctgtcgcatcgtctgcagccagcataagatgatacgaaggaatgctgggaagactcacagaatggcgccatctccaagacagttcttccctcagaaagcttcaaactgtatag

SEQ ID NO: 335 - DNA, 381 bp, Rattus norvegicus
  Genbank Accession No. AA891476
agctcaagaattacacactagccaacattagtatatatttacatgctgaaactggctgcaattagttgaaattcatgaaaataattcttatgtgctattcattgataatccttttttgaatttgactaccgcgtgtatcccagagattttagaagtcctgatgttagaaagacgtgaaaacggatgcagtgagtcccgctagtgctttgcatttttctagctgttggggagtgagcaggatgtgtgtgttcagaaaggctacaaggtcattgtaaggctgataatcactacgttgtgaagacacgggaccatcacttcttataaaaggacagttcagaactacgcaggaacaattccataacagaactatttaaacaccat

SEQ ID NO: 336 - DNA, 621 bp, Rattus norvegicus
  Genbank Accession No. AA891535
tttacatttgagaccttatttaatcatagtgaatgctccaagtttaaaaagcattaggcagtaaccacacacaagatgaaaacagtgtaaactatacaatactttatgtacatttttacaaagtaacacttttttaaataatataactggacacaaaaatatacactttagagaaattcacatcagtaattgtataaagctctcttctagggtcctgaaaatttaggacaaacattagctctgtaaataaagtgttaccgtgacagtcctgaaaggccactatatatatttatctacatatagatatcacattgacattttcaaggctaccagctttactatagaatttttagattatgtattcaagtgttgaggtccttatgattatgcaaacatcaaaggaatagtggaataagaagcagagcaaatttacacgaattgggccagaacacggatgcacaggctctggctgccccaacttagatcctcagtggctgatatattcatacttcagacagcagtgaaggttttaaataaaattatggcaaacaggcttgaaacatgattctgattttctacaattttcacaagttcttttaaatgcaaacaattctttaccat

SEQ ID NO: 337 - DNA, 598 bp, Rattus norvegicus
  Genbank Accession No. AA891542
cataatactgtcattacaaaaaaatacaaaaaactactataaaaacattcaggggcttgtcaaagtgagaaaacctaaagaccccaccccaggaccaactgaagcagttttctcccagctccttcactattcgacttttatacaactgtgggagtggggtggggtgagggtcacacaggcagagaggctggaaatttccgacacagcctccaagaaaagtaagaaataagtagcttcacatatcgcaaaagtggggcttggaagtttggggtggctaggccctgagttcagagatatgggaaggaacctgtgatcctgaatctcttggtggggaacagctgccacctgatcccaaagcccttttccttcctggtgatggctgggagatgggtcctgccccacctcttagctgtggtggatggttcaagccctcctttcttctctccacccctgaacactccccagagcagctgagggggacagatcctccaactctgtggggtgtaggcaaggcagctgttgggaaggctcctaagggttggctcaactccctgccccaaatgaaaagtgtctcgtgctcaaatgacagccttgttca

SEQ ID NO: 338 - DNA, 564 bp, Rattus norvegicus
  Genbank Accession No. AA891546
actgtgctaagcctttattgcaggaggcgagtcaggcctgggtagacacagattcagggcagcagtggaggaaactttcagaggcacagtgcatggcattaaagttcagcaagtcccggaccccatgttctcctgattctccacggctcagttcttcatagagtgctttccattcaaagggtcctaaaggccaaaaggaagggattttttttcagctaccggccaccttcaggtctcccagccgaggcatccagtgagcctatcttccagtttcctctggaggatcagaaagcctgcttcgcatcgcagcgccgtgctccctgctcctgttcctcttctccatgtactcattcttcaagcacttcctcatttcccgatcaagatcgttgcaatgaccaaaaaatttcagaatgttgtgatttttgtgacattccttaagcaagttaatcaagacgttgcattcttcagtgtgcaagtgtggagacaagtcaggatgcatcgtttggaggacgagtaagtgcagaccgccactcagccctcaaaggaagcactgaaagaagccac

SEQ ID NO: 339 - DNA, 587 bp, Rattus norvegicus
  Genbank Accession No. AA891551
aaaaaaagatttattaaggcaatataacaatatgtaaagcactgaaaactggccagggcgccctttccaaagtgagcccagtgtgtcgagagcttctccacagttccttatcaccagcagctactccacatctctcttctgtcaggaagaacatttctttcaaaagttctcacgtggcagcttcacaccggccagcagcttcatgtcctgagggacaaaccaatcccacttctgctgagaggattcctggaaaggccctgcactcaagacaaatccccctcaccaccccggaggggatgactagtccagcatgtaggagcctctaaaagaaattgaaccggaactcttcgttggtcaagtcggacatggttccggctcttcctgcaggacgaggcctgcagacccttccactcttctttctggcggcctcgccaaccagctgtacctgggccgagcgggtggcagcctttaaagcccgtagggcctcccgccactctgcatccatctgagccctgtagtccccaaacaaggagcgcatcagctgtctcttccggggcaaaggggttttttcactccgcaaagttcgg

SEQ ID NO: 340 - DNA, 486 bp, Rattus norvegicus
  Genbank Accession No. AA891580
  misc_feature (1)..(486): n = a or c or g or t
aaagccatatgctacacatataacaccttctctctctgtaaggttgacattattcagagagacagtcagaccacaaaccacaaaacaacagtcagacaacaagcactttacagcgcccaccacagtctgtacactaagaacagtcctaagacggcatccgccttctccttcttcaatcaggatgaagctgtcactgacattccagtaacatgctgacgtggttgtcattgtttcaagtcacaccaaactgacatcagagagtacaaggttctttaatcaaacaaaaaattagtcttatttaaattaagagaaattcacttaaactaaaaataatttatttgagctgagagttttaaatacctaacacattttttcagggaaatgttggtaccatctctgagccagctttccttcctccagactgtatctgtataagaatatataatttacttatctctcagtcattttcagannacacgtatctct

SEQ ID NO: 341 - DNA, 471 bp, Rattus norvegicus
  Genbank Accession No. AA891595
gagcaagtacattaaaaaccgtcatacatcaaatagtctgacactgacataagtattacacgtaaaatagtgcacttctttccccataaagcaagctgcatcctatgagctggtaaacactgttctttctttagttaaatatagaaaagggctgagatttggagggagaaaaaattaaattaaggcattcaaaatgggtaaagttgcctatcttaagcattagaaaactggaataattaacttcaaatttcttgttacagttattgtttacacaaacatgcagctccttatcaggtacatgagtgaaggatataaactccaacatcatggctttatacaagtgcatagttgcaactgaaataatgatatctgattaacgtgtattaaaaaataaaacggtaagttaaaaaaatcttgcagtattacagtacaatgtgtttatgtgtatgtgtgtatgtgtatatatatatg

SEQ ID NO: 342 - DNA, 395 bp, Rattus norvegicus
  Genbank Accession No. AA891596
caaaagttgatagaaaacagttacagtttttttaattaaatgcaatacacagcacaagaaaaaaaatagccaactttttactagacatttcttatcttccacaatattcagtagctttttaataccacgtcaaatacatcctatttaaatattttgattatttgtagacagtcttccagcaacataattaatttcttcccttcatcaaaactctgcaataaattattctttcaactgaagattttaccctagcatgacaaagtttaaaatatgaaaacaaatgcctctctttttttgaataatgcatattagaaagccatataacattcttcaatattacagtaataattgcacaaaagaaggctagatttttcttctcctatctttcccagact

SEQ ID NO: 343 - DNA, 327 bp, Rattus norvegicus
  Genbank Accession No. AA891631
gccagagcagagactcaagccaggtttaatggtcattgtctagttccagagcccgtgggctccgaggtttgccagcctggtgtacacagtgggaggaagagtcctagacacagaaagagagaattacaaggcaaagacacatacacacccggaaatcggctttgttctccccagacaggtctacccttcctggcctcctccaggggccccatagatacagcaaagaaaaagatcacagataattacacagactgtagagtcctgtcacatcctgtctccagaggaacctgcttctccttcctgggagatagtttatgagtatagatg

SEQ ID NO: 344 - DNA, 381 bp, Rattus norvegicus
  Genbank Accession No. AA891666
aaacagaattgtccaggtttattcacaggcaggacgtcttcgggcctgctgctgtatatccctccacactcagtcaaggaaagacttctttggcctcctcagctgatatctcctgggagtagagatctgtgaagagagctggcagccagtagtgggcctcccctggtgcctgcagatccagccaggccagtccttccttcagcaggtgttccagcacttgccgtgctcgctccgtctcccatttaagactggctttgatttcactgacagtcacataaccgtttttctcggccagctgcagcacaacagtgtgatccatattgagctcagctggaacagactgaatgaggtaagttccctccacagggatgatgccaaatc

SEQ ID NO: 345 - DNA, 482 bp, Rattus norvegicus
  Genbank Accession No. AA891677
aaataaaaattataatttatacaagactttgtatctaaacaagggtttctttttaaaaaaaagtgacagaggaattttttcctatcttcagttctttatagaatatgatccttttgtagaacaaaagttacaccagtgacaattatttacagatcccaaacagactcaagctttacacacacagaattgaacattctaggtcagtgattagtcagcaattaaacacctgcccagatcacacagttcagtacaaaccccagtgtctctgtaactatgactagaggcggcctaggcccctggcccagccctgtccccctgagctccacccaaagacctgctggtggccaatggtggaactaacagttgaacttggggctgccaccgtcacctccctgacccactgccctggcctaaggtcagtcttcatctctctttcccagagaaagagactcaaactaaaccacttactccaccccgaaagc

SEQ ID NO: 346 - DNA, 454 bp, Rattus norvegicus
  Genbank Accession No. AA891721
accaatcaactgtttattaaatgttacagaaagggtgaacaaattaatgaaaatatggaattgaaaggcagggatgaaggaacagggagcacagcaatatccagtgggtttagatggcccttaaagggcagacctgcatgctagagaagcataatgggtccctgtttagggtacctctgtgtagactcggagcctgaaggccaggatgctgaagaggcaggtattacaacaggcccaactgcacaggctgttaactgaaatctgaggccgtctctcagataggtactccctttgactcttaacggctcttctaggccgcactcttaacccaccagatgtctgcttccttctttagggtccaaaaatagtttttactttatagattgtttaaggatagatactatgcctgtctcaaacactaccatgtccctactgcttagcacatacagtgcct

SEQ ID NO: 347 - DNA, 418 bp, Rattus norvegicus
  Genbank Accession No. AA891727
ggggaaactgggcagtttattgacaggcatcaggagactgcgcagtcaggtccgtgggcgggacagcacccgagtccaggctctgtgcttctcctcgggccttgtgggcgcaaacttctcctgcagtttcctccacacactcttattcatctcttgaaactcctccaaagtgtctgtggacaggatcagcttgtactcttccacggacaggccactgaagctggtgtctctggggcagggtacttgtgcttgtagtagtttgaatgcagtcgtgctaagctctcgtacatctgatcacaggcctcgggttctgcaacctgggtgttctctccctcccgaaaggcctgtgctacccgctgccgcaggtaagcgcccaagtcccggccccgtttggtctcgtccactggcccctcgtgcc

SEQ ID NO: 348 - DNA, 664 bp, Rattus norvegicus
  Genbank Accession No. AA891733
aaagcaatctactaaaaaaatacaactgtatttgaaccttccgatctctgtgagctatgatgatcagaagtcgggagtcctttgtgtttaaacaaccacatgctcactctttaacataattcctgcttatatacgggaagcgattcacaaccgccatccacctgcaccttttgcccaggcggcaatgtggtttagacctcaggtctgtaattgcaatactttttgatgggagatgttgcacaagtgctatttgttagctatgaaatcaggttttctgcttgttcttaatgccatggtcaaatcatagcacaaaatcattaaaaataatcagtgataaatgatctgttccctggggttgtttgttcacttctcatagtcaacaaatagaagactgatgtatgtgtatgaccagtcttggaaaatacctgttgtttgtggtgctggagggagagctcttggctacacaccaacccaaaggatactgctgatccgtccctagttactgactttaaaatatttgtcatgtgtcacagctcatgtgtggtgaggacaacctgctcctgtcatgtctctctgactactacgtgagttccaagagcattcttggcagtgaatgcctttagtccctttcttactggtctgtcactgatttttttaaaaaaag

SEQ ID NO: 349 - DNA, 616 bp, Rattus norvegicus
  Genbank Accession No. AA891734
actctgaataaggttgatatttaaagagcagaggaaatgcctatacaaaaggtttatggaacattcatttacatactggatatatattctttacaatatagaatagtgaaaactgcgctaatgggtaagacaggtacaacaacattacaacgtccttgacactgaggataaatgcagtgtggcttttaacgtgggaacagcccaacactggaaactatgagaccattaatgagaaggttaatgggaccctggttatatatggaaagtggagggacatcactgaatttactcaccgaacaatgcactaacttctgcccaactgatggccttgaagcaaaagcctgagcaacactcctcctcagtgtttctgagtatagtctatgacactggtctcgtcttgttctcttcaatacaaacgtcacacacagaagacagaagtttgccctaccagctgttgtagacagttgtagagctgtcttcctgtgtttcctcagagtgaatcccttgacacccttgactacttttaccttgagtgaagatcatacctggtcagccacttgaaaacgcattcccatggcttcttggatgccaacctctgtggcattcaattcactgg

SEQ ID NO: 350 - DNA, 516 bp, Rattus norvegicus
  Genbank Accession No. AA891735
aatacaagtaaaagggggcagggcaactccttccccctccaggtcaggaccaggagaatctgctgggctgtccccgggaccaaagaggaaaagagtgacatagaaactgaagcaaaggaagcttagtcacactcaggtgagggtgacagctcctcctggattttgtttccatttattaaaaaaaaaaagaaaagaaagaaagaaaaagccaccccctcactcccagcccattcctcacagccagggtcagaaagcagcatcagtgaggcgggttcctcacctctggttatctctggcccaggtcagcttgagccacctgccctcaccaggagagggtttcagttggcagttaggcttggggaagtctctacctggaccccccagaggcctgggagcacccccctcctcccaggaaagggaatgcagtgtctactgggctcagaggggtggcctcacccacctgacatgagtcctgattctcccatctcgaggacggcaggaagtttattgcaccag

SEQ ID NO: 351 - DNA, 558 bp, Rattus norvegicus
  Genbank Accession No. AA891737
aaatggttcagaatcactgtgaggcttttagatgttcccattattcaaacaacccaaattaaaaacatacaactcacattttaagtaatataagcaaaataaaaattatctttaacaatgccttatattttgttttagtattctactatagacacataagaataattatttccattttctgcttccctcaaaactataaaatgctgttacatatttttgaaaaatcaaactccttcatatcctttcatcaattttatgttgaaaagagagttattttgaagcactggaattagtgttggaaaaataggtttagagtccaaagctggtgtgtttgcgaataagaacacaagctgacaagtgatttaaattccttagaaaccttcacagttctccatatgtacatgtggcagaaggatgaattgccagccaatatacatcagtgatcagttgcttacatttcaaagatcaaaacacttggtgggaagcctagaaggaaacacttaaagacatataattaagaactcttatctctgaaaagcaaagtccacattttagtta

SEQ ID NO: 352 - DNA, 608 bp, Rattus norvegicus
  Genbank Accession No. AA891746
cactttccaaggttttgctttgtttgacagcagttatgggttgagggggcacacaggcctgacccccatgttccgtttgaccatgtgaggagacccacggcagtgctggtggtcctgggggaccagccagaagagctcagccggaaccactggcttcgaggctttgtgttcatttcgccttcggccccttctcgataggcttcccgatgtccttcccccggagcttgaggccgatggctctctcaattttgcccaaaacctggttattcggaatggcccgtccactttcatagtctgcgatgacttgcggcttttcattgattttcgtggccaggtccttctgcgtcaggcctttgctctgccggccccgctggatcactttgcccacctccagggtcatcctgtcgtggtgcagctcctctgtctcccggtctagcttggctgtgtttttagtgatggaatgctgcttgttctggccagcagcccattttttggatgtctccacatcttctcctcgtcgctgagctgctaagatggcctgcttagacttggcctgtgcggccgtggggcccttcttgcgcagcaccgtcacggtgtcccagtcactc

SEQ ID NO: 353 - DNA, 423 bp, Rattus norvegicus
  Genbank Accession No. AA891769
ctgtctctctgaacacgggggagacacatgggaccagaggggagacaagtgtgaccatggggagggctggactggacaacgggatggcacatgtgaggggaaagacaggcgtgatgacgtgtaaccatgaagacgagtgtgaatacagagaaggcaggtggaaaggggagtggatgggtgtgactgcggggaaggcaggtttgaccttggtcgggagagacggtggcttcccccttactttaagaagggaaagctgtgaggtatcaacaacccaggcacttgaagaaggaggaactcggaagagaagtcccttagctgctgtggactaagcagactcttccatctccaacaggtcatccacatactccacaacctctccctcatcgtcgtccatgaggtgttcctgagcgaagtcatacagtt

SEQ ID NO: 354 - DNA, 555 bp, Rattus norvegicus
  Genbank Accession No. AA891774
ccagggacctccgtagtcggtctccctatcccactcccaaacctcagagcaggaaatgggcttggctgagaagattcatgcttgatgaccaggggaggcgtgcagccccccaagaagaaggggaaaagaaaaacggggaggttgaaaagcagagaggtgcaccttcccttctgaggaagcaattctggtctgggaccagttgcaaggggttagtaagagaaacctaaggggtgcttacatttttattctggcaaatgaatctcttaaaaggctccctcctaggggtgcttacatttttattctggcaaatgaatctcttaaaaggctccctccttcgttcgggggaacagcacatgtacctgtgtcagcgtgagatgcaatgctacacaagaacgtggcattgggccaatcatgtggacccctgtgctgctcccaagggagaggttctgtttgggtgtgggataaatctaaacaagcatacactcgtgttatatgtggccttaagggtaggggagcaaaaggaatggacttctctgtagagcagctcaagaggga

SEQ ID NO: 355 - DNA, 636 bp, Rattus norvegicus
  Genbank Accession No. AA891789
gaaatttagaaacaagttttatttaagatctgaaatacaattcctaaaatatcaacttttcagaaaactgtggctacacaataatgcattgcctctatcatgttagaacgtgcattagactcaaatacaaaaaccaggaaacaaatcaccatccttcaacaatttgagcaaagatagaatgaatgcctaaggaacaacaaagatggacttgcagaggatgggctgtttacagacgtcaagcaccataaaaaaaaaaaaagaagcacaaatgcgtgggtttccaggtatatacagtaagttgaacctttggcactaggaaccagggcatctcatcacgtagcattaacacatattagaaaactgtgtagtgtcaaagggatagaaccaccagcattcaagcaatgttgtcaactaggcaataaaatggtctactgaacttcttctttgtctaattactgcatacactggtagcaactttgaaatgaggaaaggagctgggcactccttttattttctgtctacaacagaacaggaaacaaactgaaacataagccctgttttacatcgacagttttaaagaacatcaattatacaatgagagggactaaacagaagtgtttacagataccagacaat

SEQ ID NO: 356 - DNA, 620 bp, Rattus norvegicus
  Genbank Accession No. AA891800
aaaaagttttaacaatgatgtcggacaggaagttatcagacggtcatccacttgcttcacaagagcactaaaggaaaaggagtccccggggtcctcggaggtttaaagtctcagtgcagaagccccagagtccccatcagttgcggaggaagtgccacacttcttcttctacactgctttctttactcattgaaggtgttgggatcgattcaactagtgaccttgcttcctctgtagtgcagtggaaagggctatcacagatgtgcacgttcacacaactgatagctcccttgtcacacttcttcatcaccatctctttccaatgttcatgtgcagagttaataacttcgagggcaaaagccttgtttttgaattctccattaaaagcaaacttgttttctggttttccatctggtaccttatagagtctaaaccaattgacagtggcttctaggtaacctggtttgaacttcttaacatcatcaatatcatgaaatttttcagcctcaggatcattcacattgatagcaattattttccaatctgtttcactctgatcgataagtgccaaagtccccaggatcttcacatggaccacgtctccacgggaaagaaccttg

SEQ ID NO: 357 - DNA, 648 bp, Rattus norvegicus
  Genbank Accession No. AA891802
aactacatgtgcatacagaaaatattcaaagaaaaatgcaaaccacacaactgacatgtaaatcatttccaacaaccataaaaacacttcttgctctgctctttagaaaattatttttattgttttgtaaatgtctcactttgggcaaactgagggatgtggtgctcacaggaagtggggatgagacaggtggaaggagagggcggcctggcttagcctgtgcaaccccctctggcagcctcccctacacctactgaggctgaaccccctctcccatcctcagagacaacagacaaagaaccaggttaggacagcaagataacaagattctggacacaagccagtagatatggtgcccccccacccctaaataaagggcccacagtgacagtgccgaaaggtttatatgccagtccctagcatagctaagagacatactagtcttctccatgtttggttcctctaggctgaaggctcaactgctgtacatagtcataagtgtgtggccacactgagcatgatgagggaaggtttagccgttctcctgggtacccttagacacactatacccctaggcgggtctcacccaggctcagcccctaaccctatgtataccttggggtatacctctcagctgcacacacaaat

SEQ ID NO: 358 - DNA, 531 bp, Rattus norvegicus
  Genbank Accession No. AA891803
caaggattcaaggattctaattcgaaccggtgaattctgagaggaagagactggatttacatgtcggccagccaaaggcagaaagtgccccccacgaggaattcatgctaaaacaactggatggatgtcaagaattcctaatctgtagattttgcccagatagaacttggttgcacagggaacgtgattcggcctctggaggccaaaccccacctacatggacacagaaggccaatgtctccagtagaagctgctgcttacgcgaaggagagtaacttcagatcataacagccgtccacgtcaaagcggccgatccttgaggaagtatgattagcccggatcatctctgacaatgcccacatctgctgcacctcagaggagactctgctgaggtctggcagaccctcaaggcgaggagcaggatgctcattgggcactgggtgggaaagccacttggcggaacgccaaggaggagctctttggaccttgctggaagatttgcagttcctccacggttaacgacagccacag

SEQ ID NO: 359 - DNA, 617 bp, Rattus norvegicus
  Genbank Accession No. AA891824
gctgggccacagagggcatggcacctaatccagagccactcggactgctacgggatgaaaagtttgtgcaacttcttgaagcagtgggaaacccgaaacatgcagtggaggctaagaagctcagggcgggcggctttccgcgcgggactcctcgccctatctgtgcagatgaatggttacatacatataatacagggggactgacttcccctcgccagaagagaacattgtacattcccttgctctttcttggttccaactgataatttcttaagagtgtaaattatagaatactcagctaaaatgtgtcttcataaatagttaacgaacctgccaaaacacaaaggggaaagtatttttcgttcaaaaaaaaaatgacatttgaatgtcacacaacacaagaaacaatgcttagagacatgttattgtttccagaagaaaatggcgagtaaactacttagctgaagacaaagaccacccttccccaggaccgtggtgcacaggaagcgaagtgtcaaacaacagtacctcaaagcaaaacaaaggtctgggtggagcccgctcacttgtaatcctgttaaagaatgagagccactgtttaggtccaatgtactggg

SEQ ID NO: 360 - DNA, 614 bp, Rattus norvegicus
  Genbank Accession No. AA891872
gagaacatgatgaactcatttattactcaaatggttgcattccattcaagagcacttaatacagaccattcaagagcacttaattgattgaaattaaagagaccaattggcatgggacttttaaaaatacaacttattccttttaagttattacttaaactatctagatcttctacatattaaaatagaagtgagaaaatagatctttggaatctagagtctagagtgaaggctaaaaacctgatatggaattggcatgatcaatccagactacggctaaaatgcaagagaacaggtcaggagttgatcaaagtttcaaaatttgtcacatttggtggaaaaataaaacactaaatgcatgtgcctgtgatgatcaaacggcataatattcttcagaccaaaacatatcctgaaatcttgaacattcaacttctgagctcatttctagctcccgaaagggggttgcaaaatccaatgggattgcatctacagtgaggccgctctctcactgctgacaaaatactctgctttttggcaatggcaatgataaacaagtagatgatgagaactcccgatgctttttgagaatcaagggttgctgatcttgaaaatct

SEQ ID NO: 361 - DNA, 583 bp, Rattus norvegicus
  Genbank Accession No. AA891937
ccggccgccaaacattttttttatttttttttttttttttttgccagtgaacacacacacaggagtttttattttatgcatgtcgtgttttgtctgcaacatatgatgtatcagctgaatgcctggtctcctgggagcccaggaaagggcatcagatcttcacagaccaaagttagagacggttgtgagctgccatgtgggtgctgggactttaacctgggtcctttgccaagaggaagccgtgcttttagccaagtcgtctctgcggtccctcttgggtatctccagcaattcttggccagctctgtccgtctgatccatggtgtgatcccctcattccctccccatgaggagagctgaggacacggaggttcaggcacagtatccctaggctacagccctgccatagtcagtgtcacggggccgggtgacaggtgagggcagtagttctctttattttagaaatgggggtggctgtacatattaaaagtgccacagagtgattcgaacttgaaaacttacagaaagaaatgttccctgtcccccgccccatagtcataccctctgaggtaaggctgcacca

SEQ ID NO: 362 - DNA, 569 bp, Rattus norvegicus
  Genbank Accession No. AA891949
aagcagaaaaacgtttatttctatcaaattccatacaaatcaatcttcaagcaagataacaaaacaatcaattaatacaatgaatagttaggacagcacatacagaacagactctggattaagcacatacgccaaaatcatcttgaacaccaactgtcactgaaggaaagctgatgtgtcagctcccgggggacttaagccaacattgcattaaagactgccttgaacttggggggatcacagtgaaacgccatcacagctcaacatagtcccccagacatccgttcagctcagaaaacaaaattggcaaattcagtagtacaagttctcataaaactagagaagccttgagccccaccatttcttgcagttcacacaaagcccgggtttcccatttttcttcccttttcccgaatcccagagagaaggtgcagtactcttttcaaaggttttaaacaagagtcttttattgaaagatgttgtgcttcctacaattgtctgtcactagagggagtccatgtggagccgtgggcaatggcttactcacttaacctgtctctcacacccaa

SEQ ID NO: 363 - DNA, 542 bp, Rattus norvegicus
  Genbank Accession No. AA891950
ccaaacggttccaaatactcaactgagaactttatttatacgttattaaaaaggaccggcttcttctgttggacaacagagcccaaaactcctttcccccaagtccactactcacagcttgactgaacatttacccaaggcggatcactgtcactgctattcattcaaaacagacagaaatcctgagtgtgggttctgagaagacagttgtgcctgtcttgatggtgacaatttacatccatggactctgctttgctactgagtttctgaaggccaaggctcaggaggactgccttagcaacaaatggttattcctctagtctgaagacatgaaggtggccgaggctccggagagtgcctttgtgcttatcatccatgatgccaacatgtcccgtgcttccgttaccacgctcagcaggacctcagtggcttggcatagattggctccagcacatgatgagtaagaagcaggaagaggcctccaagaaagacagcactgagaaaagccagcaggacatagcggccgatgaaaaaggcatcca

SEQ ID NO: 364 - DNA, 244 bp, Rattus norvegicus
  Genbank Accession No. AA891962
caggttaaaaccagctttatttggaacaagcaacatacaaatcatttatctgtaaaataatagcatctattctctaactcacaaaagtttcacacaaatcaaaatccttcctaagaaaatgtgacagtaagccaagatattactatttagcctaagctttaactcaagagttgataatgatgatttgagaatttatcttttatacgtcacttgcagaccttaattgtgcacatgaataaactgg

SEQ ID NO: 365 - DNA, 216 bp, Rattus norvegicus
  Genbank Accession No. AA891965
agagatccagtttgacgttttattaggtccagccctctgctacctgagcagtttcctcatcatccccagggatgggcttctatactcccgcccaaagtggttccaatggtttaggtagttaaagagctggtagagcagcaggcgtttgtcgaaccctggagcctttgggatcttctgatggtaggcagtgaagaatgatctggggaaccccccaag

SEQ ID NO: 366 - DNA, 343 bp, Rattus norvegicus
  Genbank Accession No. AA891969
ccatcagcattaatgaatgagaatattttattttaaatggaacatgaagaattaaaatacagcctgaaggtttcaattttgtactgtgaacatcaagacagcaattacccctaagaaaaaaattcacagaaacatgttgaactaactgaacagaaaccagagtgggtatttaagtcattacatttctcatcattgtgaaaacagatgtcctctaacaactccagtctacagacagcacacttcatcataacactacatttaaaacactacaaacgtttacaaagaacatttggatttcacaattgcctatagaatatctttcaatattaaaacaccatgatgc

SEQ ID NO: 367 - DNA, 305 bp, Rattus norvegicus
  Genbank Accession No. AA891978
cagatcctctgaaatggagctatagaccgttgtgagctgctttgtaggtactagaaattgaacccaggtcctctggaagaacagccagccattgctcttaaccaccaagccatctctccaggcccaaattctggtttttgatcatggctgtattactgactccttccaagctaatctcttgtggcagacctgcagcacagcacatatcagccaggtaaggggtctgacttgggttttacagacaagcacaggttagatgagtcatcttacacattacatgtctgtcctgtgagaggttcaagtgt

SEQ ID NO: 368 - DNA, 476 bp, Rattus norvegicus
  Genbank Accession No. AA892010
gctgggaaatgaatataaattaagggtttattacaaaataaaaagtgttaagtttctccttgtcagtgattcaagaaaacaaagccagaagccttttgtggagccgaagccaggacctctgtgtgcaggctggtggtcaaaagccaggctcatgagcgggcagacagacactgattaacgacctctagcaggtgggtattctccagggcagctgccactcgctccttatctgcaagttgtttgttcactaagtgggaaaagaagggtggaaaaacagggttaaaacaactcggccaggctgctagccccagtatagattatatttctaccgatgaggttctcttctgacgtctcaggactccaagcctggatcaggatatatttactgcctgtgccataactagcttcttcactaggaatacctgtcacggccagggactgctcattccgtctctgtccctgtgtacttgagaact

SEQ ID NO: 369 - DNA, 421 bp, Rattus norvegicus
  Genbank Accession No. AA892014
  misc_feature (1)..(421): n = a or c or g or t
ctctgataaatcaggactaagtttacgagtggtggtgacgcagagaggcatggagagggtgggctgaagtgtcaggggtggggcagtagtgtttcctccctgaccccttcgtcctcttctacaacagactgccacagtccagaataggtgattcctctaccgtgtctgttcaactgaagaaagaaacagtcagttacaacaagacacacaatgggaacacacacacacacacacacacacacacacacacacacacaccaagccggcactcactgtangaggaaatgtcgatctcatcgggcagctcactgatgttgacctcgaaacggtcctgcacgtcattcaagatcttggcatcgttctcgtctgacacaaatgtgatggccaagcccttggtgccaaaccggcccgctctggccac

SEQ ID NO: 370 - DNA, 592 bp, Rattus norvegicus
  Genbank Accession No. AA892042
caggcaagagcacaactttattttcacctctaaaagtaaaccacaattgataacaacaaaggagactgtgcagttcaactttttattttaataaaaccagaatatgcagagcacatgcggtgctagcatctaaactaatacaataagcaagtactaaagctacagtgacttgagggtcaatctttacgttcagcaagtttaaacccattcttaactttgaaacataactgaaaacattgcttgctgataagacttgctccaatgctatcgctgaatgtccaagtcactgaatatgccaatacaacaaagataaccacatgtttgaggattgcaatgtgccagacattcactgaaaaaaaatacaactaaacaaaactcacacaacaaacatctgagaatctggacactttgtatcagtgtttttgaagtgtttcattaatatcttaagacaagtgtatcaaaaccttggcatgatttagtttcaagtcgccaattttgtttttactaacatcagaaagttatggctacaccgccaatgccgggtctgcttaatttgacttaagagtttattatggcttaacattaaaagctc

SEQ ID NO: 371 - DNA, 404 bp, Rattus norvegicus
  Genbank Accession No. AA892094
actgtaagaatataaacgttttaagaggatctttgttatcatttatacaaattcacaaacagtacaattaattgataaaggtctctgggtttctccatggtctctcatgttgctgtggaggactctaaaaaaataaacaaacaaaatatccaacaaaaatatacatcctactcaaaagccatttgttttaaagccacagtcccaaccccccaccaaaataaagtcatctattcctccatttagaaacaaaagtttttcaaactcacacgttcctcccatttcatgaacagaacacagataagacatgaagttcagtctcctccctttcacatagcctcgggctctctgcagactctgagctcctagacagggctggaagcctcactgtaaccttctggtgggaa

SEQ ID NO: 372 - DNA, 476 bp, Rattus norvegicus
  Genbank Accession No. AA892120
ccaagttcagcagtcgtttattgtgctccaagagcttccaatcccggttcttgcagcctcccttccaaaggcaagcccgagacagagccaggttcacttggcctgggtcctgtaattcttggcaggtctatagtccttatgggagaaccagttggggtgaagttcaggcagcaggtctgggcatacatctgcccatagtccaagtttgcagtgctctcttcacaagatgaagcgtctacagacagctctaaggcactagagatctacaagagttctggggtcgagttactaaccatcggaaccatgatggggtcctgggtgacccctcaggcccctgctcagaaatgcagtgagctcttgcacctgggctagaaacagcaagtagtgcttgagtgtatgctgcagcgttagcaagccaggaactgtagccactgcaaagagtgacaaggaggttctggggacaatttttttttgag

SEQ ID NO: 373 - DNA, 528 bp, Rattus norvegicus
  Genbank Accession No. AA892127
aatgtaaacaaggaatttattcaactgattaccagacaacgaaatgctaaggagtacaacaggcatttataacttaaataatttatcaccgacttcagtgaagtcaaattcttcaactgtatcagagttcaatatcggaaacaaaaaggataattacaaaatatctgggtcaaggaatcttctccgctgtaaacacttgagaagcttgtttcctggcagctctctcctctggggacaggataccctccactgctactatctggtactgcttatgcttcagatttcccacacatttccggagctgcctgagactaccagcctccatgtcttgctttaacagcttctgcatttctcgagaaggacatccaggatcaaatattagcaaacataatgttcgtttttttctctcttcaatcccaacaactgttcgactgtgaccctgatgctggagatagacaggaggtttggatgtacacacgacctttggcgccccttccgtctctgaggaaatatagttcagtatccact

SEQ ID NO: 374 - DNA, 442 bp, Rattus norvegicus
  Genbank Accession No. AA892137
aatgcacgaacttaaaaccttaaaaagacatccttttttttctttactttataagtcatcacaatagatcagggaccacagtagctttataaatcatgaagatgcatgtgcagtcacaatcccagcttttgtaacacgttttaagaggatagtacacctggtaacacgtctacatttacacacacatttactttgactaccctctggggttgatgaaagctcaatcatagacctcaaattttgcttttgataactagatgtgtataaaccataaagaagaatttacaaagtttttttcaatagccttttagttcaaatcaaagatatcttgtggatgtattttttttcctcattctttaactagattcttgtattggcagtcataatttactctttcaaatcatcttcaaaagcttaacacgagaaagttcttctccaatgt

SEQ ID NO: 375 - DNA, 486 bp, Rattus norvegicus
  Genbank Accession No. AA892149
gaagacatttccagtaagtgtttgaagccttggcttagtacccatccgtcctagtcaccagagttctcgagcacaatcccattgcctgcaatggtatttatcaaaactaaaaatgctagaacactgcctgtgccaacactgcacccagtcgtccatatcaaatactccatcagctggaagaccaaaggcaaatgctgcacacagagtccaaacaacattcttcacagaagaaaacagtgagacaaatttctacaacatgtcacctgccaattcctcaatattattactgcaattatctctaggatagtaaaattaggctccacaacctgtggttgctcgactttttaaaaaaaaacctaagttctaaaaggtataaacaggtatacacagagacttgtttataaacttttgatatttgatatctgtatgtcatgatgacgacatggagacaggacacatggcacgaagtccatagtgggtatgcgc

SEQ ID NO: 376 - DNA, 662 bp, Rattus norvegicus
  Genbank Accession No. AA892238
ggccgccaaacattttttttttttttttttttttttttttttttcaaggaaggtaaggtttattattttggctcacggttccagaggatgcaatctataatggctgaggaggcagcagtggaagtatgggacagaggtaattcatacatcctgactggataagaccagcaggagtatataatcctcacccatcgatatccttaaggtttcacagccttcaaaatagagccttaagttgaaagaccaacagctcaaaacaagcctccaggtacatttcagattcaagcctcaacacacaccttaatatatttcaacgaagctacacattcacaatttaaatacagtttttcatcagggagacagatataattcataagagtgtttagactacaaatcagatacaatttagtcaaaataccataaagagtactttaagtaatcaggaaagagattttaacattattgcttactcttatgaattttaaccaaattgataattctataatcttagtttattttctatagacttaaattatactgcttgccaggtaatgcaagtattgatgcaactttctgaaattaattgaactgcaaacaaattataaacttagccagcacacacattttgactctactgcttcagaagtagtactataaaaagt

SEQ ID NO: 377 - DNA, 630 bp, Rattus norvegicus
  Genbank Accession No. AA892240
gccactttctgacccgactttattaagggatctctttcctctcctctcctatctagtgcttgggggtagatgggggcacaaagaagagggatggagaagggtgggaaaaagaaccccagcaccaggtctcatgcctgcacgccaaaagtttagccatggagtcatctgattccagtggactttgaaggttgttaccccaaaatttcggatcctggtgatcaattctgacctcttctgaagaacatggttggtggagtttgttaccttttgttccactttcggaatgtcctcactgcctgttcattacgtctgtccgtttcagtttgtacttcagcaatgggtcaattgcttcttgctcttctttttctccttcccaggccggagaggcacacttgtcctccagcttcagtgtagcaaagggtctgggattcttgaccggaggcagatcccagatcactgtccttcccagagcctccttcatccactgattccaacatggaaaccaatgtcatttatgttgtcgttggagccgtctctgctgtggccattattggagctgtgattattggagctgtggtggctgctaagaatccaggtaggaaagaggacgtctgggtgccctgtcagaag

SEQ ID NO: 378 - DNA, 644 bp, Rattus norvegicus
  Genbank Accession No. AA892250
aaagagagaaatggtttatttggtaacaaggaataaaaagaaattctttaattcttctctcttgtggtggttggactgcagtgtccagtgggcgggcaccacacaggaacccctccctccctcagaccagatctgctgctcaagcgcaaaggccatagttgcatagtcttctagacagaggggctggcctctgtgctttctggggtctcggtggctgttgcagtttccttcttgtcttcaggcttcatggcaggaaagagaagtacttccttgatattgttggagtctgtgagaaacatggtgactcggtcgatacccatgccccagccagctgttgggggcagcccgtactccagggcagtacagaagttctcatctatgaacatggcctcatcgtcaccagcagccttggccttggcctgttcttcaaacagttgtctctgccgcacggggtcgttcagctcagtgtacgcattgcatatttccttcttcatgacaaacagctcgaagcgctcagttagaccctctttgcaacggtgccatttggccagaggactcatgatctgtgggtgatcacagatgaatgtaaggctgatgcatgtcacttcgaggaactctcccacaagcttatcaaggagcctggc

SEQ ID NO: 379 - DNA, 529 bp, Rattus norvegicus
  Genbank Accession No. AA892273
  misc_feature (1)..(529): n = a or c or g or t
caaacattcaagaacagttcatttctatgtgatgtaaactcttccataaagtaagacaagaggcaacagtcccccgctcagaggtacgcagaccaaaaggaccattcaggaccatcttagaaacctctttagaaatcttactaaaaacaaaggcactcatatacaagaatgttcatagcagcattgtgtataagaacagaaacctgcaaacagcccaaatgttattcagcaggtgagtggctacctaagttgttttgtctgcttggtggagtattatacagatggaaatgaacaagttatagcaatcacaacgtacaggagtcttacaaacaatggttaagtgcaaaaaagcaaacctcaaggaacagagtacaacatttttgtaaagctaaaagtacaagcaatacannataatacattcctaaaggatatatacacacatgggcaatattattataacaagtgattaatgagcataaaattaaagacagtggctacctctaggaagaggctgggcaaggggacaaaa

SEQ ID NO: 380 - DNA, 605 bp, Rattus norvegicus
  Genbank Accession No. AA892280
acacttacgctttattggagtgtaaaatctataccatgtgctccttcacaacgaaggccccttgaagaaccacaccagacacatgtaaagacatgaaacaacgcttagtaggctccggtcccacatgagatgtcatcatgatgtcgggactaagagtataatggggcctggtcagtggctcagtttctgattttgttgagaaatgtaggtttggaggttgtgaaagatgaggatgaactcatgtgcctgagccctggggaggtctgactcacctttgggctctactggcaaatatggcgtccttccccacaaagagggcagagagtttgactaggtgtaggactaagcagacaggaagtttgtgtaagaaatatcagggtgaatgggggcgagggactgtgggatgtgatggctggagggatcttgtgggagatctcttcaaatagtaaatgtatgactattaggaaaaaaagtattgcaaagatataactgttttgctggtggtaatgagtacataccccagtgtttcaacccaacactctgtgtgtggctctatccttctgtccttccttaattagcccaggtcatggtgaaacttttttttt

SEQ ID NO: 381 - DNA, 572 bp, Rattus norvegicus
  Genbank Accession No. AA892284
ggaaattttagtcaaaaatcaagcaactaggaaaaatcaaggcaatttattgtaaatgacagttgatttgaataaggcacattcaacatcatcaatatggaaacaaatgcaaaaaagcagttatggtgacttgaaaagtctgacaagccgttaaatttgtgaatacatcaaggcaggattcttggggctaagaaatccttgatagagaatgtaagcgtgttgctggacatcgttttgctgcatttctctcgtgttcacatctgtctgccatacccagcatctgtgctcacagtgctccggccttaaacgagaatgtgaaccaaaggccttgagacaaagctgtcccctccatcagccagcactgttagggtgggccgacaggaagggcactgatcctcactaccctcccccaagcctccgaacttccagataaaatttgttcaaattagttcagggataagaactctctagaacttctctgatgatctctgagaactacctaaaagaaccctaagaaccctaaattttacctgaaagggaaagcgagactcaagtctaaagacagtttctat

SEQ ID NO: 382 - DNA, 541 bp, Rattus norvegicus
  Genbank Accession No. AA892318
gaacaagatcatttaatagtgaccctctgctgtccacttcggtgcctaggccacccactgcacccaagaggatgctgggccgtaggaaaggccgctggacatcagtctccaaactaccaacagcagttcacagagctgggatggcagtgccctccctcagggaagcaggcctgctcgcatctggaaggccaggccgtcccctcgggtggcttgctgaggaaagaaacaggttggaagcatgagaaactaagtgtagacacaatgagggcagagcataggcagagtggtaccaccaaccttgttgatctctctgtgtcgttctttggttacgatctcctctaaaacctcaccgtctcccttgatgagccttgtacggccggtctctgggtccaccacctttcgaataacgctctgtcgagcgtcccactcctcctttgtcatgggcttcatggcctggatacgagacttctgctcgtctgtcaggactgggccatcattgtcctccccagctgatctgtgccactgatccagagaggggccg

SEQ ID NO: 383 - DNA, 662 bp, Rattus norvegicus
  Genbank Accession No. AA892367
gatgagaccccaccagctgcacaaagtactcctggcatcaggcaccttcctccttggcaatgcgatctttcttgagcggtcccatgaatgctttcttttcctccatggtctggaagcgaccatgtccgaatttggaggtggtgtcaatgaacttcaggtcaatcttctcaagagcccgacgcttggtctggaccagcaaggacttccggagagtaagcactcgcttcttggttcccaccacacagcctttgagcatgatgaagtcattggtcacctcaccataatggacaaagccacccagtgggttgatgctcttgtcagacaggtcgtagtcagtagatgcattgttcttgatcagcttaccatccttgatgaggtagccttgaccaatcttgtaaatcttcttgttgatctctgttcggtgatggtagcctttctgcccagctcgagccacagagaaggctacacgggcaggatgccaagctccaatacaagcaactttgcgcagacctctgtgggtctttcggggcagcttctttgtatgccaacgactggtcacccctttgtagcctttgccctttgtcacgccgatgacgtcaatcatctcatcttggccaaacacctggttcacagggacctgctgctccagcctctctcgggcc

SEQ ID NO: 384 - DNA, 624 bp, Rattus norvegicus
  Genbank Accession No. AA892376
  misc_feature (1)..(624): n = a or c or g or t
gttttccttttggtttaatcaaagactggtgaataaacataaataccgcacaatgaccagatcattcttcatactgtgcacacacagaccaatgaacagtaatcgcaaagaaacttgcagtcagcagtgaaatgcactcagcttttctttcccttgtttaaaaaaaaaaggaaccgaaagccacaaatttagaatctcgtcagcacatattctgctgtgacaaatgattcaaacataaatagtggatgtaaagaaactatatgctaacatatgtataacctttgttaatgaaaaaccaaacaaacagaagcagccgtaatgattaagatacattcagttactgataactagttgtacccagaagggccttatcaaaagggaatcgtgctgcagagaaaagctatatatacatacacaatgagaaataaactgcaagatcaacgcatgcatgtttaatactggaaaaaaatcacagccctccagaatttctccacatttgttataaaagccctctgcactcaactaaaattaaaatgatcttaaaagtataatacttcttttcagccacagaaactgcaatggaaataaatgttcagagtcattttcaaaacanaaacaaaaatc

SEQ ID NO: 385 - DNA, 589 bp, Rattus norvegicus
  Genbank Accession No. AA892378
gcgaagccacggcccaactttatttacactcattgcaaagcatgactgagggtaaaggacaggtaccaggggatggggggctgggggtcatggagactgtgcgggtgcacggtagggttgcaggagaaaaggaaggcggtggtgaggatggacagcccctctttcagtgtcccccaggctcccaggcgtccgggggcacagagcaggtgaggctgccttcaggatttggacttggacacagccagtccaatgagtccagccaggcccgccacacccagggccatgccaccaacaatggccatgcctaccagtccatctttcttcatggccttgtcaatcaggcgttccagctccttggcctggctgttctggggctcagtctgtaacagtccccgcacatacttcagagccttttcatattccttgagccggtagttgcccacggccaggtacaagacataatcccgctgctcctctttgctacctttgggcagcagctcctccagcatcacgatgcctctacggatgtcgtcattgtatttgcttcgaaccaggcaccaggcgtattcaaactgcgtgctcttggaca

SEQ ID NO: 386 - DNA, 649 bp, Rattus norvegicus
  Genbank Accession No. AA892388
agataaacaagaagtttaataataaaaatgagaaaaaaaacaacacagtgagctggcaagaggctggcagacacagtctgacatgagacagcctgactccttatggattcttgtaaagtcacaggattggtccctcactctagagagtctttactctgatagggtaggcttgtcttcctggtatggctgctacaccagttggttctgtactctgtcaccttgtgaggaaagctgcctaaatctgacctttaacctgtggtaaaaacaacaacaacaacaacaaccacgatattccttgagatccatttcctcagtccacacccattcccagcttctgaggttagcagacagatgaaagccagttttctggagaactaagagcttgaggaatgctggaggctccccaccaggagatagccacaactcccagggtctcctgaaagttctgagtcctgcagactcctctctcttgcaaagtgctcaggaacacaaaatgtctggatcctggtgacaagcaggtgccggatcagttaggaggtactgctcctcctccgggggtgaagggctttcctcctggcaatgttctcctccgtgtcactctcgcagttcctcaggtcctcacttgtcctcaagtgcaccttcttcatca

SEQ ID NO: 387 - DNA, 611 bp, Rattus norvegicus
  Genbank Accession No. AA892391
aaaggctaaagcctggtatctggagcccagtgatgccctaccctcaaatgcactcaaatatcctagtccctgggaactaccacctaacttttctctgtgttcctgggggctggcaccccaggtgaagagatggatgttgagggggcaggattagagtcataagaggtagagaagctagtcccctcgggagattgcaggggttcaggggcagaaatgctgggactagaccccagagagccaggtgactcctgtactgggagcatggctgggtggcttttgctacagtgagctaccacactgtctggcttctcgaagcgcttgccacagaattcacaggggaagcgcagggcagctgcagtctctgcatgcttgcgtcggtgccagtttagggaggccttctggcggcaagtaaatccacatatctcacactgcaggggcttctctcccgtgtggatccgtctgtggatgacaaggttgctgctagtgcggaaagatcgggcacagaattcacagatgtagtccctggcatcgctgtgtagtttcacatgctccttcaggtgctttttaaagttgaaggacttcccacaagccggttcagggcagcaaaacga

SEQ ID NO: 388 - DNA, 448 bp, Rattus norvegicus
  Genbank Accession No. AA892414
caataacatctacaaaaaatagttttctctaacaattaggaaacaaatgtgaaaggcaggatggttcacattatagactcaggtagagacttgtacttcatatagatgagaaataccaggtctacaatttgtttaattgactttggattttattacaaaagaaaatacgattgcaattataaatgtcataaaaattgtaactgtattgagaagttacaccaaagtatcaaatattatataaatggacaataaatttaaattttaatttaagcttaacatagtaaacactggaagacaccttacccctacaatgccaaatatcttaaaggaatacaagaaaagctacagtacagaaacaatgaatgtgcaaaaaatatgattagagaccacagagctggggtttacactctaactacatacagttaaaaatttaaaataatctttacat

SEQ ID NO: 389 - DNA, 482 bp, Rattus norvegicus
  Genbank Accession No. AA892417
  misc_feature (1)..(482): n = a or c or g or t
ccattaaaaaaccaaaaacatcactttattatgaatccaagaacactgtataaaaaacctccagtcgtagaaatgaacagacagcacgtttatatacagacactgtacatgtgggccctgccctttaagctaaactccacagactatacacatgggcactgcccttacagctatactccaaaaccaggctgctatagtcctcctgctggcacagcttcagggaatgctgccccagggaaggggaggatgcagtcagtgccgggctacaaaactctctggcagcccagcaggtggaaatcttgcagagatgctgggtcagcccaagctgtctctcttgtacctggcttccccgcaggaagctgtctcaagcttttcctttggtcagttcatctgcaaattatggcttccttggggaaggacatttttnacaagttcagtgtccaactgcatggnctcaggctctttcagcgcatctcccagtg

SEQ ID NO: 390 - DNA, 470 bp, Rattus norvegicus
  Genbank Accession No. AA892470
aaaacacaagggagagacctggccagtcaacacatgactgaccacagggaaaggagtttatcaaacttcgagagtctaaaaacatacaaatgtgtcttctgtctacagcaattgtctatgctttcccacacaccgactggtaccctctgcccagtcacacacagtgaggacagcaggtcagtgactcacgtcctaagcagttttctgctgccccttctttccgatcagagacttgtggatgtgcggaatcacaccgcccccggctatggtagccttgatcagtgaatccaactcttcgtcacctcggattgcaagctgtaagtgacgtggggtgatgcgctttactttgagatctttagaagcattacctgccaactccaacacctcagctgtgaggtactccagaattgcagcactgtacacagcagcagtggcgcccacccgtccatggcttgtggtgcgagtcttca

SEQ ID NO: 391 - DNA, 540 bp, Rattus norvegicus
  Genbank Accession No. AA892485
gtcaaatgacaaccttttatttttctttcaagagaacaaaagagcattagcaaagaatgagtcatttttcaaatatttcacatttgatcagatttggctcatgctaatgatgtgcccctgtgataagcatgttctttctgtggttttcagtactagaatatctccgtgctgaagcggcaggccactgaatgggcctgtctgtacagaaacatggccattggaggtttgcgaactatttggagtgtcacttgtgcaccacatgataacgaacatttagaaacagattcaacaccaatgaaacacttcaaatttcagggagtggcccccccatattacacacaaggtgaaggctatttaaagtcacaaataatcccaaacatttatgaaaacatatcaacaggaagtctgctcccaatttatttttaccatcctgcatgtcagccctacgtccctctaacacaaaggtcaaacatgataaaacgaaagagcgttcaggacaggaatgagacacctatctaaggtttctgtccactgggggtc

SEQ ID NO: 392 - DNA, 555 bp, Rattus norvegicus
  Genbank Accession No. AA892486
aaaattaagtacacttcacagtaagtttctcaagtctcagtggctgtgcagcctgatgttggtgcagacacgacgtccccacgccgagctccacattctctagtgggaggcgagggacagacagctggggtagggcaggcgaggcaagcctcactctcctcctaaccacacagagcttcaggggcgcatgcagcaacacaatgggaaagctcaaaggtgtgtcaggagagcaggacgcaggtcctcacaggagccaccagccagagcgagctcaaactcgcatggcctctaggggggcctctgtaaagtctcctaggaccaatcgatttgaaaccgctctcccatcagcagtgagacagggatggacaggctcttgtcgtccgggctgtaggtgaaattggagacagagatgccattggaaaggacctgggtgggagctgtggtcactcccaagatggtcacctccctcagttgcagttcacctccctccttggtcacgtgcactaacttgtttacaatggtattattcttggctgagaaggtgaccagtgtgta

SEQ ID NO: 393 - DNA, 617 bp, Rattus norvegicus
  Genbank Accession No. AA892498
gaggactgatacagagtttattgaattaaatttttctatttacaattgagatcacatctacatactattttgctagtctccatgggtacattatctctaacgagtgtaagacttatgatgaatgggttcaatcacacagaaacgcacacacactaactgctttaaaacagtgcatacattatagtcttcctataaagccagctttgattaaaaaccactagtttcaaagatcagtctctgattctgaagatgaacaaggacacatactgtttgattctaaaatctatgttagccattttgtacaattgctatgttattgtactacagtatatattctttaaaaggacactggtgagcggcaccagacagctggcgtcctccctcttacccccaaacctttggccaagagttctcattatgaggacaaaaagggcccagtgataccacaacacagtcccattactcctcagaggtgaagaagcaggctacaccctcctttagctctaccatactacaaaacttgtaaatggttctgagattaagggcatggagaaccatctagaacaagggtaagaaagccatagatgggtaggtaagaaagtgggtacatgaaatgc

SEQ ID NO: 394 - DNA, 443 bp, Rattus norvegicus
  Genbank Accession No. AA892504
gacagtctatacagtttatacacagagctgagagcccatactgggctcacatcccctacaaatagagttctctctacaaaacagagataatttagctccccatagcagccagtagggggagggaggacagatagggaaaagctgagttcctgtcatccctggggcacaggatggaggtgggggtgggggcagagggctggtggggaggacccgaaggtaccgtcagtactaacggtaagggctactgtgggcactagagtgggcttctgaggtcagtgtttgtgagggtacactagtgtctttggtagggctgaaggcaccaccggtggggacaggctgaacaggaggtcttataaatagaaggtggggagggaaggggtaaagtgggtcctaggagcccaggagcccgatgtagaagacatagagcaacagcatggagacca

SEQ ID NO: 395 - DNA, 541 bp, Rattus norvegicus
  Genbank Accession No. AA892507
cacagtaactcatgaggtggataacagagggagggagctgccctggatgacctgcagccttccctccaaaggaaccttctgacaccactccaaagaatcaaggaaaggttcctgtggtgtgtctgctctctgctgagctgcactgacactctggcctttgtcagcagggtggggtgacttcagtccatagtcatcctcctgcttgtctttatggtcgagtttattcttttctgtcgtagcctttctcggttcatcttctcaatcctgagtctctgaagctgagcatcttctttggatggctccttgggcacctggctggccttggcaatcatgtctcgaattttctgtaggcattctgccagattgcggaactggtatcggctgctctcggaggtaagtaccagctctcctgccttgttgatcgtgagggcaatcttctggcgtacaggctccgcaatccagtctgcactggccaagtgaaaccttacttcggccttggaattcactttgttaacgttctgccctccaggaccgctgctcc

SEQ ID NO: 396 - DNA, 547 bp, Rattus norvegicus
  Genbank Accession No. AA892520
gacacagacacaaaggcagctgtggtaatggggtgggggacacaaaagcaaaaatcacacttcctacatggaggcctcaattagacaagagagaggctgggtccctcccctcacactccttctgacagtggctggagtaacagctctctctaatccaagctcagaagcagcaggtgacccccacctagcctcaaaggtccccactttggctccagaagcccctgtccttttaaccagcccagtaattcccctacccgagctccttctcccccaccagtgtaaacagagtttggggctgaacaacagagctctgggaaggcaggagcctcctagatagcaaagggaatgtgcttggagtttcacttcggtcccagaatgagacccagcagtgtctcccagaactcgggctgatccagtatactgcctcttcattctccaccactgacagagataggccaggccccagaccacagtaaaaacaattgatccccagaggttagagctactccctacccccgacccctggcacatacacagatttttggca

SEQ ID NO: 397 - DNA, 560 bp, Rattus norvegicus
  Genbank Accession No. AA892522
aaatgaaacaaggtttatgccacacagtccaacaatgtataaagagcttgaagtagaaaagcttgtggaaaatgtatactctttacatggtacatacagttttatagctcataaataaacacagagaacaggagccattgttcacattaccgaccagcaacacagagcagcagtaacaacacaaacacaatttccttcgactcagccacaaaaacttgaaatggtctcaccatacttgaggaaaatgacaggtggtgaagtgttacagccacacccacatcaccaagtgctttaagttgtctctgggttagaaatatcaacaaccgtattaactccagagagaagaaggcagggtaagaccctgtcctataaggcacttaataaattgacactacccttgtcttaaaatactgcaaatttgccttgaaatatgctgatgttttacggcgaaatttaggtttcttttatccaggtttagacatagacataatttgaataaattgataatactgtctgatggccactctttacaccagcttcaaaatggacccatttaaact

SEQ ID NO: 398 - DNA, 605 bp, Rattus norvegicus
  Genbank Accession No. AA892545
aagaagaagaggttcttaagtttattgcttgactgggccaggtcgttgggttttgtggtcaccgggctttgtctcccttctgggacaatggtttcttccagaggaccaataggacaagcaagttcaccatgagttgcacatggcccaagatggagacaccatagctccggtacagcaggccacccagggtgggtcctacagtacgggtcaatggatgcacagatgcacagaggcccaacatggtccctgtgtctgaagcagatacagccttggtcagcatgctgtctgtgactatgttgagagcacagagactgaatacgagtccaggcaacaaaaggcagaagtggaacacattggacatcagtgccatgcccaggcccacaacagcaaagactagtacactggatctcagcagggcttcctctggaaaacgggtgcttagtctcccaataaccaggccttggatcatcatctggaggatcccaaagaaggacatgaggtagccagcctgtgcagcctccagctggaagaagtccatggagatgatggagaacatcaccatgaagagtcctgaagggaagccagagattaccttgaccaggaat

SEQ ID NO: 399 - DNA, 584 bp, Rattus norvegicus
  Genbank Accession No. AA892547
ggaaaaaataattaaaattttcccaataaaggggagaattaacactaaaagaccatacataccctggttacaagttgatgatctcatttttcataatatggaagtgttcaatgttccagaatatgaactagcatttgcaattttgaaaccccaagtcctgtctctgtaaacccataaatgatgaaataaatacctagaaacaagaatcgtctagaagctgcggtccatgatagagcaatccgttgcggacagacagtgctgcaattgtcacagtgtcacctgctagtccccactgagcttcctcatgatatggctgtctgctgttgcattagtgaagatacttcccacaaccacatgagtaccccagagaccatgacggatcactttacagcagccaaggtcatcaacagagaatcctaaatgccggtaccgttcatctgtttcaaaaagtgtgttgtttgtatatggtccaaaaaatgccaaaccagacgacgggtcaatgaagtcagcccagtatccttcagcccgaagagcatagcaaatttccttagcaccattaatgaacttctccaagagcgcctctc

SEQ ID NO: 400 - DNA, 549 bp, Rattus norvegicus
  Genbank Accession No. AA892554
caacgtttgcagctgtgtggctttgcagcacagcaattcataaaccacactgtacagaatcaccagcaagactggaatgatgttatagaaggcaccatcatgcttattacattaccagagaacaaaatacaggaaagacagtttctactgtacacagtttaaagaaaggaaaggggaggagtgtgttgagcagccatccatccctgtactcaagagggcaggtagaaaactgacaaaacggagctactaaacctggtctagtatttaagaccacagcttttgaagttctcgtttttgttatttcgttcatagctaaaggacttccttctggaatatttgcagtcttgttaaggtttgtgtgcacacgctggtcacagcaagcagatagaatgccctcatcatttcacaaactattctctactggaaaagaagatcaactttttatttccctgttgcctcctggtgcagatttcaatgttaatgacttcagagtacccgacagtgcattctgatgaatacgtaacaagtttccgtttgtgttgggggttg

SEQ ID NO: 401 - DNA, 647 bp, Rattus norvegicus
  Genbank Accession No. AA892557
ggaattaagaggatttattttaaaagattataaaagttgatattaagagtgataaaaaaagacccacaggctttaaatcaacaaatacaaaagtgatctgatataagcaatgtaaaaatacatttttcctgtcccacataaagcataatttaaagtataattataaaagtcttgtgctgtaagtatatttcccttctaagtcttaaaaaccattctaaacaatttgtataaattacaggaactcaaatctgccacagctactagaaaagacattgtccctactgtgctgacagtctctggttccagtgcttctgcagggtgtttgttgccacagtctttaatatcatctctctccatcgaatccagaagtcaaccagccacaggttcccccaaaagagaaagttctaagagtggccacagacacaagtgaccaaattatcttcctaaaaggaaagcctgaagtggcccggcagagtcccccgctgtgggacactaacacagcaggccagagtgactgtcaatcacgaacaagccacacacgggcagagaggcgcctaccacagagtacaatgtccctaagcacctgcgagttagaagctaggtctcaggatggcactattgcaggcagacacctttaaaggtgggga

SEQ ID NO: 402 - DNA, 443 bp, Rattus norvegicus
  Genbank Accession No. AA892572
acactttaaaaaagatttaatgataaatacatattggtagaaatggttaaattcttgaatgaagaaacatctgaggactttctgcatcatggctcccagcccttccctccaggctgatggggcaactggaggcccaccaaaccagcagactcctccactgagcgctcacccttgccatgaaattcctgatgaagggctacatgttgccggatactacgcaagaggcagagataggtggcagcttggaagtgaagctcgtgttgggctctgcacaacttctcactggtgacccgatgtgctcggaaagccttaaccaggtaccggtaggctgctgtgtcgcggtatggtcgcccggtggccgcgttcaggtagcgcagctcccgcagaaggcctcgcagagtgcgcgccggcgaaccccaagccgccattttcctgtccttggc

SEQ ID NO: 403 - DNA, 424 bp, Rattus norvegicus
  Genbank Accession No. AA892578
gaatgctaaggaaagttttaattgtgcatatgtattacataatatttcgggtacaaatggcaggccatcaacgtcgccatcgaaacatgtgggatgggaatatttttcttaaagtttggaaaagatgctacaaggggtccataaatctgccttcttatgcatctacgtgggaattcacatgtgctatgatgtgggcttgttttatcagtcttctgtattcatctaacaagtcggccttgaactccctatgtagacaaggatggtcttgaactcctcattctactgccttcacccccgagtgctagaattacagacaccatgtccagccactcatgcaaacaaaaatatgtagattggataatttccttccccttcagtcaatgctgctggagttgtgggggggccgggggaagaacacccgatg

SEQ ID NO: 404 - DNA, 512 bp, Rattus norvegicus
  Genbank Accession No. AA892582
  misc_feature (1)..(512): n = a or c or g or t
attagccaaagcacatactttattagctcctgaactctagttctccttctcctgtacagttttggttccacgtagccgtccagtccggcgagcagcaatgagacccactttgcgcccagctggggcatctcttcggatagtggaaggcttgccaatgtgctggtggttaccaccgccaaagggatgctccacaggattcatggcaacaccccgcacacgtggccagcagttcctctttgccttgtacttatggtaggcacggccagcctttaagataggcttgtcaattctgcccccgccagccacgacaccaacaacagctcggttagcagaggaaatgaccttcttggaccctgaaggcagcttcactcgggtcttcttggtctctgggttgtgggagatgactgtagcatagttcccggaggctcgtgccagcttgcccctgtcnccaggcttctcctccagacaacacacgatagtaccctcaggcatggtgcccacgggcaaaacat

SEQ ID NO: 405 - DNA, 658 bp, Rattus norvegicus
  Genbank Accession No. AA892598
acaaacactttttattttgtttttaatttagaacatgatacatattcacaagatttacactttatatcataccaaagcaatctagaaacactgtacagagcacacttgaacatttagaaggctatatataatctgtggtaaagtcataggcatcgtcttcttcactcattttatccaagataaaggatctgtcagatggtttacttgctgttgattgcccaggtgacatctccctggtctcttctacaggagtcacatctgagatctctgcatttttttcaccagtaacatgttcttgatcatcaccatcctgttggtcttctgtctgttttggtgactcttcggggatgtccttttcttctagtattccatttgtcaggcccgaagaccggaaaaggattttattagttaaatgagggcccttgaggacttgtatgctgtgtgcattattcttttctagttcttctagattaaagcccctcttcatgattgctgtaatattctcattaaaatgaggagaatgattccaggatgcagggggatggcagtagtaacctaatgaggcacctgtccactcagaccatagcagcttagcagcactttcgacatttgggcttccacctttttggtgcagacctcttctctgagcaagtttagt

SEQ ID NO: 406 - DNA, 393 bp, Rattus norvegicus
  Genbank Accession No. AA892607
ccaaaaataatttatttttacgtgtgtgtgtgtgtgcccatgcatgcaccatggcatgtatggaggagctggctctctccttacaccatgtgggtcccccggatcacacttaagttgcaagatgcccactgagccatctctctggctcctcaaatgcccttttttttcttttttaaacaaaacagcaaaaacaaacaaacaaacaaaccaacagttatcctgaaacagagccagatgctgcccgtccagcagccgtggcaggtcctgtttgctgccatcacaaaggaggaaaggaacagctggaaatgtgcatggtgaaaaatatgtaaaagtctgtgccagccgaagagcataagagagtaaggatgatgaggcttggctggaataatctag

SEQ ID NO: 407 - DNA, 506 bp, Rattus norvegicus
  Genbank Accession No. AA892642
catggccaaacaaaagtatttattagggtttttttcttataaacattttcttctaaagaaaaaaaacctaaaatttaaatacctcacattctgccacatgagactgtatacattatttacatctgtcaaataaaacatattacagattttctgacattcagtatttcctttaaaataataacagagaaacaactttgatcagtaactacaatttgcataatcttggcacaatttacaatatggcgcctacgttgcatttcatagtttagatcgtttttgtcccatctaactatcttactagagaacctgtcccatcacgagaacagacatgtgtctccgtgcatagcttaagcaattgcacaatgcgaatcctccttctgcttccattacctggcactggcagcagttctgatttttgtcttcagaaatgatttctattctgtgttccttatatgctatcttcacaacattatttctaccaataattttaagtaataacttaaatg

SEQ ID NO: 408 - DNA, 421 bp, Rattus norvegicus
  Genbank Accession No. AA892647
catgctcgcccttttaataggaaaaggtgggctggccctgtaaaagggcctttggttttgtgagatcagacgacagacgagagtcccttaaccgccaaagccgtagagggtgcggccctgccgtttgagcgcgtagaccacatccatggcagtgacggtcttgcgcttggcgtgctccgtgtaggtgaccgcgtcgcggatcacgttctccaggaacaccttcagcacaccgcgggtctcctcgtagatgagaccggagatgcgcttcactcctccgcgccgggccaggcggcggatggcgggcttagtgatgccctggatgttgtcgcgcagaactttgcgatgacgcttagcgccgcctttgcccaggcccttaccgcctttaccacgtccagacatctctacaaagctggagagcagc

SEQ ID NO: 409 - DNA, 606 bp, Rattus norvegicus
  Genbank Accession No. AA892773
aatgaccagcaaacaatttattggttaaattatcaatcgtggagttccttgataacattatataacaaatggattaattcaccagaaactggcttgaagatactgattttaattactttaacaaaatttggtttgtgtagcaagctcctactgtcactgctagacagtgaatgcagcggctatccaaagccagtcattccttgaccacgggggtctctcagagcacaggtgaataccagttacggttgtgtttgctgacctagcacctagttccagccttaggactcagaagcagctggacagaagatatggggggaggggagatgctggaaacgaacagctaactcgacttcgggccggtgttagatctgaggcaactcgcaggctctgagaccaaagaggaacacagctttggatgtggctgtgaagaaggcaggccccgggaccgaattggtgggtccagaatacagtgccaggtgggcatcaggaactacggggcttcttcttggcttccaggtcctttttaatctcctcaagttttttagccaggtttggcatgtcgtaattctggggccaaatacattccaaccacgttgcccaaagtaa

SEQ ID NO: 410 - DNA, 711 bp, Rattus norvegicus
  Genbank Accession No. AA892775
caaactttttttttatttttttttttttttttgcgttgaaaatcatttaatgagaattatactttttctctatcagattagatctgttctagtgattattgtctggtgttacaagctcatctgtctcagagttggttagtgtgcatgaagctacttaagaaagatatggacaagcacagctcactggtccccctgagcacctcacaagactgggaacatcctctcaagggttaaaacagacgggcatacgggctgagaatttattttgaaggcaggataaacaggccagctctaagaagatactgttttgaaagctcacacgtttcataagtttctgagttcaggcagtctcagttctcatccactgagtcctgggccctcaaaagccctccaggtccaccacagaggctgttctaactgggtgctgagcctatacaaagccctggcactcacacaactgccattccccaagatcaactcgtctcctgtaaatatgtgctgtttgtatccggcacagggctgatgaagatggatcccgatggagcctactgtgcattacttcctgatgtgcagagatgtgtgtggtgagactgtgcgggatgctgggagcagtgtgcagtgcgttgggagactgagaagtgaaagccctgttggtttgaggggaaagcaaggaaatgtgacctttcccatagctactcccacagtgagaaa

SEQ ID NO: 411 - DNA, 635 bp, Rattus norvegicus
  Genbank Accession No. AA892791
gggcatggaaatgctttattgtgtgacacggagcctcggtggcagggggtcatcggggcactttgaggaagggttcatgtagtacttcaaaaagcctgcgggccttctgggggcccaggcctgggcacaaggctagatcctcccgtgatgcggtgatgagctgttccagggatccaaatgtagtgaggagggtctggctgtcagtcttgttcacagatttcacggtggtcagacactcagtggcccgtgataggaagttctgttccagcttttccataaggaggtcagcaggcttctgctcatacgccttgtaggtttccaggtaccgccctgcttcctctgcactccaggccaggaccagggtgcagtcagccaagatgcaaatcttagccagctccttaagagcctgctggggatctttcacatccacctggaccagcagcacacgcagggcgaagttcttccccaggctctgcagccgttcatggatgtagtctggatgcaggttgtggtagcggaggctgaggaaaagggcgcaggtgctctggcgcagcacataatcaggagtcacctcaccgaattcccaaggcacactgcgaacaaacttcaacacggggttgcccctctgccgcggg

SEQ ID NO: 412 - DNA, 626 bp, Rattus norvegicus
  Genbank Accession No. AA892828
actcataggtaggaatcccctttattccttatcaaaacagtttaacagcaaatgtagataatatatgttttatttagacatataagttatcttccatgggggcattctatcttgccccttctaatgaaagagggcaaatttttatattaatcttattcaaagactagaccaacttaacagtaacagacaaagagagcagagcatctagggtagggagtagaaaaattctactcataagcacatttaaacttcttaccagtacagagacacctgctgccacatcagcattactcctgactagtaagtctcccagtacacgtcaggggaagtcccaacacgtattttaaataaatttcactgacttgacattcaacgtctagattagatattcaaagtcttctttattgcaaatatgatgtctttgacctgaggtatggagttgtcttctagaatctttgcgtaaggcatagggacatcagcaccagtgactcgaacagcaggcgcatcaaggaagttgaatgcagggccttccataattctcgcacaaatctcagctcctactccaaattgtggccagcctccttccacagttacgagatgatttgtcttcatgacactggcttcta

SEQ ID NO: 413 - DNA, 544 bp, Rattus norvegicus
  Genbank Accession No. AA892842
cacaatgtcatatatttgcaatgctttcaaagcccaacagtgattttaaaaagaaattaaacaacatgccctcattgactttttaaaaatctatacaattcaagctaatgaaatagtttattatacatagtaaacgtggcgtttaaaaaaaaattccaggcccagatgtctgcaggagtatgtgagaaatggattccacgcgagcataagcagaaaaactactgaatgagaccacaagtccaccaactcctttatagtaaatgccgacgttcaccgaggctcgaattcctgtggtgtcaggagatatatttaacgtattacacacatgcttacgatgcataggaaaatggaaaacaaaagatgcagttgcataccatgtggactcccaaattttctaatttacaacttgttaagaatgacaatatacagagaaagtattttaaaatagtgtatgattcactgatgattttttttttactcaaataaataccaaattttgccattttaatgtcacagtatcattcagttttcaatccaaggggag

SEQ ID NO: 414 - DNA, 600 bp, Rattus norvegicus
  Genbank Accession No. AA892843
ggacagcagcagcacccaaggcttctttattggtgttttagaaagaaagggtggacttcagggtgaagcagtactcttaaggctcaataccaatagattttcttgaatcttcgagtctcctggatccccatggcctccatcacatcttcttctaatgtctttagccggggcacgtaagttctttctaaagcatcttccactgatgtgtccttggggccatcagtccatgtttcagggacaatgccatctgctctaggaaattcaggtttggggataattctcccagatcttgtagagacacgaacacgctctcctgcctcagtaaatctccactggatctcagtaggtttcctgtccacaggatccactagcttgacttggtgatgaagcaagggggcttcgctagggatcatggtccctcggtgatccttggttctgccaatgtagcggtaatgcgtgttcaatccctccaggacaacccagttccgctgccgaacaacttggactactttgccctgcttcccagcatccttgccttctaagatttccaccatgtctccaaaagaataggtgccagtcttcatcagagatggggtctac

SEQ ID NO: 415 - DNA, 644 bp, Rattus norvegicus
  Genbank Accession No. AA892851
caaagagaaaaattttattgatataaaatgcacttataaaatgtccacagaagacatgtcatttttcactgctatataaatttattgggaatgttattcacatctattgtcacctaaaacatactgtaaacaatgggttattccctaagacaaatgcatacgtgattctcagcaatcattggtttgattattagtaggttacaaggtcacatctctgtggaatgtcagtgaccgctgtagtgtgacaggcttcagcgcatcattgcacacactgcttcagaacagtccccaccgggtctggacccaggacgcaaagcaccccctctgcttgaaacggcagctctggaaggtctgcgtcacagctccaggtctctcgctgcagcactctatgggcacgtgtgatgacgtgtacacacgcacgactaaaaagtttacctctcgtaaacaagagcaacattaccgtcaactctcctgcatatttaagtagtaaagtctacgtatttgtaaacaaacaaaacacacaaatctatttttaaaaacttccatcagctcgtaattcctctgtgatctaagtgagtccacactgaatttctgaaaggcgcatgtattaccttaggtaataaagctctgcaaggggtgcttca

SEQ ID NO: 416 - DNA, 486 bp, Rattus norvegicus
  Genbank Accession No. AA892859
ttaataatttatcaggcaggggaccctcagaagggtcaatgggaaaatagaagactctagggacctcctgggagggctgttggggccagcacattctgtcccaggcacatagacacactcaggagatgagaatgacaacccaggtggcccaacaaggcacagtggcagagaaggtttggcagactgattgagtgtcaggggtcaacgaaggacaccatgatgtatcgagttcccctggtggtgggcagcccctcgtggtagtgtgtgaggcgaccagggtgcaggagagcccagcccttcctcggggatgagactctgcagtcgtacctcaggaagcggcagccacctccctcataatctacacccttgtgattgagggcaacgttgagcgtgaaggtggacgagtcatggtgtggccgaagtgagggctgctcatctggccggtagcggaccacaaagttcatcactgcccgtgtcttggtgtgg

SEQ ID NO: 417 - DNA, 436 bp, Rattus norvegicus
  Genbank Accession No. AA892860
ccatataataatttaatatatgccagccaaacaaagtagtttatctttattcaattaaataaaaacagacctgtcaggtatattatataacattcactatatacacatgatttaggcgatgcaaggtaattctaggtatgctaactgttcaactattagtgaaacacagaaggtgtcaggagcccagcgtgttcctgctcacattgggtgcctgcgtttctgtggacagttagagggacagccacaagccaggacagatattaccagtaaacgtctgagggacagaggggctggggatgagtctagcagagattaacagtctcctaagtgtggatagcatacttgacagttacgctttaacaagttcctcttcgatcatgttcatgacgtcaaagtttttgtttgaaggcaacaccaccacattttacctcgtgcc

SEQ ID NO: 418 - DNA, 593 bp, Rattus norvegicus
  Genbank Accession No. AA892863
gcattttcctagatcatttttacttgaccttttttttgggacaaaagagtaggtaatgcaaaacatgttttatattaaaacagatgcagatagtattgaatagaatataaaatttacattacttttgagacaaagtacttttgacatcaaagacatttcaaactaagctacttatgagcttctgggtgcatccctccctaaccctgagcagaagaccctgctcgctcacactacctaacatcatggcctctgctgcattgacagaagtctaaaagcagcaaagtcagtgcttactcatttggcaaagtaccagtgaatttacttaaacaattgacaccttagggctttctcatcttacgagcattttaacctgacgttaaaaggcctgagtgaatagaatctcaatgcctgagttgagaattttcattgtaaagtgaattttcctccagtaagtgtttttaacaagcctcactgagggtctgacatgcgagctggacaatatcctaggaacctggtcaccagataaggaggtacagatacacttttcaagggcatcatcacaaatgagaacaaactactcaccttctgcagta

SEQ ID NO: 419 - DNA, 541 bp, Rattus norvegicus
  Genbank Accession No. AA892916
caaaattaagaccagtgtataaacatacttgccaagaaataagcaacttggagcttattacattagcacaaacattacatcaacagttcgctaatcacatctgtgggtctaaaggaatcaggccgtaaaagggcatctctaaaacacccctgggcaggtccaaactcgctgggtcacccaattacagtggagaaggcagtcacagaaagaaacccaatgaaatcctcctggccactaaatgggagtcttgaaaaccctctggcatgaagagacttgtagagagtgggagaacacccctttactatggaggaaaaccaggagtccaggtattctcacacatctgacatggcccctgagaacaagtttcagcttgcataatccctgcatcaacacatgcattaccactaaaaggagtcccgttgggtcctacccggatgcccaggggtctcccacaggtaggttcatcatctcgggttttgcaagggcccgaaccaaaccgggcgatggtctctatttctccattctccagttttacaactcg

SEQ ID NO: 420 - DNA, 574 bp, Rattus norvegicus
  Genbank Accession No. AA892919
ccggccgccaaacattttttttttctttttttttttttttttttttttttgaaatgcaatagctcgcttttaataacaacatacaaaatctagggaaaaccccaagtagtgcccactcccagagaccaaggaatggaaccagatgggagccatgctcccgtgcctgctctccagccccgaggggctgaactctacatccacagctgagttctctggatctggggcactaaccccaacagcaacaggaggcccagcttccagtttattccagttgggtagaggaggcctcagctagagcacactgccagggtgaggcttgggctgatgacccacatggccacttgcacccaccaaggacaatgcagactcatgagcagcctggtctcctctctgcctaggaagccaggctgaagacaagcccagcatgctgatcaaagcacggggcaaaggggacagcaccagcctcgctctaagctctggctcagggtggttctgcctacaaccttcccagaaggattccaccccggtccccatcagacatccctcagcagaagtaccctcccactttccttca

SEQ ID NO: 421 - DNA, 476 bp, Rattus norvegicus
  Genbank Accession No. AA892940
  misc_feature (1)..(476): n = a or c or g or t
acaaactgtggctaaggttgaacttgcaaaaaataaaatcttgaagaaaggccccttagggttaaacattttcatcttgttctcgttcttctctgggcccaagctcctctctgttccttgggaatggggccaggcagaggccacataaggaaccaggaggccttcctcattgggatggaggtttccgggttgttcagatggccccataccagttcccagatgctcagagcatgaaggcccagtcacacaggtccagcttgagtctagagctgcgtgctcacatgggataattgagccatctccactgtcttgactcaggccacaccctggactcaaccttgctttaggaacattatctgagaggtgttgatggaacaaatccctcncctcagcactttctcaggaggaaaacatggcctcctgcaagtcctgngaagtgctcaacaatgggtgtcatggaacttcagaagggccta

SEQ ID NO: 422 - DNA, 511 bp, Rattus norvegicus
  Genbank Accession No. AA892942
acactctaataaagaccctgatttaataaagaagacatttaaaatgtgccaacaatagacaaatgtatttacaacataatctaaagattccaacaaaattttcagtagctacaaaagaattcagctgcctataatagttcacatttggtttagtctatagtatatcactgtcttaggaaataaccttaatacaaatgtaatttataatatcccctttataacaagaaaaaaataaattcatacagtattttataggcatttattatgccaagtacttaagcaattactctcattattacataagaataatattcttattaaaaggtaatctttccagagtgatctatggccacaaaagacacagcaacagcggcctgtccatccaccacagctacaaagatccatttatatcaaacagctcgagtgaaatgacttactactaagaaaaaacaaaattttagaaatcagttaacactagtacccagtttagcttttacgtgcttatacaagt

SEQ ID NO: 423 - DNA, 379 bp, Rattus norvegicus
  Genbank Accession No. AA893022
ccgtgggctagacatttatgtcgaactcaagttttattatcacagataatgtttgtttacatgtggaaaactgtgcggagtgcttccccttggctagcactgcccccaggcatgttcatgggtattagacgctaatcctcacagcctccctgtgaggtaagacttggctggctaggtagatgactgcctcagagccatgccatatttcctttggctagaggcctgctggcgggtgatgtgctgttaagaactctcattggccagcagtgcctgttcgttgcccttggattcaaatcatccaagtcttaggctcgtcctctgagggagcgaagggaagagaagcattggctctctgcccttgaagcaccacttgagtttg

SEQ ID NO: 424 - DNA, 465 bp, Rattus norvegicus
  Genbank Accession No. AA893043
  misc_feature (1)..(465): n = a or c or g or t
ggtcagtgggtcagcaggccggaagggtacacccagaatttgttcctcgtttgagactcaagaaaaattgctcaggaaacatgatttcatttgtatttcttcctgaaggaaggaaatttgtaaaaatctgtaatcgtgaaacagattttttttttttaatagcaagagataatagctgattccttttcatagctgggattttactctgagagaattcggactttaattttggttattcagacagggtctcacaaggtccaagctggtctgaaactctgtaagtaggccagattggcctaggacttactgtaattctcctgcctctgctccctgagtgctaaactaccacacccggcctcaaaagatcctgttttcctgnaaggccggaggctaaggagcgtttggtgagcaaagacggcgccgcttctgtgagtccaaccctcctgagtttccattgcatgatta

SEQ ID NO: 425 - DNA, 281 bp, Rattus norvegicus
  Genbank Accession No. AA893105
actctctctccccgtccccctcttcaaaggcaaaaaccatctttagaaatttcagtgagcaaaaagcactaagaaataatataaaagatagagtctcaacgcgatgactctacgaactcagagtctagacgagtgtttgagacgtaaacaagtgatccagatggatgctttcaggtgcctcgggaagcaagcgacatcatgcaaggttaatatagttaaggtgagaaaccacggtttagcatccgaatggtgctctgaggatggcgtgctcacctctacat

SEQ ID NO: 426 - DNA, 582 bp, Rattus norvegicus
  Genbank Accession No. AA893164
aaacaaatggacacacatttatttataaatctgtttatttataaaagtaaatggataagatgttatctgtcattaaataaataattttcatatgcgctttgcagatccacagactggtcctccaacctgtactgcggttacagctgatggactttggcttgtccccatggaagagttaaccttttccttccatacacagccacatgccctcagcagagccaaggtagaagggtactgagctgacacacagtaagaaccaacatgtgagactgactgtctcctcaaggggtgcttgaagggagaaggcattggagaggctcagcacggtgattccaggtgatggaaggagccacagttgtccctggcccttcatggagggttatcagcaccttgggtagctgggtaagagacaaccttctctcctggaaaggagttagacgaaagtgaaccctctccttgttggagagagctcaaaagggccaggagctctgtctcagaggctgcaagagcaagatgtaacctttctaaggtcaattccctgagcatcgtgaatcagacttacttcttggagaaggcttgcca

SEQ ID NO: 427 - DNA, 414 bp, Rattus norvegicus
  Genbank Accession No. AA893194
cacaagtctagaggatatgtggagaggttagcaggctggaggtggctcttctggccttcctggccccatcccctctgggagggagcggcaaatcactgagatgcgtcggccccgggggacccggtgtgccccaaaaaatgattcttcatctctaaggatctcatgggagaagtcatatcgggctgaaccccgagtcccagtggtcgtactcgtagcgccggcgccgcagctggggctccagttcgcgtgtcagcgtgtcctcttcctcctggctcaggaagcctggatgcactacggcctcatcacgcaggcggctcagcaccgcagagtccgagccgcgcacccagccgcacccagaaagcaagcgcatcgctagcctccagctgcccgccatcttcaggacagcctcgtgcc

SEQ ID NO: 428 - DNA, 638 bp, Rattus norvegicus
  Genbank Accession No. AA893212
gagctgggaaccgaacccagggccttgtgcttgctaggcaagtgctctaccactgagccaaatccccaacccctgtagtgcgccttctatactagaaagcttgaccactgagccacacctcccactagtgcttcaatgtcaaccgagagtaaaatgtgtttgtatgaaatgcctccatttgactagatagagctttatttggagaaagtcacatataacataattgaactttgaattatacaatcccgtggattttagagtgctcctggagcaggtggcagtcaccactatctacttccagaacagtctcatcctttccagaaacccacactctgtctttcctctattccagatctgttagacgagtggaattacatagtccggtcttttctgagttctgttactaagttttaaaggtttattctcaggtagcatcagtccgtaatgtattactgctgaatagtgttccgtgtatacagacaccgtgtgtgtcttcttccagcgagcagaggaactctgagctgtttctactttggggcttttgactaatgctatgaacatctgtgaaaaagttcgaaatgtttgatttagtacagaccctagtggggagctccggggtcatattatgacagcctcaa

SEQ ID NO: 429 - DNA, 663 bp, Rattus norvegicus
  Genbank Accession No. AA893217
aacataaagatagtgaaatcttaaggataaggaggcaatttatatagcctcttctattcattgttcaggatggagctttccaaagggcataggtatgagatttaacactggaaaaatacatatgaaacttgtttaaccggctgcacttaggaccaggcacagcacaataaatagagaactgcataatcttttaaaaagactgctatattttaacacatccttacgaaagaagcactatcagtgaacaatctgaaactctacagtgtgggcagagggaaagttaccgtgaaaatctgagcgttgtttctgtaacttcttcacactcatacatcaacagtctcagagggaggaagaacgcacatctcaaatccaggacaacaaaacacacttggtcaagtagtttcttgggatcattcattctgatcacaagcctaggttgctggtaggtgtaggcagacaggttttgaaatctttctcatctccactagtcagggcttctggatacgaagccatattggaagcaaactgattaagcagcaccgttaatccacctctcaacaagtcattgcataatccatatctgatttaatagtttttaaattgttatgtggaagaatatccttcttgaatagcagtctatcgtgtagacatgcactagcaagg

SEQ ID NO: 430 - DNA, 635 bp, Rattus norvegicus
  Genbank Accession No. AA893237
ccaaagaaacatttattgaaacacagggcccatgttagaggctcctgagccccagggcgaggcccacaaggcagagaccattgctcagcagacaccccaggttgcagagggaagacaggccatggtagtagaagaatttctgccggagagcactgtacttggggtccttctcccgcagctggcggtaggggtcagggccctggaggctgcctggcacctctgtccccaggcctcgctctttctctatactctgcagggcccacatggtagctgtggtgcgagcctcgagccagcgagcattgatggtagccagtgtgagactcagaagcagtagggtaagctgactgatttcccacagcgtgaggttgatccaggcccgctgtggtgccaagatgcagaggttgatgaaggcacaacccaaggagacgtgaaaatagactgggaagagcttgctctgcacaagtccaaacgtgtgcctcgggaggctccggaaaagcaggaagcctgaggcaaaggtcacccacatctgcatgccccagacaccagacaagaccagcaagtggaccactttaatcagacttcctgggtcctcaccttcttccattctgccgcccgttggagcaccggaggtcagc

SEQ ID NO: 431 - DNA, 643 bp, Rattus norvegicus
  Genbank Accession No. AA893242
aatgccgtttatccagtctcagaggtagcccttgaagggaagaaacttttgatttgacccttttttctaagatttttgtttcaggacctgaattaagaaaaatcaaaacaaaacaaaacagaaaaattaagagatgattttttctttctcttgaaagtttaagagagattctcagttcatcttttcatgactggaactttctaagacaaaccacaaagccatataccaagcagaaatcagagaacgaagcccagtccccatcagctgcaggtggaaaccacggagaagccagcacagcaagtggctcatggttaatacctcaggtctgttctgagaaaagatgccgatgaactgctctgagcaaggtttgaaacccttctggatcagcgccgagcctatgcactcagccatttctgcaacctgtttgtaagaaatccactcatatggctggtttggctttctagaacctaaacaagggccatcatttgacacctgaatccccctctggaagccatcgtacatcgttctgacatcgtcgtagtagtacagcaagagcttgtcgtcctcaaggactgctgatcttcggacaccctcagtagtacccgttactttcacagactgcatggacagatcacatgggggc

SEQ ID NO: 432 - DNA, 433 bp, Rattus norvegicus
  Genbank Accession No. AA893244
ggcctttgagagatttattgaagaacaagtatcagcgggacactgaaacagtcacaccaactgttagagcaaaaaggcactttactgtctttagaatctcactccatttggtaaggcactgcagccctgtcgtgttttcagtgaacacacagttttaaaggcagcaatgagtaactccggcctaagtgagcacaggcactaacagttgaagactcactcgctgtggtcacggtatgtaacttactctcaaaagagctcttactagtattctaaaaacgtggcagtatgaaaaaaatcagtttctcttcagtctgtggtctcttccaaagacacctgtatgtaaaggtattttttcttttacgtatccctgggcaacagtgaaccatgcataaaatatcaaaattccctcttagaaaataaacgtcaaaggacg

SEQ ID NO: 433 - DNA, 472 bp, Rattus norvegicus
  Genbank Accession No. AA893267
actcctgggagaagtttattgagagtagccagcaaccatcccatccccagcgcagccagccatggttctgaccccgagaggccggggcggtgatgggaacagtccttgacctcacagccgggcagaggtatgtggggaccgctggtctttcctcagagcttctccaagtacgaaccagggacaaagccacgttgtccgtttcgttccacagtccaccagccatcctccccttccaggatgactgccaggatgtctcccgcagaaatgtccagctcatcagaattctgtgccgtgtagtcatagagcgcccggtagtcctgggctgctgagttaaggttcccctgggttgcctgcacttcaatggatgcatagaccaattctttctgctcagaggtgggagccagagtctctgtggaagcggcaggagcttgagaaggtgtggtcttgggacttccatgtagcagcccagaga

SEQ ID NO: 434 - DNA, 480 bp, Rattus norvegicus
  Genbank Accession No. AA893280
gggtccaaaggtgatatttcttcacatggaaaaaaactaaattcaagccacacaagaacatgccttgagggaaacagtgatgaagcctgctcggaccacacaggagcagatgcccattcagagcagaggccgcatgaacaaatctttattcggaacagacagacgtttacagccaataagaacacaaaggccatggacaagactgtaagcgcacctgagctttaaggttctggtgaggtcctcacaaaactaacacactccacataccagccgggtaagaagaactcatgtgtcagggccagcgggggcacgaccataagtgagctgtgaatgaccataatgaggacctttgttcacactagctgcttttctaatctaatcaggttaatttcaatacagcaaataaccgataaaaaataaaaggtgccacctggtcagcaacatcatacactggtgacaagagaacgttactgagttgtg

SEQ ID NO: 435 - DNA, 362 bp, Rattus norvegicus
  Genbank Accession No. AA893328
aaaaaaaggaaaaaaagacaaacctggaagattttaaaaacaacaaaacactagttagttgcttcatgttacatttcacaaccattatgttaaatgttttcttttctacagaaacagggtcctttacattacaactgcaatagtttactgctagatgtttaaaattacaggctagtattcactggaacctgttgatggtaacatcttgaggttttctgagctcccacctaaggtacaccaggccctctcctaggaccatatttgcaggggaaggggagggagaggaaatcacagatcaagttcttaagattgtttcactctcttcgtggatttccgtttcttggagatctgttcaaaaattc

SEQ ID NO: 436 - DNA, 519 bp, Rattus norvegicus
  Genbank Accession No. AA893338
  misc_feature (1)..(519): n = a or c or g or t
aggaaatgtacatgaaactaaattgttattttcaacaaacagaaagtttacgtttagctcttgacatagtgatcctgaaaggaaattcacaggtaccagacagaactaattaaacaacttcttcatattaagcctactctgaaaatctgcaataaaataaatgctgctatgttttctggttacaatgactcaaataagtaaaacttgtgctttgaggagcaggtgtttcctacaaaatgttgctggaaatctgtaaagatgttactattaagacaagaactaagatattttaaagtttaagcatactaacttaagtgggcatatgctacaatctcaaaggggccatgtctacatggactaatccgtgcctctgaaaaaaaggggtctgaacatgtgaaactttaagcagcacttgtacagaccatgtgcagcataangtcacagctcaagtctactttaaaaacaaacaaacaaacaaaaataccctctttccaagctgtcagacttgctagtaacaag

SEQ ID NO: 437 - DNA, 434 bp, Rattus norvegicus
  Genbank Accession No. AA893357
aatatgcgcgcccaggctgccaacggccacactgggtcacgtgtaaatctgaaaacatttaatgctctttcccctgggtttcacgtataacgcaaaacagaaatatttcaattacatgtgactaagagtaagaaaaatatacaactctatttaaaacacttaaattaacaagaaagggtttttccattctagcaaaatattgtacatttggttttaaacaagagttaatatccagacatacattttcaaaatacctgatgctagttgaaaaatcagtgaccatgaggccttccaagatatttctaactagcaaaactgtgcacacctgggaaggcctgaaggcttttcccccctagaacacagacatcaaacaggccaataccgcaaactgaccgatgcctctaaatccggttgcttcagcttccggaactacg

SEQ ID NO: 438 - DNA, 476 bp, Rattus norvegicus
  Genbank Accession No. AA893493
ctgggcatgacatttctactcctgcatcttctcgatagtttcttccttgtatttgcccttctcctttcctacttgccgggacttggctttcctctccaggatcttcttgcggtccttgtccagctttagcctggtgataaccaccttgctggggtggatgcccacatggacagttgtgccgttagccttctctcgctggactcgctcaatgtagatgacgtatttcttcctgtacacttggaccactttgccaatctgctggcctttgtagtgtcctcgaacaacctgaacttcgtcgtcctttcgaatgggcatagaccgaacattatacttctgtctcaattctttggaaagcggctaagacatgatcttcctccgaatgtgagatggtgcattgaaatgccgtttgcggttcttgcttcggtcagaagtcacgaagggattgaacttcattttggcggctgcaatccagcgat

SEQ ID NO: 439 - DNA, 548 bp, Rattus norvegicus
  Genbank Accession No. AA893515
  misc_feature (1)..(548): n = a or c or g or t
aggacagcaaattgtctttcacagcagtgcctcctcatctgataacacagtccccatttctaaatgtaaagatttaaaataaatcaaaatgaacattaaggcgtacacacagctgttcttaatcaggataatttttactcatattaaaacacatggaatgttggcacacaactgcagctgctgtagaaagatcagatgttctgtgggttactgaagctcgctaagaacacaccttacatggtttccgctttacaaatctaagtgttgagaaatgtctaaataataagtaacaattaaaataaaatgttttatttgtaaattatgtacagaatacatttttatgttatgacaaggagctggggaggaaggaagcacctcntcgtccactcagtgcccctcacttctgctggagatgacctttctctggattgaacatacaagtcagttgggatttcctaagctggaaaaggtgaatctgtagctgaattaaaagggttgctgcactgttactagctggtctgtttccacaagatgctgttgatccctgc

SEQ ID NO: 440 - DNA, 419 bp, Rattus norvegicus
  Genbank Accession No. AA893581
acattccaaagaggatgtaggaaggaaaacgccagttatccaataactgttagacttctcagagagaggcaatctgaaccctagtcctagttcaaagctgcccacattagttcaaagagttgcctctcagcaagacaggagaggctgaccagtatgtgtatgtcactcatccaggaaggcttgggcttaagagaaaatgtctttattctaaatgttcaagtccttagagctacaagaagatgaggaagaccacacacgctgagactgtgtttagttatagtgtaaactagcaaatggccagtttgttctaggacatgttgcatcagacatcacagtgcacgaaacaaatcttcatggcatgaggagccgccaggcatttcagatccaacttgtcatgaaatggagcctcacctcgtgcc

SEQ ID NO: 441 - DNA, 515 bp, Rattus norvegicus
  Genbank Accession No. AA893607
cgggtgaaaatcatggcaaactttattggcataaatcacaggagttgaaatgggaaaagccaggttagaggtttaaggtaaggaaaaaaaaaatcaaatgatcatatatccatgacccagagaatggccctccaggtaccccagtctcttcttggaggggcctggagcaggtaggtcactgtaaacagagcagtaaggcctgtgggtggaagtgtcggtcggtgtcgtctgcagcgcccaagctgaccttgagctgggctgctgctagcccagtcctgactgaggacccttgtctgggaccccatcacactgggcctctgctaggaagctgatgtactgtgtaggtccccagcctatggaaccttccagagtgccttttccaggacacatgaggttcaaaattccaggtccaaagggctgaacattcttggaccagttcttaatgaaaagtgttggcctgggcagtaagggaagggtttgagaatacagcagtttaaaaaacagtcctgggagct

SEQ ID NO: 442 - DNA, 298 bp, Rattus norvegicus
  Genbank Accession No. AA893612
catgagaattgccatttattcccgaagttgccaaaatcatcaccaaggattcaccaggggtgccaagggaacgaggaggctcaaacactgattgggggttgtcagtttagagggagatgggatgggtgggggaaccccagctgtccctcccccatctaatgccacagaaaagggtcctcctctggccggctcccctccccatccccatgtccagtttttctcaaggggaggtgggttggggacttgggaagaggttgtagtgtgagtgggccccaggagatggaagggcactgggggt

SEQ ID NO: 443 - DNA, 474 bp, Rattus norvegicus
  Genbank Accession No. AA893634
ggggaaaaattggaagtttattaagtcctaggactgagatgtcagaggtccaaggggaggcaattttgctggttcccatgaccccaggggcaggccgggacgctgagcaaggatgacagaactggggccaagcttttgggtctcagaatccctggcacgaggcctcagggagagaggccggagaaggcagggtggtctctcttgcctcttgacattttggggcttacgcagggaccggcaaaggttctctgggaaaggagccttgactccaaggtcttcatttcaataacgaccacttaatttgttccttggctgactgaagaacctgggccacgctctgttctgttaggccactgtcatcagtcctaaaattcactttctggatcacttgctgggggtcactctccaggatcacacctccatcaacaatttcatccagcaccaagaaggctccgtccatgttctccagcaacc

SEQ ID NO: 444 - DNA, 496 bp, Rattus norvegicus
  Genbank Accession No. AA893663
gaaaaacaaggaatttaatttattttacaattgtacaaatgataaagcaggaatagctcattgctatgcacaaacaacagaagacattgttgaccagaaagaacctacagagtgagcttcatccttcctttctacggatggtagaagaaagacacagcaattatcctatgcagcaaagcgatctgtaaactctgttttgcttttcttctcctggctatgtacatctaaaactcttgtgctttcaccaacacaaacaaaacagtattctgtaaaaggcgctacataaaggagaaacacacagcctagacccacagtcagaaaaccgcaatttaaatacatcgccagcttgaaggtaatttttttccctttacttttgttttgaaaggcttgaacagactagttgctgactatttctctaggaaagaacatataattcagctacgaagtgggtctttcttaaagcagagtagtaagtgaagtttcaaaagaacttctg

SEQ ID NO: 445 - DNA, 409 bp, Rattus norvegicus
  Genbank Accession No. AA893664
aaaaacaatccattttattaggttttaaaactagttacacaattgaaagtcaattaggtactactctgtacagggactgtgcctgggtatgctcacacttcaatactgtactaagcccactgtgtagattgagacattcagcatgtagatactaaaaaataaactgtagtattcctttaaggaagattgtaaagggtgtgtcacaagatgacattcatcaactttgaattattccaactagaagatattttacactctaaagttgtgacaggcaaacatgttacttaaaaatgcacacaaaaaggtacataaaaatccagatattctaatgataaatgaacttaaaaaaccacctatgtttcagcttttgtaacatgagaagataaagaatataatttaaaaacacaca

SEQ ID NO: 446 - DNA, 485 bp, Rattus norvegicus
  Genbank Accession No. AA893667
aaagacagacccacaacgcctttcaaaggtgaaaaagaaaatgccctttccctcctgggtcgagggtgaggggaaggatagaggtcaattcattcttctctcagactcgctctcatccactgggtgtcctcggggaggaccgttttctggaagccagtgcagaagggtgccctgttctctctggtgtcccaagctcagctctgtccagtgtccgaggagcctcctcccaggaacaggggctggctgtccctgtgtgggtcggaagaagtcagtcctgctccatctcgatgagcgctgcgctgccgctccatctcaccgtggcagcagcgtgtaccccctgagggcgggctggtcagctggggcatctggttcagtccaggcaggcccatcagaagccaaacatcatgtcggcaatttggacctgcactctggagctggggtccaataactctgcctcactcatccttgcttgtcatcagattttg

SEQ ID NO: 447 - DNA, 472 bp, Rattus norvegicus
  Genbank Accession No. AA893717
ccacataatattccaaatacatgtcttacagataagggttagtatgagtatcagaaaacatcccagggaaggaagccattttagacactggaaaatgctaaccaaaaaaccaatgcttacatacacatgtctggaaaaagctcaccacctaaagtgcaaagacagaagcaactaacgttctcgctgtatgaaaatagacaatcttctgaactattagctggctttttaaataggctccactggacaaaggacaaagggtcagtcgtcagaatgaatcaggctttaaaccaatctggctttgaccccaatcaactgcaaacaaagtccaggttgaggctgactagagactacacgccacgtgggatcatagcctctagcactttctacaactcagacttaacccagttagaagtgagtatcctcagatcagtgcctcggcctacccgccgcacaaggctcccggacatgtgtc

SEQ ID NO: 448 - DNA, 520 bp, Rattus norvegicus
  Genbank Accession No. AA893743
cagaaaacaagtgttgcttttaatatcaattattggagcatgcaacattgctaaatacaaaagtcatagaagctcacagatgacttcccaggctgtcgctagtcaatgaaggaacagttccgggcctctaagacatcattatggatcctttcttggtttaatttaacgactatactttcccccttactacggcaggtctcattcagaagcttgctgcccaacagttacattttttcttattcctctgagaaggataaagatgtcatttttaaaatctacattggttccatgctgtcatgtgtgcggaagactcagtggtaggctatcgacgggctatgttagtattccctgaaaaatgaagatcgtgatttctgttacagggcagaaagcatttctgtgagctcaggatgaatatgtactgacataaaatattctcagttaaaaaaaaaagttaaactcaacaaattcaacagcttctcattcattgttaatgtgttaaaaatggaaaattctgtgtttc

SEQ ID NO: 449 - DNA, 464 bp, Rattus norvegicus
  Genbank Accession No. AA893811
catcagtaagaaaatgtttattcttttgaaccccacaggggaaaaaaaaagaatgcagccaagaccaagtttaacgaaaacagtgtcccaaaggcagcagaatgggggaaacctcatcaacatagtgacaattttccatgttttagcacaaagatggagaaaaaaacctctgacaattctgagtaacactttcatggtgacatttacacaagatgactcaaaagtgcaaacggcagcaacatgcacgcacacctggcacgcacacctggcacgcacacctggctaagctagaagtcgcttactccaaaataagctctgtgattaaagggatgactgtaacacttctaattgtactgactggtttgtcctacctaatttgctttaaatgagatatacatgccaatcaacaggaaattttagagccatgaccttccagaacacacagtatggaagccaagccaatc

SEQ ID NO: 450 - DNA, 419 bp, Rattus norvegicus
  Genbank Accession No. AA893860
gaattcatacaaaataacctgggtacagaaaacatcctccatgattttccattttggagagagacatttaatggcccccatctaacagcattctctaagacttgtccagaccagaaaggctgatccacgaagactcggcagaaccactccttgctcatcatgaagccatgtttcccagtgcacaaggtcacgtgatgggcacccatcttcctctacactgatccagctcgggccatgtgcctgttaaaactcctcctctgcctgcttactgcgcaactgcttgagctgctgcagccgctccactgtttcccccacagtccgctctccgtggaccttgttgtctctcgtgcggatgttcacagtgccactggctttctctttttcaccaacaacaatgatgaagttatactgtgccaact

SEQ ID NO: 451 - DNA, 355 bp, Rattus norvegicus
  Genbank Accession No. AA893905
caaacaactcaactttatttatctggaaaatggatgagttcattcagtggtgtttaaagcctgagtctgcacgttctccttagaaaggtcagctatgtttggcaggggctctgacggtttgaaatccgcctgattttccaactgggcttcaggccggtcaccccagaggagatgcttggggtcattgaggaaccgctggcttcgctggcatgtcagacaggtctgtactgtccagcgttgtccctttcggcgtctctggcgctgcgtgcaggtgaggccagggatgaggagagaggagcagtcgcgacagagcgtcctcttcacagaggggtcctgccgtaggaccagccgcttc

SEQ ID NO: 452 - DNA, 520 bp, Rattus norvegicus
  Genbank Accession No. AA893970
aacaatgaatccctttgataagattatgcttcaggaggctttaatgcccttaacataaactgtacacattatacaaaaacattacaaccacaataacagtaacaacaacaaaaatcaaagtgagcaaaaccatttggggacaaatcttatttaaattatacacaactcaatgaaatattcttaaggaaaatatataaatactttttctttctatgttacagttatacaatataaatcagatttcaatgtctgttcagtgacctacaaataccagaacctccaaaaatgtagcagcgtattactaaataaaaacacgttatgtggtcggagagcattagctgagatcctctctatgatcccttaccactcttcaaagctaactgaacttacatcatttgtctcacaatgcatccttagggtttctgacaggccagcaatggaacatttttcaacaatcatacattaaaaatttttaccactcccgctctgccccaagactgcattttgtgctacatcaact

SEQ ID NO: 453 - DNA, 484 bp, Rattus norvegicus
  Genbank Accession No. AA893980
aaaataactgcatcctttaatggcagtaatacaattactggattaagagaccacatgagaaggcaggtgaggtttctggaagacagatactgagtacaaaaggggcgggagagccatgcgacgatcattgtaaaaatacagtacgttatatacatatttgcaccatcgactttcaactcagaaatactatttacacgtttgttacaatcctggttagagaacaatctttctttacgagtgtggcctgacggcaagtggggattcaagcggatgtccttgttccatgagggccttcagttaactgttccggaggaaggctccagactccacctcacccacagatttcagccttaaaaattcatttaattttttctttagcaaaaggacagcttttttctaatatagaccaggctggctttgaacctgtgatcctcctgcccctcctcctgagtgccgggatgacaggcgcactaccaagcctggc

SEQ ID NO: 454 - DNA, 458 bp, Rattus norvegicus
  Genbank Accession No. AA893994
ggtggctcacatctttaatcccagcactccagaggcagaggcagactgatttctgagttcaaagccagcctcatctacagtgagttctaggacagccagagctacctggccttctggaaaacaacaaagtcaagcatggtctctgcccccaatttacttaaaagagagcaaaagtgacaaggaagaagcacagtaggaggccataggtaagcaactgggttggaaccccagcactcccatccctcttggatagccctgtgcaagctcattagctcttcctgattcaatttcctcagagccttgctggcatcgttttggaaggagagtaagggtcagcgcatggatccagacattcaaatctgtttagtcacttacccactgccctacaagtacacccaggactggtctaagggcatagtgacacatgcctttaatcccagcgctcagaaggtggagac

SEQ ID NO: 455 - DNA, 430 bp, Rattus norvegicus
  Genbank Accession No. AA894004
gggaacagaacgtgtcctttattgagcatccagagggcccctcagttctgactcagcagccagaggggaaacaagcaggcaggtggtgggggcaggagagcagggatggggacacccaccctcacttccagtccttgaagaactgcttgaagatgggactctctcggccctggggcagaatctccacctgagtgtttggggaatatctcattcgagagatgaagccatcagccacttggagggccgcctgccgctccttctcattggcttttctccccttccagatgtagattttgccacatagcccgttgtccagaacaaagcagtcatctggaattagcagttcagaggcaaacgggctggagtcagccaccttggtcagattcatctgtccagtggcatcagagaccttatacagggctgcagcctg

SEQ ID NO: 456 - DNA, 445 bp, Rattus norvegicus
  Genbank Accession No. AA894009
acaggaaacaaaacactgacaaatactgtacagcttggatcatttatatattcttctcaaaaaagtgactgctttttctttacattttcctgttctttttcctcctcccaagaaatcaaaaaagtccacagaacaatggataaagacccctctgatggtttctgagtatgaccaaggcagattagaagtccaccgtgggtgggaacaactgggaattgcccttctggatgtttcgtgacaggaactagctcaagtctatttgatcaggaagcagtaggtacactgggcccggagacggaagcttcactatggcaatcagtaaaaactgacttctgtcttaattcaaactggcagccagttgtcacggaaacagtgttattcgtatggtccctgatcctgtatctgacatcccacctctgctgtgtctccacctcttcccccaagt

SEQ ID NO: 457 - DNA, 407 bp, Rattus norvegicus
  Genbank Accession No. AA894027
caattcaaagcaaggtttaatctgtgcacagaacagccaatctggcggccatctccccgtaaagtttgagttctggaactgaagggggtggggttttgcaagcaggaagaacaaggcagttaaggaaatcttctcagaacatctggtacagaacattctttggttatgggatggggtacagctaaattctgagaagcagacattggaacgtaagttttacagtaaacagagcctcgaaacgactcctggccttcaaatggacttgaactggtttctgactcatctgtcttatgtgttcctgtcacataagcctcttggaagctaacatttctggctattgtaatggctactagtggcaagcattttagcattctttatttgtccgtagacaagccttgtgaagcgct

SEQ ID NO: 458 - DNA, 663 bp, Rattus norvegicus
  Genbank Accession No. AA894092
attcagattcctttattgagtacttgttaacaataaaaaaaggtatgaagtcctattccaaagtctaaactcacttttaacttaaaccttgagttttctgaattaccaagtctgaagtaattctctttatacctgaagaatgtttttattgaaatgtttgagagaaacatttgtactgcaaaaagcatatgacaatcatcttgaggatataaatcaagtgtaaaaacaacaaaatttagcaggaaacccacattgcacaagaaatatgtaacaccactgtttgtaatttggtggcttggcttgcttgttgtataactgaacaccgcttttgatagcttagcctcccatggaaaggtaactgtgtgctttgggtttttccagcctcttcttgaccatgttcactgagcaaagacttagctgtgtggatccagtcacaatgatggtctttggtggattcctaatataatcagaacttctctcattgagataaaatccctgcatggtcctatatttccttcagttcctaccccacaggagactatcattttcctatgtttctcattcagaaacaaattaactctgcgttcagatttgcttgacaattagcttctgtttgttgccatttcagattccgaagtcaatggggctcttaaaatttccctt

SEQ ID NO: 459 - DNA, 350 bp, Rattus norvegicus
  Genbank Accession No. AA894104
aaagtcagagctggctgagcttcaggggtacagcaacagctcaaggaagggtgaagctgtctgttggtccccaccaccgcgagttggggagggggtttcatgccaacagctgaggctcctcgcagctcccgggcgatgctcaagcagggagagggtggtcacggggagagggaagctcctgacgctccgacactgctggcttcttctccccactcctgtcccttttcagcacagcctggctacccagctggcctggggcagagcaaaggcccacgaccagtggagggacgtggatggggacagagcaccaagggaaggggccctcggcccaagggaggagggaaatggcc

SEQ ID NO: 460 - DNA, 515 bp, Rattus norvegicus
  Genbank Accession No. AA894173
acatatcagagttcaaaattttacaatacaaaggagttaaccatcaaaagaaaaataaatgcaaatttcccccctaaaaaaaaaaaaaaagaacaccagttactagggtaaataacaactaggttgaggtttttttgccctggaaagagatgggaaaaagccagtttttcccaacgtgggtaaaatttgtaaagcaaaatgtggcgttttcaaggaagtgatcctggaagcttatttacactgtagttctgagctggaagcagacagtccccatcttcccaacagtctgtgggtgtggggtattccttgtcagccagagcagcaccagtgcaagggcaatgaagaggacccagctgaaaaactgcacgcaggattcttattttactggtttaaggcttgtgggcggctggctggggccagcaactccaaaggccctgctagtgtctccccaccagctattccatgcttggaaggtcccctacctgaaagcagtgtaaagcatactaggataggat

SEQ ID NO: 461 - DNA, 670 bp, Rattus norvegicus
  Genbank Accession No. AA894174
ctgagaataattttaaaggaaggtgaaactttattatattttttattatagaattagaaaatgtcaaaaataattgtttggaatcacaaaaaattaaaaaggaatataataattgattcatcaaaaggcattctagctgctgttagcatattttctttctttggattatgaacttctatgatttcaactgaatacttttgacagtttccttaagatatgattttgacttattttttcttcagtatttctgtcatttcaggaaccaccttaaataaatctgcaactattccataatctgccacttggaaaattggagcttctgggtctttgttaatagccacaattgtcttgctgtccttcatcccagctaaatgctggatggctccagatattccaacagcaatataaagttctggagctactatttttcctgtctgaccaacttgcatgtcattgggaacaaagccagcatcaacagcagcacgggaagcaccaactgcagcatgcagctgatctgccaagtcatacagcagtttaaagttctctccactcttcaagccccgaccaccagataccaccactttggcaccagttagctctggtcggtcactttttgtcaatttctggtcaagccactctgatattcctgctgatgaaagaacttggtgcc

SEQ ID NO: 462 - DNA, 589 bp, Rattus norvegicus
  Genbank Accession No. AA894188
cacaaataaaaatactttattatagaaaaagcatcccatacacaggattccgtaaacactggtaggtgaacaagtgcaacttccaaagtaaataaaatgtaagaggcaaaatccacacattgcccttaggggagaatgtaattctccagattagaagtccatcagcagacactggagtggctctgcctcctaaaagggcagcagtatcctcctgagctcgttgcactgacctcagaagtcgctgatggccaacactaaaactctccacttgagttgaagcctgtgctcggaacatttatttccctaaggcacattctctgactccgagaagatgccccttcctggatttcctgaagagcactcgggcctgtacacatcagacattacacagcatctcctgaggcgctggttaaatgactgggttacccacttccctcctatcttcctcaaattttgccatcacccccatccgttacattctaacactgtgccccgttcaccaactcctggtgcaggcgttccctatcagctccacagactgcaacagcaagcaggtccgacctcaggctcagccttaacttttatcttg

SEQ ID NO: 463 - DNA, 584 bp, Rattus norvegicus
  Genbank Accession No. AA894193
tgattttattgagatttacttacaggagtatcaataagggattacttacaggaataagggtgactcaaagtcagttgcatcaccaaaaagtacactgagaaggggtgaccactcaaaaaacttcaaccctgtagctgctcctcacacaactttcaggccgtcataatagttaaaaaatttaagtacttcattatcttatgatttcttttatatacttattcatatgaataaagttagagcagaaaagagagagattataatacatagaaaatgaaatccagagaatgatctgaggattctttgaaaacatacaataaactggaaaatcgtgaagaatttcaagacatatatgaaatatcaaaattaggccaaagttggaggtttcacaagcctccccctccacatatcataggctattgcgattgttcttggttaccacacagaacttgacagtaagaccttattactgaaaacaccacacatcaagtcatagagcaattaggaaatcatagcttatactgccctagaagcttcatccttctggctagctgtcatagtgctagatgatgctgtgcatgctacca

SEQ ID NO: 464 - DNA, 560 bp, Rattus norvegicus
  Genbank Accession No. AA894200
cacagagagcaagttttatttggtgaaggcaaacatcatccaaaagaaaccagacaggcaaggtgctgtgattagggagcctctggggccacacaggaatctcacactgggcaaggagcaggctcgagacacgtaaatgtcctcagccattcagcaccatccggacaagctctgtaaagagatggggtggagtcagccaagcacagggctggggaggggtacccatgggccaggagaccacaagaccatgaaggtggcatgagggaacgtgcccatagcagccaaccttggggtcagtatccaaaacagccaccatgagtgaccagttctctctgtccctggttcccctcccactagctgttagcccccaccccactctaaatagcaagaacacagcagaggcagaaaggttctcagctacacctacagtcactgtcagccgccggcaggaggagcggcagtttggggtgaggtacctccaagctctccaagctgtccagcaggggtggaaaaaggactgtggtgtttcagcagcagaatggggcagttagctccccagc

SEQ ID NO: 465 - DNA, 630 bp, Rattus norvegicus
  Genbank Accession No. AA894207
  misc_feature (1)..(630): n = a or c or g or t
aatggagtgtgctggatgtctctacagttttgttcagatgactacagaacctggaaaagctgttgctgctgttgatgcataacacactgctattattggtctttttatataaatataaatatatatatacagataaataatttgaattttttgaaactttacctgtgctgtcaactttggaaaaaagtatccccgtttactgtgttgagttggcactgtaaagaaattaacagccatattggtctagaaatgttgaacttgagttttttccatttgtacaggggtaacacactgtattaaatatgtaaggtcttatctacgtgggtttgattacaaaaactaataaagtattctctaaattaaaaaaaaagatgtatgtgtactaagggctgagtcacaccactagaaatagtttttttgtaaaataaataacttaatcgtggggttcacattgagatcaaatatcctacaacaggtcggtttccaataattcctcaagacgtcaagtagcgactagctcctttccagcaatccagctctgctctgatgccatgtacctagagaccacatcacagattcacagaagcagggtgagggttcagcctanaggagtgcccctctacctctgac

SEQ ID NO: 466 - DNA, 511 bp, Rattus norvegicus
  Genbank Accession No. AA894233
  misc_feature (1)..(511): n = a or c or g or t
aacatagccctttattgtgatattcccctcctcttggaaacctgcgttccctgcagatagattcatccagagtattgtaaagaaatcacacaaagcctgtcactggagagtcctggcacgctctgtgaagctctgacatggccagcttcctgcagacagttgatcctgccccaacaaagggtgagcttgctgggtggcacccacgacagcagagccaggggcagagctgccggtgagtggtcagtctctgggagagagagtcaagtctcaactccagtgtggaacagaccttggtcacagtccaaatggggatggactggaaatcccacggaggctgctatctcaaggactcttgccacccataaccagaggccaaggccaaaagcaagcagaaagaagcagggtggtaacctggaaatcactcgaggactcagttgcccctctggtctctggagatcaangcagcaatgctctcccccagccacaggtctctatcctgggattcctaaag

SEQ ID NO: 467 - DNA, 554 bp, Rattus norvegicus
  Genbank Accession No. AA894297
agccatcagaattccctttacatccattctgttgagcagtatccagtcaacctgctcatcctgcttcaggtcatcagttgtatttaggcacaaaggttttagttttgtctcgacaccaagttttaatcacttgaggtaactgctacagcaggaggaccttgttgaaaaatgtgctaaacacttttcatcttctgtcagtacaaattaatgtcctttccttaagtagagttaggcatttttggttttagaattggtacccatcataaagcaagacacctcacctgtggagtcagcattagaacacccagtgtcggcagcccctgcatgggcacggccagcacaggctctgccctgtggcctcggagactgtgctactgagctctttggtttgctgcatgcagccatgcttacctcttctgccaccacagggtcgcttttgtcagcaggtgccaggccgctgtcccatatgccacactaggactctggggctgcttcacatattagacatagtaagctgtaacacagtaatcgtgatggtacaaccacccagtcaa

SEQ ID NO: 468 - DNA, 510 bp, Rattus norvegicus
  Genbank Accession No. AA894345
gacatggcagtgcgggtttaatatacatatatgtagaatatatatgtacacacagttagcacggtcaagatggggaagggcatcttgggacagggaggaggctgggttcactcactgtactctaatggcttggctgtgtggcattcacaaacccaaatgagaaaggtgaccagtcccttcctggattgaatggggtggtagtcagtgcaaaggaaacactgtcgttaacttatctcttgcttggagaattccgaactggaaagtggaaaggttgcctacaatacccattttgggactctgcaggttgcggttaaaacctaagggatctcattccccaattcctacgctccgggtcagtatatcccaacagtctgtatctagaaactgaggagcgagagtgggcctgtctctgcctgcatccctggctcaggctcagcagtgcatggtcccagcatagtctctccagagcagaagttggggacatcaaaagctggcttctccactggggtt

SEQ ID NO: 469 - DNA, 430 bp, Rattus norvegicus
  Genbank Accession No. AA899109
tttttttttttttttttcagtcgactgttttattgtttgtttgtctcccacttgcagtgctggggagagaacccagggctttacatatggtaggcaagtactctatcacccacctctagttccaactcgccaatgcactcctcctccttcactctctgtccagtgttctcagtgagtatttggcagtgactcatggtgggtttacattagatcttgttcatgaggcctcatagtttttatcagcaccttggatttccttgggttagtgtggcaatttccatatatcttgcaaaccaagagatatgtgtacactacttagaaattaaggaattggaagaaagaataaacagattcttttatacataagtaatagaataaaaaattgactatcctgagttttttctctctgtgcagtaaagtggtagccatg

SEQ ID NO: 470 - DNA, 427 bp, Rattus norvegicus
  Genbank Accession No. AA899253
tttttttttttttttttacattttattcacatttattttttgcttttagtgtgctcacagaaaattagaacaccttaagcaggagttgaatagcaatgtttgtaagcaacgttacattccagctctatgtcaaattggtcaaagatcctccagtatttacaaaacacgagagacgaggtgctacgcaaaaccactgcatctgaagatttgtttttcctttattctcaaagacaactggaaaagaaagcattgtctgctgtaatcaaaaaaaaaaaaaaaaaagaaaaaagaaaaaaaaaacataccacagtataaacagtaaccattccacgtatcacagcttggttgggtttaaaatttgtgtttaaaaggtccaagatgactgcagttttacaaaaagatgggcagggtggagacttgcaaactt

SEQ ID NO: 471 - DNA, 407 bp, Rattus norvegicus
  Genbank Accession No. AA899289
  misc_feature (1)..(407): n = a or c or g or t
catggtcagcatttctactcgggaactggttaactccaaccagaaacgaatcaggaacatgattgcacagctctgggcacagtgtctgaacagttcagtcccagtccccctcgccctcaggattgtcctcccgaggcacctccaggtcgttgaagtggaagttggccatcatgtcacgcacggccaacatcagcctgttcaagccttgattgcggttcggacccccggccactccttcctccagcctctccccctctgtggtgtaatttggcaataatgaccggaagaagagggcgattgtgtttccgtggctgactggactcagcctctccggtctgacgtaggagtagatggtgtccacgggaggcanagggtcaaaccccataacagactgtgtggtcacatcc

SEQ ID NO: 472 - DNA, 504 bp, Rattus norvegicus
  Genbank Accession No. AA899491
tttttttttttttttttacgggagcacaacagtttattatttcttgcctgaaaatggtgcaaggtcagaacactcagagcgagcggcccttgtgccttcagagaggacagacccttcaaccagggctttccctgagatatggcctctgctttccaagactctgagggcggctcatacatgcagccaccccagagggagagcactggggcctggacagctgctgttcttctgtctgtctagctatggtccaccggcctgaggcatggccagcacacttctggcctgccctccacttcagtcaagtgtcaaagcaaaagcatctgcaaaggtaacagaccgtccttagagtctggtggttgggagaagccaccactgggcttgacaaggtggagtctgggccatctgtgggaaagttaggacactaagggtaacaagcacgattctggagtggacagcacgtgtgatctggagtttagttacttcagcctcaagtctctcccacag

SEQ ID NO: 473 - DNA, 498 bp, Rattus norvegicus
  Genbank Accession No. AA899535
  misc_feature (1)..(498): n = a or c or g or t
tttttttttttttttttgccttttcaagtttttatttttatacatttttttgtattaaaaagaaaagcataataattaccaccaattacaaaggactagagcaggaccagaataatgaatgaatcacttcagcctgggaagcagacactctcaataatattaatgttataatacaagctcattcaagtattttacatttttttgtcctgttgaatgtgatatcctagaacatggtaaagacaatgtacgagcgtaaggtggaaccttctctgcaaagcccatgagagttttcctttcctgtgagaactgggctcaaagttttcttctgcctctgccatcaccatggctggaggagagggtgggagctggggagaacctangggccctttaactagagagactctggggtcctatccaggggaacaaccaagcctctagcactccccactatcagccttgtcttcatgccctttccctcacgtccagaccttccaagca

SEQ ID NO: 474 - DNA, 344 bp, Rattus norvegicus
  Genbank Accession No. AA899797
tttttttttttttttttagaatggaaaaagagataaattcatctttatttgaagataacatgatctaaagaatctgtttttaagaagctgagaaggtaatgaatagatctgactactgcagggcataagccatactcaaaaaattaactggggttggggatttagctcagtggtagagcgcttgcctagcaaacgcaaggctctgggttcggtccccagctccgaaaaagaaaaaaaaaaaggaaaaggaaaaaaattaactatattcttatatgttagcacttgaaaactcaacatagccaggcactgtggctcacgtctagaataatagcactaagaaagct

SEQ ID NO: 475 - DNA, 497 bp, Rattus norvegicus
  Genbank Accession No. AA899828
tttttttttttttttttcagaaccttttaactgtcagctttatttaaaaaatacaaatattttcacatgttggatttttaaagcatcataaaacaaagaaatgtatgtcaaataattcaaaaacaccaattctgtccactaagttagtatttacgattaatcaaaaaattttcatattatcaacacttaagaaaaaagttatttctaacatattgctacaattaaaataaaacaatcagttttcttttcttttctttttcttttggtttttagagaggattttcctggctgttgtggaactcattttgtagagcaggctggcctcaaactcagacatctatggagtgctggggttaaaggcttgtgctactactactgcccagcaaaacaatcagttttcaacagcaatcagttttcaaacttaccacttgcttaaaacaaacatcaaaacgatggtgaattgatgcaaacatttcacatctgagaaaaatgcactt

SEQ ID NO: 476 - DNA, 528 bp, Rattus norvegicus
  Genbank Accession No. AA899854
tttttttttttttttttgactttcgatgtttagaacatttattaaagtacaaaatagttggaattaagctgaatagacagacatattaaatatttacaaaagacactgataatagcacttaagtaacatatacaacagcacagaaggtctcggcattcacaagtcggaattacggagattggcacggatcacacttcctggctgagtgtggagatgtcaacagtcctgcctccccccagggatctcgagttcggaaggcacccccaaacaagagtcaagacttcacgtaactggcctaactttcttcatcctgctgcttgtgctgagtcatgaagacatggtcaaggtgacttcctccagcctctgatgatgttcaaaaggtacgagcaatttctcatggccaaacaaaagtccatcacatcagaggctgggcactgtatctgtactagaactaaccagctctttatgactgaattctacctataaaattgaaaacaagggctgtcttacctcatatttagtgggata

SEQ ID NO: 477 - DNA, 425 bp, Rattus norvegicus
  Genbank Accession No. AA899894
tttttttttttttttttaattttataattattttaataaccaggtttacattaacagtcacttgatgagcttttttgtttgtttgtttctttattctcagctaactcaatacacagttttcttcacggttcaaaccaaacagctcttccatatctgagctgcctcacagctagcacaggtcacaaggagactcactgtctgtccatagccaccagacacagaactgaacacccacacaccatgtctcaaaggggaattacgagaaacgctggctgcatgggccagcacatgactgcatcgggactcaagctgggctgtctagggaagaagatctgggaggcttgtggcaagaagcaaaattgggaagcactcacctctcggaaggggcttagaaagagcagaatggagtccagagttaggattca

SEQ ID NO: 478 - DNA, 513 bp, Rattus norvegicus
  Genbank Accession No. AA899911
tttttttttttttttttcactcttgaaatacagaattttatttaaaaactgtttaaagtagaaaaaaaccctgtcaagaaagaccaggtggaaaatgggttcccaataaaatggaattggggtcaacagaagtctgaaaggccacagaggaggaaacagcaccgctgtcgttgaacaatggctagttaacttacttttttttttttttttttggcattgttaatcactgaatctggattttcctctgaattccacagagcatgcactacataacaatctgtcataaaatgcctgtttctacacacagcataagacactctaccaccagaaacaaatcaacacaaacacgtcaggggcggaacaatctcagtagtgggtaacacattgtgcagagttctgccaaaggaaatgaataggctgtgggtaaagcaaatgagggagaattaaggaatgaactattttaaatattaatatttcagtcatggtactgtaaattcttaaaaaaaaaccctc

SEQ ID NO: 479 - DNA, 511 bp, Rattus norvegicus
  Genbank Accession No. AA899951
tttttttatttttttttcaagagagatttgtcatgtattggagtagcttgaatggaggatctccagacacaaaagtttgcacataaacctgtcttaggtcccctttgtccaagttctcagtttttagaagtctctggggatttgtaagaaattaggagtaagatgacattttgtagaacagaatggagggaggccagtctcaatcatgcggtgacatagttagacacctcaatgagatttctgtcaggatctcggaagtagatggacagaataggcccctttgctcctgttctggagactgggccctcttcaatggggacatcaaaagccttaaggcgcttcatcacctcctccaggggcgtctctgtgatcaaacaaacgtccaaggagcctggaatggggtgggctgctttgggatcaaattcctttcccacctcgtgcaggttaaatttttggtctccgaaacacagtgctttccggtcccccttgaaagtaatgacctccatgccca

SEQ ID NO: 480 - DNA, 552 bp, Rattus norvegicus
  Genbank Accession No. AA899959
  misc_feature (1)..(552): n = a or c or g or t
ccgccacaattgttttatttttttttatttttttagtaggcatatcaatactttaattcctatggatcagattgctctggcctctaaggcctggcaggtggtgtgttgcccaaggtacaaaaggagaacacagggccagcccctcaagacagaatacagggagagcagagtcctgacttagatgctggtggggagagcttcagtagccatcatcagcccaggtgacctcataatcaggatacttggctttgatcttctcagttgaaacagagtgctgggcacggccgtaaccctagagagaagatgaccaccagtctgctatggttttgctttgggagtccacccagaagctacagcaatagtagccatggggaaagtaagcaaatcctaaccacactgggaacatgatggtgactgaaaggctctctangtgatgcctgaggatccaggctggacttttatgaagaaagatggaggtggtcagggctgtgaatctgaccccagcactggctgctccaagggcccctgaagagccaggacacagactcatca

SEQ ID NO: 481 - DNA, 351 bp, Rattus norvegicus
  Genbank Accession No. AA899964
tttttttttttttttttggctctccaaaagcacgtggtttattatggtgagctgtagtgcacatcggtttctttagtaattctaagctgatacaggttccccactaggagtacacatggggagtgactgggcgcgcggtgacagtgacaaaccagtgagccactgtgatccatagaaagttacattagcaatcaggagagaaagggaagtgtgaggtggcccataggcaagatgtgagcagagcacctggacccttccttccctacatgcagtgcttgggccctgctgacgggcacagtgaccttatgacctatagtaagtggccagcctctgactgctatgcatggtcag

SEQ ID NO: 482 - DNA, 485 bp, Rattus norvegicus
  Genbank Accession No. AA899969
tttttttttttttttttcttgcaaatcaggtatttgtattaaacaaacaaaaataggaagaaaaaaaaagtaaggatattttcaatggaacttactttaagtgatggcgacatgcacttggggtgggtgggggagttctcatttgtgttttgaaatcccaaattaatgagcatgataaactgttattgctggcactggctttaccccaagcggccaagtggcactgtctgaccctctactctgagtccttggtaggttcccctaatcctcccctaatccccaccctttccctttctattgacttgggacagcccttgtcaacatgccaatcacagtgggaagggggggaggcagaggtcacagtgcatggggttcaaggtcacagtgggcggagcaagggggatcacagtgcaagtaagtcaggttattccctctgctcaagtccagacgtctgccacagcagtgcgacccatggcagacaatcc

SEQ ID NO: 483 - DNA, 360 bp, Rattus norvegicus
  Genbank Accession No. AA899986
tttttttttttttttttggttataaaactgctttaatggaaagtccccctccccccaatacaccatctgggctggggtagatgtggccagggctggccccaggacaatactgagcctgtagtcgttaccaaaatatacatctgtcaccataaaaaatgctgcaccgcctcagccccacaggtataaaatcataaatatttacactcttccatggacattatgaacagagaggcctgcggcctgagggatggcaaaggtgggagggaacccggctcctgcatacggagaggctgacattatgccgggcgcaccaaaggctgctgccatggtctgatccagtgatggctggctgtctccaga

SEQ ID NO: 484 - DNA, 569 bp, Rattus norvegicus
  Genbank Accession No. AA900230
cggccaccccgccgccggcgcgcgtcctcctcccgcccttgcttttcctctgattcaggcccgccgccccaagcttcgctctgccgagcccgcagcccacgccgcggccgacatgagcttcttgtttggtagtcgctcttctaaaacttttaaaccaaagaagaacataccagaggggtctcaccagtatgagctcttaaaacatgcagaagccacactgggcagtggcaacctgcggatggccgttatgcttcctgagggagaggatctgaatgagtgggttgcagttaacactgtggattttttcaatcaaatcaatatgctttatggaactatcacagacttctgtacagaggagagctgtccggtgatgtcagctggaccaaaatatgagtatcactgggcagatggaacaaacataaaaaagcccatcaagtgttctgcaccgaagtatattgattacctgatgacatgggttcaggaccagctggatgatgagacattatttccatcaaaaattggtgttccattccccaagaatttcatgtcagtggcaaaaaccatactca

SEQ ID NO: 485 - DNA, 493 bp, Rattus norvegicus
  Genbank Accession No. AA900290
tttttttttttttttttgtttgtaagttcgtttattaatattaggtaatattcagaactcagacattaagctatttaccatcttaccacactggtcagttattttgtttggaagaggcttcaacaattggaagagaactccaggttatctttttgactcttacatttttttttagaaaatttgaacccaatcatctggctgtcttcgggatttttttcgagagagggtcttgatatacagcccaagctggcctccaagacagacttccttgtctcagctgagtgttgggatcacacctggcatcttgataggatgtctcactaatattcttagcagctgttctcaagctacttgtaaaaagcacattgcagaagaagtgatggagtaatcttcacatctaccaatgtcatcacaacagaaaaggcacaaatacccgacagtgactacagtggaaactagaaccgaacgctacagaatctctgaaacacaatga

SEQ ID NO: 486 - DNA, 495 bp, Rattus norvegicus
  Genbank Accession No. AA900326
  misc_feature (1)..(495): n = a or c or g or t
tttttttttttttttttaacttgtaaaaatcaggtttgtttttatttaatacatcctagtcaaagagtaacagcagtaaataaacactttgaaaaacaggcaggtacccccctatatctggaagaagagtaagtcatagtattctacatggtagaagggaggcagctgttgatgtccatggtcagacaattcaaggacaacttggaaagttctaaagccatgtccaaaatgtcatggcaataggttaggactcacagctacgccgaggggtaaaatgtctctgtctgcattggttttcgttttgtttttgtttttgttttcgaggattgagttgcacctgtgtagcgtgacattcttgtctttagccttaaaggaaaagagagaagtctttcctgtttgcaccagtttggaatgtttctaaagtaaggctgccttgaaatagatgactacagtactcattcacggnggagttcatacatgtagtaaaaaagacaa

SEQ ID NO: 487 - DNA, 219 bp, Rattus norvegicus
  Genbank Accession No. AA900343
tttttttttttttttttgatgcaaaatatttattccacgttagttattttatgcagtagtttttcccctcaacagacttgtggtaaccacatcttttaaatctgtaaataatgttatcaaaataatcttaatctttgaatctcacaaaaattcatattttacaatccaccctgaatatcaaggctgcaagaataacatttcctatatccaaatatttta

SEQ ID NO: 488 - DNA, 474 bp, Rattus norvegicus
  Genbank Accession No. AA900469
tttttttttttttttttggcagcaagggtagctttaataaacaggcaaactgagagggtgagctggacaagtagtactgggaggggcaggagacacatttagggacagagggatggcggatggaaccatcagaagtgctcttgtaccacctcaaacacaagttcatagcagggctctaatgtggtcgtctttaacaacagtccattctcttttaagttatacaatgtttgaaacttatgctctactctcaatctagtggttctgactttaaaaagcatgcgaccacaccacaggcccaagtccaccacaggcccaagcccaccacaggcccacgcccaccacaggcccacgcccaccagcagctggtttatcatcctgagggcttcactttgctgtagcagttggtggctatgtccagaggggcctgccgtttggctgtgtctgcagagggtggtattgtcagcactgggatgc

SEQ ID NO: 489 - DNA, 419 bp, Rattus norvegicus
  Genbank Accession No. AA900474
tttttttttttttttttcgtcacatacctgcgttttaatccataaatatcagtgccaagactcacaggttttcctgtttgccctgagctttggcagagtgaagcaatgaggccctgcccgctgagtaaggcctaaagcttgtttatacagagaactgcctagcactgcaatcacacgctgatgtcctcaagggacagcttatggcgcttaaatggctgagggaggggcctggagccaagtccacgggttctgaggagcatgcgtgagctcatgaaggctgtggagtgtgcacagcgcctggcatggtggccggcatggggctagcatgaaacagccagggtaagccgggatggcaccatgtaactcaaggccagggtagcttagaccaggcaagccactgaaggcaggggtaatgccag

SEQ ID NO: 490 - DNA, 291 bp, Rattus norvegicus
  Genbank Accession No. AA900762
tttttttttttttttttgcctcttagcactttttttattacaaagtatttattcaacaaaacaatatgacagtaaaaaaacgacacccatgtggcagcggaggaagcttctcagctgtagggaagctgcgcagggactgagttcagcttccacagtgaggttctagagctccaacggcagctgcagcagctgaacactgattaagcaagcataagagccggggatgctttttgcagcctattttctggctaaattaatcctgttaaaaaaacctttgcggccctcgtgccg

SEQ ID NO: 491 - DNA, 530 bp, Rattus norvegicus
  Genbank Accession No. AA900825
tttttttttttttttttaaccaccgatacccatttattttaaagaaaaaacaaaacaaaacaaaaaaacctctgcattctgtatggtccgaaatggaaacgaggagtcatatgcgggcctctacgcatgtaatctcactacaacaaagacaacatgtgaccctagtgctggcagaaggcaaactcaaaagcacaaggccaaaccagactgcagaggaaagaagcatatgtgtgtgtgtgtgtgtgtgcgcgcgcgcgcacgcaagtgcgtgtggggttaaaacctttagtaagcaacagcattgaaatgtaccaagacacttaccttaccctagctcctgctgagcccgaaagccacaggctggcactagcttcattccacagagaacaatttggttgtgagctccgatggctcccttacggtttgtcagcgggaagataaccttagtgggagccctgatgttcttcttagcccgacatgctcacaggacaaaactcgactcctttccagacataatgaacaacttttta

SEQ ID NO: 492 - DNA, 567 bp, Rattus norvegicus
  Genbank Accession No. AA900860
tttttttttttttttttcctataaatacttcttaatttatttttaaaaaattgtgctgttaacccttttacggggcaacaagctatgtgaaaagtacaaaactttttgtcaaatgtaatattgagagtgctttagacatagttcactggtttatcatctgatcagtatatactgcgcaacgggcaaggctagaatccatgaaccaagctgcaaagatctcaagctaaataaggcggaaagatttggagaaacaaaaggaaattctttcctgtccaatgtatactcttcagactaatgaactcttcctatcaagccttctaaactgttaaataaagtttccaaacaagcatttgaacttcattacacagaagagcaacaagaatggtatcccaccagacaaaaggcaagagggaaaatatatatactgagttcaatgggtaagcctgaatgtagcacagttcttcacaaccgatggggataattcaacatggtgtccaacaacgttctaaagacgtgcttcatcactggttactatgaagcaaagtgtaaatgtttggccccaatcgg

SEQ ID NO: 493 - DNA, 534 bp, Rattus norvegicus
  Genbank Accession No. AA900863
tttttttttttttttttgcctcaaaaagtgacatttattcaaagagagagagagagagaaaaaaaaaacaaaacaaaaaaacaaaaacaagatgtccatcccttggctcccttccctcccccctccagctgttcctcagccctgcccccaggactgaaccctgggctagggccaggtagcaggacagcccctcaaatgaggtcagcaacgttgaggggcatctcttcaatggaggtgttgtagaaagtctcaatgtctcgaagagtcctcttgtcttcttctgtcaccatgttaatagccacacctttccggccaaaccgaccacctcgaccaattctgtggatgtagttttccctgttggtgggaaggtcataattgatgactagggagacctgctgcacatcaatgcctctggccaacaggtcagtggtaattaatactctgctatagccagaccggaactccctcatgatcacgtctcgttccttttggtccatatctccatgcatggcagaaactgttaaatcccgggca

SEQ ID NO: 494 - DNA, 358 bp, Rattus norvegicus
  Genbank Accession No. AA900875
tttttttttttttttttgtaaagcaacccagttttattttggtttcagaggccacccggagcatggcttcactctgcagggtgtaaaaaccttccctccccgaggccagaggaccagggaaggtaggggtacagggagatggctccctagacccaattcgattaataggctgcacgagatagaaggtagaggcctgcaatggctcagattgggggaaaggggcggaaagagggcacagaattcaagaacatggaatccacaggctggttcagttccctccattagaacgctgaggcttgggtacgagaagcaagacccaaccgtcatccggcaggaggcagggcctggcctcgtgccg

SEQ ID NO: 495 - DNA, 558 bp, Rattus norvegicus
  Genbank Accession No. AA900881
tttttttttttttttttatctcccaacttgtccctttatttggcatttcatacataatgtacagtagctgtcatttccacatggttggtacatttcatttttccagggcaatcacttaaactccaagataatcttaaaacagaattcctccatgctgtctggaggagtccagggacaagaaagacagcctaagataaatactgctacatgctgcccgaatcaggcgtggtttccgaaagggtttcagcatggagagacagaaagtacacttctatgttcattctcatggtaaacaagtactgaatacttactatgtgctgggctttgaggatacaaagatctagaaggcacaggacccctagtctcatagcagcgcagtgagcagccaggtatagttacagaaaaagggcagtgagcctcacagacaccttcggtgacattagtgcaggccatgataccaagaaggggcacggtcaccttagcgcggactcagggacttacagaagcgcggagaaacgaaatccagccgaccaaacttttgtttaaaagacagaaaca

SEQ ID NO: 496 - DNA, 466 bp, Rattus norvegicus
  Genbank Accession No. AA900967
tttttttttttttttttcaccattatagtcttcctttattggctgtccttgtataatacaaatctgcaagtttagatacaaaaaaaatctggaaataaaagatagaaaagtacccgccaggcaacgcccttcttcttctcctgggacccctccccagcgggcacggacatgaggtaacagagcgtcttcatcctccccccccccctccggggcccccaatcgggccccaccccgtgagaccttgaccctccggaagactcgcccccgagtgggggagggggcagggcaagcacagcattggcagtgaacacagcttgggcataatggaagcccttagcttgtgctgtgtgtatggggcaaggacagagagaggatgagcccggctcgaactgggcccaggagtgcccctaagtgggcatcactcctccatcctgcccaacactggaaaatggaagggcacaacaga

SEQ ID NO: 497 - DNA, 488 bp, Rattus norvegicus
  Genbank Accession No. AA900974
  misc_feature (1)..(488): n = a or c or g or t
tttttttttttttttttggtatttcccaaagctggttttaatttccaaaaattatgaggtctcttcccacactggggataataggatgggatagcccagactattatcccagtccaacccccagcctagcccaaacaccattgctgtctctgggtcccgtcatttcaccactgggagcttatttctaactccctcactggccaagacaggtggatggatgtgaagtttccaggactcagcactgtctctccaaagtgaccctgggtctcctctgtgaggggaagccatctgtgtcacgtcaaagtggattggtgtaaccaccaggctcaactcagccaagcacatacaccaaatgtctgaacctgcggttcctctcgtactgagcaggattaccatggcaacaacacatcatcagtanggtaaaactaacctgtctcacgacggtctaaacccagctcacgttccctattagtgggtgaacaatccaa

SEQ ID NO: 498 - DNA, 385 bp, Rattus norvegicus
  Genbank Accession No. AA900993
  misc_feature (1)..(385): n = a or c or g or t
tttttttttttttttttacttttgattaccctttaattgttcctgggatgacttatctgtggaaagtagactttagattgcttgtccagactcctaaggccagcatgttctgaggatagcagttttcagttctaacttttgaattccacttgtgtgtacaccttggtgatgtcattgtacctgccttcaagggcctggtagttagggacaagcggtgtgtacaaagggcaaggacttaatcaacgcaagcttatgacccgcacttactgggaattcctcgttcatggggaataattgcaatccccgatccccatcacgaatggggttcaacgggttacccgcgcctgccggcgtanggtaggcacacgctgagccagtcagtgta

SEQ ID NO: 499 - DNA, 470 bp, Rattus norvegicus
  Genbank Accession No. AA901058
  misc_feature (1)..(470): n = a or c or g or t
tttttttttttttttctgaagatggacatttattaacacagccaggcgtgccacacagaacgtctattcagacagggaaccctgcccaagggctcacaatctaagagacaccacactcgcattcatgtgcatccacagacacatagacacacacaggacccagacatgggaagtggatgacttcatgagaaacagatgggggcagctcaggatgggggcatgaagcatgttcagattatccctcagctgtctttctcagagaaggagaggagagcccagaatccagaaaggtcagagagacctttagaagtagtgcatctgggagggacttgcaagagagagagtggtctcaggcacatgaagggatgtgtgagtagctcagagcaggcagagggactgagcctcagaagtccagggtanaggtcctgtgccagtggccaaggtctggcacctccctcgtgccgaattct

SEQ ID NO: 500 - DNA, 406 bp, Rattus norvegicus
  Genbank Accession No. AA901069
cggccgcattggtggtggcgggggtgaagaggaagatagtcagcaggaatctgaaactccagatccaagtggaggtttccgaggaacaatggaagcagaccgtggaatggaaggtttaatcagccccacagaggctgtgggaaacagttgtggggctagcagctcctgtcctggctggcttcggaaggtaattcccttggaacagatacttcagctaagcctgtagcaggagccagtaaggactgccaaggtctcactttcttgtgccctactaatttagacaggagtcaaggcttcaccgtcccacctgcgaagaagatgtctatattttattttaaaactaggtctcagtttgtatccctggctggcttagaactcacagactcccacttcagacctcgtgccg

SEQ ID NO: 501 - DNA, 330 bp, Rattus norvegicus
  Genbank Accession No. AA901107
tttttttttttttttttcaataacaatatcgtttatttaatacccttgaaagtctcccatatctattcagtggtcacattcacaaacatggcttctgcaggttcagtagagtgccagcaaacaaaggacagcgtgaagatgtagctgtggtcatccgtgcacggactgggctcttgtccatttagctggctgtcatgtcaaggtttcttaaatgccaacctcagtgggttataaattatcggccccccgaggatttcagcaagtccagatcatccgtcttcgaatccatctcttggtactgaacttgatgtatcaagacccctcgtgccg

SEQ ID NO: 502 - DNA, 477 bp, Rattus norvegicus
  Genbank Accession No. AA901238
  misc_feature (1)..(477): n = a or c or g or t
tttttttttttttttttaccatcacaaaacagtttaaaatttaataaaaacaggaaacagaacggaggtctggaggggcaagtgggctattgatgcacttggtgaatgtgcttgcacacggctggcacacgtaggcccctaagtggcgtaccgcttggtccactgtctggccatccggtcgtgctcggctctgttggtcatgtactgtgtggcaatactgcctaccaaagggtcggcaaggttgcagtctgtaagtagtgagcacatggacaggaggactttagagatggtcaaggccggactccagttgtccttgaggatgtccaggcagatcacgccctggctgttgatattacagtgataaattcttgttcggaaggtgaccttaaggggtttaaacggatantctggtgaaaaggtaatgtcaagaaagaacacccctccttcatagacagatccttggggtcccaatatagt

SEQ ID NO: 503 - DNA, 355 bp, Rattus norvegicus
  Genbank Accession No. AA901290
tttttttttttttttttggtgctttaaaattaattttatttctctttatatctttgatttcaatctttaaaaaaaaaaaggttcatctgacattgtcttcaagagtctcgcgtctgctggtaagtgcacgcatgggtttgtgttcacagtactgtccgtgaccaaggacggttggtgcttattgctggaaacagtgagtgtccatgcctgggtgggcatgggtgtgaaggaaaagcctggggtctgtcgacagtatgaggcaacgggctgaggggagcagccccagagaagctgggtgctctctcgaagatccacacagcctctctggggttctccccagccctgtcttctgcca

SEQ ID NO: 504 - DNA, 480 bp, Rattus norvegicus
  Genbank Accession No. AA901341
  misc_feature (1)..(480): n = a or c or g or t
tttttttttttttttttacattcagaagttttatttcaaaacagaaactacagtaacatgaatagaaagtgtatatgaagatattcacaagctggccattggcaaatgtaaaactccacccagcatttctgtcatggaggagcacaagaggctaggttacagaggagtcacctttcccagcaaagcccctctccctagcaatgtgagttcttaaatccaaagtctcaatggccacagggagtcaggactggaatggagcactgagataacgctctatgcaagggctcgcctaaagggtctgtaaagtgtgtaagcaccgaggaaggacagtgggatccagtgacctatgcaaaaggggtgagggtcatcagggctgtcttcatttatggaagtggaggaggggatggttgggaaggtgtctgtgacctatgtanggcaagagggaatcttggcattgctcccaatataccaaaacgccat

SEQ ID NO: 505 - DNA, 478 bp, Rattus norvegicus
  Genbank Accession No. AA901350
tttttttttttttttttgccaaaattaaattttatttcacatcgatagaaattgtgaaaataaaaaaaaaaaaaacatgacattttcccacattacaacacaagaattcaatggaaaatttcttaccccaaataaaactttactggtgggataactgaagtaagtttacattctacagaggaaagcaaaatagcaaatgactgtttgaaattgttttaaatttaaatccaaacatgagcacaggacttcataattaacattttatctagtccatacaaatggtctgcatgtcaggtagcaccaattcataaagatgctttttaggatggtctcgagtagcacccattcataaagatgattgatagcatggtctcaggtagcacccattcataaatatgcttgttagtatggtctcgagtagcacccattcataacaattcttgttagcatggtctcggtcagttaaaaaaaaagaagg

SEQ ID NO: 506 - DNA, 334 bp, Rattus norvegicus
  Genbank Accession No. AA923850
tttttttttttttttctcagagagaccctttattaagcagggaagaaaagttaagtggctgctttctgactcaggcagaaaaacagcatccgatgaccttgcaggtgtaatttttatgaagagaaaaaggcggtctggtaggctgggctatgttgtattttgattgggtatgttaattaggtgaaactgaagggggcttttgattgctggactttaatacttggatagctgggcctttgtaggcggcctcaggaggaggaagtggccaaataaggggatagaccttggggtctagcctcaggaatgtgatctaacacttttagccctcgtgccg

SEQ ID NO: 507 - DNA, 454 bp, Rattus norvegicus
  Genbank Accession No. AA923996
tttttttttttttttttcccttcctagcttttattcttcatctatccatttgagattataaggaggcagagatagttaaggaattccatgatttgaacaaacaaacaacaagcgaagcaatgttctgcctccaggaatagaaactagaaaaataaagaatcaggagaaagtcattctgcttatgtggtcttaattgtcagtggttggctctctgtgggttagactatagaactgtatctcccaattttcacaacccatccatcttccagcaaggaagtcatgcacagtttttcatttgtctgtttcaatgtggcagcaacacttctggattgtgctatttccccacagtctctccaccctctgtcatccactgagagctttgcttcctccccgcttgtggctcctgctccttgcccagcactggcagcaagtttccagcttttagaccttgcct

SEQ ID NO: 508 - DNA, 428 bp, Rattus norvegicus
  Genbank Accession No. AA924013
tttttttttttttttttgaaagcattttcaaactttatttacaactgtcacagtgacaaaaagtagtttggaaaaaaaaaatgctagtttctccctgagcctcgatacagaacagacagaagtcacaggaggttcatctcacaacaggcatgtcactgaaatactaggattttttttttcaatacgatcagttagaaatacacacaaattacttaaagaaagaagaggaggaagaggaagaggaggggaggaggaggagagggaagaggaagagggtaagagaaagagaaagagaaagagaaagagaagaagaggccagacaggagctcagccacttgtccaagagcagctgggtccccccaacaggctcaaccgctgaggggcctgacgttagctatcagcccctgacctgctcagacaacacacgg

SEQ ID NO: 509 - DNA, 492 bp, Rattus norvegicus
  Genbank Accession No. AA924036
tttttttttttttttttaatagacaaaaaaatcattttaattgtgtaaaattttacatagaaaatacatagaatgtaccaaaaggataactaaaatcttcaacatcaaaagtggacagaacaatttttctcatgttctttggagtcttgggtttttgagaaaaacaataattccaggaggtacaaggacaattcttccccaaacgataacccttaacacatcttacacaaaaaaaggagcccaggagaaactggaggattcacggtgtctaggttataaatatcaatttaaaagtcacccatatcatgtaactcaggagcctctgttccaacccagtgtgttttatgaaacaaagagacagggctaactaaaggaatcaaagaacccttctccaagcactgacaccaatctaactggacaccctactctgatcccatgtgtccttgtcacaaagatgattttaaaagtaagaaagctgcttgtcctgaaagg

SEQ ID NO: 510 - DNA, 279 bp, Rattus norvegicus
  Genbank Accession No. AA924091
tttttttttttttgggtagtcacatcctttattgcacaggttgggaaaaggtgagactgtctttcctctctgtgtgtttcttatgagaagcacttggccctcaatcctcgccatgcccttcagagaggcacagtgatctttgcctgtcctagggagtttgcaggccccgcagtcggggccagccctagctcccaaggcctgatgttctctaggctgagtctgtgttgcaagcttgtgaggccaaggtttggtggcccttgtaggtcccccctcgtgccg

SEQ ID NO: 511 - DNA, 460 bp, Rattus norvegicus
  Genbank Accession No. AA924097
tttttttttttttatttagagaaagaggtttaaaatactttattagggaacactcatcaatattgaacaaagcttaaatacacggcatcgatatgtataaggaccatataaattttcatcatcgtggcaaacatattatgaaacaaataagataaatttatttttaacagtgggcatgagccatacatctatattaataatttattcacttgcttagtagtatgtacattgattttcttgaaaaacaagaacacaaagccaacacgattgtctaccatgtcacatcataaataaatgggcctggaaaaagttcataaacacttacatagcacatgccaagggcatggagtccatttaaatggaatcaaaagcttcgaagccattgtagatgtctgagtgtggcctatatgcattaatacacaacagtgcacacaattcaagtacaacaatgcacacacat

SEQ ID NO: 512 - DNA, 438 bp, Rattus norvegicus
  Genbank Accession No. AA924107
tttttttttttttttttgagtttctatgatacaaatattagagtgattatttttaactttaagtagctaggagccaaatacctgaatggcaccttgatgtgaggcagactgtctgatccagacacacagttgtatatcctctgtgtataaggccttcaaatacctggcgtctgtctgcttgctgcccttggctgatcggggaaacagttggacttctgccaacttccttatccatgcttcttcctgtgtacttggatgaagaagtgtctatggaagtgcggtctaggatgtggtcaagagaggaagaagaaagaagagtagctattaaatgccccaatggggtagatttttcaatttctgttttcctaaaaaaatatagattatatataatgaagaagaggtgtgtatacatgcctcattctttctggcttggcacca

SEQ ID NO: 513 - DNA, 280 bp, Rattus norvegicus
  Genbank Accession No. AA924140
tttttttttttttttttaaggaaataaaacacatttattaatccactcagaacctagatgagcagggggaagggatggctgattcacccccagcgcgcccaccacagagggcagctggccccagagctgcagaatgcttaagcatagacctggtgctccctctccacaaaggcctggaagaggctgcccagctcctggggggctggggtctgttcaccagtaagcagtcctctgagagcctccaggccctcctgctccagactctgctgctcttgccgca

SEQ ID NO: 514 - DNA, 327 bp, Rattus norvegicus
  Genbank Accession No. AA924251
  misc_feature (1)..(327): n = a or c or g or t
tttttttttttttttttccgtgcgaatgcgcttttttgttattttaattttttcttctttcctcctccccctccccctccatttttctggcatagatactcgatgagcaatggtgacgatcagggttttgcctaactttgtggaaggaggtgactgtggttagccaactaggaaggagcctagaggactggcaggtcanggctgactctgagcagactcggcttgaccatcccattactaatccaagtgtagatggtgaggtagtcccgaggaggagagggcggatctgaaagtctgttctgctgtcctgggcatccccgggctaca

SEQ ID NO: 515 - DNA, 511 bp, Rattus norvegicus
  Genbank Accession No. AA924335
tttttttttttttttttcagaattcaattctttaatacaaaatgctttttttttcttaagatatatctgtatttctttgttgctgtttaaaaataaatatgtactacggaatatctcggaaaactgctctagagacaaagacgtgatgttaatatcttttcccccacaattattacggataaacagtagcaccaataaataaatgataacaaatattaaaattaaaaaaggagagagatttagtatgtagaattctctattttttctcgttttgtttttacatataaaaaacagaatagcaatgtctattttatcagaatcacatatatacataaacatatatatatatatatatttatatacaaacacaagttgccaaatatatatatagtatgtaaatgtatattgaaaccttatttcaaaggaatgtgtggtggggacaggggagggcagagctgagtgttagcaaaattaaatatcttctcaggacaagctagtgactgtcaccgat

SEQ ID NO: 516 - DNA, 488 bp, Rattus norvegicus
  Genbank Accession No. AA924346
tttttttttttttttgtctcctggtgtacacgtgaaggggtctctctgtggcactgtatccaggaacagaatgggaagtatgtggtgataaaaagtcaagacacaggagcagagggaattggttaggaatgagaaggggccagcaggagtggggggggggcaacgaggtgagtatgatcactgagtattgtatgcacggatgaattcgtcaaaaacctgacaaaactaaaagtatgtgatagctcaacttcaaagaagagagcagggttggccggatggctcagcaggcaaaggcgctcactgtcaagcatcagagccagagtctagtccctgtgactgaacacagtaggagcagagatctgggcctgcgcggtatcctctgacctccacatgcaccacacctcatgcacggacacatgtgcatacatgccacggacacatgcacacacacaaggagcacaaacatgaggtaatttcaaagagagaga

SEQ ID NO: 517 - DNA, 479 bp, Rattus norvegicus
  Genbank Accession No. AA924352
tttttttttttttttatataaaggcactttatttaaaaatcaacttgtctgtgtaaagaagtcactctccaagttccattatccgtgtttgggagcacagtcttcggtatttttctgggctcacagagtaagctgacatggtgttcaagaacttgtccagtggacagagcttgtcggggcagcctcttggtacttgctcctgcccgttgtaggagagccgcacaaaccactccttagattcttggtgctggtagagttccacggtcaggtcaacagcaaacgggggccacttgttgtcaaaaatccccaaggccaacagcataggcaggagggttacatcgtgcgttgcatagaggtacatcttcctggtcttgctgggtggggtggaagggtccacagctttgagcaggtttccctccaggatgtagaggaatgggcccacggccatctggatactttccctgtcttcctgttgcagc

SEQ ID NO: 518 - DNA, 438 bp, Rattus norvegicus
  Genbank Accession No. AA924415
tttttttttttttttttcactgttctcagatatctttaataatcacttgaaacgacaggataagtctacaacaatttcagagggtagattcaaaaacaatatgcatgcacagacactgcaagtctctggctactgcgatagagaaaagcgaggtctcacatacaatggacctggtttcacctgttctgataattttcaaagcttttacaattacatggtaacattctttacagtatcacatccaatccaaaaaaaggcagcaatccttcaggtactacagattagcttattcgtgagggtcgaaacgcttctaaatctatggcaaaactgaatttctttttagagaaaattaactttgatacagttttgttctatactgtccgattttacgcttcaaattcatatcattagctagttgggtatcaaatgctgtttttt

SEQ ID NO: 519 - DNA, 449 bp, Rattus norvegicus
  Genbank Accession No. AA924444
tttttttttttttttttggctgtgtgcgtacagtttattaggatgattcactaatttcttaagctgttcttcaaccaggagggcacttggggtaagctactagattgatagaaatcagtccatttgccccacaaagtgtgtcccttccctctgggccaccacagaggcagtaggcaggtttccagttgaggcaaagggacgtctccatctctaagtggactcggagactcattttaaccagggacaggaccaggttgtgggcaagagccgaaaactggtatagctgtaggatccatcctaggcaagaacaggaagccaagaaaaagcaggcagtttctcttggggttctgagccctgccgtatgctcaagtccagagtcagccataggcagttattggcaatgtcccgtcattagctttgaagcctccctgggcacctgcccgaaagct

SEQ ID NO: 520 - DNA, 497 bp, Rattus norvegicus
  Genbank Accession No. AA924548
tttttttttttttttttcaatatataagtcttttattgtttccacagagcccaaactgtacttgttatcaggatcttgtttctgaagctaggaaactgtaaaaaaaaaaaccaaatatacaaaatacttttgtcaatattcctgtccagaaagttctgtaatcattttcatagcatactacattcatctgaaacagtcatagacatgggtgcccacctgaggtctcattcgtcaggctgctggacggttcccttctcagaaacatagatgccatccaaaaacttcctgatatccttgtttttaactgttgtggcttgctgaatcagagccgctgaatttgaaacaagttcaatatcatttccttcaaggattaactcatccttctgggcttgagagacagaacaagcaacacctgtcctcatccgaaccctccggatgtatttttcacccaagaaatttcggatttcaaccagagacccattctcctgaataacgac

SEQ ID NO: 521 - DNA, 431 bp, Rattus norvegicus
  Genbank Accession No. AA924571
tttttttttttttttttggtttcaggcattttattttccttattctaacattaggctttcacaaatgtaaaaaaggctcatgagtacaaaagattctaaatagctttgcagtgtttaaaaagatccatgagaacaattaggttggtaatatttatctctagttcttgatctatggctgttaaccagtaaggacagtgtccctgcgattgcactcaggtttgaggacgcctcttggtaccccacactgcaccccttctctatgtgtattttgttatggcctcccctccacctcctccaggtttcagtggtgacagcttcattttacacacttcctgtacagagaaagactccaacagcctctgacacaagcaatataaatatttgtgagaaattagtacacgttagaggaaaagctgaaagcccatcctttc

SEQ ID NO: 522 - DNA, 487 bp, Rattus norvegicus
  Genbank Accession No. AA924578
tttttttttttttttttgaagcagagttaaatgtttatttaaaatattttaaatataaatttaagttacaggagtaagaggtgctcagggaaagagtaaggcacacctgagagctgaggtgtgggcttctcaaaggaaaaccgtccttaagtgtcttaacaattagttgtacacaggagttctgaagcctttggtattgcttgattggtttctaagtcccacccctaatctcttcccctttttgatagtaagagtaaaaggtggctccagaggtgccttggataggactgtgccctgataaaatgaaaccatgggtcataagtgtagcataggagtcttgagatatgcctttgactgtaaatgagttttctggcaaagttgtaggaaactgtatgtttatagccaggaaaggaaaaatggcatttatattttggccttaagcataactccttgctgctttaacattcctacttgaacctcgtgccga

SEQ ID NO: 523 - DNA, 467 bp, Rattus norvegicus
  Genbank Accession No. AA924598
  misc_feature (1)..(467): n = a or c or g or t
tttttttttttgggggctctccaaaagcacgtggtttattatggtgagctgtagtgcacatcggtttctttagtaattctaagctgatacaggttccccactaggagtacacatggggagtgactgggcgcgcggtgacagtgacaaaccagtgagccactgtgatccatagaaagttacattagcaatcaggagagaaagggaagtgtgaggtggcccagaggcaggatgtgagcagagcacctccactgctctcatggtggtccacaggatacccagaagctgagggggccttggtggagggaggctgtccccctatctctaaggaactgggacttagtggttgagacgctccactgcctgcaggtggcaccttttcctcaaaagctcatcaggcactaagtccatggttgttgcanaaggtgctctgttctttcaggtactcggttctggttcctcccctcctt

SEQ ID NO: 524 - DNA, 526 bp, Rattus norvegicus
  Genbank Accession No. AA924689
  misc_feature (1)..(526): n = a or c or g or t
tttttttttttttttttgcattaaaaatttttatttcatttaaaagatccaatataggaagccaaatttaccccaaatttacagctacatttagagatctctgactaaatggcactgttcgaggtcacctgtcaccgttagcttccccaaagttatttctgagcaaaagctggtattactgtaatacacctctcagatgtcacttttcacgcagaagttaaaggctgacaggctttcccctggtgggcaaggatgaaacacaacagaaccgggtccagtgctctgtgcacactaggtgtgtgtaactataaagtaacaggtgacgctgtgcttggctcctgtatttattccaaacactggtgttggtcaaccctttccgggatagcacttcagaattcccctcttccagtgcacaccactgtctcaagccagagacagactaccacaaggcaaaggaacagcttttctagttggctggtaacagcacanaccacctcctgaaggctttcagttttggcatcattta

SEQ ID NO: 525 - DNA, 520 bp, Rattus norvegicus
  Genbank Accession No. AA924794
tttttttttttttttttcgtgggagtgttgttttaatacagtctgtgccaagcaacatcataatctccaagtttctcctatctttaataggcaatattcagaatttaaaaaaaaaacaataacaacactgcagtcataaaacaggccagcgacacttttgaggagacttaaaaatgagaagccatgaattatcttctttgaaaagcagccatttcaaaaggttttctttaatatcataaaatattctcatggacaagtgagcgagcaaacacacatgcaccagtgtgcctctgacaagagtacccacctaccccacccccaagtggacatgaaattagagaaatgaacacagcagatggaacaggtagaaggaaaaaaattcagtaaaaagaatggaatataactttgtgcttggttattttcctatgtcacaacaaaaacatttcggtgcaaataattaatttttcctcttttccatttaagactggtggagaaaaaaatacttttctataataaaata

SEQ ID NO: 526 - DNA, 600 bp, Rattus norvegicus
  Genbank Accession No. AA924802
tttttttttttttttttcagaacagtgcaaattatatttaattttaaaagtaattataatggcttgaattcaaagtcattaaaatgaacactgtcaagtatattcacttgagtctacgtttcattaccactgtttacattccccataaatataaccatcaattcttcacaatttcctttgaatcataaggtttcgtcccatatccccaaactaaaaaaagtcaagtcttagaaacccacagagctccatattttaatgtattcttaaagaacacatttgtgaactcacaaaagtgttcatctttcaactttaacaatgcagttaagttaaacaaacctgttctaacatcccaacaaataaatccatgaattaaataaaagaccttgacagtgtccgttaaaaatggtatgacagttaagtgccaataggcatggcaatgacctcttatataggatcattttactccttggacatgggaagtgccagcaccaaggattacactgagatttgattttgctgaaagctacaattaactgacccacttttcacgacctagtatactcactatgttagaatgaaatgtacatgttttgtgttgta

SEQ ID NO: 527 - DNA, 497 bp, Rattus norvegicus
  Genbank Accession No. AA924902
tttttttttttttttttcaagttttaaaaatcactttattaggttgaatagttagagtggtgagaactgaatgtcaacactgcttacactgaagtgcagaattgaacttcactaggggagattgaatacacatagagacaactcaagatcttcctgggtttgtacatgttaacaaattaccaaggtaaggccatatctgagaatctagctggtccctgaatggccccaggttcccctaataattagttatgctatcatttaagtcttacagatattgatcatttagttcctactgtatgtttcaggagaattttaggagatggttaattattcgggtcaatttaattattcaaaatttgtgcttgagtgctgttaaatatacttgttcagccattcgatgagattcctcctcgcttcctcaatgtagggtttgtctgcaggggagcagtcttctctcttccgatgcacaaagccatgagtttgcccagaaaatgtct

SEQ ID NO: 528 - DNA, 567 bp, Rattus norvegicus
  Genbank Accession No. AA924926
tttttttttttttttttactgaacctggctttatttcacttaacataatgatctgaggtttccaagccgtgtttctgaagcaaacactaaccagagagagtttacatatacaagttcacacacaccacctggtcaatataaaacgtattcaacaccatgtctttgtggattatgaaaagtttattaagaaaggaaacacacaccctttaaaaataaccacctcaagtgtatagaaacactccatcttctactcttgatttgatcaaggccaggaaaggagattacagccccgtaatgcagacccatggctctgaaagaggcagtgctcacttgagacaagaaaattagaagacgtgagttcttttcagtgacttcaacactaagcagttggccgtcagataggctgaacttacactacacagctaaagcacattctgggttaacaagagtaaaatccagtggcatatttatacagaggtgatcacacggtaatagttcagagacagtcatcaggaaatatcaagacacagttcatgtttgcaagtgatggacagctttcaagttcat

SEQ ID NO: 529 - DNA, 377 bp, Rattus norvegicus
  Genbank Accession No. AA924943
ttttttttttttttgctgttgccaactgtttattcaggcccaaacagttcatgagtgcagcatgcagcacccatggtccactgcaggccactccatcagtagcaagacccgaattatcagagaccggtgcctgtggcctgccacccagggtacactcaagacgccaagggtgtgggtttggctgagtatgaaaggtaccaggcagaggtcagcttggccacaaaatccctgctgacatccagaaagatgaagaagcactcatcattgggtgtgtaggcacggtgtgctcgcagagctcgcttcacctcccgcatggtcttcagatcaaacaccagcaagtcaatctcctctgcaatgggtggtggctgcatggggtc

SEQ ID NO: 530 - DNA, 467 bp, Rattus norvegicus
  Genbank Accession No. AA924985
tttttttttttttttttgagtttaatgtccattagtttattgctgttccataaaaggactgccccagtttcaaaaacaacaccacacagagtcttctccatgttaacagatttcaaaaataaattagaacacttagcgactatcactaccgagcacagtgctgctttcagacaatccaaaaggcacttgggggttcttttttttttttctcagttcctcagagcatcgtgaactctaaattatcgatgccctggtcaactgcaggagtgctgatgaatggggagagttaattgaccattggatagagtggttttaactcagaatgggacagctcgctagcaggacagagagggtgcattcagttcccagcgtactgttggcagccagcagacctgaacagtctccgtcagaaaaatgaaaagccttttagccttcagtctctctcctcactgctggtgaatatatga

SEQ ID NO: 531 - DNA, 417 bp, Rattus norvegicus
  Genbank Accession No. AA925031
tttttttttttttttttcgagtggaaaacactttattggaggtactgagccaggggagatgtgtcgtaggatggacttcggattccacacttggctcctcttctagtggggtcagcctaggtcctaggtcttaaagagaatggtcactgggaatcaggaactgcgcttctcagtcctttcaccttagggaagaattcccagttaatgaaaggaagcgcttttttgaacatatcagtgaggacgtgccagttcaggaagtcatccgacttaaaggctaaggccctctgttcccgaagggtaattactggaggtggtgtcttccataggcgtccccagggctgctccctgggctgcatgcaatgccagaagagagaggagagccacgatgggaagaattgggatcttcacctcgtgccg

SEQ ID NO: 532 - DNA, 428 bp, Rattus norvegicus
  Genbank Accession No. AA925057
tttttttttttttttttccaaagatcaagtttattaaaggcatggagggctgcggagagccctgctgtctagggacaaggcctggcactcgcctgggcgggtagggagagtttccacaacctcagtctacttgaaagtgtggctttcagctccacctcgcccaaagcctttgggcccaaacatggcggagtagcagggatggttgcagtagggcttgccttcatgctcagcatgacccccagaggtcagtgtctttccacatttctcgcacttcaggcagggacgatgccagtccttgcctagtgacgtcactcgctcagcgaaatacacctccttgtcgcacttggggcacttcggcatggcggcacctggtcctgcacaagtggctgcagctagaaggaagtaggttgtcctcgtgccgaattctt

SEQ ID NO: 533 - DNA, 495 bp, Rattus norvegicus
  Genbank Accession No. AA925150
tttttttttttttttttaagatgtgtaagcacattcagacctttatttttatttttttatttatttttattatttttaccattttgacagtttctttttctcaaaggtgatttgaacatgttcacctgtacactttggattcattttttaaccactgtttctctgtggttttttttccacacttgttttcctctcttaagtcaatcttttctctacagcagacaattatacaccttattcctattaaagaagttttttggtgttctgatgagcatttctagtgaaaactagtttttctagaggtgagaacactgaaacacaatacttttgttgcaaatgcaagggataaatttagagttacctggtatcacaatttcaaacaaaaccaaatgatgccattgttctgtgtcaaagcaaaagaagaactttaataagcttttacaccactgcaaatacaggaacagtaacccatgacatgcaacaaaagtaattttg

SEQ ID NO: 534 - DNA, 483 bp, Rattus norvegicus
  Genbank Accession No. AA925267
tttttttttttttttatagctaaacaattttattggctttctgtgaaataaaaaacaggaaccgtcatggttaaaggcgaatcagtgtcaaccaaatgaaccagccacttggttcgagcagccgtggagaacacgagaggacattattgcttacgccccatgttcgtgcatgtgtctgttgtgttttggcaagaatacaatcggatggagctttggttaaggtcgactaggactactcattgaaaatccctgcatggcacctcctcaccagctcctccactccaacccggggaatcttcacactccattaaaaaaaggtcgtagaatttggaagaagaggtagcgaggtaaatgcggtgcgcaaagatgtgctcctggtcgtggaggataaagaggacgtcggcgcataggggattgtccagtaaacaggctgcgtcgctcgtcccggtggacggacactcggggactttgatgaccggggga

SEQ ID NO: 535 - DNA, 545 bp, Rattus norvegicus
  Genbank Accession No. AA925289
tttttttttttttttttcaacgagagcaaaagagtttatttgaaaaaattactatgtattgaaaatatacattagaaattattacagacgtccatagccttccctcccccaccacaaaagtagaaatatctgcttgctatgctaatgccaaaggtaaatccaaaccaaaagaaaatcaccagcagtcctccacatctcatgtgctgaggtgagggggtatcaactgtatgtgtcagtcagtaggaattgagcaaatcccagtcttccacagccagacacacacacttctgcttagctgactgcggcgagctctgctcctgctctgactcctcgaaagctctctttttgctcttctttgattcttggctcaacagtggctcatggcagtccggagccttctccctatagaactggagttttccagaagagttcatgtgggtctctgctaggggacatttccttgaagcttctgtgagagctcgcttctgatagaagtactgagctgcctttcgaggctccggatctttccgctgccgcaccgcttc

SEQ ID NO: 536 - DNA, 454 bp, Rattus norvegicus
  Genbank Accession No. AA925300
tttttttttttttttttgcttcattcatctttggtaagacaggactgacacagcatacctggaagcttagtggggcagcccaaacctctacctcctgttgctgggggacgctgggctttacctcaggcttgtgtgggctcatgcagcccagagattctctggtggtctccaaacattgggagagaaacaaagtaacactctggatgaagtaacactattcatacccttgagtaggtcctgtgcctagtccctcttgacttcagtgctgtctgcagtgttaggacacatctgagggcaggcaggacccatggcagtcttacatactggtcccagcccttcctgccacactgagcttaggatgtcaaagctcttgggtcttacaggctggagctcccagtcttgatgccagatcctggctttgagtcccagcggcagatggggcaccctcgtgccg

SEQ ID NO: 537 - DNA, 423 bp, Rattus norvegicus
  Genbank Accession No. AA925335
tttttttttttttttatggccactaattgatattttttatttttataattaaaaataatacagtgataaaaatatctcctgccttcaagaatatgaatttaggtaggagagatggctcaagcatgtaaagaggcttgttggcaaagctgaccaccagagttgtcaggacacacgtccatgttggaagtgaagagctgcttcccacagttgtcctctgacctctacacatgcacaaacatacaaaataagggaataagtaaatgaatttttaaaaaaatttaaatatgaacttagattcaattccaagtgaacatttgattttcagtcataaagctagtgataaaattgttggacagtagcatgtataccctttaacccagggagtccttagacagcacagtaacttagacttcctagtactca

SEQ ID NO: 538 - DNA, 387 bp, Rattus norvegicus
  Genbank Accession No. AA925342
tttttttttttttttttggagagacatgaggggaaagactttattcacactgggggaggccagttcccaaggctgccatcagaaatgcaccatcaccacagtaacagtgacccaccacactcaagcccacagcagtgtgcctctgttctgacagagtgccagatgtagacacaatccctaagaacttacttcatcagcttccaactcggcctcgcttctgctctcttttagcaccactacgacattctctggccttcttccttgaaatcatttcctaatgtatttttttactacagaaattgtagattaaaaacccttaaattgtcctttattggtgcctataggagtaagagatttgatggtttcctcctaagtcagcacaaagca

SEQ ID NO: 539 - DNA, 423 bp, Rattus norvegicus
  Genbank Accession No. AA925352
tttttttttttttttttaaatttcaaaatgatttattggattttaaaacaagatacaagaaattctgcctgcaagaaacgcacatccatcacatagtcatacaaaaactaaagatgaaatatcagaaaattatattctagaaaattaaatcagaaaccaagcaggagacttaaagacaaaatgttcagaaaatataaaaaacaaggtcactatatatcagcaaaaggaattgtactaggcagcttttcatcactgaaacaagtaactgaaagaaacaattttaaagaaggaaaggttgattttggctcacagtgtgagaactttcagcaaaggctagctttctccacagctctcacattggagtaaagcatgacagtggaggcaggtggcagaagcttattatttaatgacagagaagaagca

SEQ ID NO: 540 - DNA, 511 bp, Rattus norvegicus
  Genbank Accession No. AA925353
tttttttttttttttttaaagcttgcagctgttttattggcccttcttccaagtcacacacaagcaatgacacaggcacagtgggaacatctctcggccctctcagccctgtagccccatctacaccacaagcaggagcaaattcctagcaacccctagaaccccgagcaatgggaaagtgggcagagacacctggactgaccctccttgctgccaccatgggacacaagactctggctggctcttcacaccccatgggctagcctgcccccaactaggcagccatagtgacagacatagtgacagacaactgcccacagggcagccaattccaagcctgccaccccctgagcgtagccctgagcaaacaggctggaacaacctggctgttgggatgtcatggtgataaccagaccttaaatccgccagtggctaaagtgaccctggcaggaacctccccattgtgtggctatggggaacacttgactgaagataaggacagcttgcctca

SEQ ID NO: 541 - DNA, 477 bp, Rattus norvegicus
  Genbank Accession No. AA925364
ttttttttttttttcttactttagccaaattggtggggcattttctagcccctctgagacccacccttggagcctggcggcagacctggcactccctacctttaggcgttttgaagtcaacaggcagaagtgagggccttccatccgtgtctggaacattctttctgtcctctagtaggattccgtctttcctcagtggtaaagaagacctgtaacagttactaacaagcatctcaaatgggatggtgagaaaacaagggaatcttgagaatagaggtccactgaagaggacaaatagcatttagtcacacagctaaaccaggaggccttcttgggacaaaaaggccgttgtagaaataagcacaagctttgtgcctatgaaacagaacggcaagcagagagggagctgatctgttatcgactatctctctggacttagattttacttaagaagtacctcccttcagtgtcagctca

SEQ ID NO: 542 - DNA, 419 bp, Rattus norvegicus
  Genbank Accession No. AA925529
tttttttttttttttttacggaagacacactttatttaaacaggaaaagggaggaatacagcaatatgtgaagttttccagcatttgtattaagaaaataaacaaacaaacaagcaaataaacaagtgcttgtgttgtcttttgtatgagtcacaaaatatttctggaactctataagaacaacttgggtgggggaaaggcagacaggaggtttttactatgtacatcaacaagactcagttataatgtatgtgtgtggtgtgcgtgtgtataacactagacgattagattattttttttaaaattacacatgtgtgcattttgcctgagcacgtgcatgccagcgtggacagaagaggacaccttccagaagtcacttctctcctttcatcctgtgcatacagaagaccacacaggtt

SEQ ID NO: 543 - DNA, 436 bp, Rattus norvegicus
  Genbank Accession No. AA925708
  misc_feature (1)..(436): n = a or c or g or t
tttttttttttttttttgaagattcaacatttatttaggttaacaattcttcagcaggagtgcatggggagatggatatcagactgacccccatccctacaaaccctgttttgtccccagacaggatactaagcaggacttcctgatgaaaacgggctgacggccccaactcatgcctcctgagtctgggagaagaacttggacttggatttgagaaatgcttactgagagccaggcacgatgatgcgtacctacaatccagaggcagaggcagatactgttgcaccttcaggggggaaatgaagcacaaagccacaatgtcataccctgcctctctganggagttcctgtaacagggcagcatgggatgggatggaccaatcacttcccttgttctcatcatcccggctgtgggacagggaaagcgcctgccctt

SEQ ID NO: 544 - DNA, 504 bp, Rattus norvegicus
  Genbank Accession No. AA925755
tttttttttttttttttcagcttaaaataaatttattgtacaatacaaaatgtaggcatactggaaaataaaggtacatcattaaatatacaaagcaaatgaagaaagctcaacaacacaaatgttttaatccaaacactaagataaaatgcacaacatttatgctaaaaacaaaatatttcaagaatatgcatttcaaatgaaatgttaatgatggcaaaaaaaaaacagaaaaaaaagaaaaaggaaaaatatgctgtcatgtaaatgcttgaatatcaagaatcaaaaatggtaggaaaaattaaacccaacaatactgggtacttctcaaagaactttatttgaaaagagagtatttatttgagaatactgaagggaactgagataaatccacaaagtggcaaagcttttctttcctcttcttgtctgcagatgccttcccagtacctcacctcctcttacactcacaccttcctatacacatttttgaatgcttgttct

SEQ ID NO: 545 - DNA, 446 bp, Rattus norvegicus
  Genbank Accession No. AA925771
tttttttttttttttttaacaaaaatgaactaaagagctttattgacatcacagtacattcaagaataattttgagaacattacagctgaaagagaatggcatatttatagtcttattaagtactatttcttgaaaaaaatgtaatacaaagaaatcctattaagtaacttggagcagcatttggaaaaagacacctatttacacaattagaaaaaaaaaatctgggttcacctacacagccacaatgtgcctctataatgagacaagcccttaaactcatggaatttttaaaaatggcatcatggcattcttgccacgtcattcctcagcgcttacgacggggaggggttgttgatctgtaaagaaaaaaagggaaaagacaaaatttaaaaataaaaatgtatttatacttaaaatctgcaatataaataaatacttttataca

SEQ ID NO: 546 - DNA, 531 bp, Rattus norvegicus
  Genbank Accession No. AA925876
tttttttttttttttttacaaagatagggtcatttattcatgttatattactgcatttcaaaggcaaaaatacagatgtctgttctgaatatcaaggtcagagacagccacccactcccagccccagtggtaaatacatctatacacatgggatatcaaaatacacacagagcatcacaggtctgtaacagcccagtgggcagccgagaccctgccaggctaaagggcagcacgtttcctttgcctttctgtgcctctgagctttcccaagggccctgccacacaggccaccacaaatatagacagagaaagacacagcatgggacaacagggtgagaattcccaagtgaaggaaatggtccctgccccctcaatcctccagcccccaacggcatctcctgggtcaggcaaatgcccaggcctaacaacagtgccttgggtgtgccttgggcctgaggtgccccaaagcatgctgggaggaaacggaaagaacaggcaagacaatttcccttgggtctgagaatgaacctc

SEQ ID NO: 547 - DNA, 455 bp, Rattus norvegicus
  Genbank Accession No. AA925924
tttttttttttttttttactcttttcttatttattcaaagagactcttggagggtcctgcataacccttgtcattactccaaccctacccatattggggtacatccaaagttgaccatcatgtggccaaagctgtggttgtgggagctcattgtgccccagcccctggtttgtttcttcattgccccaaagtgacagtacagatggtctccagttcaggtgagcctccaggtctgcatccagcaggaggatggcctatcctcagagtttagccggcaggacctgagggcagaaaagaggccacattaagcctgggagtcttgagatgactccctttcagcagctggatgatgcagtgaagcctgacgcttccctgttgcagctaataaatacaagctaaatgagcgagtgctaagagcttcccgttgagcaacaccaagggagagggagagaaac

SEQ ID NO: 548 - DNA, 414 bp, Rattus norvegicus
  Genbank Accession No. AA925938
tttttttttttttttttgggttatttttgctttattgtggtcttttatctggatataaaacttttaaagctttcttcagcaacagtcattctcctgggtgtggagtggctcgcctctgaagtgttctcgtttggttttcctcttcatccttctcatcttccaaaaagcggatagcgctaactctgtggacggagtggtcatcccaggcttcctcagagacgtcatttaccaggctctccatggcaccacagcgcggcaggctctcttggcagatgggctcagaaggcatctgaggaagtaagacacacgttaaaatcttctccccggtggtgtggtctacgtctgtctggaacgtgaggagaggctgggactggttgtcagataaccacagggcctttaacttcagggtggtca

SEQ ID NO: 549 - DNA, 369 bp, Rattus norvegicus
  Genbank Accession No. AA926089
tttttttttttttttttaccacttaggacattttattggcatatgacaatttacaagggtccctgttgaaatatacaccacactgaggaagaatcgtttagccatctacattcattctcattggatattttcccctcaaattataatttaattcccaacactgattttaactgtgacgaaagggaacaataacaattctttgaaatagagtgcaactgggaaagactttgctttttatattaaaattcctaagatgttgaagcatacaaacctaagaattgagtcatggccttctaaaaactgttttcttattttttttttctggaaaaatcctttggttcctttttatttcctttctccgggtaaagg

SEQ ID NO: 550 - DNA, 314 bp, Rattus norvegicus
  Genbank Accession No. AA926129
tttttttttttttttttgatataataagtatatttgagaagccagagctctggggatgacacgtatctcacacaggagacagaggagtcaaccccgagcccaattaggggaagggatttatagggaaaactacatggcctcagttcaactctaggccaccctgcttctggggcaagctgaccctagttcttgttttcctcagaactgttgtgtcaggccttatcgaggccagatggtttgtggtggctatagccaggctacctcaccaaaacatgtgatgctattcttttgggaggtgcacttgtcctcacagc

SEQ ID NO: 551 - DNA, 341 bp, Rattus norvegicus
  Genbank Accession No. AA926137
  misc_feature (1)..(341): n = a or c or g or t
tttttttttttttttttccagaaaatacttgagtgtaataaggatttctgcctgacattagactctcccgacatgcaagtgttgggagctcaaaggattcttgagctgggaaatcctcaagggagatgacgtagagggagccaggcgtccaaggcgtacgaacaaggtttaatgctgcacccgtcaaggcaggagctccccagatcgatgcagacttcttcctccgtgtcctccacaggactaagctgtttctgaggcctcagcgcatgctaccatcgaggcctgtggtggggganggggctgcctaatcgtccttcttaaacttgccattgatgtacggc

SEQ ID NO: 552 - DNA, 524 bp, Rattus norvegicus
  Genbank Accession No. AA926265
  misc_feature (1)..(524): n = a or c or g or t
tttttttttttttttttccagatttgttatatttattgaatacagaaatctgctagaaaaatgtaataaaataaatgaagcaaggtatcaggtacttactgtactgttttttctgacagcagaaataaaaacaagaaggggcattgatgtaataaaattaaaatataaagatgaaatgaacgaatgagacagaagcgggctacagacacgcagcagcttggggtataccttgaagccagtccacgccttcctgcagtccttctcctttgagggcatcactagcacaaatatgccacggcttatctttaatgttctctaaacacagcagctgagacactttcacagaagtcactgcgtctctaagatccattttgtttgcaaagaacaagattggaattcgacggtgcttaatatctgggtgatttagaagggtatcaagctcttctttggccacaaccattcttaatttatcactactgtcaacgacaaagataatggcttgtccatctttataatantgttcc

SEQ ID NO: 553 - DNA, 571 bp, Rattus norvegicus
  Genbank Accession No. AA926305
tttttttttttttttttgaattttaaaaaggaaatgtttattgttgtgttacaaggtgattataaactcctctaaaaaaagcaaagatggatttaaaatatcaatatacatattcatctaaaaagcaaaagagaaaaaaaaaaaccgaaaccctgcaaaatgcggggtcgccgtaattaaacatacacagagcttgtatactgcaagacaggtcacacaccaaggatccttcaaacacaaacgctcctcaccttcttggttggtttcaggtttttgtgtgtgtgtgtgtgcgtgtgcatttgtttttttgttttttgttttttacaaaagtttaaaatattttaaaaatattttgaagtttttaaaaaatgtcctgatgagccagacatatttctgaaggaggcaaaacccacgttctcagcttttctcttgtgctaaatacagtcacagttgttagggattggcaaaattggtttaaaagaaatgtaactaccatctcattttgaagccaaatatctaacaagatgccctgtccttcggggaacatgccagaacatgcctgcaatgacac

SEQ ID NO: 554 - DNA, 457 bp, Rattus norvegicus
  Genbank Accession No. AA926328
tttttttttttttttttgggacaattagggaaataagttaaaaacaaatttattattcaaattccagagggtgggaaatttgaggttgcaattctttcttcatctactgggccctattcataaaaacatcagtaactaagagcaggtaagaatcacaatttcagagtcaaactggtttagcaatgtctaatgcatatgagtaagccaattaggcaaatgtgacaggcttcaggcagcacttgtaagctactcgaatgagatgacatcctgctgtccactgctttaattctcctcagcctgggagctgaggcaaaatcaaggtaatgagttgtaagggaagagggtttgtggcaccacacgtgtgatttcatttctctggaaaccacccccggcccaccgcacttcatctgaatgcaggatttgtttaatttgtcccaaaggaatgggcctcgtgccg

SEQ ID NO: 555 - DNA, 609 bp, Rattus norvegicus
  Genbank Accession No. AA942697
aacaaatcctaactttatgtatgatatatatttaaaacaaaaaaaaaaggcgagaacgacatcaactatcgaaaagctgactcggaatgcgtcatcactcccaggcagtcttctccctcgcttgccgattctgggatcactccttccgcacagctcccaggagacccgacagtctctcgatgacttgttcggaaccgtccacaggtaagcaggtcaggcgatacacccaacggagaatggtcgagaagcaggagtcaggaggatcggtccacagatggcagatggggaaggctgggaagcgctcgcctcagttctcctccggcttgtccgccggcggcccgctgggctgcagcattttctccatcaggttgaaacgcacgcgcgctttgctctcattctcagcaatggcgaagtagttgaggaggtcgaagtgacccatgtaggagcagtaggaatcccgatgctggttcacaagccattcccacttggtggtgtcggcgtggcccgtgccgatgtacttggactgcagatgctcgagctggctgtggatggtgtaccggtccgtcatctcgccgctctgttcttaggcttcgaggtcaggccacagat

SEQ ID NO: 556 - DNA, 717 bp, Rattus norvegicus
  Genbank Accession No. AA942704
tggtttgacaaaagttttctgaaaatgctttagctttatgtgggaataggtataaacctcatttttatgctgtattttatatcttagttgtgtttgaaatgttttgatcttaggaaacatcaaaataaataatggcatttggtgtacagtgtggtcctatgtggtgaccagccagggctggggacctggccaggctcaggatgctacagtaagctacagcaagggtcactgaacactatgaagaaagccatgcatggagaggaatcttcaaccccgctgatgccatcttctgaacagaacctccaggcccactctggacagcagccagtgtcaggacatcagtggccagttccaaggacacccaaaggctttctttacaggcttcagcgccctagctgcttaaaggaactgaagttcttgggcttgtgatgatggcttttgaacttcttggtcaacggggtgagctccttcttcctgagtttacggcccctcttgtggcccactttggcttctctctgtgcagtgctcttttctgactgtttgggcttctcctgttggtctgtctgaaagtcttcaggcttgagcagttctctctctgtgaacagctcaggtgggtataggtctgtcatgctgtcatcactcaaggcgcctccctcgtcactggaagttggttcccagaattctgttctctggcctgggaggtcatcgacatccatc

SEQ ID NO: 557 - DNA, 588 bp, Rattus norvegicus
  Genbank Accession No. AA942716
aatgaaacaaatccaaaagatgtacagtcaggctcacgttgtgcagttcacaagcatggaagaaacaaacagacagaaggacagagttccaacagaagaagctaacccaagaccaggctggacttgccgccaggggggtttctcctggatggcgctggggccggagccactgggctgggcacaggagcagcgggcaccggcttctcttccacctgtgccaggctggcttggaagtctgtgtccacattttcatgcacatcactttctcccttgaggtctaagaaatctccagagcttgcttcagaagagttacttctctgtgttccaggcgactccgaatcctccctgccacctgctgacttggcccaagatggggggttttcttcaggtgtcccaaagatgttagaagccatcttgttcttcctcacgggctgttctgttggctcatcaaaacctaatgaaaaattggacccaccacctggaggccgcaaaacccgggagctgttcctgctgttagggtctacacccttgaaggtggtggcagtggtcatggcgcaaaggggcgaggtagactggccctgaaaacgc

SEQ ID NO: 558 - DNA, 323 bp, Rattus norvegicus
  Genbank Accession No. AA942718
cacagagtcacagacaccatttattactgaactgcactttcaccttcacacaaactatttcaaagagctggaaaaagtgtagggtgaggggaggagagggacaggtgcctctcagaagccacgaccctcagtgggcttccccaggcagggcagggacggagcgtcaggctgtcagtctctgggcaccagctctccacgggcacgcgcacagcaagccagcagctcctcatacataaatacagacacgcttaacaaaaatagtatatcatcttcacaaggaactaatgactagtctcacatatgtacagcagagatcccggggt

SEQ ID NO: 559 - DNA, 550 bp, Rattus norvegicus
  Genbank Accession No. AA942770
acaatgttccctcataatgcaagacattttggacttcacatttttaagccagaggccactcctgtctgtttctttagagtggtcactttagaaagcattgataggcggttgttgaacgttgccacggaaacacattcaagatgttggtggtcttctttgctgcctgctttgggttaaaatcaacatgaagcacacaaacagaagcatacgtacatttgcagcaaaggccgctgcaaatacaaccccaaagagaggtggggctcagcgatccatctcacagcaatgcagggagcctttgtgcctcctgcacaaaattagcacattcaggggagacgtgtgcctcacaaagggccatgtggaaagagttattcactctcatccaaaaatgaagacagtctgagggacaaaattgttcatggactctgctcccaacgctccccccattccccaaacaagccaatgctcaagacacctaccaaagccatgggcaaacttgaccatgagcaaacaatatgaatgagaacagaatgacgtaatgccgttgtgcctg

SEQ ID NO: 560 - DNA, 502 bp, Rattus norvegicus
  Genbank Accession No. AA942930
gaatattaatccgttacaagtactgtagacatcaagccaaagcacaattacaggttaaatataatcacagagatgttttaaacagaaacccaccatgtaggccggttaagttccttgatgccctcttttagaaataagtagaaggcgaggggaaaaaaatgtctttcattcctggtgaaagctataaagaccagagaatttacatgctgtgagcctccttttgtgatcaaactgttaggactaccaggtttagaaaaactacatagaaaacaaaaatctaggagattcagtcaaaatctgaatttcagataagttaatgaacatttaaaaaattgcacagatatgtcaaatatgaaatatacttgagctagaaaattgcctgaaattcaaatctaactgggcatcttgtattttgtctgacaagcctactgatggacaaatgcaaaattaaaaaaaaaaaagtggacctggaaccccgtcctggtgggtcacacagagacca

SEQ ID NO: 561 - DNA, 601 bp, Rattus norvegicus
  Genbank Accession No. AA943015
aatctagatacaggtactttatttacaaatatttagataatagcattttgttacatcaaataaagagtacagcagtctgaataaatccttctgtcacaaaaacaattgagacccactgtaactaactttgggaactggggtattgcacctaaacaggccgagggtctttactttgtgattgccaccttatatccccatgggtgatttgttctgtaaatatatacacacaccagcaggccatggtccctgggtgaatcccttgtgatgcaacagtatataagcaaatggatcacgctaagtctttaacagaacataccagcctacgccaagattcctgtaagttaaacaaggacaaaaacggtgaatccacccaaaaaaaaaaaaaaaaaaaaaaacccgaatcctattttctgcacattccagttttggcttttatttaacattgactatacaaaactctggaaccacatgtttataatccagaagatgtacttttacattagtgtctggtaaagagggatttaaaatgtgtattttaaccacagcattgagctaggagcattttatataatgtgctcaggcttacctacgtgcatttcca

SEQ ID NO: 562 - DNA, 522 bp, Rattus norvegicus
  Genbank Accession No. AA943016
aacaagacaggagaatggcgattatttacagcctccatctgcagtggaccttgggctctactttccgagtaacacaaaaccagaggtgtgcactcctcgatggggggggtcacagatggagctggtgccagccagtttggggggagacattcattctaagaagggagaaatgcacagttagccgcccgcaggaaccgggaccgaggacaggtctccccgcggttcaactaacgatgggcagcgaacaacccaaagtctcctagggaggacttgtcactacagttaggacagacgagccagttacaggcactgggtctggggggcagaggcagatggcacagtcaggcgagggacgtttgtcgctgtgaggtcagaggggaagcagggcttcacagcctagaagctcctgctagcaagtcttctaatagtcagctcggggctttttgtttaacttcagatcaatctcaaagtcataatcaaacatgccagacgggctgtgccgggttttattctcctcgtgcc

SEQ ID NO: 563 - DNA, 546 bp, Rattus norvegicus
  Genbank Accession No. AA943020
aagttaaaacaccaaatttattggataatattgaactatatgcagacacatagaaaataaacatttcatatagttgtgtatcttttttaaatgttgcatttataaggacagacaaactaccaatttagcaattggagaaacttttaaaaaaacagaatcaacaacaccaacaaaaaaggaaaagcaacatctacattccttcatcaagacttggtgctgcatcaccatctataagtacttcttcagtttagataaataaatactttatctaccacagatttaaaattagaattacataaactctttgaccacgtagagttttcttacacaatgatgagcagtcaaacatgtcactattgagacacatgtatttgacttaacgtaatccccctgctgaaatatcactgtcaatgcacatttcatatgtgataaacaaaaactctattataaagagaatcttcagattttcacagttagagacagaggtttaaaaaaaaaccttacaacatttcaaacagaaaagacagcatgcatccactagcagaa

SEQ ID NO: 564 - DNA, 596 bp, Rattus norvegicus
  Genbank Accession No. AA943028
gactgttaatgaggacgagtcagtttggagaggagcacgcagtatttgcttggcgttgtcagccttgcaccaaggtcccatgcctgtcagcctagaatgcagggcactaagtaaagcatccctggctctcagctgccactgggctcctagtgtacaagatccaggatgagacgggactgtagataaagagaaggtcaagagtggcgaccagtctgtgagcttgggaagggccgcctgccccaagaagcctgcagtctgagcctctgtcagggaggcaagcttctgctcacctacaacctgagacctgtctttttgagacacaaatcagtctttccattgaaacgagagttggggacagttttttcaagtgggaacaggatgaagaaagtgaagtatgggttcaccagttggtgtagtaaatagaggctagcactgtgagaaccccactggcagtgatggcccaggctatgggaacccctcatgttcagaagcgtcagagctgggccgagctgaggacgaagttcatatgctctccccatgtcgcccatccatggagctcactggagctctcctcttcaggctcactgctgcctcgt

SEQ ID NO: 565 - DNA, 439 bp, Rattus norvegicus
  Genbank Accession No. AA943099
caaagataggcacctgttgaaattgagtggctactgtaagtcagtaaggcacttttcccccacaagagggttgcaggcaaaggaacgttactgcagctccatcaagtgtgtgtgtgtgtgtgtgtgtgtgtgtgtgtgtgtgttgatggcttcttaaaaaccagagccaagaacgggtctcatagccctgacatggttaaaagcagagtagcactcgttctgcctcaaggactcctttgtgccgtcaggaatccagaatcatcaaaagccacgcggtataaggaagtttagcgcctcctggggcttcctaccctattccgtacagacagataagcacgctgcagctgttcacaaccactcggagtctgcactgacaaagcctgtgtgcagtgtgtacctatggagggcttgtcggcttaaggggacttcacctcgtgcc

SEQ ID NO: 566 - DNA, 602 bp, Rattus norvegicus
  Genbank Accession No. AA943114
  misc_feature (1)..(602): n = a or c or g or t
aaatacaaacaaggaggaaaaaaaaacaaaaaacaagaaaaaacaaaacaaggcaccacggcccattcaagtattttgcatagatgtacaaatattgtaaacaatcaataggaggacatgagaggagaggactatttcctgtgaacaatctcccgaatcaaaagaaaattcacatttgccctggatcccagacagacatatacacagtcatacaagaggacactgggtgcatgactttgggctgctgggcttgggttctacagaacctctccctagcaggcttccctgggagaggggcacctttccagttggtgtccctggcttgtgtgtggagtccttttgggtctgtcatgacacgcatttgacaaaatgactaacctccaattttaagaatacaagtctcacgcccactttgtcaaataagcaaattcattgagcccagaggagacactgaaggattactggagcgtggcagggagctactgcaacagaagggactgttgaattgcanagagcatccagaccctaacatctacaatgttttggagcaagggttaaaaggggcttttctcttacgggtggaagtcaccaaggctanaagg

SEQ ID NO: 567 - DNA, 229 bp, Rattus norvegicus
  Genbank Accession No. AA943229
gaaagtgtaaacattttatttggcagttgtttcgggacgcgtgaataaataaatggaaaagtacatatgaatatttcctcttggggtaacagataccattaaacgcttatttacactgcaaagaacagttacgtaatgaaactttggcctaaaaaagggaacttcccaaaacaatgggctgggcaattaagggtggggattccaagaataatgggtttaacaatcccaa

SEQ ID NO: 568 - DNA, 405 bp, Rattus norvegicus
  Genbank Accession No. AA943240
ggattaaaaattcatcctctgacaaaggctttactgacaattttccatacagttagtcaaaaaaataaaataaaatataaaaaaatacagaatacagcagacagaatctcatacacggaaaacaacagtttcttcctataaaaacaaaaattctccccaaatctaagaacttagttttagcagtgaacaggatgccaccaaatgaaccacaaaaacccagcagagaatccagaccagggtaaggtaggtagaggagagcaggtgtttagaataattgcttttgtgacacagacagctggaaggccaggtgggctaggcggcgtctcttactatgactatcaccatgtgttcttcctctaacttgcccaatgtccgaagtgctgactggaggtactgctgtgagaa

SEQ ID NO: 569 - DNA, 483 bp, Rattus norvegicus
  Genbank Accession No. AA943409
gggagcgattatttattggaaaacatttacaacactgtaagtttttattgaatccagatatcacacattagatacacaatttcaatgaactgaaatggacagggaaaggacacagtgaagtaaacacttgcaacatttaaaagccgtctcctgtaagacacaacaaacttgcatcgttgcccccatcttaaggacggggaaacagaagcgaagctgggtgaatattccatatcactactgacctctgaagaggcaagaaacataatgttaattgatacagactttacttgttcaaacctgttctaaataaagaaaagaatatgcacaattctcaactggtaacaatcatttcacgggtactaagtcagttgctaacaccgggtagtaagtatgtaagcaattgaggcatggatacacagctttgcaacctacctattagccacttttcccgaagctcaatggacagtagcgtgtcgtggtata

SEQ ID NO: 570 - DNA, 377 bp, Rattus norvegicus
  Genbank Accession No. AA943440
aaagggggggggactttaatctcagcatttaggaggcagagaggcaagagaatctctgtgagttcaaagctagcctggatctacataaggagttcggagcagccagggctctataagaccttatgtcaaaaccaaaaccaaccaaacaaaacccttaactccttaactcccaacatctggaaatatgtagcggatgttcccttgagtggacagtaactggctcggggagagagaccccctcatctgcttctccacagatctggccccttgagccattgctgctgctgatctgctttttatgccatgttagcacatttcaccttggcagcactgagggaaggagtgtagccatccaaatctgaggggcaaacacccga

SEQ ID NO: 571 - DNA, 541 bp, Rattus norvegicus
  Genbank Accession No. AA943524
aatgtgaaattataattaacatctccatattaagcttttggatcttgcctgtatcttacaattaaagcacactttactgcggacttagaagcacgcgagcgccggcaagatgaattcttcatgcctctgtgcctattcgttcttcaggtgaagtccgggcggatccgcaccatcgccccacatatgctccggcggtagttgcttccttcactttactgtgctgtgtttactggtccgtggtcaatgccctggcgatgaggcttggaccacattacagcgggagaggttttccaccttcccgtccgcttgctcgcagctgggtccggatgtgtattttgctccttctggttctccgcacttgctagtgggctgcgaacaaactaaggccgacttggtcttcagaggcacgcggctccggaattcatagcggtcaactcgccccggtgggctcagaggccgggatccagcggcctcagaccgtgcctgtcgacctgagcgctcccagtcccgctcgaacatacgcaacgcgaagactgcattc

SEQ ID NO: 572 - DNA, 556 bp, Rattus norvegicus
  Genbank Accession No. AA943537
ggaaaatgaggttttataatcttagctgtggccacaacctagcagcacagagcaaggtgggtgtccaggctgctggagccacgttcccagagggttggggcttccaccctcagcaagcacgttgcataggctgctcaggccagccaagggcattggtgcagcagtgaaagcagcagcactaaatgtgacccttgggttgggggcctcaggatgataggtgatccctgcagaagaggcaagggttggtgcccagggctgggcctcagcaccaggacggggcctcagtacttctaggccatgctggggccctgggtcagggcacttgagacacaagggagggatttggaatgcagggagggtggaggcaaggactggcctctgtgggtggtccacggtggcggatggccctgtggtgtggaaggaggtccatcttcaactcaggtctgggctctagcagcgtggcacttccgacaaaggacatggccatccagagggaaacagccgttgtcatctgcctcaatggacagggcattcccacagtcctcctcgtgccgaa

SEQ ID NO: 573 - DNA, 628 bp, Rattus norvegicus
  Genbank Accession No. AA943573
cactgtaaagctttaatcttacatatttgcctcaagcatttggtaaggagatctgggagcatactgcaatccattcaggatacatccttggatttagatgaagttccccccccccctgggtttcctctgtagactatgctggcctcatcctccagagtgatggaagaatatgactaccaccatactggctttctttgtgtgaagtatcacccgagcatcctcacaagttttctatcagcagtaaaactagtctacaaatgactcaaaagggtggtcagatcccctgggactaatgttagcagtcctctgcctccatgtgagtactgggaatgagtcctcacagagagcagccatactgcttacatgctcgactctcacccgtgactgggtttcatccaaccccttcaatatctcaggtgtttttgcacattcagaatatcagaggtacatcattttgcttgtgattctgttacatatcctggactggtttccacattggcaattctgcttcagctttctgaaatgaaactgcttgtaaatttctaaaatatactgctggcttactctaatcttagagtaacttaggtacatgagtttttaactgaggaaacagattttcatttttttt

SEQ ID NO: 574 - DNA, 566 bp, Rattus norvegicus
  Genbank Accession No. AA943740
cagtgcattctctgctcatgctttattgctaacaatatatacatacaggtgcagtttcagactctcaaaacagttccttttccaagaacacaaatttcttcacaactcccaaagatgcatagattaagaagctgccgtttgtagtgcttcaaacattcagtgaagctcttcaacatcacctcatacactggtggcccaatagaatacaagggcaagtgaacagtgacacctatgcttgaagggcagaaaacgcagcactctcaagtagattactgttcttaatctttctcattaaaaggatgcttaagtttaagtaaggttaatgcccggactagtaatgttgtttacgaactgataacaccctaacagaatacttgtctgatccttgagatagggtgtcagtgatgaggactggccccagagtccaagtgttcttcaagagctatgtcctaagcacaaaagaacatttaaattaaggatacagcacaccattcccaaagatgtcaaaatgtttggaaaatcagcagtaatcatattgctgaatgatatcttgacttcagtgacca

SEQ ID NO: 575 - DNA, 519 bp, Rattus norvegicus
  Genbank Accession No. AA943748
gacaagactcaaacacaaaattatatttattttcaatgacaaaaacaacacaacaaagtggaccaatcaactaaattttaagtctacataattttcagcagaaaacttacgttccataaaatttacaaacatatcacaattaagagtctccaacctaccttgtctgaggatagcgacaagggtgaaacacagaatcacaaacttacagcacagagctttaagatctgtgcgtgtgtctataacttgattttctctttgattcctgactgtgaagtctgtatatgacatcttttatgttggaaagggtggaagctcccccaggcctagggcttcgtgtacacagagtggatggtaagtaaccaaatacatgctatagagacttgattcaaaactcaaacagcaagagccacggaaggagaggagatttcaaagactgttagcaagatgcctgtgggataattcaacaccatcgaaacagagcccagagctccctgggggaatgggatagtttgggacagt

SEQ ID NO: 576 - DNA, 620 bp, Rattus norvegicus
  Genbank Accession No. AA943766
acagaaacaacactacagcatatttatttttgcacttaatttacacaagaacttgaaataattgaggatcactccatgtcagtgagcaaccttcccgccgtcacgtctttcctctttaaatacatatgttgacagacaagagagattacatgcagtctactttttcttcaatcgcctgattgtgtagagagttataaaccatgaaactaaattgagtaaatgttggaagtctgttgcaagcagcaccataacttcctgtcacattggcacatataacagctccaaagaattttggataatatttctgaattcttgaaatcactttttggcaagctctggctggatcatctcctcctctcatatattctacagcttggtagcttggcagaaatctcaggagtgtgtcaccatctccagtggccgcagctgctccagccatgtcatcagcataggctccagctccagggattggtgagtctcctacacgaccaggtattttgaattttaaaccatttgtagatgtgccagcagcagtatgtcccgtcttatggattacaaccatgcctgcttcggtggcattcttaaaaggccaagtgttgacgaccaggggtagagggttg

SEQ ID NO: 577 - DNA, 546 bp, Rattus norvegicus
  Genbank Accession No. AA943981
acaaaaagaaaagggaacaaggaataaatagtgaccatgacagaggcagtcttgggggccaggcagaagcacaagaggagctgtgacggggggcagtcagggcaccctgagctcagagccagggtggggctcctgtctccattgctgcctccttccaagcttagtgtgtcccggaggccacaggtgtctgtatgccagcctcagtctggtcttgagcccaccccacctaaaagtatcactgcagtttaaccatggagatctggtcaccactcccaggcaggccctgccacctcctcgtgctgaggggaagcctggcagatgtccctgcaggctgtgtatggctggcatcttcaattcctacgactctctctcttgggactatatctgcattcgtagaggattcaagaggataaatcctctgagaacagtcaaccaatgtcacccgctctacagcagctgccactgtactaagagctggcagtggctggacctgtgctctgagtcaagagttgggaactgagggactggcgcaaagccagtgacagg

SEQ ID NO: 578 - DNA, 461 bp, Rattus norvegicus
  Genbank Accession No. AA944188
cacacttaaggctcaggctgctagattctctggagatgacaggattctgttgacacttgtcacaccctacaactgttgctgaggtctggtggtgggtcagggtcagcttaagtgagccagtcaggcatgaagtcttgctgagctggtcttactaacctaacctcccctcatattctccagaaagggctcatcaggattaactagtaaggacttcaggtctcagcccagaatgtagtcgagtatggtctcccaggctataccggggctcctgccttgcggggcagactcatctaagagtcgatggctcagtgtgtttcaggagacagcagcacagtagccctgcactgtgtggtagatgaactagtgcgcttcaggcttaaggtccgccagtatgcactggccacgcctggggccaccggggaggcccggaaacagcagctccaggagagggagcccttgct

SEQ ID NO: 579 - DNA, 593 bp, Rattus norvegicus
  Genbank Accession No. AA944212
  misc_feature (1)..(593): n = a or c or g or t
ctaaaatgcacctcactaaatagaataagcttgcggccgcaatgtttttttttttttttttttttttagtttcaagaatcttttattttagctttatagttctaattatgccattgtgctgttagttactgcagttaatctcttactgtgcctaatttataaattaaatcttaacataagtatgtgcagaaaagccaaatacaaaggggttcaatactgccttgggtttcaagcatccactaggggttcagataaggtctctctagattagtgggtgtcaactgaagccagccttttacttcataggtgagaacatagacatcctccagtctgggtcatctggcacttgaccattataactccttgttataactgaatcactgcttctcttccccacgacattctgaggaattgaagctccttcggctggtggcggccatacttgactgagcttgcaatctcattagtctcccagggaccacgatgtggctactaggtggagacagcgctgctgacggggctcctganggatggtctttaaatgtagcaatgactcaaagtcttgtgagtgactgcagaaccgctggaaatct

SEQ ID NO: 580 - DNA, 513 bp, Rattus norvegicus
  Genbank Accession No. AA944216
  misc_feature (1)..(513): n = a or c or g or t
aaaagaaaatggacatgaaagtttatttctagccctgaaagaacaaaattattcagtcatcaaatacagcagttaatagcaaagtacagttgattatgttagattaaattaaaaatagagggcaatataaaatttgaaaacaaaacagaaataggctacttttacccaactcaacttctacctaccaaaacaaggaaaacaaaacaaaaaataaataaataaaaaagtgactactttccaaatcctttgaacttcaaccaattattttgacacagaatgagcatgtctgacagggttatcatattttttttctgctctttgggtagcacagagcagtgaatgagaaagtcttgagtcttttaaggccaggccagtgcttgaatctgctctgaactctaacaccggcaaacacagcatccttgtcagagtggttagcgaatgcacggacaggagatggacggtgtgtggatgtttcctgcacacgtgctacangaaaacactcaaatacctatc

SEQ ID NO: 581 - DNA, 603 bp, Rattus norvegicus
  Genbank Accession No. AA944341
acatcttaacagaagtttcctctccctcctctcctccctgtccctcccctacacttccccctcctccagatctggagggcgggcctcccagggatatcaaccaaattcaaattcggcatatcaagttatagcaagactaggcacatattctcacagtgaggctggatgaggtgacccagtagaaggaaaagggtctcccaaaacaggccaaagagccaaggcagcccccacttcccaactgttaggaatcccaaaagatcagtaagctacacaaccagagcatgtacacagaggaactaggtcagactggttcaacctgtgagccccgaggggtcctggttagttgattctgtgagatgcaaacagcttttctagagtaggcactgtgggtcaagtccctgcagatattcctatatcaaagctcatagagagcagtgctggtcacggttctgactggagagagactgttgaaatttaagtagtgccttttggccgggatgcagcgcagcagagacatgacgggatcatgtgggaagtacagtattaagcaagcagagtgctgaggaatgcaggagaggcccaactcacagtctatcacccagt

SEQ ID NO: 582 - DNA, 507 bp, Rattus norvegicus
  Genbank Accession No. AA944353
ataagcttgcggccgcaattgttttttatttttttttttttttttttttttttttttcaagtttcttcagattttttttaattataattattattttaataacaacctgaatccaagaagttgaagatactgtccataccccctccctgggcagaggagagggggcacttgaagagaacaaggtgggatggtgagggggcctgccagggaacctccaaatctttctgagccatctgctgctgaggggctccccagaacactgatacccagggaaggaggtggggctgggttctttcatggatgaggggcttcagataaacatcccctcctgggttctttctcttccggcaaggcctgaggcttctggggagaccaggtgggaagggacaggccaatatttagcctcaactcccatccctgggcattggggtcgggcgtgggcattaaagctacataggaagagggggcaagctgctggcacaaggcccgggggccagtcctcgtgcc

SEQ ID NO: 583 - DNA, 315 bp, Rattus norvegicus
  Genbank Accession No. AA944383
tatcctcactaacaggaataagcttgcggacgcaaaggttttttcttttttttttttttttttttaccgatttgctttagtctatgactttgtgaaataaaagaaggtgacttcagagggtttttgagagggaggtaacaaaaggatagagacaaaattatttgagtctttatatgtttagtctttcactaaaatcacatcgatctctctgacataattatgcaccaggcactgttacaggtgcttggcctaccagagagaacaaaatcaaagcctgtgagttgtttattgtttatgttgctgtggtagaatcaa

SEQ ID NO: 584 - DNA, 542 bp, Rattus norvegicus
  Genbank Accession No. AA944397
cagcctcatcatcactgacttccttgtcacgttccttctccacaaagagagtaatggggtagccaataaactgagaatgtttcttcacaatttcttttattctcctttcctccaaatactcagtttggtcttcttttagatgcaagataacctttgttccacgacccattggttcacctgtgtctgtcctcacagtgaaggatcctccagctgaggactcccaggcgtactgctcgtcatcattatgcttggtgatgacagtcactttctcagcaaccaaatacgcagagtaaaaaccaacaccaaactggccaatcatagagatatctgcaccagcctgcaaagcctccatgaaggctttggtgcctgacttggcaatagtgccaaggttattgatcaagtcagccttggtcattccaatgccagtatccacaatagtgagggttcggtcttgcttgttgggaatgagattaatgtgcagctccttccccgagtccagtttactagggtcggtcaagctctcgtatctgatcttatccaga

SEQ ID NO: 585 - DNA, 641 bp, Rattus norvegicus
  Genbank Accession No. AA944398
  misc_feature (1)..(641): n = a or c or g or t
ggaataagcttgangccgcaatgttttttttttttttttttttttgacctttcgtgctatttgatcatttttaataatgtatgtgcactattcttatcattaaacaacaacggcaaaaaaaacttttaaaattattttttttcttttttcctttttgagacagggtctatatagctctggccggttagaactcccagtgtagaccaggttagcccggaactcccagaaatctacctacctctgcctctccagtactgggattaaaggtctgtgctaccatgcacagctgattttttttaattgaagaacacagtggaagcaggaatggagtgtcagctttagccataggtgaggagtggcattcagaagccccctatggctgtttccagtttgccagccatcatcccgcctcaggagaccttggcctgtactcagtgcctgttggggtgcatttccctccctccaaggtggagagactcaagaccaatcaggtcagcatgattaagttaagttacagagtcacagcaaaaagccacttaggagtggcacggctgcccacagcccagacgcccaccacttggagggattgcctgacatgtcaccttacggggcaacagtggtgaagaagatgtacatcttgg

SEQ ID NO: 586 - DNA, 636 bp, Rattus norvegicus
  Genbank Accession No. AA944413
  misc_feature (1)..(636): n = a or c or g or t
ggaataagcttgaggccgcaatgttttttttttttttttttttttttgctgataagaattctttttatgttattcgaataaaaaatacattcatacagaaatataacaatctcgcaaaaaacaatttcaaataaaatcttgtaaaacaaaattttacaaaaatcttacaaagattctttagataacagggtgcttcaaaaaaaaaagaaataaagaaatttcactaatagaaattttttttttaaatttcaagcaaaagtttctgcttgattgaggctcagctgtcacctgaacagaatgtactcgcttattattaaaattacaggcattgacacatacggcacccagccccacccagtccaacaacatctatgtgtttcataagtgagacaagccagcacaagtcctccttctcttctgtttaccttcttacttaatggaattgttgtggataagcacacagcagggccaaaaaaaggagttttccaaaacccagcaaatcaagtgctaggattttgaattgccaaacaaaagtgcattttccccttaagcaaaacgaaaccagttccgtagagaaatgtattcgtcaggccagatacgacaaaacaacacaacaacaacaacaaganaaaaaca

SEQ ID NO: 587 - DNA, 608 bp, Rattus norvegicus
  Genbank Accession No. AA944426
tttcttcacagcttgaactgaacacaatattgcccggtttaaaaaacaaaaaacaacaacaacaaaaaaaacaagacaaaaacagaaaaacaaaaaaaagaaaaaaaccaaaaccccgaaacattccgcaaagtccacagcctcacgcctacctgcccttgccctcaactctaggctgggtctcctgataagctctgtccctccctccctcaaggctggcgccaaggggtgagagaagagagtctcaaagctgggcaggtcccagcaaaaagcaacaagatcgccctggggggccagatgagaacagagaaaggaacgaacccagactgaactgcccacgttgactgatgtgtcccagaggctagagtcagaagcaagggcgcggatcatgctctccgctggggggtggggcaggcagggcgagggcagaggcgggcagaaagcgatgccaagtcgccatggaggggcaggaggtgcccgctgcgtgctctgcgcggcggcccacagaagtgtttattgcaggttggttcttgtgagcatggtggggctcgtctctcctctccccacccttttattggcccggcatgtttaggacaaaatcaaagttt

SEQ ID NO: 588 - DNA, 611 bp, Rattus norvegicus
  Genbank Accession No. AA944442
gaatcagccttcattgtgcaagtatgtcaccacttttgggtctgagacggccagggcaatgtgctcctgggaaatgggacccaagctgggtgggcagctgggaagctttctatgaggtcttctgagtggcaaaggcaatgggggtcccagccctctagctgggtttgctgacacagtgtaagcacaagctacctactgtggttgaataactgaagggtactcccctgaagcctctgtctgcgtggtgctggccctggggctgggtcagcttctcagccaagccccagggtcacactgggcctgagagtctcctgggagagtagagaggagaggtatcgggctgggatcagcgggccaagcaagtggcaaatcatcctgccccagtttgtcccagtccctggaggttgtgggtctggaaggaaatgcttgtgacgtgggccaggcctcagcacagaagagaggactacatagcccgaagtggactggaaacagaatgcccccggaggaggggctgcattggagcagaagtgggaggtggctagcaggacttggggcagagggtggtagggatcattcttgaacatgaggggctgctcatcaatggcgaagtg

SEQ ID NO: 589 - DNA, 583 bp, Rattus norvegicus
  Genbank Accession No. AA944449
gaagatttggtttcgtcatttacgagtgtaacatagttaaaaatagagcactctgcttgttctcggagaaggggtaaggctgaccacagctctgggtgacactgctcatgtttcagtcactgacaaagttcaggagactctggacgctcacagcaaggagtcgtttcaaatccctgggactgaggacacatgacaaacactgccaagccccccaggcctggtgtggaccccgaacacgtactgaccaaaagtgaccagccatggcttacaagggcaggacagcagcagtccccaggaggcacaggggacacagagaccctgactctgggcccagaagatgacaggctaccaaagtaagtcacaaacacacaagatgaatggtcacagggccgagggtactgagctctgccccaggcaatgcagaactggatttaatgccatggaacttgctgggtctgttttaatgcagagcaagtcaggacctccctgcccctgaggaagagcctggttagctcctgaaaccaaagatgcccttgatgtagcctgtgaggccgctcttggtcttctgctccaatttgtcctc

SEQ ID NO: 590 - DNA, 629 bp, Rattus norvegicus
  Genbank Accession No. AA944463
gtataatgtttatttaaatagtaatcttaaaaaggctttatacaaatcatataaacacagtctgacattgttttattttttacattgaagaatcacagtaaaagctctcgagttcccgtgatctggcctagccagcaaatggtcaaatacctttaaccgcacaccctggaaaagcttagtgttccccttgttttcttgtcattcatgctcattccttggaccctcattcctgtcaactccccatcctcacaaaagagagaaagcaaccctgtggccctgtggaccgcttagtccaggagagcgtggaggtaatgtgtcattcagtacaaggcaaaaagggagatcaatactgtgaattaagtttcccaaagggaacaattcaaggagatgggccagctagcctaccttcggatggagataacaaatgcgccaaggtgtcccctggctaagttagtcagacccagctatccttctttacatcttaccacagaccagcctacagccttgctgaggtatccaggttgagttgcacataactttagacagggctggtctttggagggggaattatggtaaaatggtccactgggcatgtgagggccaggacctgcaaagtgggctcttctctc

SEQ ID NO: 591 - DNA, 570 bp, Rattus norvegicus
  Genbank Accession No. AA944481
aagggatataagcttgcggccgcaatgttttttttttttttttttttttgttctgaggttgtttttattgtaagaatgttgtgagctgtgccttggaaccacagttggcacctgttcatccacagcacccacaagagcaccattgagtgtatccagggctcctgggaaccctatctccagtcggtcaatatgaccgagtccgccattaagggcccagctagttggactgaaatggtccctctgcatctccaacttctctggtaggcgagaagtgagagtcaatgccccttgagcccacgttttctgggtctgggccatttgtttcctgttgctctgactgtttcagacaacagtgcttgcagaccccaacacggaaaaggggtcctccagtcactccagttatgggcttcttctctgtccacgagactccagatagccctacttagagctcctgctctcagcagaaaacagccatatcttaaggtcacaaccaaagtcactgtcttcttaggcctggaaccaggctccagtgaggaggctaggaagctgctgtaacctccatgggctgga

SEQ ID NO: 592 - DNA, 479 bp, Rattus norvegicus
  Genbank Accession No. AA944493
ctcgggcgaccgggggcccggtttgtatgtagagagatgtataggtgtcaggcagaggcggaggtgccagtccgggcttgagaggccgagccctcgagggcgcgggcgagagtgtgcgtggcttcgcaggatcattccccagccgcacttctgcagccaacttttaaggagagcggttgttagcgccagcagttggtgtttgctttgcacttcggaacctgttgcgttttgacccacggaggtggaggagaaactttatgacatgttgggctttccagttttgttggttggattttgctttttgagtttcatccttcctctccccggtcccacttggtccctgttgcatgcgctcggttctgatgttcggtctgaaatagctggccaaggggagagccggtgtctttagcctcttagagtagggtggctcggggctgccttactccgcgattataccttgaattctgcagacctctgca

SEQ ID NO: 593 - DNA, 522 bp, Rattus norvegicus
  Genbank Accession No. AA944498
catatgcaaaatcaaagagtctttatttaagctccagctcagaccctccaacttctccagaacagaaggtatgaaaggtgcaaggagttggtacaagctttgcttaattatcatggtaacaggatgagagactttccaacttggcagttacatgattggttgatatttaattggcacatttctattggatagtaatgatttcagcttggtatgaacaatggttgctagcttaatcaatctactttagacattaggtactttacccttaagaccggattggttattgctacaagaggagtggctatttgcccaggagaattgtgaatgtcgccagggtgacatggcttctgaacaagttggcatttttccagttgctgatttcattcagagggcaagttaatcataaaacgaagtccagccttagctcctggtaccacgttccttacatgcagatcttctctttgggtcctaacaccagtcctcttcccttgtcctttcaggccgctgtgttcacacctgcgg

SEQ ID NO: 594 - DNA, 597 bp, Rattus norvegicus
  Genbank Accession No. AA944556
attacggggacagatacatgatcaatgccttagtgtaacactaaagaatatcatatttgtaaggaggaagcatgatgctggaaagtgtgaggaaataaaccagcacgaaggagggacaggtaaatgagtgagcaagtaagtatcgagtgcactcgtcatgcttcgagaaaagagaggttcttaaatgagactcaaaagaacttaaggcatccatggtaagcgacaaagggattaataccctgtaaaaggccaatagactctttcctaataaaacctgctgctacaaagtcacaaatctaacactccccagttactcagaacccaaatcatatataacgctagtgagtactggctactttcttatcaactgtgagttataggcagataccagatttattacttatttgcttttgagaaacaattttccacccagcctaatgggttataaattgtctcatttgcagctgtttaatttaaaccagaacctcagtgcttgttaaacaagaacatgaggaatgactatgtggtgtgatgctaagagcctactgttaaaacggttatttcattcaaggcaaggcgggttgggggtggggaatc

SEQ ID NO: 595 - DNA, 325 bp, Rattus norvegicus
  Genbank Accession No. AA944786
  misc_feature (1)..(325): n = a or c or g or t
acccactcttggggctacatagaatattttaccattttaacacatagaatatagcgcatacatcttgaaactactgaattaaggcaagcccctgtgagttcggtactccaaaaaccatgttttaccaaaaaaagaaaaatgttgactcaaaccagtggctttagacatggggtacccagtcaatcttcacaacgggagtactgctaactgcccccattacctcccggctctctatacatcagaagggaagtttctagtttctgtaactcaagatgggtggattccatgtgggcaaagtgtgtggggtangggagcagggctctgt

SEQ ID NO: 596 - DNA, 400 bp, Rattus norvegicus
  Genbank Accession No. AA944803
ggcaggacatggtactcttttattgtgacgctcagtggaaacatctgtaaaccagcttactgtagtggtgacagctgcaacacatgctaaggcacttgtattatataaaaaaggggtgcgggtcccactcactcctgtgacagcaactgggacctgaattcagagcttttctagcatatgtagcttcatgatttgactgtttctcctttaaaaaaaaaaaaaaaaagccttcttgccatagggactctaatcacagcatttataacacagtgaggaggagcacagggaaactcagcgaccagtgtagaccattgtagggcaggctactctcttctaagcgtggctccaggggcaaggctgtgaggatccacaactagagcgcttactacaagaagggaaa

SEQ ID NO: 597 - DNA, 472 bp, Rattus norvegicus
  Genbank Accession No. AA944818
acatgaactgaagatgacacaggaacaaatcctttactttccaaattacaaagaacacagagcagtgaatactgtacttgttgaacatcaggtccacttgatctttctcagacaggggagggcggccaacaggagatggtaattctagtcatttccagacaaggtagaaaaagacatttcatcccttttctacttacaggccaagcacagagcaggaggaagaactgcttcttctctagtataccagcattcaccagagttttcctattttgtttttaagttcaaaacaaaacaaaacaaaacagtggtcctaaactttagtcagtgaagtggtgaagatagactaatttggcaagcagaattactctgaagtcatggtagcatagttgtgcagaggcccgtcctcccttaacagtgggatgaaagggtatgggtgggagtaagaacaaaacttctacaagcctgaaaccaa

SEQ ID NO: 598 - DNA, 300 bp, Rattus norvegicus
  Genbank Accession No. AA944828
  misc_feature (1)..(300): n = a or c or g or t
ggggcagtcaaatcatgtgtttattgagtgcctgttatgtgctaaatattgttcaggggacgtgggacccagcagaggacacggggagtcctgccctcgtggagcgtacagtctattgcactgctgtgaccttgggcaagtcactgcacccctcgaccggcccagcagatagacctggacgtggtgcagatgctgaccaggacagcgctctgacccaccaccccagacagcagagagggctgcaggttcatctttaataatcaagtacacgggggattannattgtttggntatcacatg

SEQ ID NO: 599 - DNA, 428 bp, Rattus norvegicus
  Genbank Accession No. AA944840
cctcttagaaaatgactcaccaacttgctagggaaaaggctcttcctccgccagtgttttgacttaaagggaggaacagctggaggtgaaagaaagcactgaccagtccttggaaaacaactgactgggcatcagtggacccaagaaaatccctcagttctgtgattcctcaccatcccaactgacagcaaaatcagcagctacattcaagaccgtcttccaagtagttcatgactcacccaaatacccacagtcccctcacccaccccccagggagagaatgtggacaggaggtgggtatcactcaggcctttctcatgagggctgctagtcagagccatcctcagtgagtcagtccttggaaggtgggctcagtgcccgggggcaaggccatgggctggctcagtaacttgtccatcatgctgatt

SEQ ID NO: 600 - DNA, 605 bp, Rattus norvegicus
  Genbank Accession No. AA945069
cccaaagctggttttaatttccaaaaattatgaggtctcttcccacactggggataataggatgggatagcccagactattatcccagtccaacccccagcctagcccaaacaccattgctgtctctgggtcccgtcatttcaccactgggagcttatttctaactccctcactggccaagacaggtggatggatgtgaagtttccaggactcagcactgtctctccaaagtgaccctgggtctcctctgtgaggggaagccatctgtgtcacgtcaaagtggattggtgtaaccaccaggctcaactcagatccaagtcaatcatccctgggtctaagggtcagcgcccaggtcctggtggccgttccagtgcctgtgtgcctactagtacatccatgaggtagtccagctcagcctcatccaactctggagtttcctccttggctgggccattctcagggacaggtttgagaccctcagaggctggtaaccaaagttcactgtcatacatggaggtatcaatgtcctcaaacaaaccctccagtccatcgtccaacagacagcccgtggctgggcctagcaagtccaaggcacccaggttggg

SEQ ID NO: 601 - DNA, 618 bp, Rattus norvegicus
  Genbank Accession No. AA945100
acacttctatgaagacaagagcatttattaatttgaaagcatatcatctttaatacaaacatttatagactgcataacacattgcaattaaacatttctgtaaaatagagtttatttattagtataaccttactgtataatatagtattaggcaagaattgaaagaacgtaatgagagaacagggttggatgatgtcaatgttgtcaaatttgtggattttacttttcactatctctctgtttggacttctacaccaactttaaaattccaaatgtgagacataaatgcttgtgtggaagtatgccatcatcatcatcattcaagcactgattggtgttattttaatgtggctcagtcacttattgagatagaaggtggcccactctgcagatattggagatcattagcatgagcatgcgggtgtgaacaggagtgttgctctctctaatggggaattgttcctcagggtacatctgactgcagagtgaagtctcagatacatacctgggttaagacagtcccatttaatatgtagagagaaatacatctttataacacatcttttggattgcttaaaaatggaagtgaccaacagctaatctggagtcagaatgagt

SEQ ID NO: 602 - DNA, 643 bp, Rattus norvegicus
  Genbank Accession No. AA945172
atcagaaggaaatactgtaatttatttactgcattggatctggattttgaaagttttatgaacacttaaacaatctaccttaagaatcaaaaattagaaaatgtaacaaagtcattaattatattttcctttgtatattttggtggtggtggtgtttgtttttgttttttccgagacagggttcctgtgtagccatggctatcctggactcactctatagaccatgctggtctcaaagtcagaaatccagctgcctctgcctcccaagtgctgggatcaaagttgtgcgccgccatgtctggctccctttgtacgtttttatggacttaagattttccctgtcttgtaaaaatagtaaatatggcttgaaaaatacatactattacaagatgttttaataaaggacctatattaattcatatatcatttagatttccatgattcaagcatactaaaatattccaagaattaagattaaaaaaagaacaacatccgtttttgtctttaaaagattttcattcattcaaaaattttgaaggctaactatccaattcaagacagaaggaagaatttctgagtgtatgaactaagaactgtctttgctgaagcgaagtaagaactcaatcagagtccttgtgggtct

SEQ ID NO: 603 - DNA, 646 bp, Rattus norvegicus
  Genbank Accession No. AA945181
gtgttcagcttctcatttttaatatttggttaaacaaaatacatctttgtaaacaaacccagcacaaggccaacaaagaaagggaataaagcaagaaaaacaaagcctagggttgcccttgctgggcatcagggtcaggatgccccttaataggaatggggctttttgcccttgggcatcaacatgggtccctgttcctaagcaccagaattggatatgaacagaaccagccctgaaatgcttaggcatctttatacatcccaccagctcatgggctccacgtgcgtgggactgtttgcagtgccatttgcaaaggcccaagcagatctgtagggaggagtctcctcttcccaagaaatggcttactctcaccgacagtgccaatggaccaaggtcctgcttgtgacaatcagcaaggtcggctgtaacttctggctggtagtgattggaatgtcattgtgcaggggcagagttagctccccgtggtgccaagcagatctggtgtagaaaatggtgcagatgaccatggctgagcgcaatgcagtagccacttgaggcctctgctacttgaataaaaaacggccttgttggattgaagatacatgtgcagaaaaagtgctggggtaaacatgcactccagtcacaa

SEQ ID NO: 604 - DNA, 505 bp, Rattus norvegicus
  Genbank Accession No. AA945591
  misc_feature (1)..(505): n = a or c or g or t
gtaataaaaattagtttattgaacaggttggggccagctgtggtcgtatacacctttaataccagcgctcaggaggcagaggcaagtggatctctgggagttccaggccagccagggatacatagtgggacggtctcaaaaattatttgaacaggtacttgagacatgtgagatgatgatgtggacagatatgactagcaccctcaggtcctccccagggtacagcaaaaataatcacaaaccaacattctttaatcagaaaggcacttgagggcccctacagagtcttacacaagagcagccctgcggattcccactcagccaccctcccttcccatccggctcagagttcatcgtgacctgtggagggatctgctccgggcttgatgaagattccttccatggccttccacgtgttgtgtgcattggcactangcatgccatgcacctcatgctgcccacggattgggttaccatactgttcaacagtaactgacaggaacac

SEQ ID NO: 605 - DNA, 615 bp, Rattus norvegicus
  Genbank Accession No. AA945601
aaaacaagtttatttattgaaagaatctgaaaatagtaataaggccttcattaacaattaacaaaattttaagatattaacaatatgaaacattaagaatttacgtgaaaattccatgtgtttgagatcagtctggtggcagctgcttctgtacttgtcaacactcgctttttagatgcatggactatgcttcagaccttgctctcctctggatcatagcagagcctgctgtgcgcagtcacagatgaacagcacaggtgaaccgtggggatgagccaccatggcttaacagcactcaagccagaccacttggggctgcacgggtgcccagtaggtcccaactttaacaggtagaagaaagctcagagtagtcggttctatagcagctgacaaaccttccctagaagcatgagacaaaagcctgacttcacctggaaagccagtcaaagaacaggcagtcctccctactcctgccgtaagaggtgagcacaaaactgaaagcggatacctagctgaggtgctggggccgaccactgaccccacaaaggctccagggccagtgtggcactcacgtgcgttacttgcactacatacatgtgttgcacacaggctcca

SEQ ID NO: 606 - DNA, 437 bp, Rattus norvegicus
  Genbank Accession No. AA945636
cacaggttcagctctttattggacatgttaacaaaagcagtttagtcaaaaagaccaaagcccatgtcatcctcggattcttcagattcttccttctttgcttctactttcttctcctcagctggggcagcggcggcagatggagcaggaccaccagcaggcgcagccccagcggctggagctggcccaccagcccctacattgcagatgaggcttccaatgttgacattggccagagcctttgcaaacaagccaggccagaaaggttcaacattgacaccagctgctttaatgagagcattgatcttatcctccgtgaccgtcacctcgtcgtcgtgcaggatgagggcggagtagatgcaggcaagctcacagacagaagccatgttgtggactgccggcacggtgctagtcgccggatgaaatgagggcccctc

SEQ ID NO: 607 - DNA, 451 bp, Rattus norvegicus
  Genbank Accession No. AA945643
  misc_feature (1)..(451): n = a or c or g or t
cactgttaagctctggcactttattgagcagctgtggaattagggaaaggaaagtgggacagagagacgattaagttcctaagggaaggtttcaagttgggctttgcagaaggtataattagtatggtccctgaatcctgtaagatgtgtgcctacttgatgctataacttgccaaaattggtgtcctttggtcgggagagataggggaaagggagttaagagccttgagaatttgcattcgttaacagggatgacctgtatctatctcacacggtgactttcacaatcccaccgtcctaccctatttccctgttcaccaggtccgagcctgctgtggccccctacacaggttccaagggagggaaactgacacccagtcggnggacttagcattgcaagtgaccagactcctggccggagggtggggggagcatgtgggaaaaggggagc

SEQ ID NO: 608 - DNA, 450 bp, Rattus norvegicus
  Genbank Accession No. AA945679
ctccggggtcccccgggaggcgacagcctggggctctccgggcgggggatccaaatctgctgcggggtggcggcgggcctcgctggcccgagccggcactgctggagagggatagcgggcgggcgggcccgtcggcgtgagtgtgaaccggtatgcgctgggggtggggtatgcacagtggagcggtgtgcagaatcggagttgcgagccaaaggcctttgcagcggcgaccccgggcgagccgactcagcgcgggccgcctcccgcgcacgctcaccgcagagttcgtactgggaaagagttaaaaaataaacatttacaacggcaaagaaagcggcttcccctccctggcgtccccggacgcgctccggggtcacggctgatccgcagccgggctacagtcccagagagtgaggggagctgatcccggtagtctgggcgcctgggggc

SEQ ID NO: 609 - DNA, 520 bp, Rattus norvegicus
  Genbank Accession No. AA945704
caggtttagcatcagtctttaatgctgtcacactgcataatgacaagtcacacactttggtcttgtgttggtagtggcaacttacaatgagtcgaatggtcagagcaccaggctagctccaaagaacagatccattccctccccaggtctgactcatcacagccctggacaggcagtagttgacagggactgctttcatccaagtgcacaccagctttgcatggaattataaaaacatatttacatacgttccacggtgctcctttcatcagaagcaaaggcccttttatcaaaagggattatatctagggctgtgcaaaattcaaaaggactgtatccttttgagaaagttgagtccattacacacacacatacacacacacaaaaaaagtcacctgcacctctgagaagtgccaggtgtggccaagggctacctctggaccagcaagtactgtgactgtaaggcagccatctgatttcaagagagccacaggtccaggggatctcctggctgtccagg

SEQ ID NO: 610 - DNA, 588 bp, Rattus norvegicus
  Genbank Accession No. AA945712
actaacattttctatttattcattaataaaaagtgcatagtacaagcccttaaccccaatccaagaactcagtaaaagattaacaccaaaggctagatggcatgggctgatttgtttggcatgattcaaacattgagaaatagtacatcatatgaccccttttcctttaacaaaataatcatgggacaagtaatgatacacaggattcttcactgagaaatgtaagactgttcctatcttctattgcaacaacaaaatttaaaccatttgtcattttccttcttcgagttgctgttttgtgttttaaagtgagctggtcaaacttaagtacaaaatcacagagagacaaactttcatttagaatgacagacttacacaatccctttaaagtctaagatattggtaattccataaatgctatcacagacgctaaatgaaaccatggggcagtgctgctcaatggctactctggagagcctctgtacattgtaaagcatgtgctctgaagcgtgggacagtgtttagatacatggtaaaatcatttgttataaacagccccgatgttaacctgtcccatatggaaaacag

SEQ ID NO: 611 - DNA, 620 bp, Rattus norvegicus
  Genbank Accession No. AA945737
caagtttaccattgacttttattaacaacataatacaagactgtacatttgtaggtactgaaatcaatccacccttgaaaactgaaaaaaaaaacccagcatttctataccatttcaggctttggttttaagtgccatcttctacagaagaaaccacacagcacaaccaaacaattcaggaacggggtgggcggggcgaagagattatgcagcgacagctgagggtcacttctagctttatccgatttaccacacattctggagcgttcagttccttcctctacagctctacagtcctacacacagacacacagcgactaagaacttggccacaggtcctgcctagacactcattcacgtgaaacagacaaacaacagaaaaaaaccaatatttatataaattaagtcaaacctcacacacacacacacacacaaaaactagagaaacataaactccaacagtcaataaaaaaaactgtacaagattggtcagtcttttatatctgggaaatgtgtaacataaaaaaagttctttgtcatatatatatatatatatatatattatatatgtctttgcgtaagtgttagctggagtgaaaacttgaggattctgactctgt

SEQ ID NO: 612 - DNA, 622 bp, Rattus norvegicus
  Genbank Accession No. AA945750
actgcattttattcatttatgtattgtgtgtgggtgtaggtccgagtgcccatacagaggtcaaggaacatctcggaagaattggttctctcctcctgtgaattgaactcagatcatcacgcctagtggtaagttcttctacctgctgggccatctcggctggcacaagtaatcagcttctcaccaagagctaagaatatatatttcacttgtaatttttagtttaaaaatcttttgtttgagaatctcataggtgcacacaatacaatacattttcatttgtagtttttgaaaggaatttgcttctaagtacagtaaagtgtcttaaatgtgaatgcatattggcgaacttttatatgtatgtgtatgtctatatgcttgtgtgtgttcaagtgtgtgtagttgcatgtgtgtgtgtgcaggggtgcatgcaaaagtacgcaagcatgtgtacgagggtcagaggtgaggctctggtatttctcctcaggcattgtccactttcgttttctgaggcagggtctctcattgacctggaactcattaaaacagacgaggctggccagggatgcccaggaaaccgttttcatctccctgcccagtgctgggattacaagtgcat

SEQ ID NO: 613 - DNA, 488 bp, Rattus norvegicus
  Genbank Accession No. AA945878
cagcttggggatggggaagatcgcagaactcaacagagctggagatgaggtcagacccaagaacactgcttaaatgctcatgcatgctggcctttcaggtatctcatggtactgcttctgatgctactgtctggtgctagcactgccacagaaagggggtggaaggcagaacccaacaaggtgactttttcctccacaccccaagaggaaggctctaatgggaaactgaggaagaaatgcctggctccttgctgctgttcatacactgtttttaagcacttttttaacacggtaaggagcttatattccagagaaagacttctcgtattctgtttacactgtatttctttcgctttgctttggtcttttgagtgaggttaattatggctatataaaaagttcatcaccaacagaagtttgcttatgttcttatgcctgtgatgctgcctaaaggccataattaacctcactcaaaagaccctcgtgcc

SEQ ID NO: 614 - DNA, 598 bp, Rattus norvegicus
  Genbank Accession No. AA945898
ggggattaaaaagagttttaaatacaatagtatgaaaatataacttaaaaatataaaagtcagacagcatagggaagacttaaaaatctgtttgcccgttagacccataggtactttgtaggaaactaacacgtactcaaaaaacagtaacactgtcgcagcctgtgagacaggcttcagaaggaaagagttacaaaagccggtttttgagttaagaaaccattcctgttccaacctgggtcaaccagcgactgttaaccccaagcacgtcgcgtgtccacaaggcctgcagcctcggcaggagaacccaccacagttctgtgtgtgctctgttttcttccaccatgccacccggtcagacataggacagggggtctcacgaccccccaaagggacgacaacgaacgaacaaagctcttcgcttgcatatttggtcagtgtttgtagtgcaactgagcgggaactccagctgcccacagcccctcaggcaccggtcctcttccctcttctcagtcacagtagtctggggcgggcggagagcatgcagagacagcaggaggagtggaggtagaagaggaaggcagaggggaggggaagc

SEQ ID NO: 615 - DNA, 536 bp, Rattus norvegicus
  Genbank Accession No. AA945910
tgcagctcaaggtggcctggagctcgtagcggtaagcctatctccggccactagagcagggcttacagttgtgcagcaccccaagtctggcttccgtttaccccctaaggaatgtcatctacactatcttgtcaacaacactaaaacccccatcatgcatcaagactcagctgacatgctagcctgtcttcaaataatcagtaaagttaaaacaatcaaaaccagtcgtctttcaattttactatcaacagctatcgaaaaatgtttacaaaacgcaagatatgggggtactttagaagataaattacgaaatacaaacaagaatacataaacctttgtcaacacaaaatagaaaattatttatctatgtcttcaaatacatctctctacagcatttatgacaatctattgcaaagtatctcatatattttatagtgatcactttgtttttttggctcattcccaaagtcaattctttgacagactaaatactgatttgtacagctataaagagaccctacttcttaaaataaaga

SEQ ID NO: 616 - DNA, 441 bp, Rattus norvegicus
  Genbank Accession No. AA945932
agaaatgagagacagaatagccagagccttttggaacttccaagatgttcaaaatggctacatctctggggcagagaggagaggggcaggctgtcaagagccagggctactgctcttgggagcagagagaagagcaggagtaggaaaaccttatgggtcatacaggaaaacagtagttgtaggagggaaagggaatcctctgagctggagcagcctggaatgaactggggaagtctggaggttagcatgcaccagagatacttgttaacaggcagcctgatgcctcatctaccagaggaaggagagatagggaagtggctttcctgtcagacagacagaaatctgttccacaggttcctgaggaatagtggatgtatctgccagcagtccttctgtttttcctccagaatccacccctgctgaagtcaaatatagacagca

SEQ ID NO: 617 - DNA, 469 bp, Rattus norvegicus
  Genbank Accession No. AA945986
gtttctcttttattgcaacccattgcaaggtcaaaagattcacagaaatatagaaactacaaactgggtagattttctttattcattcaaaagggcattaaagacaaagggccggaattttccactacagcaatatatttcataggcttttttctgaaaatactgttgacatttggagaggctaaaaagccctgcattaaatgtgttcacatgtatttatgacagtctaagaaaaaaagggactatattgcccagaaaaaagtattttaagcctcatttcaaagcatctaatgagagcacatcccacaacctccccaggatcacttgaggtgatgcttttcctggctgcttcttttaaaagattaatgctttgaggctggatatgatatttctacagatttctacaaatgaaccaaggcagttttccgggttctgttgcgtcagggtttctgtattagtcagcgtcttg

SEQ ID NO: 618 - DNA, 489 bp, Rattus norvegicus
  Genbank Accession No. AA945996
acacaaaacagtttttatttgatgaaccacagtgactaacaagatcaggaaaaaaaagcgcattctgaaggtgggatgggggtggggaagagagcctgcctccgctgctgtctgtcccagtcatggttgagattcctgtctcccagaagcctcctacagcctgtactggctgctttgaggatggcctggcagatgaagacgctgtgtgaaagtttctggcctgagacatgcagagctcagctaagaaaagctgttttctccatcccccaccaccacaacccccttttctgccccaggagcaggatccctgccagagatggtccaactgcatcaagccaggctcttcctgtccaatggcacatgtcatgtccttggtttccagagccctccaagaacaaaaccggaatacacacacccatttccagctcacagaggccccgctattaatttgatccctgagagcccacaacggcttcagtcactctttca

SEQ ID NO: 619 - DNA, 454 bp, Rattus norvegicus
  Genbank Accession No. AA946040
aacctttccagtgagtttttattagtagttgcatcatgattcagggtcccagggtagggaccatcatatactgaggtcccccttttctatcggggagaaggtcaaagagcagaggagaggtgggcggagccaggtcagatcttcccaggaaatgtgccttctgctatgcggtcatcccaggctgagacccatgagacggggcagagggacttgtacactcgccggtaccactcgcacacggagacgtcaccgccctttgccgtcattgccttctcacagcggtggaagtccaggtagttctgccagcagttcttagtctggttctggtttgggaagcggctgtcaaagggggcggttttgtagttcttgattttagtcttgatgtcttcggccatcctgactcctaaagactgtcccggagcagcgttacttcaatgtgaccctttgcaaagac

SEQ ID NO: 620 - DNA, 629 bp, Rattus norvegicus
  Genbank Accession No. AA946046
gagaaagtagtaaagatttttatttgtcaatacaagataacacaaataaattaatttttacaacaatcttagactccagggtttctctatgaggttagctcattatgtaaacagactactatctaaaatgatcgagcaattatatgagtgttcaaaaccaacagaccatatccttccccctttcctcggtaatgtgtgttacagaacagatgaggttaacttggtggaaaatggtctcagtgttatcagactacagtggcaccaagttcatgtgaacctgtacctgtcatcttcttctctaacagagctgaagtggttgtcacacctgcaatcccagcactgggaggcagagatgggtacatcttctgactgagtttcaggctagccacggctacaaagtgagacatctcaaacaaaacacacaattaaaacagcataatatccaggaactaggggtgacacgcagtggtagagcacttgcctagcatgagccctgtctgggttaatcttcagtgatggaattggagtgggaaccatttgccagtatgaaaccaacatactgaattagaggttaaagtgcgaaagagaagaggctgcactcaaagcaagcagacctgtggatctctgta

SEQ ID NO: 621 - DNA, 598 bp, Rattus norvegicus
  Genbank Accession No. AA946063
tgcggccgcttccatttttttttatttttttttttttttgttcttggttctttttactttgtgaggagagatcacagagctcatgagtggttcagtctggatgtgcgggcgactgtcccacaggtgtcggaagctgccgagtctcctctgtccccgcagtggtaacagactgccacacctgcgctggcgacgatgttacaggatcacacagcagttgctctcaccagttttctcccggtttctctgaccttgtgaattgggctctggcagggtctctctggccaccaaatgcatcactgttgttttgccaaaaggaagttttaatgctcctagggtgacgtttccgtgtagaaatctgccttgataaatgagtcgaagaatgttcgggctgctgacctgctcttcttcccagtccatgggccagttgtcatacacgtgctttgcgatgtcagaggcagagtcgtttggggagaagaggaactctttcgtctttccactcaccaggatgaggcgcaaattaatcatatccgccgggacatgactggacatcttgccttttgagagtgggccataggtttacgcacaaaacatgacaagg

SEQ ID NO: 622 - DNA, 420 bp, Rattus norvegicus
  Genbank Accession No. AA946072
aaaaagactaaaaatatttattgtataatgagcattccattccacatacatgaaatacagcatacaggtatctgggatctacacagcctcttggttccaatgttctatcgtctgcaactgtcatttcatcaatactgaggatagttctgaagtgttattaaaccagtaagaaatacttaggattccatccattactcaggactgcctggtcagctacgcatactacagctaaaataaaaaccatctcctcctctgaagttgctccagggttctttggagtgactcctgttgcagcctaacaaccttatccggtgagatacttattagaagcaacagtgctagcaggtgtgatctgggaccaggctctgagggacccttatcctgcttcaacaagaactgaagaagagtccccaggcctaa

SEQ ID NO: 623 - DNA, 239 bp, Rattus norvegicus
  Genbank Accession No. AA946203
cagagatactttattgacacgaacagagagactttattggaaccatgggcctgtgcacatttctacaggcctaagaccaaggggtctagctagagtctaacctagtacttgacacagagagcgttgagtcaatgggattggatggtcagaatgataagcaggcactccaaggtcctggtcacatacatttgcagtgactgggtgaagtcacagaaccagggctttttcgtcctcgtgcc

SEQ ID NO: 624 - DNA, 574 bp, Rattus norvegicus
  Genbank Accession No. AA946224
agacgctcacagacacaaaccaggaacacttcgtgcctgatgatagaatgaacatctctaaacatccacgagatagtcattaaatacgcattgttagacatctcccgggaaagaaccacaataccaaagacgacaacagccccaccccagagacaaggctggcaagagtgtcatgaggaacattactgttgatttggcaacagctacaaatcatttggcattatgtattgaatgtacatacgcttagacacagcaattatctgtctgataatctatcttaactaaataatgtagaagggaaggggtttgagaacgtccgagacaggtgatgcttacaaggaaggggacagaaggcaggtgaacccggtcacagggtgttgtgtgccggacagtgtcacctgtggggacgaggtgacagaaagtgcttatgagaaaaggagcgggaaagcagcatcgttaggtaggtttgtgcagctgtaaagtaaacccacatcttaaggacatgaaagctaccttttacggcccagcacagagaaagcgaacacagacttgctgacttgcactgcagtgtgca

SEQ ID NO: 625 - DNA, 490 bp, Rattus norvegicus
  Genbank Accession No. AA946264
gtaaattttactattttatttgtgaaaaaactacaagcagaattcataaatagacatttctatttaaagcaggaaaatgataaagtggcttctaataacatagtcgtgcacatgccaataacaggaatatattaacagcttttatttgctagacaaagagcagtgtccaatataaatttcccccaaaacatttaagacctgtgaatttctgaccagttcacaagaccaccgacactttagcatgaagagaaaacaaacctaacagactgtcagctctaagacggacggagcagaaacttccaaagcgttatacaagccatctttctgggcaaatggaagatacagctcgtataagagattaacaaaagttcacaagggaagattatgttctgacatacttaacaggcattcgctatctgtctccaacatacagagctaagggaataatgtaaccatctttacacagtaaattaggttacaagtcatacac

SEQ ID NO: 626 - DNA, 481 bp, Rattus norvegicus
  Genbank Accession No. AA946275
aacataagcagcgacatttattacatatgaagtaccagcttgaaattcaaacccaacacccaccctccaaactcttgaccgagagctttcccggtagacaggctctctcctctcgtgacacgttaagaacaaacacataggactgtgtacacctcaatgcgatgctgaccatggctcctctcactgcccgggccccgaaagactcttgttcatgaactgtctcttcacaaagcaattccaccacttgcttgggttatcattctgagggtcaaaaactttgtcacaaagcctcagtccggtctcttgcctcagctgctgtaggtacgcgcgcatcgtttcatcctcctgtttgctggcaggtttggcgtaaatggcgttgaggggaaagccaggctcgccaggaatgggaaagttggtgattcctaccgtgtacatttctttctcgccttggcttctggagttgcacttttggagcttcttt

SEQ ID NO: 627 - DNA, 476 bp, Rattus norvegicus
  Genbank Accession No. AA946323
gtggaggcaaagcaatactttattacatcctatatggcacagcttgaatccacagctggatctaaagaacttgtctagcaaactgcagtatttataacaaatttaactacttattttactgtataaataaaaatatcctcagtgaaaactacaataattggagtagaaacaataatcagtactacagagctgtgtgggtgaagcgcatttcaacttgaattgtgtcagtgcaggttcagtggcaggcgttcgcagcagcttcctgatttgtagtgtggagtaagagctttttaaagtcttgccagagccacaagtacatgctctatgtactgctcttgacaaatagtaggcttcctgtgaagttttagttaaatagaattatttaccagaagaaaccatggttgatgaacaatgagctattacgagatatttaagagttatctagacattaaatgcattttcacagttttacatgt

SEQ ID NO: 628 - DNA, 606 bp, Rattus norvegicus
  Genbank Accession No. AA946362
ttttttttagtttttttttttttttaacatggattatttttattacatactttattaaaaacatccaaagcacaaacacacatgccccaccatcagggagtgttaagaaccctagattctccttttctctcaagttatttagatcccagttacaaaaatggagctgtaaggatgtataaagacatcaggtcttctcgcttgttactgtacaagcatctgaagtgatcttgacaagagggcgcaaaatctacctaattaaagaacagagtgtctaccaccagcccacaaacagttcccatgtgttgtaattcgaacctgacatgtctgtatgggcacaggaaatattgagacagacaagggccaggctattgcttctcaatcccagaaggcacacatctctataccagttatcagtcattcctgacatctataggagaatcattagattctacctactctgaagtattaaatgcataagaaaaggattaattatgtccaagtaacatgcaatgaaaatatttttaaaccaacatggttaagtgttaacatttttagaaatcaacatatttattcacatgactttaacctagtcaaagctatttcttt

SEQ ID NO: 629 - DNA, 562 bp, Rattus norvegicus
  Genbank Accession No. AA946415
gcaagttaaaataggtattttattgagaaacgtgctgtcagtgagaaagtaacatacaaacatttcctttaataaaattagcttatccttactcctaagagcatggctaaacgcctttatcatctgaaactgcgagtcactctgatctatggttctctcttagagcctcccacagacaatgatgtttcagattccacttgtgcaaatgaaagagcatagttaatatgggttattcataaacagaacagattccctcgcttgaatttgagttgcccgcatacatgtgaattttgtcttgctactggaggctgctaaggcgggggcttatgtgtactcctgggccctaggagtacagtgtgagcgtgtctcttttttcccctaagttttatggtgctatagttctacctaaaacatcccgcttccatgattgtaacataaaataaacatcatttctttttatatacactaggcttccatgcaaggttttcttttaattatgtatttgcgacattagaagggccagggcactaaccctataaataatttcctaaatggcttttat

SEQ ID NO: 630 - DNA, 575 bp, Rattus norvegicus
  Genbank Accession No. AA946432
agaagtcattatgaatttattatttacacaattgttaaagtacacaaacacagtggtagtacaaacgcacagctcagagactgctcaccaagacacaggttgatacacacattctaactacgcttcctgcgagggatggtgggattaaatattgggcaagaactgtcagggccacaccctggagacttccaatgggcctaatctgagcacaacccaacaaagccaggctgaacctggattagtctcaagaccaccctgtacccctccagcaccacaggtatctacaagaacacttgccaggcaggcctgccactggagagggaagggccaactctgataaagaatttgcaacaaagatctcaaactcgcccgacccccccaacctccctctgcactcctcgacacacaatcccaccgagtcaagtctctccaccctaaaatgcttgcagagtaaccagctcaggattcagaaagcacccacaggctcacgtggctggcaggcacaattaacagccacattctgggatgctatcacacatcagcagtgtgtcccccaaccttgggccagtgctcag

SEQ ID NO: 631 - DNA, 616 bp, Rattus norvegicus
  Genbank Accession No. AA946439
atgttgcatggtgactttattgtgggtttccaaacctgaacaccagtcctcattcaggtccgctttgtcctataggaacacgaagcttcaactttaacttgaagagcatccgaggctgtaccctacaacgcctaatgggacccttgcagcctggcacgcaacattaaacgcctccgttaacataatcagcttggcatacaagaaaattcattcgcacagaccgaccagacacagcattcagagcgcttaccagttggtgggtggagccaccacacctagccctccaatgagaaagtgcacagaagagacttagtttgcatacgagacaatgcaacgctaataattgtagaccgtaacctagccagcataataagagttcacagctcatttttgatggtttgggggccctgaaaagggcctttgtgagtgggggagggggccaaggagaaggcctatacacacgaggacgccgatcaaccgccggagccatagagcgtgcggccctggcgcttgagcgcatacaccacgtccatagccgtgaccgtattgcgcttggcgtgctcggtgtaggtgacagcatcgcgaatcacattttcaaggaaaacctttatgacgc

SEQ ID NO: 632 - DNA, 510 bp, Rattus norvegicus
  Genbank Accession No. AA946469
aggatcataaagaggcgtggttttaattgataacaatcttcttcatacaatattgcacaaattaaggatgtatcaacaattctatttatgatacagactcatcaacattcatataaaactatgagttggtacaatttggtggcagatactttagtaaatagcacagatattaaactcggctacgtgagactcagcctccacagaagaattcacaggtcactaagatgtccgacccaagtccatcaagaccacttaaagagaaacttgggatccaggtcaggtgtggtagcacatgcctctgaacgtggaagcaggaggattgttgtgggttcaaggctggcctgtagtatacagcaaaaccatggctcaaaaaactggtgatgaccacattaaagaaacttagaagcttcctctgggaagcagggagcatctgcaccctggcaactgtaagtgtgtgcatgttctgccccccaggtgccgtgctgagagggacccctctgctgcagatct

SEQ ID NO: 633 - DNA, 557 bp, Rattus norvegicus
  Genbank Accession No. AA946476
agataacagtgacgtgtttactctgaaatgctgagcggcaagcgagatagatttaagggaatttgagaagccaggaaatgttctttcaagggttaggtccgtgcaaacaccaagtattctgccactaagctacatccacaaccgtctaggggagttttatttaagaggcaaatgtggaataagccttgaacatgggatcgaattaatgatgaaattccatggtctcaaaaagctacatggaaggttctggaagccaaccctggtggtctccaaccctggtggaacccccagaccatttgtacggatctctgagacacactttgtgcaggggctcaaaggtgactcaaaatgcagctgctgaaagtctagctcaccagcagccagacggcagcaccaagcctggagcttggtgatgcaagcctcagaagactccggaggctttgtcatgtgtggctttagaagccaggcatctgttgtgtgtgggacacttgcccagatttgatatcacggctgtgctcaagggctcgatgaaattttgttggctgcgtagaacaaag

SEQ ID NO: 634 - DNA, 556 bp, Rattus norvegicus
  Genbank Accession No. AA955162
  misc_feature (1)..(556): n = a or c or g or t
tttttttttttttttttcatattttaacaaactttcctttattaggttactgactgatatgagtcatcataaaacagaacagaacggggatttcagaactatacatgccacaaggctttacggtgatggtgccgggacggcagggaggtgtggtgagtcctggggcggcggagtatgggggacacaggagagccttgctgttcgccagcatccgtgagggtacggccgggtggagatcaagctgggatctatgcggctgaatgtgatccgctccaaaaccagaacgagtaagatttctgtctgacaaaaggcccccctcccaaaaaaggagaatgacctcaaaacgcanagggaatgacttagattctttatctagtctcggcaccacctctgtgccttaaaaattatactctactggaagatgtttatttattttttaaaaaaggtaccctacagcagctgcttaaaatgattcttacaaatatatctatgtaaatatattaaacattttcaacaaataaagtcatctactgtacctgtgcagaaatgaacagaa

SEQ ID NO: 635 - DNA, 501 bp, Rattus norvegicus
  Genbank Accession No. AA955206
ttttttttttttattttacaaggctttaatgagacatgaaatgtaacattaattatacatcaatgaaaagaaatcctaaacgagagtttattgtaatcacacatatccattccagcttgaaaactttctgaggggcgaggggcagctattaagagccccggaccagccagcactgtgtgtgactcccatgcatcctgtgctttgtacacaagttctgtccatcagaggctgaagacatttgctgcattattacttttcagaaaaatggctttctcattcggtgatgggtgactcaaccagattcctaagaaattagttccactcagcattttaaaggataagaatgttcagccaaaaagcgatagttaagaccagcgttagccaccgagatgaagccaagactctaaaacacagacttgccaatagtgtccacctatgaggactggcatacattagtgaatagttaaggccaaggactattccaaccctcgtgccgaattc

SEQ ID NO: 636 - DNA, 496 bp, Rattus norvegicus
  Genbank Accession No. AA955213
  misc_feature (1)..(496): n = a or c or g or t
tttttttttttgtttttcagaagaatttattaaatgacttttggtattgatgtggagtagagcagacatttcctatcacagcattcanaacaccaatcattataaagcagagaaatttcctcatctcccctacttctggtatagaatagagagcttccttagtattttctcaaagattctgactaattggatttctttgggaaattcttagtcattattaaggctattgtgctctcttggttattgcttttctcttcccttttaatttaaccatatatctaaaatttttttctttattcacccttatcatatgaatatttgccttgcttgtatgtctgtgtgcctagtccttgtggaggtcaggagatgatatcagatttcctggaatgaggtttgcaggcaactttgagttactgtatgtgttctggcaatagaatgctggtcctctggaagagcaaccaatagtcttagcctctgaaccatctctccctcgtgc

SEQ ID NO: 637 - DNA, 223 bp, Rattus norvegicus
  Genbank Accession No. AA955248
tttttttttttttttttacactccaaaacaattttttattgcaagaaacaaaaagcacaaaacagcctgtacatacatacaaaatgctaactatagacagacagatgcagaacatgttgtcatgttcttcagtgttaaacctacatcatctaaaaaggatcatacattactgtacaacagtgtcatatagggagagtgctgtcatatttaatatgaaacagta

SEQ ID NO: 638 - DNA, 508 bp, Rattus norvegicus
  Genbank Accession No. AA955298
tttttttttttttttttaaagatgagcatttattcactttacaaagagaatggtattaaattgccataaacagctccatttatagacaaagaacaactgtacatcaatcgcaccagcagcttgcccaggatgcccttcccgcttcggctgtgcagcctgctctgtccctgatggaagtcctcccagggagcacttttcttagtcacaggtgggaaagcctcgcatctgctcagtccttctgcagacgacagctctccatctgcacccctgactgaacgagttagtactggcccactctttagaaacaagacaaattactggtaatttgaaaaagctgtgtagcacaccaaaatacttatttatacatacataaaaaatcttgagtaagatttatcattttgaaagataaacagataccctagccctgctaagagcgggtaatgaaaaggaaccaaaatgttaaattactgaattataaaaatagtctctttggaaaaaaattccagca

SEQ ID NO: 639 - DNA, 545 bp, Rattus norvegicus
  Genbank Accession No. AA955415
tttttttttttttttttcaatgtcaaatgtttatttctatgccatagtttccttagcacaatttgcaaaagaaaggaatccaaaaaaaccctgatcattattaatatttttgggatattttctctgcagttaaaatacacacattggaacgagaatgaccatttctttcacagcgttctagcaaactgcatttgttttccttgggtgtcacttttgcttagagctggggaaatatccacaggagaaacgtttttgattcattcagatcaccatggggaagatttttgtcagcgaatatatctttgttttggtacacttcattactaatctccgctctctttccttaatagaataggcataatttattacacaagcaaagtgcactgaaaaatgaacaacgttagaaacaaactgaaatgtcgtgtctctcctcagtctccacagggtaacagctagaggcacgttaacacagacttctgataagtacaaacgcagcccatctgtgacgggaacactcttaggacactagtccatttggctgtagt

SEQ ID NO: 640 - DNA, 495 bp, Rattus norvegicus
  Genbank Accession No. AA955540
tttttttttttttttttactagaaatcatccagtcatttatttttgtttataccagagatataatgaacatattaaaaagaaaaaatgtttttataccaacatgtttttattgtttgtttctagactcctccatttagaaaataggaaccacggtttcattaagctgtggctccttttcctttaacctaagcttagtttaaggaaaacttccctcgtacaattatgtaactaactttaatcaatacatagtaattatgcaagcctcaatacagtagctaactttttgaaaatgacttaacacaaactattaacaactaccttctttgaaaatttctctatgcaagtatcagaacagatttacttctcttttaattttcatttcctattttttgggtatgccttagaaaagtaaaattacatataaacattgtcaactactttatttgtaaagtcaagataatggattatctcctctaagtaattaaattttgcaa

SEQ ID NO: 641 - DNA, 387 bp, Rattus norvegicus
  Genbank Accession No. AA955564
tttttttttttttttttgagatttcaatacaatctatattatctcatatatatttcttcctgactttatttgcttgcttctgtcacgcatttaaaatatcacagagaccaaaatagagcggctttctggtggaacgcatggcagtcacacgacaaaatacaaaactagggggctctgtcttctcatacatcatacaatattcaagtattttttttatgtacaaagagctactctatctgaaaaaaaataaaaaataaatgagacaagatagtttatgcatcctaggaagaatggggcagttgggtagattcctgtcccgtccccagggaccactagcttcctgccactgaacttccccatggcctcacccatcatatctgcaggtaa

SEQ ID NO: 642 - DNA, 285 bp, Rattus norvegicus
  Genbank Accession No. AA955684
tttttttttttttttttagaagaaaagatgcctttttattttacacggaaaccttccctatcatccccccaaaacccccatttcaagcaataaaactggaggcaggcagaagttcaaggtggcctgcttaggaatcctccagcacttccgtccacttaagagtcaatgtgaccctgttctataaaaccagaaggagcccagccacacccagttgtagctataagcaaaaccctgcaactagaagcaggccctgctgatcagaactgtaaactggtcacgtcactt

SEQ ID NO: 643 - DNA, 348 bp, Rattus norvegicus
  Genbank Accession No. AA955729
tttttttttttttttttgaaagtcagacatgacttgtcagcctttattagtcaagagtgaagccgggacctagagtttcctttaaaagacaaacagtcaaccaacccaaccttgtttacagcaaatgatgactgatttcaagtgagttttaattaaacgtttaagactacagatcaagaattgtttgttttccagtcatatgttcgtttgagattaaaatacaagtgtaaaacaggttaaagttagattcaccccaatgatttattccacaagtccaattgatagaatttcaagcacgatgtctagaactcaggaccaagggacaaccatagaatcattttacctttg

SEQ ID NO: 644 - DNA, 536 bp, Rattus norvegicus
  Genbank Accession No. AA955760
  misc_feature (1)..(536): n = a or c or g or t
ttttttttttaaccttttcattattttttggcacagctttgtgttcttccttccctgttcagtcattagagcctgttctggatggaaaccaaccatgtaccatgtagctgatggcttgcttcatccttccccagctgagcattctaggtagaaaccatattcctgtgatacaaccatgcgtatgactttgtatttgtttgtgttttaaacttctggatggagattangggagggggggaaataatcctgtggccagggacaggtgatttccaagtagactcgaacaagtcaagttcacacagtttggagcccatcataggaaagggtgctgcaatcccacacattcactgctgctccattagaatggttttgttttctacattttgtgtttactttcggagatctaaaacacagacagagccatcagatgcactggcacccactttgtctcctcgagcattccagcacacctcaaatatgccgcctgttcctcggtagctgtggacgagacttccactctgagtattccagatatg

SEQ ID NO: 645 - DNA, 175 bp, Rattus norvegicus
  Genbank Accession No. AA955857
tttttttttttttttttaaggaagccaaagagcagcatttattctggattccaatacaattccaatttcctttcattcatcatccatggaatgaaggcaaaccctgcgctggttggggcgctgtggttcatggctccttgcgtgcctttgccttcctcagtctcaaggcacgcaa

SEQ ID NO: 646 - DNA, 208 bp, Rattus norvegicus
  Genbank Accession No. AA955914
tttttttttttttttttggcagattagtcctttaatagaaaaatcccctggaaaaagtcaaaagccacatgtgcaacagtagcaacaacacacatttcctcaatccagacagtccagtttcaattcctcgccttgggaagtggcctgtacacacctacaaccacagcgtgggctcgttcaaaagggtccaatgtcaactggtcctgaa

SEQ ID NO: 647 - DNA, 371 bp, Rattus norvegicus
  Genbank Accession No. AA956111
  misc_feature (1)..(371): n = a or c or g or t
cggccgcggagccgctatgggcccgccaggcccctggcgtggcgcggcgcaaggaccggctcagagccagaattgaaactcaaagatggatgatcaggatcctgggggcattagcccccttcagcagatggtggcctcaggagctggggctgtggtcacctccctcttcatgacacccctggatgtggtgaaggtccgccttcagtctcagagacccacggtagccagcgaattgacaactccctccagattctggagtctttcctacaccanatcaccctccactctacagtccccagggaagtgcctcctgtactgcaatggtgtcctgnagcccctgtacctgtgcccaaatggtactcgctgcgcca

SEQ ID NO: 648 - DNA, 354 bp, Rattus norvegicus
  Genbank Accession No. AA956114
tttttttttttttttttaataaagtaaatgtaatgaattaggaataaggtgataaatgcatcaatatacatttttcttatggccagcctcttctgctctaccctgagtcaacagtcacgccagctttgttctactattgcagaaacacgcttttcatattcccgcttgttctcctggtacagctgggcagcctggctgtttgctggactattgggattaggttcatccaatagagactgtatggatgttaaaatggaagacacatcataggttggactccaacggttctgaagtatatccagacatatactaccatctgcatagacgttagggtggaacatcttagacacaaat

SEQ ID NO: 649 - DNA, 501 bp, Rattus norvegicus
  Genbank Accession No. AA956278
tttttttttttttttttgcatttataaaaactgcagatttattcagcgagggcccgtgtccaagaagctatggtgtagaagtcggaggacctatttttcctcttctcctccccctcacttcgtcttcctggagggcaaaaatggtctggaccctgaaatcctaacccaaataaaaaaaaccacaaaactgaggttccaaaaaagttaaagaatcttaattccttatagaaaagagagaggagccaaggcaaatggggaggtatcccaggggtgggggaaatgccccctacttggtgggatacccctcctcttacatagctgcctctgatgggacaaagcttggggtatagcatttaaaaactcccacaccccattttatcaaaaccaaagagaacaaaaaatttcccttccccccacaaaacccaaatatatatatatactttttcttaaaaaaaaaaattccaaggcattaaagcgttaaagtgaatccagaacaagaga

SEQ ID NO: 650 - DNA, 376 bp, Rattus norvegicus
  Genbank Accession No. AA956294
  misc_feature (1)..(376): n = a or c or g or t
tttttttttttttttttagggttcagttccagctgattttatttccttctcaaaaaaagttatttacagaaggtatatagcaacaacctgacaggcagtgacggacaggattagctggtattttttttttcttttttctttttctcttcccccaaacattgcttttttttttttctttttagtggccttgaattttaagacaaatattctacacggcatattgcacaggatggatggtaaaaaaaaaaaagagagagaaaaaaaaggaaaaaaaattaaagtttaaaaaccaaaaacccttaacggaactgcctcttaaaaggcangggtcctcgtgcctgtcatgttatattaaacatacatacacacaatcttt

SEQ ID NO: 651 - DNA, 393 bp, Rattus norvegicus
  Genbank Accession No. AA956550
tttttttttttttttttcaaagaacaaagcttttaatactaaacagtctttttggcaaaaaaagaaaagtagggcaaccgccaccctacagccctgaagaatgtgtgtcgtcatacttcggtcacctgcagccggttcagaggaaacgctcagtccaaaggcaagttcaagtccacaggtgaggtggccaggatgcctgcctgcaaaggacagagagcccagagctgacaggaacttcagtaacaccactgcagtgataaaagatggcggcggaggcttgggaagacggcgaggggaggctctaagtcagagctatggagacacccaaaaagagggatagacacacagatggaggagtagaggaaggacgccttgagtggtacactgaagtgg

SEQ ID NO: 652 - DNA, 496 bp, Rattus norvegicus
  Genbank Accession No. AA956555
tttgctttgttttgtttgaggcagagtgttacactgtagtctaggctagcttcacactcacaatgtagaccaggctggtttcacactcagagcaatcctcctgtcccagcctcatgaactctaggctcacaggtggcgccactatgtctgacctttttaaatgccgttccttgatatcactgtcccaccacggaacaaagtgatttccacgtacaccaaggctcaaatttctttgcacttaattctctgctcagcgaaggtagtctgtattgttatacaaatgagtttggacatgcatggtataatatgatgcatgcttctgtgtgaagacagaaatgacctttttgtacttatgggttaggttggcatttaagaaaccttgacatgacagccagctaaatggacaagagcccagtccgtgcacggatgaccacagctacatcttcacgctgtcctttgtttgctggcactctactgaacctgcagaagccatgtt

SEQ ID NO: 653 - DNA, 386 bp, Rattus norvegicus
  Genbank Accession No. AA956689
tttttttttttttttttcagcacagaaaacattgctttattaactgaatttgccaacacacgaggagtgctgtgggctccttagacacagaccctggtgggggctgcgatccagatgcccttgtgagtgagcaggacaggacagggccggaaactatgcagcagcagcagcagcaacaacacagtcatgcagggcacagtgggcactggccacgcggggtgaccgaacattctattgctcgttaagggtcgcgaacgaggacaatgtacaaaaaggagaaataagtctttgcggtaatgaaaaatacatttttttctctacaaagaaatcttctctaatacaagaaaatagatattgcaacataagccaaaaataatttaaaattg

SEQ ID NO: 654 - DNA, 427 bp, Rattus norvegicus
  Genbank Accession No. AA956703
cggccgcaggtggattaagaggaaggaggacggtttgcttccatgggggaaaaattcaagaattttctttgttgttgtcatttatgccgttggtaaatgaatagattctgaacgagacggtctatgaaatacgactggagttgtcttgtgtgtctacatgtgtgcctacaccaccacagagagactgagaaatgtgtggtcactgttactgcgctgagtgctgcggaagtacaaaatagccctcgaggacgaagaaggccccggcagtggtaaacaggtgtgggggacacagaccgcggcattgcaggaagtgctcgtgctgtaaggagggaattttttttttttttttttttttttgcattgtgagaggctaatcctttccatctcaaggctatcacaatcacacacacattaaaccaaatggagg

SEQ ID NO: 655 - DNA, 470 bp, Rattus norvegicus
  Genbank Accession No. AA956733
tttttttttttttttttaagaccagatcccaggtcgggctgtctttattgaatgcactcgttcatagaaaacagaattgcaaccgtagcatggaggaacacagaacagagctcagaaacaaaggcccagacctgcctcttctcccagcccaagagctagaaaaccatggtggagaggactcttggcatctggaatggacctggtggagtgaaggatagccaaggactagagtggccggggcctagagctgggtgactctgtaaacgccaaggaccagagtggccaggggccagagctgggtgactctgtaaacgtcaaggctcttaggcctatgtgactaacacagaacttggctaaatactggacggaaactcagaaaccagccctgagtcctttggtgagacaggactaaggactcacagggacttggcatgtccctccctttctaagacaggcactgggactcctgc

SEQ ID NO: 656 - DNA, 159 bp, Rattus norvegicus
  Genbank Accession No. AA956758
cggccgcaattgttttttttattttgttttttttctgtgcacacagctttattggatatcgctggattgtcgccaagtggctctgattactggcatgcaaagaggaggtggtgcctcactggagatacacacagttatgggtgcaattaaattactgtc

SEQ ID NO: 657 - DNA, 542 bp, Rattus norvegicus
  Genbank Accession No. AA956907
tttttttttttttttttccaattatgtaagtattttatttatcaccaaagaaataaaacacagcagcaagttctgtgttggcttcaataagaccaaatggttactttttttttttttaaaacacagctacacactccaaaattgaagtcaacacagtcatcactacaaattacttgttgaaataatctatcctgaagaaaattaggaaaaagaatttaaacaattcctccaaaccacacatttataaatattgtcatatttaaaatgcttgaaaggcatgaattagtggaaaagcagttttcttttggcaacagaaaaaaagaaacccacaacagtttaccaaatgctctagggacccaaagctgtactgttctggacctgcacttgagcagcatcgtcatgatgatgactaaaaaatgcttttatactcacctctctcaagtaagtctatagaaaaccccattacagccagtgtttgtaatgtctaccacactgatcagaagctataaactgcctaaatatatttaacagtaaatacctaa

SEQ ID NO: 658 - DNA, 448 bp, Rattus norvegicus
  Genbank Accession No. AA957007
tttttttttttttttttaatttaactgctgtttattggaaggagcagaggagacagagtgcgggcccctccagatcggatgggacaaggctggcaggaagcttacagagggtgggtcccttgagggaaagatggctcagcagcagcgagctccagctcagcatatgctcttgttaccccacttggccatcttgttgttgattggcatcttgaagcagcggtcagactgcaggaatgcagcaatcttctccaaagcctcaaaacggcacatgaaagccttcagatttgggaactcatccaggcacttgggctcaaacatacgattctggtccaagacgtcataagtgagaaaatccacgaaggtcagcttttctcctgcaaaccatgtgaatttccccaggaacaacgagaactgtttcagctgtgcaggcagttgttccaaatactga

SEQ ID NO: 659 - DNA, 576 bp, Rattus norvegicus
  Genbank Accession No. AA957096
tttttttttttttttttatttttttcccgtgtcatattactttttattaaatgacatatttatggaaaatagttgaaaatgcctgtcaagaggagtgttcaatcccctaacgcacagtctttccaggcaagtcagacatacacatgaaaaaagagttagaacacacttgctagagaaagagacattttcgtctcctcggttttcagtcaaataaaatccacagacagcgtggcaacactgtcagaaaagatgaacaccagttcccaacaacctgtgtccctgcatggttagaaacacaagcaacccatcagggacacacacagactctctcggagcacatcgcagggcacacttccagggtatttttgtctaaatgcttttgctaaaactaatttacatcgtgaatgacatatgatgagaacacacactaagaactaactgcagtgacttgaagtaagacccacggacagcggaacagacaaacacaagaagttaaagtccacttgattgctttccctcagaaaggctggtgaggtagtttatagtgcacatacatcgtaaggaatccgcattcca

SEQ ID NO: 660 - DNA, 385 bp, Rattus norvegicus
  Genbank Accession No. AA957123
tttttttttttttttttgccttttcaatctgctttattaggttcacaatatgtcatatggaccttcccatgcatctgataaaagaattacaggccgagtaaaaaacacaagtttcacttagaagttggtaacaggaagagatctacataaaaggagtaacctcaaaacttgtacatcacaaagcaggggtccccatagcatcttcagagacaacctcaggactcagggcataaggcaaaactcatcattgtggtcatggtgaggggggtcagtgctcaccgcccgcagactatggctcagctgcctttccctcaacttgcccatgaggtgtctcatatcctccccaaacctttgcacattctcatctctcatcctgccctgggcc

SEQ ID NO: 661 - DNA, 453 bp, Rattus norvegicus
  Genbank Accession No. AA957139
tttttttttttttttttcctttgcctaatggaacgataactgctcattttctatcctggcaagattagagaaacaaaaaacaaaagagggatagtaaggctgcttgttgattgccactttcgaagatacccttggtgaacacgcagcattacagtctcaacaccgctacgctggtggtggtaggtctcatgtcaactctgcagatttcaagagctctagaaataaccacgtaagctgctcagggtcttttcaggacctcccagagatgagttatacactcacttgtaaatcaacagttagaagaccgtgttaagataaacaagtacacataaccccagacggaatgtactcagtttccttttcaacagtcctgattcatggcaattattgagaactgtatttatccatatgtaaaataataaacgatgctgagaatcttgtttgtcccaagca

SEQ ID NO: 662 - DNA, 156 bp, Rattus norvegicus
  Genbank Accession No. AA957259
tttttttttttgctaatttctttaggctaataattcgtttaatatcagtaagagtgagttacatactacacacaatattggatacaataatcatgatccaaacattattggtccagaatttaaaacttatgacagaaatgctggcacatgacctat

SEQ ID NO: 663 - DNA, 430 bp, Rattus norvegicus
  Genbank Accession No. AA957270
tttttttttttttttttaaagttaaagattcttttattaataagtctccctcccctccaaactttatccccaaaataaatatcacccccttgggggatgggttgtgtttgtgtgtactgggaccagccctcccagagggccagcccccttagtgttatgaacaggtccctcaatctaacccactcccagggctaaaactcagggtagtggcatttcagtccatccgagtgggtggaacccagtgttgtgtctgcccctcaagtcggccaggcctccaggacttgtggggagcaagagattcccttgtgcaaatgctgcagatccttagtatgagtcgctttgtgacctagcttgaggctctctgtctgccccagaaccagagacagggcaattagacaccctggaaggctcccctgaaccctaagcccag

SEQ ID NO: 664 - DNA, 265 bp, Rattus norvegicus
  Genbank Accession No. AA957335
tttttttttttttttttaaaaaggtttctgtaaatattttattttccatattttagaatcagaaagaagcatgtggtaataaaaataatagagaattattttcttcagatagtcccgctctgctgcgaaccgccagcccctccagtccagccccttccagccagctctcaccaggcctcgcggctctctcatgagcagccgctgacccggtatcagtcccactatgtacagatatattacaaggcaaaaagaaagcctcgtgccg

SEQ ID NO: 665 - DNA, 417 bp, Rattus norvegicus
  Genbank Accession No. AA957362
tttttttttttttttttcactgtgagatgtggagcgtgtttttatgtttgtagaaaaaaaaagtacagaacagtgagccatgggtgaacagggacatcttggcctctaatccgtcagattagaaaaccagaatcgtgtcaaagtgagagctagtggggcccttgctgagcttgacaaacctggagcactctccagtggccgggccatagtggggatggaggtgggagtacaggcaagaatgcctgggcagctccagagctagggatctggagggcccagtctttttcagggagaacaggtttttggaggcgtggttttggaggtctgtgatcccaagaggaggtcagccaaagagcttcaggaagcaaggctggcagtaaggcttgctggcacgctcctggaaggagcctttggtga

SEQ ID NO: 666 - DNA, 400 bp, Rattus norvegicus
  Genbank Accession No. AA957422
tttttttttttttttttgagcgtgatctctggcagctttattggggggtaatcccttcccattgtttagtgagcacagaggatcagggaaggaaagaggaatgaagcaaaggaggatgggagaagagaaatgtcagtgagtaagtctttggtggatatggggacattgatttagagcctagcatggttctgggaataaggtcagctagttccagaagcacggaggtagcacagccacgtcaatcatgagggcgaggagagaattaaaagcggaaaaggaatgcagctgagaacacgtgttgtaaagctattggggtggtttctcatgtttcagagtctcatatgtctcctggttccgggtgttcaggcccgtgtagacagcaaccgatttctcacggctg

SEQ ID NO: 667 - DNA, 337 bp, Rattus norvegicus
  Genbank Accession No. AA957452
tttttttttttttttttcacgttctgctcattctgtcgttttattatccaattgtccgttacagtcccagtcgctttacagaaccaaccgtttccaccgctgacactattgtaaaccacatcggcgagttatacagaaagctctgcgtttcaaaaaactagacgctttagtaacaatattacaaaggctttagcttcaaaaataaccgaaaatgaaaaaaataaacttttaaagaattagcatcataaaattaatttattccaagtaaaaatacaaaataatattatgacgttgaccagatatgaaagtccctcccagaaacaactctagtaatgat

SEQ ID NO: 668 - DNA, 339 bp, Rattus norvegicus
  Genbank Accession No. AA957535
  misc_feature (1)..(339): n = a or c or g or t
tttttttttttttttttgacatttcccaggcaattttaatacattcgcccaccaacacaaaaaccctaaacttgctccctctccctcttatctgagactgggaataaaacattcaacacggaagtaataaaagtcgaagcagacatccaagtgcaaagggaaatactgagcacacagtagttttcttgtatggtcgtttaaagtcacagttatcataaatacttacagaaaacactaaatcccctactttgtagacaaattgttttaacagaacacaactttctcncgttggcacacagtgaacaatgaacaagcccgcttggaacacactattagcaa

SEQ ID NO: 669 - DNA, 496 bp, Rattus norvegicus
  Genbank Accession No. AA957653
tttttttttttttttttaagcctttttcgtctttattttagcaatggattatggaaaacgtgcagattcatctagacatgaaaatatttcagtgcacggtgatcttgcctgacgggtttagtactgctaagggaactcaaatataattctccatcctgtggtaaaggtcagaataaaagcagcacactgagggaacagctgatcgccagagtcactgtgtctgaaggcttccagaggttggcggttttccctcctgactgtgtatccattttcttcttacagcttaaaaattttgggggttgttaacagttgtttgtaggaatttttgtttttctccagattcaagtcctgtccctccttagtttgcttctttatgcagtattcgacttgctcagttcctgcctgattgcatcaatgagctcctccttcagctttgcaagttcttttctcatttcatctaaaatgtcctgcttcagcctgtcatagtcaagccctt

SEQ ID NO: 670 - DNA, 463 bp, Rattus norvegicus
  Genbank Accession No. AA957736
  misc_feature (1)..(463): n = a or c or g or t
tttttttttttttttttcttgggatggctgctgcgagtttattagaaccccgagggtgggaaagcaacaagagggagtgcccaggacccaagcaagcactcagagctctgcaaacacgaaaatataaagcttggccacaaaggagctgactgtgccgtggcgataaagatccatcgtgacggtcaggagcaagtccctgggctcagggatgggcctggtgagggccaccaccccactgtggtggctcacctttcgggtggtgaaaaagccctcctcattgccagcggtgatggccagctgcatgctgtcnccagggacagcactggaagggcccatgcggaaaaccaccgcgggcacttggatgttggtggggaaagagaggtggtagtaggttattctcagaggcagcctgnggcactcctggttctcatggcaaggcaagcgctcacagcgggtgtctgca

SEQ ID NO: 671 - DNA, 445 bp, Rattus norvegicus
  Genbank Accession No. AA957808
cggccgccctggacctgcaggaggtggaaagcaagatcgatggcttcaaatgcttcaccaagaagatggatgacagcgcgttgcagctcaaccacactgccaacgagtttgcgcgcaagcaggtgactggcttcaagaaggagtatcagaaggtgggccagtcctttcggggcctcagccaagcctttgagctggatcagcaggccttctccgtgggtctgaatcaggccattgccttcaccggagacgcctatgatgccatcggtgaactcttcgctgagcagcccaggcaggacctggacccagtcatggacctgttagcactgtatcaggggcacctggccaacttcccagacatcatccatgttcagaaaggagctcttaccaaagtaaaggagagtagacgacacgtggaagaagggaagatggagcctcgtgccgaatt

SEQ ID NO: 672 - DNA, 333 bp, Rattus norvegicus
  Genbank Accession No. AA957835
tttttttttttttttttgatgtttaacgtctgtgttttattttgttggcaccagaaaaagctcatgtaatgttatgccactgtccatactgtaaacaagacggcattaatatgttttcttatgggtttcttgttccaatgaatctagattttaaaaaatacattcacaaactaccttatgtttaaacacaatgattcccttttatttcttaactgtacccaaagtcccacaataaaaaaatcatttaaagctgtgtgtttcagatgtacgcttagaagtaagaacaaagtggcacgaaacataaagacaaaagatcagtttgcaacgtaattt

SEQ ID NO: 673 - DNA, 544 bp, Rattus norvegicus
  Genbank Accession No. AA963094
tttttttttttttttttactggaaatatttggttccttttaatcagctattgatggtataataaaataatctcaagtgatacctaattaaacatttaatggttcatgaaggataatctcagcacaacatatagcctaagtgtcaggtaatacctctttgctttttcaagaaaggaggaatgaaggcatgatcaaaattctggctgacaacttggacttgtgtgggttacttaagggtcattttgtaggtatactggcagatggaatgctggaagcaaacccacggtcttagaaacaacagtatgcttaaaaaagaaagtgaaaagatatacattgagctcatatctgcaaaacaaagaaaaatatccaccaaatatcacaacagatttttttttaattattttccaacattaagattgttattgtagggaaacatttctctctctctctctctctttttgaacactcaatttaatgtattaaataaattgcagagagaactaagttctgtgttctatacaaattaaaagtcccatgaacatact

SEQ ID NO: 674 - DNA, 379 bp, Rattus norvegicus
  Genbank Accession No. AA963171
attttttttttttttttaaaagtctaagttctgtttatttagtggacaggacactgatcatgtcagaaatctttctcttcatcagatgtttgagccccgtgcaaaacctttggtttttgaggttgaacatggatttctactccatcaataatatgatgttcttcttgtagtgcattctgaagttcttcctgtgaagaaaactgaacccaacccatgcctctgtgaaagccagtctctttgtcaaaaggtacagtgcaccttcttacatggccaaactgagcaaaatgttctcttagctcactcgatgccgcggtccaaggaatttttctaataaacgctataggccgaccagtacgggaacgcaacgcagttagtcctt

SEQ ID NO: 675 - DNA, 488 bp, Rattus norvegicus
  Genbank Accession No. AA963173
tttatttttttttttttggtgtaaaaacaaccccccttaaaaagtcaacttctgttaattcccccaaatccaccctgggaagtgacacacttcaaaagtactgagcaacttgggtatcacacaacaaaagggtcttccaaaaactcagaacgcccacatgtccaaatgatttctaaagatggaggatttccacacaagtgatcacggagttaaatgagcctttattacgaggaggcaagggcatgtctgcagagggcgatggtctgcagaacaagggtttaaattaaagtccctaactgtattgtgtcaagggaaaccaaggctggatggggaaacgacggcgaccaatcacatgagcagaaggccgcaccgtgcgtgctggacacagagctgcttctgcctttcaccatggaacccattgttaagagtggagggagaaagaaacaattcagaacaaaagtagactcagccctttcagacatccctgt

SEQ ID NO: 676 - DNA, 568 bp, Rattus norvegicus
  Genbank Accession No. AA963260
tttttttttttttttttagaataaacaaacttttattttttaacagtattacataaagcaaaatatcatttaacacaacttgaagctgcaataaatctaatcaggcgtcataactatacatagtcaaaagcaaatgagaaaatgttcaatacagttaataaatccctatcagctctggtgttagctttacatggtacagctttcttacaaccaaatccccactgtcccccaacctggtctccccagcatccacaaagctgcgagtcctcaaactatctcagaaatacctgcccagtggcagagggtcagtttacatggagacagaggagtttcgtacaaagcgagtgttctactcaagtgttccgataatgggaagaactgggatagggaaggttaagaaaggaagctctaaggctcgaagctgcctggatttcttttagtaacaggaagggcacatggagcggttctcctgctctggaatgctgtggcaaagcgcatgtctgagaagcactgcactgcggaccgacggtctctcacacagacccggtcagtgagcttcgtaattctc

SEQ ID NO: 677 - DNA, 200 bp, Rattus norvegicus
  Genbank Accession No. AA963627
tttttttttttttttttctgtcatactgtccttttattgtgtacaggtgatagagactagtctcccacgaacccctcccccctcccctccctatctgaagggtcccaagactgctggagccagaggcgcctgggaccccaactaacagtgagcttcccccttttacacctgcttttacacgtggagtctgagtcagagcc

SEQ ID NO: 678 - DNA, 345 bp, Rattus norvegicus
  Genbank Accession No. AA963703
  misc_feature (1)..(345): n = a or c or g or t
tttttttttttttttttggattttgactcctgattttattattcaatttctttttctactaaaagtagtcttcggtggttgggaagcctggcctcccaacaccagagtcagtcggagctggtttttttgttgaaaggagtgggcgggtgggtgggggaccgggatgagggcagaaccccgctctgctggtagtcttgggtggagaagacgaactgcacttgacagagcctggggtgcggtgggagggggtgaggcangagtgacaagctggggaggggacccacctcagtcnccagctccattctcctctaatgtctctccactggtggcgttctctgcagtctt

SEQ ID NO: 679 - DNA, 242 bp, Rattus norvegicus
  Genbank Accession No. AA963746
tttttttttttttttttgcactatacgttttatttataagactagaacagtcgagagtgttcgtttaaattaactaatagaaaggggagaatggcatatgagccgctatttacagaagacaaactgaactagaggagatcagcttttgttacaaaacaggaatcacgacattcacagacgattgttttataaacattgatggaaatgttttatacttgcatactttcttccttggggaaaaa

SEQ ID NO: 680 - DNA, 385 bp, Rattus norvegicus
  Genbank Accession No. AA963767
  misc_feature (1)..(385): n = a or c or g or t
tttttttttttttttttgtgtttcttacaggtttaatgaagagctcaggattcacagctcgaaacaaggttgttgggtgcgtccctcggaggcctgggttttcaaagtttctctcttttgatggttcttttttaactgttggaggatccggtgctgaagacatcttgactactgaagattattacctgaaggctgtaaagctttgcagaccggggtcggacaccaaggttcctacggagctcagtataaatcttctttataaacgagtatgaaaatttctgtggtcggcaggcaggcttcnctgccaggctgtggtctacaccgctgcgcaaggtggagagctgactataacccaagtgccttcgaagcttccataaataactaa

SEQ ID NO: 681 - DNA, 444 bp, Rattus norvegicus
  Genbank Accession No. AA963834
tttttttttttttttttgctgtggataaggctttatttctctgctggaagaatccatctggaagaaagagaagggcagggggcctaggaggggcagttaaagaggctgcagaggtcaggacaaggggctgctggtgagggtagctggtcacttgttgtcctctaagaagaagtcattgtaggccatgcacagcgtggtcaggaacacagagtactccttgaagtcaatctcctggtcgctgtttttgtccaggctcttcatcaagttatcaatgctgctctccttcatcttctctgcaagactcagttctgtcttgatcagctccttcagttctttcctactcagggtcaacttgctaccctctctccctgaatatttatggaaagtggtgaccatggtggtcagtgccttctcaagaggagtctccataatgatgtgtactca

SEQ ID NO: 682 - DNA, 496 bp, Rattus norvegicus
  Genbank Accession No. AA963838
tttttttttttttttctgctgtcaattctaagatttattgcttgtttgggggtgggggatatttgatagcatctactcaaatgaacctcgttggttttagtgcgtacagccgccattcttccacactgaagcaaagctgtattttcagactgcgtttgcatgtgacccaacagtcacatggtgatggtggtagattacaggtttgttccagttcctgtcctgtgcagatccgactgttctgagtatgagtaggaagtcacggtgcctctgctgtggtggacgctttgagcagtgagtccatgtggcctggttagggtcgactttctgattcaaatgatgtcaaagtggaaatctgctcaggttctgtttcaatcactgtcactccgggactccttttgaaagctttggcatgggacaagcactgacagatgtcattaataaaatggatatgaatgttccaaaaatagtaacagagagcgtcataaagaggatgatt

SEQ ID NO: 683 - DNA, 273 bp, Rattus norvegicus
  Genbank Accession No. AA964206
tttttttttttttttttaaggcagatccatatttatttttccattcacaaattacacatcaccactagcctcttcttaatgaagaatttaaggaagcaggatattgtaagtggaattgtgtgtctcttgagtaaagaagtcatactgatttcttgctatatattatttttcagttacaacacaagactaagagttgaagttcccactggagtggaacacagcacttcattactactagacaccacaggaatgttctagggacacagatccagc

SEQ ID NO: 684 - DNA, 376 bp, Rattus norvegicus
  Genbank Accession No. AA964265
tttttttttttttttttgagtctgcggatacatttatttcatcattcgtgcgcgagcgtgtacatgagtgtggtacccgtggaggcaaggagaggaggaggttcctacaccgtggagctggagtaactggaggctgtgggttgcctgccatgggctgtgggaactgcactgaggtcctgtggaagagcacccttggctgagccctctctccagacacctgagctcacatacgcaatccagactccgttagaaagaaagttaatctttaaaaggttaactctggcctccacattccgagctatgtctctgtatccattcagttttattttagcaaataaaatcggaccttaagaactttcctactggcctcgtgccg

SEQ ID NO: 685 - DNA, 468 bp, Rattus norvegicus
  Genbank Accession No. AA964362
tttttttttttgtttttcaataattttattttttctaattttgtaattttaatttcccatagcaccttggcaatgttgaaaacaatacaaatacaaagatgctcatttaacagtttatgcatgagtatgtgtcacaccattgttacaggaggggagggcacgggacagttttgacaacagaacacatctaagctatggacaaaacagaagccagataactggttctgacacgccactccccgaacatttaagttacgtcactcaatggacacctgaatcattggaaaaacagtaacagaacattggtgtgggtatctctttacatttctagtcagtgttctgtgctatagaactgataacagaatacttggcccacagctcgcagacatcagagccgcacctttacgactgtgtaatgtgtaataagacacaacaaattgttagttttaaaaataagcattgttattt

SEQ ID NO: 686 - DNA, 498 bp, Rattus norvegicus
  Genbank Accession No. AA964455
  misc_feature (1)..(498): n = a or c or g or t
tttttttttttttttttcggcttccattcatatttaatcacgttgaaatcagtctaacatcaagacatacatgtgagcacaaggagcttagccatggatagacgtgtctgtggacaggggcactgcaggaaccatcgcacttaagctcgtgtgagacccaggcagctctcgtcatgttcccttggcttaaggagaggtagatcatcagcaggaaggtanagaggacgctcttcaacagagtagccgaggacagggttctgtctgatacgaacatccgcagggtgctagcaggagcacacctgtcatacagcctgcccaaaacggccactagcatcttctcccaaaacatctcagggactggcaaggggcaagcgtgacagacactggatagatgtttctagaaagcagttcatttcacagaacctgcttaacgggacaggacgcccttctaacggacctctgcacacactagaacactagagcactgtccgcctcatc

SEQ ID NO: 687 - DNA, 494 bp, Rattus norvegicus
  Genbank Accession No. AA964496
tttttttttttttttttgttactgcagcacttttatttctctttacacaatgacgtgttgctggggcctaatgttctcactgaacagtagaaaaccaaaatttgtcatttcttaaagaattgagtacaaaaaccttacataaattaaaaggatgaatacatttacaggtgtcgatgcaaacgttcccaactcaaggcaagtaacaacccatggaggtcaggagggaaaaaaccagaacagaaactgggtcctaaggctcggactttcccaccctgttagactggcaagaaaagaagtggtaactagttcaggaacccttgccagcctcgggaaatcctggaagtctgctgttggttaataccaagggaacagttaacttgaatacaaggtcaaaaatcagcaacaagttctacgatccagtgctgatatcagatacaagcttcaaggacaaatttcttttcaaaggcttattccagtttcatgaggctagcatg

SEQ ID NO: 688 - DNA, 444 bp, Rattus norvegicus
  Genbank Accession No. AA964501
tttttttttttttttatattccaactgatttattaagatgcattaatattatggtaatacgtgtaacaaatgaggacacaccactgtattccgaacaagtcaaaggaagagaaaatagcacactttgcggatgctaaagagctgcttctcactgcctagaactagagccgtttcccgaagacagacagactgaattctcactgaaatgacaacactagagtcagtactatgtaagaacagcaaaaaggtcacagtgagttaattttgtctaagtgacagcatgtgagctcctaatgaaagttgttttgaagtatgaagcaaagtgcaacagtgtttgatcaactccgaattgtgttctatgtgaacagaaccccaaggactgggcaagctggcagccctgaacaccaatatttactagctgggttttcatgagtaaacattgta

SEQ ID NO: 689 - DNA, 423 bp, Rattus norvegicus
  Genbank Accession No. AA964526
tttttttttttttttttagggaaagggtgcctttattcggagggaaggatcagcacccacccccatcctccaatacacaggctggaacccgggaagaaggcagctggtagagaagcaagggaggcaaaggtgaggaccgcctccaatagctatctccccttttgcctgcggatcctggaagacctgcggccgaggggcgcctcctccacatgcgagtggaccctatgaagatgccaagggctcacttagatggtggcaggattctgctgactctcagcctcagaatttaaggatgctcactttggatcagggagctaactccaggggtatgaagatccaaggcaaaaaactaagctctgggactaggacatacgacgggaccgcccgctgtggagctggtctcccccactggaatctgtcatg

SEQ ID NO: 690 - DNA, 354 bp, Rattus norvegicus
  Genbank Accession No. AA964589
ttttttgttttttttttactgccaatgtcacgcattcacggttcaatttacatttattgagcattacacagatgatcaatcgaattcatgacgaagctaaggcacttatctgcggttccatagattattttaggttgggaaccctggagctctggctgccccttgctgtgcatataatttgaatatctattagaaatgctttcagctacaagtaagagactgctcaaaataaacaaatgtagacaatcatgtattttcaccaaacaagatatctggaggtggtcagatccccagatgatgggctatcccagcaataattctgtcaaggatccagcttccgttcttccaatctgg

SEQ ID NO: 691 - DNA, 409 bp, Rattus norvegicus
  Genbank Accession No. AA964595
tccttgtctttttttttcttactggatttcttcttttccttcttgctcttcgggtcactctgctctccactctcaagctttatccccagcttgccttcgggcttctccttggctccttgggggacaggagaccccttccccttgccaccagcactccctttgtttagttttgattttgccttggaagtcctggaggccttttctggggaaccagcacttgtcccagccgcaagctgctgcttcttcttcttgttctttggggccccagcttctacctggtcccctgatagtttccgtttctggcccttctttccactctccttgatggcctcggtggccttctgcctttcctgctccagcagttctgtcaggaccttcatcacagaggcctgcacctgtgcctcactca

SEQ ID NO: 692 - DNA, 522 bp, Rattus norvegicus
  Genbank Accession No. AA964613
tttttttttttttttttaaacatgtaaaaattaaaagtttaattcaaaaagaaataaaactatttacttacaaaccacttacacgttctttcccctgatgcacattttaaaagtacaaatagaatatgaggatcaatataaagttgtttcacaacagagaaccaaagcactcattcaaaaagaaaactattacaggatacaatgaattacctctgtgcatatgtttattaatgcaaagctgtgctttactcttttttcctactgagaacttatttacaaggatgattgacaagacaaaatacatttaacatttggtagtgataaacagtaataaatgtaatagtggtacttcctatttctttatgtctctctcttcaccacatattatcattaatgaggcatccatatggacttcaggcttttctcctgcaaaaaggcttgaccattgggaccattaccatgaactttcccaaagagtcatctttattctatggaggagtttgttacagtaattttaacagt

SEQ ID NO: 693 - DNA, 340 bp, Rattus norvegicus
  Genbank Accession No. AA964617
tttttttttttttttttgaaaaaaaaaattattttattggaactcatctgaacatcagatatacctggtgttggtcagcaagaaccgtttgtacatttgatatggatggtgccaaaaccaaaacagtgactgggcatgatgggaagagaagagggctgacaacaaaaacctgattttgaaaaggaaaataaaagccagtcagattcagtgaagatgcaaaccctggtacaacaaaatccttttacaaaatagaaatttattaccaaaacctggagggagactctgagaaaggctctaaagaagaggaagaggccagcaggaaggaggcgggagatgggga

SEQ ID NO: 694 - DNA, 571 bp, Rattus norvegicus
  Genbank Accession No. AA964755
tttttttttttttttttaaatataaacttccatatgatttattgttgttccttgtacacaagaaacagtaatatacaagttacactgctttagaatgtaaaatggataaaatgtgtacaaaaaagcacgttcctagaacacagggcattggcaaatagtcaaacctgggaagtaaaaagcaaaaccaaaaacaaaaccaaagaaacaaactaaaacaaaacaagaaaaaccaacatttcttcaattcagtgtgcaacatataaaaaacagaaatactaactctacaggcagtatttcctgataaattatttaaatagcatatctacatagtctgagatctctattccaatggcaatgagaaaataatttataaaaataaaagcaatggtgtacaagatgatagaacaaaaccagaactttgaggagttgtatttaacatttcaaagctatttctgtattgggatcattctctgcaaaggatttttatgctatgtacaacactgactttttagacacgacagtagttttaagtttattgacacttaaactctttcttcttgattcaaaatcc

SEQ ID NO: 695 - DNA, 439 bp, Rattus norvegicus
  Genbank Accession No. AA964841
tttttttttttttttttagatcttagaagacatttttattttagcccatggtttcaatctattacagcagggaaacctagacagagtccatggaagtgaggaggggggctggagtggtggagagctggtgcccctcacaccgtgaagcaaggcagataacaagagatagcaaggcagacccagaagtagttgtgagcttcaaaggcatccctctagtaaaccatctctatcagcaagccacacacttcggagtgtccacgacagcctagcgttgtaccaccagttgggggacaggcagtcaaacatattcaggcataagatgggggcacgtttcagacttaaaccacaacaggtagcaacaacaagaagactgaaacagggggactttataaagaaaagaggataatttagctcataagcataaaggctgggaatccaa

SEQ ID NO: 696 - DNA, 355 bp, Rattus norvegicus
  Genbank Accession No. AA964866
  misc_feature (1)..(355): n = a or c or g or t
tttttttttttttttttaatatacaatcttttatttctaggtttaaaaaaaaaaaagacttaaattatcaggacattatttacaagattaaccacctccatgtgcgtgaggtgttggggtgggccttgtacatgctaggcaaaccctgagcctagggtagtcacatttaagtcatcacactgggcatgaaggggacaccgagggcccctctttgtgccaggctgggatgcctgggacaactcattttccaaagtgaagccgaggaaccagtcttctgacggccagagcagctaacactgaagaaagaacctcaggcctgtanccgcgtgggctgccagtgatgggactgactgtc

SEQ ID NO: 697 - DNA, 481 bp, Rattus norvegicus
  Genbank Accession No. AA965161
tttttttttttttttttgagtttctatgatacaaatattagagtgatatttttaactttaagtagctaggagccaaatacctgaatggcaccttgatgtgaggcagggaagagtaatgcctcccggactcacatcatctcccagacaaatctatccccaaaagtcactgtgtcctttatcatttaagaagcacagcatgaaacagtgtttatatggcagagctaggactggagaaagtaaacactagggtctccttcagctccacatcctggctgaaaaagagggctagcctgggcaacaagagcctgcgtagaggaattccttggttaggaggcagaaaatttgactggatgagacagagagagcttggagtcacagttgccatggccctggattgcagaaaccacggcttcctggttgagtaggagaaaggtcttggaaagtgggtggcagatgacccaaggatagttgcctcgtgccg

SEQ ID NO: 698 - DNA, 511 bp, Rattus norvegicus
  Genbank Accession No. AA965164
  misc_feature (1)..(511): n = a or c or g or t
tttttttttttttttttcgtctttgttctttttaataacttcaaaataaagtcttgtttcagtgcattggtcttggtggccaggggagggcgttccaagccctctcccacgtccccaggagccctttgatctttctggggcttgctgtaggaatcctggatctggtgagcttccataagcttccatcgctgtctgggcactggtcagtgcagatgtggtcacatgcctcagtagccatggagctgctgaggtgtcaggggtcagctggtgcaactcagtaggtcatggccatccaggggctctgggcttgcttgtatcgtatggtggcagcttttcccccaccagggcctcagttccagcagccgatgcacgagctgggcgcagcgcacggcagacatgctctccgccagacagaatatgagagagatggcccagaggcacaggctanagctgtaaattcgagtagggtcaaaaggacagtccggtgccagtgttgcctcgtgccgaattc

SEQ ID NO: 699 - DNA, 442 bp, Rattus norvegicus
  Genbank Accession No. AA965207
tttttttttttttctataacggggatgtttttattgagactcgggaggtcaaaaaactcagaccagggaatccggacctgatggatatcagggctttgccagtggtagaggcggccccatgggggcaggacaagcacccactcctctgtcttcagcagcgtctttagcaaggatgccacccggatatagacatccctgcggagattaaagccttccggggggttgacatcatacagaaggtaccgtctgcgggatgccgcccccgacaggatgtccgccgccgactggccaggccagaattcttctcctgaagccgagaccggccgccaggatgctgctgccagcagcagacagacgacgctgagcgccgccatggccccggcggccacgcacttccggctgccgcgccccgctccggaagcgcgcctgtctgcccggcgga

SEQ ID NO: 700 - DNA, 414 bp, Rattus norvegicus
  Genbank Accession No. AA996451
tttttttttttttttttgttgaaccaggaagctttatttacacagtaaaagtaacaagcaaattcctgagactagagcggctgtagtgcaagacagtcgcggcctgtgggggaaggcaggcagtggtgtgcggtgctagtgagaagacccagcatgggctgccgtcctggtgggggcctgaccaccgcaccctccgttcaccacactgcctgaaacagtaccgctgagcacacgtggccctagcacagcctgcaggcccatctgtccctgacccctgggcacccccgcaacactgacaacgcacttcatttgccaatgagactatgctactgtcaggctaccctacctagcctaaagagccccaacagcctgcaatttaaagtatctttcccttcctccttcaaggtagcactg

SEQ ID NO: 701 - DNA, 358 bp, Rattus norvegicus
  Genbank Accession No. AA996583
tttttttttttttttttgaagagttagcaatcttttatttgcttttctttctgattcatgctgctttgtccctgaaacacagagctcaagtgattcattgtctaatttcctcacattattcttggtcccaacctccttgcattgacttgtttcacttttccagtttggtctgcccatgtgtaaacccccacaagtagccaactgacgccacaactcatggtgggaggcgggaagctgctgcaggaaaccaaatgcagtcgctcaacctgcttcttcttggtcacttctgttctagtttcttcataaatggcagaaccatgccatttgtcatataaatatcacacagacccccatctaa

SEQ ID NO: 702 - DNA, 480 bp, Rattus norvegicus
  Genbank Accession No. AA996658
  misc_feature (1)..(480): n = a or c or g or t
tttttttttttttttttggattttctatcttttggaatgtttatttctatacagatcgtttttccttttctagtccaacctcttgaagaacaagaaaaatatttggttgttccacgtcacacaggacacatgctaaccactcactcactgtgggtttactggaaatgaacaggagatggggatactagtgggcggacaagttcaagagaggaagaacaaccgccgtgaagagcggaatccccagacctgtaattacacactttcagaaggagctaagcagaaacactaggcgaagagcgacgtagagagtcgcaggcgacttcttgctgaggctctgacgtcagtaccttgcgaccgtcctctccgatacctgattcaatcctgaagctgaacttcagcanaaacctccacagcagctcgccgcgaggccaaacctggagccacaaccatccctcgcgtcctgctttcctttctcgcaac

SEQ ID NO: 703 - DNA, 283 bp, Rattus norvegicus
  Genbank Accession No. AA996740
cggtcgccaaactttttttttattggtgtttattttttgtcacaacagagtttattatgaaaacatgctcatgtggggacagcggggaagactaatacatctgggttgggtggctcaagtgaagtattgcggcttcttcacattgatgccatactcgctgaaggcacgggtcaagtcctccatggttacggtgtacatgcgatgcttgctcttgctccgggagctgccagaggctgtacccttcaatttgcactgctgtctggcatcattggcaatagctgac

SEQ ID NO: 704 - DNA, 459 bp, Rattus norvegicus
  Genbank Accession No. AA996832
tttttttttttttttttaaataaataaattatttttaaattatattttgatagtcacaaaaatattcacccagttgtcgaagtattccttttcagcgggactctttaaattactttatccatcagaccgtgtaaagctgggcgtatgagtcagacagttgacttggtcttctgttctccgtgactcttgtatgtatgcgtgcatgaactgaagcccaaataactcctgttcttcctctccatctacgtcatcactgggaggaagtgtcacttccagtcttagtgggttgtctcgaaagttgacgaacctcagactcgtcatttcttccatgcagcctggaatatcttgtagcttgttgttgctgagaacaagagtccccaagtttttcatattcctgattgtctctggcaggcatgttatttcattcctctgtagccacagtgtatgtaaactttgcat

SEQ ID NO: 705 - DNA, 407 bp, Rattus norvegicus
  Genbank Accession No. AA996953
tttttttttttttttctggttcaaaaggtctttaatttagttaaaaatctcttcaaaatagagcacagttttacagagttcctagtatcctattatacagttactaattagccttcctccttatatatttatatatacttcatatatgcaggcaaagaaggaggttatttgtgatacaacgtcacacaattaattacagtaccagctcgagtggcacagagcagctttagacagagacatcgcagacaggaagaaccacgcggcagcatcacagcttatcactttccagtctctgcttctcatcctgccccgcctgtcctaggcgagataaaagtttgctatatgcttccctctgtgcaatatttttgccgaggccccatttcagctcggaatccttcagagactga

SEQ ID NO: 706 - DNA, 529 bp, Rattus norvegicus
  Genbank Accession No. AA996955
tttttttttttttttttaagttagaaattgaccaaattgtccaaataatgatggtgattttctccccatctactctggcaccgccacctagtggcagattcacagcagccacatagaaggtttggcccagctctgggaacttgatggtggtgcatcaaattattttactaggtaaatgcactagtacacaaagtttccaggcaatactgattaaaataaaagaaacaacaaaacagcctacctcttatgtgttaccaaaatgtactttgctttgactcatttccctactcattcctcattacctgggaatggcactcagataacgaggttatcacaggaaaagaactgaccacttggagataaatgattctcaaggcagacagtaaggaggtgtgcactcctcctgagttccctaagttctcagcacagaccacagaacatctaccagcacagaacagctctactcctcgtaagcacatcattacagttagaaatagtcatatgttactcttaagtttataagcagaaa

SEQ ID NO: 707 - DNA, 369 bp, Rattus norvegicus
  Genbank Accession No. AA996993
tttttctttttttttttgcaggtttaactgattttaattgaacatgttggacacatggtgttgcacatgccattaatcttaacaattggaacacagatcctaaacagctacacactaagcatttataaacattcacaaacaaaaacagtttgcaactttttgaggaattgtagacacaagcaactaataacagccatgtggtcagctggaacttgagattagcactttggacctttcacttcaagcccgtcagcttccatcttcttcctcgtctcgaagatcgcacttattttcttccactgtcgatcaagctctgccttagcagtgggttcattgaagcgcctggttttccgtccccgtggtcagcaa

SEQ ID NO: 708 - DNA, 317 bp, Rattus norvegicus
  Genbank Accession No. AA997191
tttttttttttttttttaaaaaagaaagacctacttgttgttttaattccacctacccccacccgaccccaagcaccatggctggcagatgagcagtgtaccccaaagagcctcaggaggtgctggcccaccctcctctacataaacgtgcagaagccctggggacaggcagacttgcttcagttcacatcatggtgaacatggcgactctgggtcaagattagaactcagatccctccctctaggctagtgcttcctcttctcctagcttggtgttgagaacagaggtgggtgcaaggtgtgtctgaagctggagg

SEQ ID NO: 709 - DNA, 429 bp, Rattus norvegicus
  Genbank Accession No. AA997289
tttttttttttttttttctgccatggctgattctgaagcccatggttcttgagtgatttattagatgactggaaaaaaccctgtggactcttaggcttgcttccggaggcataaccgtgctggtgaacagcagagacatcatcgtaagggatgtgtctaggaaggtggcagggaggtgaggaactataatttcttctgccaatcctattagaatctagtcttctttgggtcccacaatttagaccagaattttttctctcctgcggaatgaactcagcagcatctgtattaaatttaaaagtgcctgagaccggaggcgcctccgccatcccgtgccgcagcacctcaagcgagccccgccaccgagcgagggctgtcacctggtcacgtgtcccggatttccggcgtccagagactattcgttcctac

SEQ ID NO: 710 - DNA, 429 bp, Rattus norvegicus
  Genbank Accession No. AA997330
tttttttttttttttttcagtgtagacatttttattggtgagaagagtgcaaaatagcaaaaaatccagaggagtgaggaaaggatggggtatgcctccttccggacgtgtgcccgtcctattaccaagcaagtggggagggagtggtcggtttaacagtgacacttttgaacccagcagcctccaaccatagtgcccggacagtaaggctcctgggaggcacgggggaagagagatgggtgacgcactgggaagtgtatgggtcgaatcctactctggttgtttggaaatcagtccgctgtataccttggccctcaggaaatcctcacagcttatggcaaggacacaggtttcaagagattgaactcccatccctccaaacacccaaggagctgtcttgagcctcagtttgcctcttcctaaagatca

SEQ ID NO: 711 - DNA, 491 bp, Rattus norvegicus
  Genbank Accession No. AA997341
tttttttttttttttttgaggtgcagacaactttattacaattctctccaaacgtcaaagtgcatttattaccaaggttagatctaatatataacatattaaattacaaggcagaaggcatttataatcagatatattgcatttccctatactgcccaaaatatatctttgtaagaacagcagcaacaacacgcacagtagtttataaccccaaaaatatctccccagtatcataaacatttaaactgaaactgattttatccattttcctccaatataaagaagcaacaaagctatcttctacatgtcttactgttggcacctaaaagttgtgtaaagcatgaaaacatccactgccttatatatacttcctttagtagataacaggatctttaaaattaactaaagtaaaagaatactgtttccccactgcaagcaagggtaaaatatttttctgttgttgttttgttttgttttgatagtcgcctaaa

SEQ ID NO: 712 - DNA, 403 bp, Rattus norvegicus
  Genbank Accession No. AA997386
tttttttttttttttttgcgaaaccaaatcagaaaagtcttttatttaaaagtaccaagggattttgcagaccacgtgggttcccagttttagaccttgagcagggactcaaaagcacagactctccagggcccatcttcctgcgggttcactttactgtggcgatcaagtgcatgatagtttgatgtttgtattaaagggaataatgcaccaagacatgtaccgcaaacaagctctgtggataaaacataaaactcagaagaaatgtgcttcttagcgccctctctggtgaatccaaatgtcccatcccaccttactctccacagactgatggcaaaattcatctccctctctctccattgggtaatgttgcccagttttaccacggagaaagacgaaccaa

SEQ ID NO: 713 - DNA, 472 bp, Rattus norvegicus
  Genbank Accession No. AA997412
  misc_feature (1)..(472): n = a or c or g or t
tttttttttttttttttcaatttgttaaatgaaattgtattttgcccacggctgcttctgtttgatccccagggacagagaagcaggggaagggaggggtggggagagccgcaggagtgcccaggtgcaaggcgggaggggtgtccttgatgggaggctgcaggcttgggcaggaaagaagctcattgcagggtagagatacatcctaggcgggctaggtacccaggacgagcccagccgagcctgggcagacgccgccctgaaccctgctcaaaactcacactaatgggccctgccacgttgctggcactgaggccgctgctcgctgttggcacacgtcagacacgatcaacacgtagcctgtgccacacccagtcgggcatggggaggggcaggaggagaaggggactgacttgggctttttgggtcaacccaaactgttgcctgctgccttgagttccctcncccacgt

SEQ ID NO: 714 - DNA, 329 bp, Rattus norvegicus
  Genbank Accession No. AA997466
  misc_feature (1)..(329): n = a or c or g or t
tttttttttttttttttacaaactcggccacactcgccggctgtacatttaatcagtgcacattatttacagaactaaacgatgcggggagggggtggatggccccacccctcgctggctctcaggttctgtagaggtgatacctaaagggtgctgctggcacacccctcccatctgtcacctctagtgccaggctctaagaatccaccacttgcagagaggcggtgacccagaggaccctgggtggccgccctcaaggtttangaggcagaagagccagagccagctgttacagtaccatttcccacagaagcctcctgctgactcca

SEQ ID NO: 715 - DNA, 460 bp, Rattus norvegicus
  Genbank Accession No. AA997596
tttttttttttttttttgtcaggtatgcatggttttatttaaaatgtctccaataagattttccacttggaatgaacattttttttttacctctttctgcatgttgtcataaacattatctcctcatttcatggagtttcttagaaagttctagatgatgtaacagaagagtaaaatgaaagtgtggggagattaaataacagggaggtcacagcacagcgagggtgctcttgcctcaagtcagggacacacaagtgactagtgggtgaagtaacagaccgggtcatgcaagtccccttgtgtcacctggtgtcctttggcagttctggcgtctcctgtcattagcacagaagacaaagtgagtctgacagcatcatcggcaaaggggaaattgtcttctggtggctgagaggagacagacacagaagcgtggttgctggagcgttctctaatgtctgaa

SEQ ID NO: 716 - DNA, 473 bp, Rattus norvegicus
  Genbank Accession No. AA997655
  misc_feature (1)..(473): n = a or c or g or t
tttttttttttttttttgagatgttcataatcatttaatgacggctccaaacacacctgtcactcagttacagatgaaattcgcagggattatctgcctagcccaccaaccacacgaccaccatttctagaagccaggacctgcaccaaggccacagcaggaaacagcatggttattagcaagagcagatccccgggacccggctgtgcctcctcctcactgctaaggaattcctcctgngtggggctgatcggtgtggcacaggggacgggcactatctcttcagagctaggggaattctgcaaacagcacacgtcgggaagcaggcttggtgcaagcctactcaataaatagatactcaatcaccacagttgctagcagaactgtgagcctgggaaagcagagcctcgagacccctcctgaggcctggccatggcctgctagctacgtgctgcacaccagcacatctgcaa

SEQ ID NO: 717 - DNA, 483 bp, Rattus norvegicus
  Genbank Accession No. AA997694
tttttttttttttttttgtggttaaaatctgtatcatttatttgttcaacagttgagtttcttctgtggttcaggtcatgtctctggcactgagaataaagatacatcctgactcgcaaggagctcacagtctaatggggtaaacacacccaagaaaatataatacactgtaagtggggcacactggaactatcaggaatggggattatcaggaagacagagaacagagaatctaaatcccatgtgaatgtctgcaggtgagaaagacccatctagtggacacttctataaggaacaggtaaggcaatggtttgctcaccactcacctacatcagagttagctacaacgcatactaaaatgtaggttcccagtgctttgttcggcactgggacgagttgattcagcaggtcagggccccggaactgcattttaaagagctctgaagtgattccactgtatctcaggttaagaatcagtgagtt

SEQ ID NO: 718 - DNA, 370 bp, Rattus norvegicus
  Genbank Accession No. AA997765
tttttttttttttttttactttaaacccaggagactttatttcacctccagaaaggcctctccagcctcaacccacacaagaacacaaaaccaaggtgtaaactaaaacagggagggaggggaggatcactttgttgtgacatcatgacattaacccctggttggcaggaatgacggagagcggttttggcatattgcacaggcggcgtgatggaggctgcgctggtgatcctctggtggctgaggccgtttccttgtcctccccaacctcagtgcacacgcgggccagtctcagaatccactaccacttggtgtagatgtttaacaagtctttggtcttaataagcaccattacaaaccctcacattaa

SEQ ID NO: 719 - DNA, 480 bp, Rattus norvegicus
  Genbank Accession No. AA997766
  misc_feature (1)..(480): n = a or c or g or t
tttttttttttttttttgacctttctaaactttttttttaatgaaatgaaattcttttgcatgctgctgcagccttttaaagtattggagtaactggagaatcaccattgtagccagagatgcggctaccgcttctgaacagggaagttgtgtctgatgataccaagcagttacctgtgtgaatagtgcctggggctccattcagcagaaatgcagtgacagagaggcagtcacaccagttaggcagtagagaacgcagggagaagtgagatttccaccttctaattcttatcctaaggtggcacctgtgaacccccacacattacctgaacaaacttcccatccttaggtagctctagtctctcaagctgttttagtctccaggaggctgccaacccctctactttagttctgacttcagtggggccagcctanggagaattgttttttgttttttgttttgttttttttttacccccc

SEQ ID NO: 720 - DNA, 454 bp, Rattus norvegicus
  Genbank Accession No. AA997784
  misc_feature (1)..(454): n = a or c or g or t
tttttttttttttttttgagatggaaaatgacgtttattggggggagaaggtgccacacagagccacgtgacaaagacatggtgatagtcagaggcagaagacaaaatggaagagcacattaaggcaaatgaatgatttaggaagttagagtcattgtgaggaatggtggacaaaagaatcggccccagcccctgagctctgaccctgagatggttgaagtacagaaagagtgccttctggtacacatggatcatttggaagagtccctaatgctgggactcttcaatacagttccacatgttgcgatgaccccaaccataaaattattttcattgctacttcataactgccattttgctactgttaggaatcgcaatgtaaatacctgatatgcanaatacctgatatatgacctcccaaaaggccanaatcctcagattgagtaccacagat

SEQ ID NO: 721 - DNA, 382 bp, Rattus norvegicus
  Genbank Accession No. AA997800
tttttttttttttttttggcagtgaatttcacagagctttattgggtaggacagagggccacatttctacctgtttacccaccaaacatttaaactgctattgctctgagagatccctggtgatcttcatgatctccattggagcttgaagagagtatgatcaggaaagctcaaagcttccttccttaagcacaggcaatattatttacagttcaccttcacactggagatgaaaatcatactggaatctatcactaaaccaaatttacttttccttcttaaatgtctttgctacacagtttcacttttctggtgacttcttgttcttaatatcttggtgtatacaatgtcttcatccttcttcagagtttttgcatctttc

SEQ ID NO: 722 - DNA, 351 bp, Rattus norvegicus
  Genbank Accession No. AA997851
tttttttttttttttttctggtttcatgtctgatttattggtaaatatatgggcttggcccaggaccagccacctggccactaccctcctgctgccagctcaatggatgggctgggaggagatctctggggaggggctgggcttccccaacccacccttcttgccatcttctaggccaatgagctgagcacccctcagcctctgtttccccgaccaaaattgtgctagtcaaggtgaggaggctcctggggccagccagatgcaggtggctctgggctaagccaggcgcgtgtcttgagtcctagcctcccaccctgcccagttcatcagcacaggatccagcttgaaggc

SEQ ID NO: 723 - DNA, 540 bp, Rattus norvegicus
  Genbank Accession No. AA997883
tttttttttttttttttacaaaaatacagatttattgtgtttcaacattcttgcaactgtacagagaccaagacacacaaacgtagtcttcgtgttaaattatgaacaaattgggaaagcctcagggagtctaagctgctacggtgagaggcactccgcctcaaccccaccacagtctacagtcgctggttaatgctatggcagcaacagagaagaaagcaacgtaaggttctgatggctcagttctgtactcccagcacttgggaagctgaggcaggaggactgctacaagtctggaagtagcataggccacaccgtgagttctaaactgggataggagacagaataagaccctgactcaaagactaaaattaaaaaaacaaaaacaaaacagccatggtcttgatgtccagaggccacgggtgtgcacatgacctgagaagtcatcaacccaaagacaaacgatccaggatgcttggtcttccatggtgggaaggtgttgtcctaagcccacgagtacatcctgcaacaacaaaacct

SEQ ID NO: 724 - DNA, 398 bp, Rattus norvegicus
  Genbank Accession No. AA997904
cggccgctgccgccgcctgccggggcatgtcgtggacgccggcagagacaaacgcgctcatcgctgtgtggggcaacgagcggctggtggaggcgcggtaccagcagctggagggagccggcacggtattcggcagcaaggcccctgggccggccatgtacgagcgcgtgtcccgggccctggccgagctgggctacgagcggaccccgtcccaatgccgggagcgcatcaaggtaaccggccgctctgcccggggcagcgaaccagaggcagagaaggcggggaagcgggcctgggggcgggggccgggccgagcacggggctcccctcccgggccccgggtaccccttgtgtctgctccgcctctttcttctctccctgggaaggggcgcttcttt

SEQ ID NO: 725 - DNA, 390 bp, Rattus norvegicus
  Genbank Accession No. AA997985
cggccgccgcgggccggagagaagggaagggaagggcgcggggacgcggggcgcatcttggcggggacgccgggcgcatctcggcggggccgggcaagcgataggagcggcgcccggggtccccggagtcccctcggtcccccacctccgcgggacggcggcggcgcggtgacacggtcctgggctcgcgggcgacggggagggcatcccgaaggggtctggactgcggcttgacaggtgtcgggcgggtggggctcctgctcccgagcgaagtgacaggtgcaggctctactccagcgacgcccaggcgcggagccggcgggtcctggagagccccggtcagacgcaaaaacaattgaaataaatattaaaaaaaaaaaaaaaaaatct

SEQ ID NO: 726 - DNA, 298 bp, Rattus norvegicus
  Genbank Accession No. AA998006
tttttttttttttttttgagtggcaatgtcacgactttatttatggtgcctgtgctttgtctcaaaaataccttctcctcctccccagacaataggtggggaggaggcagcaaaaatagaacatccctccctattgcacatggaccctatatacaggcccacctggcagaggccagtgggactcttggcacattcctggtccctgctggggaaggggggaggagtgctgggtagcatcacacgtgaggtgggaccctggggcaaccactctgcttctggatacttatctttgcatttc

SEQ ID NO: 727 - DNA, 492 bp, Rattus norvegicus
  Genbank Accession No. AA998053
tttttttttttttttttcctatttcaaggactttattgagaagagttttgttaattagattttacaattaacattttacaaattagaaatgttatcagcctcagcgtaagttgtaaactcttcagaaaacactagaccatccttcattatttctttgggtttttctgctccatgctgagctcctgagatgcatttttctttccagcttcattttcatcttccttagaagatgaagaatcacattcctgacatatccatccatagcctgtttgtttaggagattttttcaaaggaggatctaaacagccaaaatggtagcacagtctgcattcatcacatctgacgagattctcattctctccagttcctttgcaagttgaacattcagttcttaagtcttcagccttgggcttcttctgcagcacagactgcctctgccttctttccctaggaactctttcctcatgtttttcttcctcaggaacaaagctt

SEQ ID NO: 728 - DNA, 484 bp, Rattus norvegicus
  Genbank Accession No. AA998152
tttttttttttttttttgcagtaaataaagcctttattccaacagttgacgcagtacaggcacaggtcagattaaaaaaaaggagaggaaaaaggaaaaaaatatttttagcactttacatcttacaagtttgctgttttgtgtctacattcatccattgcacatggaatcccctggatttgaaatcttttagcaaaattagaacaacacaaagttctttacacaggtccaggctctggctgtgttttccttaaatataaaacagggtctgtctgtgtctgagctgctgctgctgtcagactggaccagccacgccctagtcctcagcaggcttgctgggttttgctaaccacatcagaggtgcgtccgcggcttcccaggggcttctgccagctgtagggctgagcccactgggccttgggctccgctgcccagaattcagtgtgtgaagagacaaaaccagtaaccactgagtccagtgtgc

SEQ ID NO: 729 - DNA, 545 bp, Rattus norvegicus
  Genbank Accession No. AA998174
tttttttttttttttttgaattttaactttattatgtctcttgtagggatcacaaacggaactctccaatacactttaattattcaaaggcctttcagagattccattgcgtgaggtcaacactatttaataccatgcaattgtttcctaaaataaggccatctttgacgttagtttgcacacttgttctctgtaaaatgcctttcaggcacaggccagattaatttgctgttatcagcttagttcttaatgcagaaaagtaaatttaaaaaacacaagtctcattattttgtccaagctggcctcaaatccctatgctcaaatgatcctcctgcttcaacttctgaaaaaaccaagcttatagtaagcacccaggtaaattttagtaaacccagtgtacatggtggtatataccagacttgcctacatagcaaattcaaagccagtgtaagccatgcaagaccccatctcaagaaagaaagaaaacaaaaaacagaaaaacctttttagataacaaaaagtggctttgggagtggtggcatatt

SEQ ID NO: 730 - DNA, 415 bp, Rattus norvegicus
  Genbank Accession No. AA998195
tttttttttttttttttgcttgccaagaaggtgtttattcttcatcctcattttcattctcctgacctgagccttccgatctgtcaccctccagacggtcagctcggatatgattcagtgacgccaacatcctcaacatgaaagaggccgggacagtgatgggtttctagtctcttccagcatgagctcatttcgagttataacttcatcagcaagttttcgattaaaaattcttgactcttctagtggcgaccagatctttatgtcataatctataccagatgaggctagaattgggtcaaatggatggggctgcaggcagttgaccacgtgattatcagcttccagaagcatcaaatgctcagcagtgtgccggtcccagatgaagatatggccacaatcggaaccgctcatt

SEQ ID NO: 731 - DNA, 409 bp, Rattus norvegicus
  Genbank Accession No. AA998207
tttttttttttttttttaaattggaattctttaatggtttcctaagcaacagtggtcagacagagtaagttttcttatgaaaaaaatgctaaaacttcttttgaacaaaggaatattcaaccttaagaaaaaccttaaaagactttattactggtactttccaattgaacactagcagcccaagccttctaccttaagttgaactcttaaaaaaataagttttaaaacactctatgctaatatatttacagtttatatagaaattttcaataatcaaaatacatctttagcaaaaatttagaatgttaaatttttataaaataagcaagaccaatagaaaaggagaattcagtaccatttcagacttagcttaagacagaggttctcctaactcctggcaactctttgg

SEQ ID NO: 732 - DNA, 452 bp, Rattus norvegicus
  Genbank Accession No. AA998256
  misc_feature (1)..(452): n = a or c or g or t
tttttttttttttttttgagttcactttgttttttatttgtctttatttacagcaaagtacatagggtgtggtcatttcatagcactaacaaaggtanggcagtaaaaagcaaaggggaagaggcagcatcttctagggaaaagaacagcctaggtctctagccactcaacctagctcctgaggcaggcctgggtgggaactcactgcctgagagaaacaggaagccgctgaaacacgtcacctgtgcctggcaccgtgagaacagagcaggcccagagccgaatcttaaagacttgcgtacgccagacgcattcaattgtgcctttcccaacctgctctcttccttgttctgacagaaagcatacagcaattgcctggaggaaagaataaacctcacgggagacacaggcggccagctggtccttcccagaaagcatgggtctgcatgttc

SEQ ID NO: 733 - DNA, 124 bp, Rattus norvegicus
  Genbank Accession No. AA998345
ttttttttttttttttgcaagttaagaagatttattgacagactagtcttgcagtccaaaaccgggctgaccgaggctcaagaagtttgccatggaaaaacccgttttggattcaatccccaaa

SEQ ID NO: 734 - DNA, 274 bp, Rattus norvegicus
  Genbank Accession No. AA998375
tttttttttttttttctatgtaataacttttaatctaatgcagagctggaaagacagttcagcagttaagaggacctgtggattttacagagaactggggtttggttcctaacactcaaatggctgctgacaagcatctgcgactctagttccagaagatctgacgccctcttctgacgtccaagggcgtgcatgtgcatggcacctagacatacacatagccaaaaccacccacacacataaaattttaaaaatccttttaaaatatttttta

SEQ ID NO: 735 - DNA, 402 bp, Rattus norvegicus
  Genbank Accession No. AA998430
tttttttttttttttttgtcaggcaccattttttataaaaacgcatagtctcattttccactctttaaaatcacattcaaaaatcggcaaagaaacgccccaggagtgagtagacaataggggagggtgcgcccacccagccccagagggagagggcgcgacaccacacacagctgcgcgactggcacaagggggcatgcggtgggcaaggtggcacctgtggatggtggccactgacatgacatgggctagggggctggacagtgtgggtgggggcacactgaccagccaggacagggagggccggccccagctgggttcttatgctgtgccacccacctgcccaggctgtcccactgtggtcctgggcagatgagcctcacccagcccagagttagggat

SEQ ID NO: 736 - DNA, 617 bp, Rattus norvegicus
  Genbank Accession No. AA998565
tttttttttttttttttgtgatttttgttgggcctctttatttagaacctggcggacgaggagccctgggcagttggtatgggcagtacaggaaccatttttcgacagtctggtcaccaagtttaagagcaatctaataatgtggaggacactgtcagctaactgaagatgaatgtgtgggggcttttactcaacaaccattcctctagagtctaatacaaaagtagatttacatttgtgggtaatctgaagctggtgatttctagtgcctttggtaataatcaataagccagcagttgcgcggcagagggatccacgcatggataaatacaaacattaaattagcataatttttaactttttgttcaaatatacatgtttttcccttttctcggccttttccctcggtccacattttccaatttccccccccttttttctttttatctttttgcactgagagcgagtagagattaaacattttacataaatgatttaaagctttacaccttgggaccagcgtactccttgcacatggtacagagtgttctcaatacattgcacagttttcagatttccacaaaaccgtgggctgctctgcgcaaccatctccggtt

SEQ ID NO: 737 - DNA, 557 bp, Rattus norvegicus
  Genbank Accession No. AA998660
tttttttttttttttttccgaataaagtttattaaataatatgtacagcgaagtagtaattcaacatgtctatcaaatcaatccacggcagtaaggaaaaacaataaatgaacagaaaaacctgtgtctgcgtagtacacgcgcttggtgtgcaatttaaatgcaatactctaataggttacatagatcggttttgtttttttctctcaataatgtcttcttttttggtagtaacctattccagcaatgtgacttaatactactgcagataaataggactgcaaacgtaaaactgcaaatatgatatgatagctgtcttctcttccccagagaacgagtgaatatgttaacaatttcccaggactatttttgtgctaaaggtccgcaagtgaattattcgaaattccttcatttaaataaaagtgttgggggggggaaacccttcgtgacttcattttactccctttctgctcaacttttaaaaattatttcttctatacaaggtaagtacatgggctccacaaagttaaacatacattacatatttacagtcccac

SEQ ID NO: 738 - DNA, 450 bp, Rattus norvegicus
  Genbank Accession No. AA998979
tttttttttttttttttcacaggtacagaggacctggcggtgggcaagtttattccacttcatgcagacactgacccacacgctcagggagcttaaaaatacactgacccacatggcatctatcccccacctccccatgagacacggagagacacttggctgagtggggtccatgggtccaaaagcctccatcctcattctggaacaaggcagcagtgtgggcccaggtagcagggaggagcagcgtcctttctccccagacgaaagtgcacagacagggcagaggccccagagccgggaggccccactctcccggtcaattggcaacaagcaggctgggcaggtatccttcacagtggctatcctttgaaggacctggtggcctagctgtgggtcacagcaatcaggaaaacagggagctggtggcaccactgtggctggctggacaca

SEQ ID NO: 739 - DNA, 420 bp, Rattus norvegicus
  Genbank Accession No. AA999110
tttttttttttctttttgtgcagtactttatttctcaaaggagttgcaaagggccaggcctcagctattctgagaagcactgatttgggtgctttatagatctgttatcgtctacagagttcatgcttcaaaactgtataattgagtcacaacagatttcaaaagcttatctcaatgtcttcagtaagtttacagctttgcaatgggccacattcatagctgtcctctgtcacatgtggctgcatatactgtgcaggttggaaatgcctgtcttagggtttgaactctgagcagaagacgggaccagaatatgccaagaagcattgggcatattgcagtgactagtgtcctcagtagccaaaaaaatggtgcaagtctgtttcggttggaaacgaagccaaatgtgtaggcagatgtcat

SEQ ID NO: 740 - DNA, 4171 bp, Rattus norvegicus
  Genbank Accession No. AB005540
ggcacgaggtctccccagcgcccggcggtccagcagcccgcgccccgccgcctcgctcctccccggctccgctgcccggagtactgggccgtccgcgaggctccgcggcccgggagccatgttgagcggggggctcggccacgcgtgaggcggccggcggccctcgcggagcggaaggcgcgagagggggaggcctgagcctgaggcgcctcggcgcgtccgccgccaccggacctgcatccgctcgttctgcgcgcccgcccgcccgtccgcccggagcccgcgatctccgcacttgctgaatttttcaagccatatccagctgataggatgaaaaagtttaagaggagactgtccctcacgctcaggggaagccagactattgatgagtccctgtcggagctggctgaacagatgaccatagaggagagcagtagcaaagacaacgagcccattgtgaagaatggcaggccgccaacgtctcacagcatgcattccttcctccatcagtacacagggtccttcaagaagcccccactgcgaagaccccacagcgttattggaggaagccttggttcctttatggcaatgcccagaaatggaagcagattagatattgttcatgaaaatctgaaaatgggatcagatggtgagagtgaccaagcttctgggacatcatctgatgaagtccagtcccctacaggtgtttgcctcagaaatcgtatacatagacggatctcgatggaggacttgaataagcggctgtcgctgcctgcagacatcaggatacccgatggctacctggagaagctgcagatcagcagcccgcccttcgaccagcccatgagccgcaggtcccgcagagcctccttatcagaaattgggtttgggaaaatggaaacctacatcaaattggaaaagcttggagagggcacatatgcaacggtatataaagggagaagtaagttgacagagaacttggtggcattaaaagagatccgcttggaacacgaagaaggtgcaccctgtacagctataagagaagtttcactgttaaaggacttaaaacatgcaaatatagtaacgttgcatgacatcgttcacacggacaagtctttgactctggtctttgagtacctggacaaagacctgaagcagtacatggacgactgtgggagcatcatgagcatgcacaacgtcaagctgttcctgtaccagattctccgtggtttggcatattgccatagaagaaaagtgttgcaccgggacctgaaaccacagaacctcctcattaatgaaagaggagaactaaagctggctgactttggactagccagagccaagtcagtccccaccaagacctactcaaatgaagttgtcacgctgtggtatcggccccctgacgtgcttcttggttcctcggagtactcaactcagatcgacatgtggggagttggctgcattttctttgaaatggcttctggaagaccactgtttccagggtcaactgtggaagatgaactgcacttaatatttcgactactaggaactccatctcaggaaacttggccaggtgtttcttcaaatgatgaattcaagaactacaacttcccaaaatataagccacaacctctaattaatcatgcacccaggttagattctgaaggaattgagttgataacaaagtttcttcagtatgaatctaagaaaagggctccagcagaagaggccatgaaacatgtgtacttccgaagtctagggccgagaatacatgctttaccagaaagcgtatcaatattcagtttgaaagagattcagttgcaaaaggacccgggttttcgaaattcttcctatccagagacaggtgtgtttgtcataaaccatttcacatgtcgatcatgaattttttttcgtggagccaagctttgggtttataaatcgatcagtaaaattattgatgtaaaaaaaaaaaaccaacaatgtacagtgcatcccaaaactctgtatttttagaattgcatatacttgctgttctgtacaatgtgggcagcgcagtaaatcttcagagagaaatgtgattcagtcaagtcagggatcctgcgagctgcagatggcacagagacctttcacaagtgacctggcttgaccactgcacacgccatccctggtacccgaggcagaagacacggcttgtgcttacctagccatccgcttcgtcactcggaagcctagaagctgtagactgaccccgtcaacacaaaggccctttaagacagtgccgaccactcttaccgtggaatagtagcgtttgctggtgggaatgttagcctcctagagtcaccaaatactgtatgtgggataatcactgagccttgaactgcctcatgaaatgactttatattttaggacatgggaagaacagaagacagagcatgctcttttaagtctggtagcttggtctcaagcccagccccagcctttcttaccagccatggactcagagctgaaggcagtcatttcttgtgctggacttgggatctccgtgtgtctgcactgtcctcttcccagtggagtctttttatttcagacctacagattgtttttatatttcttgtcacagtgtgacaatttttttttttttgtacagttggttttaaggtcttctctgcctgtagagccaggaggttacagctctcaatgtaactgtggctgcagatttgtgcaggactgagaaacacagtgcattatttattgtggaatcattgctgctaaataactactgtctgtttatttaacacaacagttgaatgcctgaagaagttgcagtggctttattagatgtgaacgcatctgtttctcctcacaaattgtttgactgctgcatttcgttgttgttttgttttgtttgtttgtttgtttttaaaaaaaaattaaactgcagtgtttcctggaatgtatatttagctttgcttagcagtaaaataagtgagccatcgtgaacactcgaagttcgtgctacttataatttcttaggagcattggccaatagagtagctgagagagggacagcaccgtgtgtttgggaagcgtgtaatgtgaggggctgagccaagcaaatgaatagcagccattttgggttcccacatcagacaccaatcaactaagaacaccaagttatccatttttacctattcctcacctgagagatgtctactgcctcttcgtatgcctacacttgattaacttttacactgtgctttcagttaacatttaaccgtagaggtcattcaaacaggaaaagccttgctgctgtttgtctgaagcacgtttcttttcctagatactacttcattttgaggaacagtttctttcacttgggggctgtgtatgtttcaaataacgttcacttggaataaccagctgaaactgactctgtctttaaatggagccatgatgaattagaaatgagaaataagagcccagaggactgccttagcattgtgggtattatctgctcatcagagacactaacagtgtaacttgaattatgcatgtccttgaccatcacagacactcggtgttggtaaccgtgtcttaggcattcgtgttcatcgttaaggactattggttagtgcatcttacaactagaaatcttaattggtatactttgaaatggtcatgtaagtttttgccttatatcatgaaaatagttataacttaatttttgtcctgccattcactgtaaaacattcagggtcctctcatttctgttcaggaaatcctgtagtttattgtttgttatttaacagtattaaagtgagtttttgtatattttcattttaactttatttgtgaatagtgattgtggcatgtttggggatgttattttaatatttcacaatactgaaattttaatttttttttttaaaaaaagaaagttctggaagaaacagattcatgtgtaacagtgaatattggaccactgctgcttttcacgattgtcagctggttttatgttaagccccgtagcctaactgctgttatttctaactgacagacatgtattaatattgtactttgaaggttataaatattatgtgaaaattccttccttcgttttgaaatttataataactaaatctctgtgttatataaaatgtgatctttgtgg

SEQ ID NO: 741 - DNA, 944 bp, Rattus norvegicus
  Genbank Accession No. AB006450
caagatggaggagtacgcgagagagccgtgcccctggagaattgtggatgactgtggcggtgcctttaccatgggtaccataggtggtggcatcttccaggccttcaaaggttttcgaaattctccagtgggagtaaaccacagactccgagggagtttaacagctattaaaaccagggccccacaattgggaggtagctttgcagtttggggaggcctgttttccacgattgactgtggtatggttcagataagaggcaaagaagacccctggaactccatcactagcggtgccttaacaggagccatcctggcagcaagaaatggaccggtagccatggttgggtcagctgcgatgggcggcattctcctagctttaattgaaggagctggtatcctgttgaccaggtttgcctctgcacagtttcctaatggccctcagtttgctgaagaccactcccagttgccttcaagccagttgccgtcctcaccatttggagactaccgacagtatcagtaggacttggtccccgggattcctggacctgggtggactgcagtttggtagggtttcagaagatcaagttacagtctgttgaaagccttaggtgggacaccggcggccaagcaggccatcaagagacatttagcacatttttctatttaaaagagactcagagtgtggaaaagataccgagtttatttattcatgcttggattgcgtctgtgatcaaaataaatgtctaataccatttaaagaatgtatatgaacttagaagataaaggaccaaaggccacataacagtgaaattcgactgtccttccttcgggacttttttgcctggtgtttatgtacagttgttcagacaataaaaggcttttgggacttgacctttccaaaaaaaaaaaaaaaaaaaaaaaaaaaagcggccgctgaattctag

SEQ ID NO: 742 - DNA, 5253 bp, Rattus norvegicus
  Genbank Accession No. AB012214
ggaattcgcggccggtcgacccggggtctcgttcagagctgtcctgtcgtctgcaacctgcaagatgccagcacgaacagctccagcccgagtgcctgcacttgcctccccggcaggctcgctccccgaccatgtccgcaggcggctcaaagacttggaaagagatggcttaacagaaaaggagtgtgtgaaagagaaattgaacttactgcatgaattcctgcaaacagaaataaaaagccagctatgcgacttggaaaccaaactacataaagaggaattgtctgaggaaggctacctggctaaagtcaagacccttctaaataaggatttgtgcctggagaacggaacactctctctcactcagaaagccaacggttgtcctgccaacgggagtcggccaacctggaaagcagaaatggcagactcaaaccgatccccaagatccaggcccaagcctcggggacccaggaggagcaagtcggacagtgagaccatgattgaagcttcatctagttcggtggctacgaggagaaccaccaggcagaccaccatcacgtctcacttcaagggtcccgctaaacggaaacccaaggaagactctgaaaagggaaacgcaaatgaatctgctgcagaggagagagaccaggataagaaacgcagagtcgcaggcacagagagtcgtgccagtcgtgccggagagtctgtggagaaacctgaacgagtaaggccaggaacccagctgtgtcaggaagagcaaggtgaacaggaagatgacaggagacctcgacgtcaaaccagagagctagcatcaaggcggaaatcaagggaggacccagacagagaagcaaggccaggaactcacttggatgtggacgatgacgatgaaaaggacaaaagaagttccaggcccagaagccagcccagagatctagccaccaaacggagacccaaggaagaagtagagcagatcactccagagcctcccgagggcaaagatgaggacgaaagggaggagaagagacgaaaaacgacacgtaaaaagccggaaccactcagcattcccgtacagagcagagtggagagaaaagcctctcagggcaaagcaagtgcaatcccaaagctcaacccgccacagtgccctgagtgtggccagtacctagatgaccctgacctgaagtaccagcagcaccctgtggatgctgtggatgaaccccagatgctgaccaatgaggcactgtccgtctttgactccaactcgtcttggtttgagacctatgattcctctcccatgcataagttcactttcttcagtgtgtattgcagtcgcggtcacttgtgtcctgtcgacactggtctcattgagaagaacgttgaactctacttttctggtgttgccaaagcaattcatgaagaaaatccgtctgtggaaggtggtgttaatggcaagaacctggggccaatcaatcagtggtggatcagtggctttgacggtggcgagaaggcgctcattggcttttctaccgcatttgctgaatactttctgatggagcccagcccagagtatgcaccaatatttgggctgatgcaggagaaaatttacatcagcaagattgtggtcgagttcctgcagagcaatcctgacgctgtctatgaagacttgatcaataagatcgagaccactgttcctccttctgccatcaatgtgaaccggttcaccgaggactccctcctacgccatgcccagtttgtggtgagccaggtagaaagttacgacgacgctaaggacgatgatgagacgcccatcttcttgtctccctgtatgaggtccctgatccatttggctggtgtctcgctgggacagaggcgagcaacaaggcgcacggtcatcaattctgccaaagtgaagcgcaaggggcccacaaaagccaccaccaccaagctggtctatcagatcttcgacactttcttctcggagcagatcgagaaggatgacaaggaggacaaagagaacaccatgaagcgccgccggtgtggtgtctgtgaggtctgtcaacagcctgagtgtgggaagtgcaaggcgtgcaaagacatggttaagtttggtggcaccggacggagtaaacaggcttgcctcaagaggaggtgtcctaacttggccgtaaaggaggcagatgaagacgaagaagctgatgatgatataccagagttgccgtcacccaaaaagttgcaccaagggaagaagaagaaacagaataaggatcgcatctcctggctcggggagcctgtgaagatcgaagagaacagaacttactattggaaggtgagcatcgacgaagagactctggaggtgggcgactgcgtctcggtcattccggatgatccctccaaaccactgtatctagccagggtcacagcactgtgggaagacaagaacgggcagatgttccatgcacactggttctgcgcggggacagacacggtcctcggagccacctctgaccctctggagctgttccttgtaggcgagtgtgaaaacatgcaactttcctacatccacagcaaggtcaaggtcatctacagagggccttccccaaactgggccatggagggaggcatggaccctgaggccatgttgccgggggctgaggatgggaagacctacttctaccagttctggtacagccaggactacgcaaggtttgagtccccacccaagacccagccggcggaggacaataagcacaagttctgcctatcttgtatccggctggctgagctgagacaaaaagaaatgcccaaagtcctggaacaacttgaggaggtggacggccgggtctactgcagttctatcaccaagaacggtgttgtctaccgactgggtgacagtgtgtacctgcctcctgaggcctttactttcaacatcaaaatggccagccccatgaaacgctctaagagggaccctgtgaatgagaaccctgtaccccgagacacttaccgcaagtattccgactacatcaaaggaagcaacctggacgcccctgaaccctatcggattggtcggataaaagagatctactgtggcaagaagaaaggtggcaaggtcaatgaggcagacatcaagatcaggctctacaagttctataggcctgagaacacccacaagtccatccaggcaacctaccacgccgacatcaacctgctctactggagcgatgaggaagccgtggtggacttcagcgacgtgcaaggccgctgcaccgtggagtacggagaggacctgcttgagagcatccaggattactcacagggcggccccgaccgcttctactttctcgaggcctacaattcaaagactaaaagctttgaagaccctccgaaccatgcccgcagccctgggaacaaaggcaaaggaaaggggaaagggaaagggaagggaaaacctcaggtatcagagcccaaagagcccgaggcagccatcaaactgcctaagctgcggaccctggatgtgttttctggctgtggaggattaacagaaggattccaccaagcaggcatctcggagacgctgtgggccatcgagatgtgggaaccagcagcccaggcatttcggttgaacaaccctggcaccacggtgttcacagaggactgcaacgtgcttctcaagctggtcatggctggtgaggtgaccaactctctgggccagaggctgccacagaagggcgatgtggagatgctgtgtggtgggccgccctgccagggcttcagtggcatgaaccgtttcaactctcgtacttactccaagttcaaaaactccctcgtggtctccttcctcagctactgtgactactaccggcctcggttcttcctcttggagaatgtcaggaactccgtgtccttcaggcgctccatggtgctgaagctcacactgcgctgcctggtccgcatgggctaccagtgcaccttcggtgtgctccaggctggacagtatggtgtggcccagacacgaaggagggccatcatcttggctgcagcccctggagagaagctgcctctgttcccagaacctctacacgtgtttgccccccgtgcctgccagctgagtgttgtggtggacgacaagaagttcgttagcaacattacaaggctaagctcgggtcccttccgaaccatcacggtgcgagataccatgtctgacctccctgagatccagaatggagcctcagcccccgagatctcctacaatggagagccacagtcctggttccagaggcagctgcgagggtctcactaccagcccatcctcagggaccatatctgcaaggacatgagcgcgctggtggctgcccgtatgcggcacatcccgctgtccccaggatcggattggcgtgacctgcccaacatacaagtgcggctgagagatggcgtcataaccaataaacttcgctacactttccacgacacgaagaacggctgcagcagcaccggggccctccgtggggtctgctcctgtgcggaaggcaagacctgcgaccctgcttccagacaattcaacacgctcatcccctggtgcctgccgcacactgggaaccggcacaaccactgggctggcctctacgggcgtctggagtgggatggcttcttcagtaccaccgtcaccaaccctgagcccatgggcaagcaaggccgggtgctccatcccgagcagcaccgggtcgtgagtgtgcgggaatgtgctcgctcccaaggctttccagatacctaccggttattcggcaacatcctggacagacaccggcaggtggggaacgctgtgccaccaccactggccaaagccatcggcctggagattaagctctgtctgctggccagcgctcaggagagtgcctcagctgcagttaaaggaaaggaggagactactaccgaggactagtgctctcacccagagccccacgtgcactgatgtttttaacccgtcgagccccatcatttgaagtgttctgctcagtgtctgtgaccatggctgacactaagctgtttggaggtttgttttgtgaccaagccgtgtagtctttgtgcattctgaattttaaggttttgtttttttgtttttttgttttgtttttttattctgtattctatcagatctgccactgtgtgggtggcaagtgagacttgatgtagttttatatgttgtaatatttcttcaaaataaagcgcttctataaagcaaaaaaaaaaaaaaaaaaaaaa

SEQ ID NO: 743 - DNA, 1624 bp, Rattus norvegicus
  Genbank Accession No. AB012231
gaagtccaagccacaatgatcctgccaagaatcctccagggtacctagaggacagttttgtaaaatccggagtcttcaacgtatcagagcttgtgagagtatccagaacacccataacccaggggactggagtcaacttcccaatcggagaaatccccagccaaccatactatcatgacatgaactctggcgtgaacctgcagaggtcgctgtcttctccaccgagcagcaaaagacccaaaactatatccatagatgaaaatatggagccaagtcctacaggagacttttacccctctccaaattcaccagctgctggaagtcgaacatggcatgagcgagatcaagatatgtcttctccaactacaatgaagaagcctgagaagccactgtttagctctacatctccacaggattcttccccaagattgagcacttttccccagcaccaccatcccggaatacctggagtcgcgcacagtgtcatctcaactcgaactccacctccaccctcaccgttgccatttccaacgcaagctatccttcctccagcaccatcaagttacttttctcatccaacaatcagatatcctcctcacctgaatcctcaggatactctgaagaactatgtaccttcttatgacccgtccagtcctcaaacgagccagcctaacagcagtggtcaagtagtagggaaagtgcctggccatttcacgcctgtcttggcaccctctccccatcccagtgcagtgcgacctgtgaccctgaccatgacagatactaaacccatcactacatccactgaagcctacacagcctcaggcacatctcaagccaatcgatatgtgggactaagcccaagagacccatccttcctgcatcagcaacagtcctggtacctgggctagcttggttccttttcaagtgtcaaataggacacccatcttaccggcaaatgtccaaaattatggtttgaacataattggagaacctttccttcaagcggagacaagcaactgaggggaaagaaacacaaccatagtgtaagaaaattaggggaaaaacacccaacaaaagaaaagaggaagactggacaacagggagaaaggagagaaactgaagaaagaagacgctagaccagcattgcagcacttccggtcactaattcccttaaggttgagactgtagtgacaggaaagggtcaatgacatctcaccgatgctagactgcagcccctgcaccgtagcctttgttccatgaagtccgctgggaaatagatgttctgtctctatgacaatatattttaactgactttctagatgccttaatatttgcatgataagctagttttcttggttagtattcttgttgtttacgcatggagtcactattcctggttatctcaacaacgaaggctaggaggcggcgtcagaggggctggggacagagccatgagccagccattttataagcactctgatttctaaaagttaaaaaaaattatatatatatatatataaaaatctctgtagcctttagttatccgtacagatttattaaattttggcccttaacccagccttttccagtgtgtaacccagtttgaaaatcttaaaaaaaaaaa

SEQ ID NO: 744 - DNA, 2351 bp, Rattus norvegicus
  Genbank Accession No. AB015645
ctaactccaatccaggggatgcaatgccatcttctggcctccagaggcactacatacacacatgatacacagaatatacacacgtgtatatttaggtaaagtgcctgtgcacataaaaaaaaataaaaaggaaaaaaattaaatcagaaggaacaggcaccggtcacttaccaaggtcaaggcctacagggcaccacagaaaacaccagcaagatggatggccccagtaatgtctcgctcattcacggtgacaccacgctgggcctgccagagtacaaggtggtctcagtcttcctagtgctcctggtgtgcaccctgggcatcgtgggcaatgccatggtgattctggtggtgctgacctcacgtgacatgcacacacccaccaactgctacctggtcagcctggccctcgctgacctcctcgtgctgctggctgcgggtctgcccaatgtctctgacagcctagtggggcactggatctatggacgtgctggctgcttgggcatcacctacttccagtacctgggcatcaatgtctcctccttctccatcctggccttcactgtggagaggtatatagccatttgccacccactgagagcacagaccgtgtgcactgtggcccgggccaaacggatcatcgcaggcatctggggggtcacgtccctctattgcctactctggttcttcctggtggatctcaatgtccgtgacaaccagcgccttgaatgtggctacaaagtgccccgaggactctacctgcccatctacctgctggacttcgctgtctttttcatcggacccttgctggtgaccctcgtgctctatgggctcatcgggaggattttatttcagagcccgttgtcccaggaagcctggcagaaggagaggcagccccatgggcagagcgaggctgcaccaggcaactgctccagggccaagagctccaggaagcaggccaccaggatgctggccgtggttgtgttgctttttgccgtgctgtggaccccttaccgcacactggtactgctcaactcctttgtggcccagcctttcctggacccctgggtcctgctgttctgccgcacctgtgtctacaccaacagcgctgtcaaccctgtcgtctacagcctgatgtcacagaagttccgggcggccttcctgaaactgtgctggtgcagggcagctgggccacagcggagggcagcacgcgtcctcaccagtaactacagtgccgcccaggagacctcagtaggaactgagaagatgtagctgggctccagtgaggtctcaggtcccacggcagcaggtcccctgggctgtcagcatgagccctacttcagtgtgctctgaggactcccgcctggcccctgaccccgcttgcggcctggttggcatttgggaggcatcaggagaggggcaggcagctccttgcttatgggtttccagaggttcctttaccatggaggaaggcgctggaatgttctcagctgcaccctgcgtgggtaattctcctctctgcagagaggaagctggaggcccagccttcagcgcctgtgggatcaaatcccctcatccgtgttcactcagtgctttaagcacctttcacgggtgtcacctaatgtccttccatgctgccatcgcatctgtccctcgctgagtccgtgcacacagggaccctggactctggggtttacatagaacgggtgtccagccagtcacgtcgcactctgggctgctccatgaggttcatctccagcctcagcaccccttccagtcctccatcacagtgggcagccctgcaagagactctgccaagtgagctcaaccactgtgcatgttcctgaaggagatcactatttgtctttccgatggccatcaggcggccacctctacctcctcgaccccaaatgtgcaggcctggctctctgaacccactttgccagctgctgccctgcataccacgtctactggaggcgcgctgcggactcagagacgaggcggcaggaaaagcctttgctgagggacagcccagtcgctggctgagcctgaggacagcaggcctctgggtcccaccctgcaaatgtggtcagtgatcctatctcggtcctgagacctcaaggtggagggactcagtcgcgaggatgttccaacaagcagggctgtttgctctgtgacgggagacctcaggaaggcaggaattggggggatggatgctttggggtgtgtggtcggcctgggtgactcagcctactcaagctgtttctggcttcctggctggatgtggtcctagtgactcatccctgctctggggagctcaggtgctccaaaatagatgtggctttttaggg

SEQ ID NO: 745 - DNA, 1903 bp, Rattus norvegicus
  Genbank Accession No. AB017544
gtcaggcctgaggaagatggcgtcctcggagcaggcagagcagccgaaccagcccagctcttctccaggaagtgaaaatgtggtgcctcgagagcctctgattgccacagcagtgaagttcctacagaactctcgggtccggcagagcccacttgcgaccaggagagcatttcttaagaagaaagggctgacagatgaagagattgacctggctttccagcagtcgggcactgcttccgacgagccttcacccgtgggcccagctaccccggtggttcctgtccagccccctcacctcatttcacagccatacagccccggaggttcccgatggcgagattacggtgccttggccatcatcctggcaggaattgcatttggcttccaccagctctacaagaagtacctgctgcccctcatcctgggaggccgagaggaccggaagcagctggagaggatggcggcgagtctctcggaactgagtggcagtgtggcccagacagtgactcaggtacagacaacactggcctctgtccaggagctactgagacagcagcagcagaaggtccaggagctagcccatgagctggccgctgccaaggctaccacatcaaccaactggatcctggagtcccagaatatcaatgagctcaagtcagaaatcaactctctgaaaggacttcttctgaatcggagacagttccctccctccccgtcagccccgaagatcccctcctggcagatcccagtgaagtctccgtcaccctccagccccgcggccgtgaaccaccacagcagcagtgacatctcccctgtcagcaatgagtctccgtcctcctctccagggaaggacggccacagccctgagggctccacagccacataccgcctgctggggcctcaggaagagggggaaggggtgatggacgtcaagggccaggtgaggatggaggtgcaaggggaggaggagaagagggaggacgaggagggcgaggaggatgaggatgatgacgtgagccacgtggatgaagaggacgtcctcggggtacagagggaggacagacggggcggcgatgggcagatcaatgagcaggtagagaagctgcggcggccagagggcgccagcaatgagagtgagcgagactagggctggcgcttggttgcccgccttcccagtgccccagggcctcagaggcgggtgggcaagagttgtggctctgcttccatgaggggggccggaaacccaggtaggggtggggccgtccttccgtgcagtgtgggctgcgtttcttttcaccagcctcccagacaggttcccagccccagccacgggcccaggccgagaactcgggagctctgcactccagccccctccttgacgggtgtcttgtctaggtgtgtcctctgagtaccttgaccacctgacaccatgcatggccagagctcatgtcatttcctgcctctgtcacctcagtgcaggggaactatggcccccctcggtcttgctgtctcccccactgtgccctggcctggcttgtggcttcttctttgcctgttccaatagccagggtgccagccccgctcttcatctctggggctgccagccttcccacagccaggtcctggctgacagatgccgcccttgggcgcctgtccccagcccacctgcccgttgttttttataccacacgagacgtcctcgcttgctgtgtcgtggtttagctactcagtggtgaggcgtgcttctccctcctgcggtggaggaggcagcagggccttcctgaccaacagccatgtctgtccttcccactgagaaacacatgttcatttacgtgatcatgtatagatttcagactataagataagactgtacataatgtaataaatacgagttgccatattt

SEQ ID NO: 746 - DNA, 1586 bp, Rattus norvegicus
  Genbank Accession No. AF002281
gatcccccgggctgcagggaactaagtgggttgtccgggttccgagactagcgctctgcagagacaccagatcgctggaccctctcacaggaaggcgtcatgccccaaaacgtagttctcccgggccctgcgtcctgggggttcagactctcaggaggcatagacttcaaccagcctttggtcatcaccaggatcactccgggaagcaaggcagaagccgccaacctgtgccctggcgacatgatactggctatcgatggctttggtacggagtccatgactcatgctgatgctcaggacaggatcaaagcagcatcttaccagttgtgtctcaagattgacagggcagaaactcgcttatgtcccgcagtgtcggaagatgggaaagcgcatccctttaaaatcaacctagaggctgaaccgcaggatgtgaactactttgaacacaagcacaatattcggcccaaacctttcataattccaggccgaaccagtggctgcagcactccttccggtattgactgtggcagtggacgtagcaccccttcttccgtcagtaccgttagtacgatctgcccaggtgacttgaaagttgctgctaagatggcccctaacattcctttggaaatggaacttccgggcgtgaagattgtacatgctcagtttaacactcctatgcagttgtactcagatgacaatattatggaaacacttcagggtcaggtttccacagctctaggggagacaccctccatgagtgaacccacagcttcagttccccctcagtcggacgtgtaccgaatgctgcacgacaatcgggatgaaccagctgctcctcgccagtcaggctccttcagggtcctgcaggagctggtgaacgacgggtctgatgaccgtcctgctggaactcgaagtgtgaggccggttactaaagtccatggcggggctggcggtgcccagaggatgccactctgtgacaagtgtggcagtggtattgtaggtgctgtggtcaaggcccgggataagtaccggcaccccgagtgctttgtgtgtgctgactgtaacctcaacctcaagcagaaaggttacttcttcgtggagggggagctgtattgtgagatgcacgcaagagcccgggcgaggcccccagaaggctacgacaccgtcactctgtaccccaaagcttaaattctttacagacgagaacactcattcacgcatgcgcacacacgaacaccggcggatgataaggaggacttcaagcaggaggagtgcgaaggtcacctcccaatcgaaagcgaggcttttagtcatttatcttactgtgtagtgagggaaagacatggggagcagaggcctgcctactgacaaaagtattatctgtgggttgtaattctttatctttggggacagcaatggtgacatttaaagcaataacgttgtaataccatgctctacggtttccatctgttacacgcccatccgatgcgtgaacacctggatatgtagggggggtccacttgtctttccttccaagttgcttttggtaattgtagtaacgccaaattacagctttgtactggaac

SEQ ID NO: 747 - DNA, 3471 bp, Rattus norvegicus
  Genbank Accession No. AF016296
ggcacgaggaccggctgaggattttatggttcttaagcggacttaagagcgttgtttcggattgttaagattcccgtttgctgggttttcctccctcaatcgtgctctcccgcggctgcctggggactggctcggcgaaggaggatggagagggggctgccgttgctgtgcgccacgctcgcccttgccctcgccctggcgggcgctttccgcagcgataaatgtggcgggactataaaaattgaaaacccggggtaccttacatctcccggctaccctcattcttaccatccaagtgagaaatgtgaatggctaatccaagctccggagccctaccagagaatcatgatcaacttcaacccacatttcgatttggaggacagagactgcaagtatgactatgtggaagtgatcgatggagagaatgaaggtggccgcctgtgggggaagttctgtgggaagatcgcaccttcacctgtggtgtcttcagggccatttctcttcatcaaatttgtctctgactatgagacccacggggcaggattttccatccgctatgaaatcttcaagagagggcccgaatgttctcagaactatacagcacctactggagtgataaagtcccctgggttccctgaaaaataccccaacagcttggagtgcacctacatcatctttgcaccaaagatgtctgagataatcctagagtttgaaagttttgacctggagcaagactcaaatcctcccggaggagtgttctgtcgctatgaccggctggagatctgggatggattccctgaagttggccctcacattgggcgttactgtgggcagaaaactcctggccggatccgctcctcttcaggcattctatccatggtcttctacactgacagcgcaatagcaaaggaaggtttctcagccaactacagcgtgctgcagagcagcatctctgaagatttcaagtgtatggaggctctgggcatggaatctggagagatccattctgaccagatcactgcatcttcccagtatggtaccaactggtctgttgagcgctcccgcctgaactaccctgaaaacgggtggacaccaggagaggactcctacagggagtggatccaggtggacttgggcctcctgcgattcgttactgctgtggggacacagggtgccatttccaaggaaaccaagaagaaatattatgtcaagacttacagagtagacatcagctccaacggagaggactggatcaccctgaaggagggaaataaagccattatctttcagggaaacaccaatcccacggatgttgtctttggagttttccccaaaccactgataactcgatttgtccgaatcaaacctgcatcctgggaaactggaatatctatgagatttgaagtttatggctgcaagataacagattacccttgctctggaatgttgggcatggtgtctggacttatttcagactcccagattacagcatccaaccaaggagacaggaactggatgccagaaaacatccgcctggtgaccagtcgaaccggctgggccctgccaccctcaccccacccatacatcaatgaatggctccaagtggacctgggagatgagaagatagtaagaggtgtcatcattcaaggtgggaagcaccgagaaaacaaagtgttcatgaggaagttcaagatcgcctacagtaacaatggttctgactggaaaatgatcatggatgacagcaagcgcaaggctaagtcttttgaaggcaacaacaactatgacacacctgagctccgggcctttacacctctctccacaagattcatcaggatctaccccgagagagccacacatagtgggctcggactgaggatggagctactgggctgtgaagtagaagtgcctacagctggacccacgacacccaatgggaaccccgtggacgagtgtgacgatgaccaggccaactgccacagtggcacaggtgatgacttccagctcacaggaggcaccactgtcctggccacagagaagccaaccattatagacagcaccatccaatcagagttcccgacatacggttttaactgcgagtttggctggggctctcacaagacattctgccactgggaacatgacagccacgcgcagctcaggtggagggtgctgaccagcaagacggggcccattcaggaccacacaggagatggcaacttcatctattcccaagctgatgaaaatcagaaaggcaaagtagcccgcctggtgagccctgtggtctattcccagagttctgcccactgcatgaccttctggtatcacatgtccggctctcatgtgggtacactgagggtcaaactgcactaccagaagccagaggaatatgatcaactggtctggatggtggtcgggcaccaaggagaccactggaaggaagggcgtgtcttgctgcacaaatctctgaaactgtatcaggttatttttgaaggtgaaatcggaaaaggaaacctcggtgggattgctgtggatgatatcagtattaacaaccacattcctcaggaggactgtgcaaaaccaacagacctagataaaaagaacacagaaattaaaatagatgaaacagggagcaccccaggatatgaagaagggaaaggcgacaagaacatctccaggaagccaggcaatgtgcttaagaccctggaccccatcctgatcaccatcatagccatgagtgccctgggggtgctcctgggtgcagtctgtggagttgtgctgtactgtgcctgttggcacaatgggatgtcggaaaggaacctatctgccctggagaactataactttgaacttgtggatggtgtaaagttgaaaaaagataaactgaacccacagagtaattactcagaggcgtgaaggcacggagctggagggaacaagggaggagcgcggcaggagaacagtggaggcgcagggactctgttactctgctttcactgtaagctgggaagggcggggactctgttactccgctttcactgtaagctcggaagggcatccgcgatgccatgccaggcttttctcaggagcttcaatgagcatcacctacagacacaagcaggtgactgcggtaacaacaggaatcatgtacagcctgctttcttctcttggtttcgtttgggtaatcagaagccagttgagaccaagtgtgactgacttcatggttcatcctacttggccccctttttcctctctttctccttaccctgtggtggattcttctcggaaactgcaaaatccaagatgctggcactaggcgttgttcagtgggctctttcgatggacatgtgacctatagcccagtgcctagagcatattagcataaccacatttcaggggacaccaatgtccgcttttgcatcgctacgtgcagcgagcacaggaaaaagaaaaaaaaaaaaaaaaaaactcgag

SEQ ID NO: 748 - DNA, 669 bp, Rattus norvegicus
  Genbank Accession No. AF016387
ccaagatgaaggacatgcggatggataagtcggagctcgggtgcctgcgcgccattgtgctgttcaatccagatgccaagggtttgtccaacccctcggaggtggagtctcttcgagagaaggtttatgccaccctcgagccctataccaagcagaagtatccggaacagcctggcaggtttgccaagcttctgctgcgcctcccagctctgcgctccattggattgaaatgcctggaacacctcttcttcttcaagctcattggggatacccccattgacaccttcctcatggagatgttggagacccctctgcagatcacctgaaactcctcggcagtagcttcctcacccagagtgacccctgggctggtgtgtgtgtcgccctacccctgcacactgtcctctcccactctgacttcccttcctgtccccaaaatgtgatgcttgtcccgaataactacaacctttctacacatgagacttttctaggtggagttttgtatggttgttaaaggtgacccttctttgctacttaaggggctgagtctggcagttcttggaagagtagccaagcctctgtacatataattatcttggtttaaattattttttcacttgccatggaaagcaaacaaatggaaaagaaaataataaatacgatactggc

SEQ ID NO: 749 - DNA, 1892 bp, Rattus norvegicus
  Genbank Accession No. AF034218
cgggcgggcttagctggtaccaggatggcggcggccctggcgtgggtcctggcggcgcctggtgcgagttcctgagctgctaccaggcaggtgacacttcctgtagcccccagcatgcgggcaggactgggtcccatcatcacactggccctagtgctggaggtagcatgggcctcggagcttaagcccacagcgccgcccatcttcaccggccgaccctttgtggtagcatggaatgtacccacacaagaatgtgctccgcgccacaaagtgcccctggaccttagggccttcgatgtggaggctacacctaacgagggttttttcaaccagaatatcaccaccttctactatgaccgtctaggcctgtatccacgttttgatgcagctgggatgtctgtgcatggtggcgtgcctcagaacggtagcctctgtgcacacctgcccatgctgaaggaagctgtggaacgctacattcagacccaagagcctgcggggctggcggtcattgactgggaggaatggcgaccagtgtgggttcgaaactggcaggagaaagatgtgtaccggcagtcttcacgccagctggtggccagtcgacaccctgactggccatcagaccgaatagtgaagcaggcgcagtacgaattcgagttcgctgctcggcagttcatgttgaacacactccgttacgtcaaggcagtcagacctcagcacctgtggggcttctacctctttcctgactgctataatcatgattacgtacagaactgggatagctacacaggccgctgtcctgacgtggaggtggcacaaaatgaccagttggcctggctctgggctgaaaatacagctctctttccctccgtgtacctggacaagacgctggcatcctccaaacacagccgcaactttgtcagcttccgtgttcaggaagcccttcgtgtggctcacacccaccatgcaaaccatgcactccccgtgtatgtcttcacgcgtcccacatatacccgaaggctcacagaacttaaccagatggacctcatctctaccatcggtgaaagcgccgccctgggctcagctggtgttatcttctggggcgactcagtgtacgcttcaagtatggaaaactgccagaacctcaagaagtacctaacgcagacgctggtcccctacatagtcaatgtgtcctgggccacccagtactgcagttggacccagtgccatggccatgggcgctgtgtgcgccgcaatcccagcgccagtaccttcttgcacctcagtcccagcagcttccgcctggtgcctggccgcacgcccagtgaaccccagcttcgacctgagggggagctcagcgaagatgacctcagctacctgcagatgcactttcgctgccactgctatctgggctggggtggtgagcagtgccagtggaaccataaacgggcagctggggatgccagtagagcctgggctggagcccacctcgccagtctcctgggtttggtagctatgactctcacctggaccttataagggatctctccccgcagatagcagtccagctggcctctggcacaaggatctccttggcacaaggagcctgttagggggtaggcaaatgagtctggagttggagtgggcagtacccccaggatgcctagaagagcatccataccacctgtcacccccctgttctaagggggagagaaacatcccctgagatgccctcatcttgccagagaagacgaggatacagttaggccggggaaggcctacctctactctctgttcctggatagtttataatcttggggtctcttttgtaaattaaatacaaaacaactgcaaaaaaaaaaaaaaaaaaaaaaaaaaaaaaaaaaaaaaaaaaa

SEQ ID NO: 750 - DNA, 1416 bp, Rattus norvegicus
  Genbank Accession No. AF054618
atgtggaaagcctctgcaggccatgctgtgtccatcacccaggatgatggggaagccgatgactgggagactgaccctgattttgtgaacgatgtgagtgaaaaggaacagagatggggcgccaaaaccgtgcagggatcggggcaccaggaacacatcaacatacacaagcttcgagagaatgtcttccaagaacaccagacactcaaggagaatgagctggaaacgggacccaaggcttcccatggctatggcgggaagtttggtgtggagcaagataggatggacaaatcagctgtgggccatgagtaccagtcaaagctctccaagcactgctcacaagtggactcagtccggggcttcggaggcaagttcggtgtccagatggacagggtggatcagtctgctgtaggctttgaataccaggggaagacggagaagcacgcctcccagaaagactactccagtggtttcggtggcaaatatggagtgcaagctgaccgtgtagacaagagtgctgtggggtttgactaccagggcaagacggagaagcacgagtcacagaaagattactccaaaggttttggtggcaaatacggaattgacaaggacaaggtggataaaagcgctgtgggctttgagtatcaaggcaaaacagagaagcatgagtcccagaaagactatgtaaaaggctttggaggaaagtttggtgtgcagaaggatcggatggacaagaacgcatccacctttgaagaagtggtccaggtgccgtctgcctatcagaagactgtccccattgaggctgtgaccagcaaaaccagtaatattcgtgctaactttgaaagcctggcaaaggagagagagcaggaggacagacggaaggcagaagccgagagagctcagcggatggcccaagaaaggcaggagcaggaggctcgaaggaagctggaagagcaagccagagccaagaagcagacaccccctgcatcccctagtcctcagccagctgaagacagaccaccatccagccccatctatgaggatacagctccgttgaaggccgagcccagctacggaagtagtgagcctgagcctgagtacagcactgaggctgcaggccttcctgaggccagcaaccagcaaggtctggcctacacatcagagcctgtttacgagaccacagaggttcctggccactaccaagcagaggatgacacctacgatgggtatgagagtgacctgggcatcacagccatcgccctgtatgactaccaggctgctggcgatgatgaaatctcctttgaccctgatgatgtcatcaccaacatagaaatgattgacgatggctggtggcgtggggtgtgcaaaggcagatatgggctcttcccggccaactatgtggagctgcggcagtag

SEQ ID NO: 751 - DNA, 1971 bp, Rattus norvegicus
  Genbank Accession No. AF056034
atgaatgacgtgtcacagaaggcagagattctgctttcttcatctaaacctgtccccaaatcctatgtgccaaaactcggcaagggagatgtaaaggataaatttgaagccatgcagagggccagggaagaaagaaatcaaaggcgatctagagatgaaaagcaaagaagaaaagaacaatatattagagaaagagaatggaacaggagaaagcaggagattaaagacatgctcgcttctgatgaggaagaagagccgtctaaagtagaaaaggcttatgtcccaaagctcacagggacagttaaaggcaaatttgatgaaatggagaaacacagacaggaagaacaaaggaagagaacagaagaggagagaaaacgcagaattgagcaggatctgttagaaaagaggaaaatgcagcgtgaattagcaaaaagagctgagcaggaaggagatgactcactccttataacagtggtccctgccaaatcatacagagcagctgcaaacaggaaggatcctgaggacctggacagagaacacaggaatggaagggttagtcaggaagaagaaaagacaagacatgaagaagagtgcagagctctcaaagaagcaaaatgcctttcattggtcatggatgatgaaacagaggccaaaaaagaatcacgttttcctggaaaattgaaatcaacttttgaagaactggaacgacaaagacaagaaaaccgcaagaagcaagcagaagaggaagcaagacggcgcttagaagaagagaggcgtgcctttgaggaagcaaggcggaacatggtaaacgaggaggatgaaagccaagacacagaaacggtttttaaagagtaccgcccaggaaaactccgactcagttttgaggaaatagaaaggcaaaggagagaagaggaaaaacgaaaggccgaggaggaggcgcgaaggaggatggaggaggagaagaaggcatttgctgaagccaggagaagcatggtattagatgatgattccccagagatttataaagcagtctctcaagaatctctaacgcctggaaaactggaaattaattttgaacaattattaagacaaaaaatggaagaagaaagacgacgaacagaggaagaacggaggcaaaaactagaaatggagaaacaggaatttgaacaactgagacaagaaatgggaaaggaagaagaagaaaatgaaagctttgggttgagtagagaatatgaagaattaattaaattaaaaaggagtggttcaattcaagccaaaaatctaaaaagcaagtttgaaaaaattggacagttgtctgaaaaagaagtacagaaaaagatagaagaagagagagcaaaaaggagagcaattgaccttgaaattaaagagcgagaagcagaaaacttccatgaggatgatgatgttgatgtaaaacctgcaaagaagagtgagtctccctttactcacaaagtgaacatgaaagccagatttgaacaaatggctaaggcaagacaagaagaagagcaaaggagaattgaagaacagaagttactgcggatgcagtttgaacagaaagaaatcgatgcagcacttcagaaaaaaagagaagatgatgaggaagaagaaggtagcattgttaacggctccactactgaagacgaagagcaaaccagatcaggagccccatggttcaaaaagccactaagaaatacctcagttgtagacagtgagccagtgagattcactgtgaaagtgacaggagaacccaagccagaagttacgtggtggtttgaaggagaactactgcaggatggagaagactatcagtacatcgaaagaggagaaacttactgcctgtatttaccagaaactttccccgaagatggaggagaatatatgtgtaaagcagtcaacagtaaaggctcagcagcgagtacctgtattcttaccattgaaatggatgactactag

SEQ ID NO: 752 - DNA, 1607 bp, Rattus norvegicus
  Genbank Accession No. AF062594
  misc_feature (1)..(1607): n = a or c or g or t
catgctgaaatatcgcggtttaccatatggggatggtggcgacaatctcctggagcccgtcagatcgcggaaattaccgatgcctgcgcagctccttccgctcagctccgcgtccgagcctcctggaacgatatttggagttcttaaaagatggcagacattgacaacaaagaacagtctgaacttgatcaagatttggaagatgttgaagaagtagaagaagaagaaacgggtgaagaaacaaaaatcaaagcacgtcagctaactgttcagatgatgcaaaatcctcagattcttgcagctcttcaggaaagacttgatggtctggtagacacaccaacaggatacattgaaagcttgcctaaggtagtcaaaagacgggtgaatgctctcaagaatcttcaagttaaatgtgcacagatagaagccaaattctatgaggaagttcatgaccttgagagaaagtatgctgttctctatcagcctctgtttgataagcgatttgagatcattaatgcaatttatgaacctacagaagaagaatgtgaatggaaaccagatgaggaagatgaagtttcggaggagctgaaagaaaaggccaagattgaagatgagaaaaaggatgaagaaaaagaagaccctaaaggaattcctgagttttggttgacagtttttaagaatgatttgctcagtgatatggttcaggaacatgacgaacctattctgaagcacttgaaagatattaaagtgaagttttcggacgctggccagcctatgagttttatcttagaatttcactttgaacccaacgaatatttcacaaatgaagtgttaacaaagacttacaggatgaggtcagaaccagatgattctgatcccttttcttttgatggaccagaaattatgggttgtacagggtgccagatagattggaaaaaaggaaagaatgttactttgaaaaccattaagaagaagcagaaacacaagggccgtgggacagttcgtactgtgactaaaacagtttccaagacttctttctttaacttttttgctcctcctgaagttcctgagaatggagatctggatgacgatgntgaggcaatactggctgcagactttgaaattggtcactttttacgtgagcgtataatcccaagatcagtgttatacttcactggagaagctattgaggacgatgacgatgactatgatgaagaaggtgaagaagctgatgaggaaggggaagaagaaggagatgaggaaaacgatccagactatgacccaaagaaggatcaaaacccagccgagtgcaagcagcagtgagcagtgactggccttgaggacggcctccctgtaatagcctaaacatgactcacttacttacagccttatggttttgtattttcttgatagaatcagtaagtttctaagggaaaggaaattgatattttgcagaccaatttgttctaaccagcatcccaactctagctctgtagccacgttaccgagtccagccctttactgcatgctcaggtcgctgcagtctggttctcctgagagatttcatcatgtagctattggtacattatgaaaccactgtgaacaat

SEQ ID NO: 753 - DNA, 7420 bp, Rattus norvegicus
  Genbank Accession No. AF084186
atggatccaagtggggtcaaagtgctggaaacagccgaggacatccaggagagacgacagcaggttctggatcggtaccaccgcttcaaggagctctctaccttgcggcggcagaaactggaggattcctatcgcttccagttttttcagagagatgctgaggagctggagaagtggattcaggagaagcttcaagttgcctctgatgagaactacaaagaccccaccaacttgcagggaaagctccagaaacaccaagcctttgaagctgaagtacaggccaactcaggagccattgtgaagctggatgagacaggaaacttgatgatttctgaagggcactttgcatctgagaccatccggacacgtttaatggagctgcaccgccagtgggagttgcttttggagaagatgcgggagaaaggaatcaaactgctgcaggcacagaagctggtgcagtatttgcgggagtgtgaggatgtaatggactggatcaatgacaaggaagcaattgtgacgtctgaggagctgggccaggatttggagcatgtagaggtactacagaagaagtttgaagagtttcaaactgatctggctgctcatgaagaaagagttaatgaagtaaaccagtttgctgccaaacttatccaggagcagcacccggaagaggagctgatcaagaccaagcaggaggaggtgaatgcagcttggcagcgactgaaaggcctggctcttcaaaggcaggggaagctctttggtgctgccgaggttcagcgctttaacagggatgtagatgagaccattggttggattaaggagaaagagcagttaatggcctctgatgactttggcagagacttagcaagtgttcaagctctgcttcggaagcatgagggtctggagagagatcttgctgctctagaggacaaggtgaaagccctgtgtgccgaggctgaccgcctgcaacagtcacaccctctgagtgccaaccagatccaggtgaagcgagaggaactaattaccaactgggagcagatccgaactctggccgcagagagacatgcacggcttgatgactcatacaggcttcagcgctttcttgctgacttccgtgacctcacgagctgggtgactgaaatgaaagccctcatcaatgcagacgagcttgccaatgacgtggctggtgctgaggccctgctggacaggcatcaagagcacaagggtgaaatcgatgctcatgaagatagctttaagtctgcagatgagtctgggcaggccctactcgctgctggtcactatgcctcagatgaagtgagggagaagctgagcatcctctctgaggagagagctgccctgctggagctgtgggagcttcggaggcagcagtatgagcagtgcatggacttgcagctcttctaccgagacactgagcaggtggacaactggatgagcaaacaggaggcattcctgctaaatgaagatttgggtgactccttagacagtgtggaagctcttttgaagaagcatgaggactttgagaaatctctcagtgcccaggaagaaaaaatcacagcacttgatgagtttgcaaccaagcttattcagaacaaccactacgcaatggaagatgtagccactcgacgagatgctctcctgagccgccgcaatgccctccatgagcgagccatgcatcgccgggcacagctggccgattccttccacctgcagcagttcttccgcgattccgatgagctcaaaagttgggtcaatgagaagatgaaaacggccactgatgaagcttacaaagatccgtccaacctgcaagggaaagtccaaaagcaccaggcttttgaggctgagctctcagccaaccagagccgtattgatgccctagagaaagctgggcaaaaactaatagatgtgaaccactatgccaaggaagaagtagcagctcggatgaatgaggtcatcagtttgtggaagaaacttctagaggccacagaactgaaaggagtcaagctccgagaagccaaccagcagcaacaatttaatcgcaatgttgaggacattgagttgtggctgtatgaagttgaaggtcacttggcttcagatgattatggtaaagacctcactaatgtccagaacctccagaagaagcatgctctgctagaggcagatgttgctgctcaccaggatcgaattgacggcatcacaattcaggcccgccagttccaagatgctggccatttcgatgccgaaaacattaaaaagaagcaagaggcccttgtagctcgctatgaggctctcaaggaacccatggtggcccggaagcagaagctggcagattctcttcgtctgcagcagctcttccgagatgtggaggatgaggaaacctggattcgagaaaaggagcctattgctgcgtccactaacagaggcaaagatcttattggagtccagaatctgctaaagaagcaccaagctttacaggcagaaattgctggccatgaacctcgcatcaaagcagtgacacaaaagggcaatgccatggtggaggaaggccattttgctgctgaggatgtgaaggccaaactgagtgagctcaaccagaagtgggaggcactgaaagccaaagcctcccagcggaggcaggatctggaggactcactacaggcccagcagtactttgccgacgccaatgaagctgagtcctggatgcgggagaaggagcccattgtgggcagtaccgactatgggaaggatgaagactctgctgaggctctgctcaagaagcatgaagctttgatgtccgatctcagtgcctacggcagcagcattcaagctttgcgagagcaggctcagtcatgccggcaacaagtggcccccatggatgatgagactggcaaggagctggtcttggctctctatgactatcaagagaagagccctcgtgaggtcaccatgaagaaaggggatatcctcaccttgctcaacagcacaaacaaggactggtggaaagtggaagtgaatgaccgtcagggttttgtgccagctgcgtatgtgaagaagctggaccccgcccagtcagcctcaagggagaacctcctggaagaacagggcagcattgctctgcggcaggggcagatcgacaaccagacacgcataactaaggaggccggcagtgtatctctgcgtatgaaacaggtggaagaactgtatcagtctctgctggagctgggtgagaagagaaaaggcatgttggagaagagttgcaagaagttcatgttgttccgggaagcgaacgagctacagcagtggatcaacgagaaggaagctgctctaacgagtgaagaggttggcgctgacttggagcaggtcgaggtgctgcagaagaagttcgatgacttccagaaggatctgaaagccaatgagtcccggctgaaggacattaacaaagtggccgaggacctggagtctgaaggtctcatggcggaagaagtgcaggccgtgcagcagcaggaggtgtatggtatgatgcccagggatgaagcagattccaagaccgcctccccatggaagtctgctcgactgatggtccacacagtggccaccttcaactccatcaaggagctgaatgagcgctggcggtccctgcaacagctggctgaggaacgtagccagctcctgggcagtgcacacgaagtacagaggttccacagggatgcggatgaaaccaaagaatggattgaggagaagaaccaggctctgaacacagacaactatggccatgatctagctagcgtccaggccctgcagcgcaaacacgaaggcttcgagagggaccttgcagctcttggtgacaaggtgaattcccttggggaaacagcccagaggctgatccagtcccaccctgaatctgcagaggacttaaaggaaaagtgcacagagttaaaccaggcctggaccagcctagggaagcgtgcagaccagcgcaaggccaaactgggtgactcccatgacctgcagcgcttccttagcgatttccgggacctcatgtcttggatcaatggaatacgagggttggtatcttcagatgaactggccaaggatgtcactggagctgaggctttgctggagcgacaccaggaacaccggacagaaattgatgccagggctggcactttccaggcatttgagcagtttgggcagcagctgttggctcatgggcactatgccagcccagagatcaaggagaaacttgatattcttgaccaggagcgcacagacctggagaaggcctgggttcagcgcagaatgatgctggaccactgcctggagttgcagctgttccatcgagactgtgagcaagcagagaactggatggctgcccgggaagccttcctaaacacagaagacaaaggagactcgctggacagtgtggaggctctgatcaaaaaacatgaagacttcgacaaagctatcaatgtccaggaggagaagatagctgccctgcaggcctttgccgaccagctcattgctgtggaccactatgccaagggagacattgcaaaccgacgcaatgaggtcctggacaggtggcgccgcctaaaagcccagatgattgagaaaaggtcaaagctcggagaatctcaaacacttcagcagttcagccgggatgtagatgagattgaagcctggatcagtgagaagttacaaacagccagcgatgagtcatacaaggaccccaccaacatccagagcaagcaccagaagcaccaagcctttgaggcagaactgcacgccaatgctgaccgaatccgtggagttattgacatgggcaactccctcattgagcgtggggcctgtgctggcagtgaggatgctgtcaaggcccgcctggctgcccttgcagaccagtggcagttcctggtgcagaagtcagctgagaagagccagaagctgaaagaggccaataagcagcagaacttcaacaccgggatcaaagactttgacttctggctttctgaggtggaggctctcctggcatctgaagactacggcaaagacctggcttccgtgaacaacctgctcaaaaagcatcagctgctggaggcagacatatcggcccacgaggatcgtctgaaggacctgaacagccaggctgacagcctgatgactagcagtgccttcgacacctcccaagtgaaagagaagcgggacaccatcaatggacgctttcagaagatcaagagcatggcaacctcccgaagagcaaaactgagcgagtcccatcgcctgcaccagtttttccgagacatggatgacgaggagtcctggatcaaggagaagaagttgttagtgagctctgaggactatggcagagacctcactggtgttcaaaatctgaggaagaaacacaagcggctagaagccgaactggccgcacacgaaccagccattcagggtgtcctggacacggggaagaagctgtctgatgacaacaccatcgggcaggaggagatccagcagcgtctcgcacagtttgtggagcactggaaggaactgaaacagctagcagctgcacggggccagcggctggaggagtccttggagtatcagcagtttgtggccaacgtggaggaggaggaggcttggatcaatgagaagatgaccctggtggccagcgaagactacggggacactcttgctgccatccagggcttactgaagaaacatgaagcttttgagacagacttcactgtccacaaggatcgagtgaatgatgtctgtactaatggacaagacctcattaagaagaacaatcaccatgaggagaacatctcttcaaagatgaagggtctgaatggtaaagtgtctgacctggagaaagcagcagctcagaggaaagcgaagctggatgagaactcggccttccttcagttcaattggaaggctgacgtggtggagtcctggattggtgaaaaggagaacagcttgaaaacagatgattatggccgagatctgtcttctgtccaaactctgctcaccaagcaggagacatttgatgctggcctgcaggccttccagcaggagggcattgccaatatcactgccctcaaagaccagctgctagctgccaagcacattcagtcgaaggccatcgaggcccgacatgcctccctcatgaagaggtggacccagctgttggccaattcagctacccgcaagaagaagttgctagaggcccagagtcatttccgaaaggtagaagacctcttcctgacctttgccaaaaaggcatcggctttcaacagctggtttgagaatgcagaagaggacctcacagacccagtgcgctgcaactctctggaagaaatcaaagccctccgagaggctcatgatgccttccgctcatcgctcagctctgcgcaggccgacttcaaccagctagccgagctggaccgtcagatcaagagtttccgagtggcctccaatccctacacctggttcaccatggaggccctggaagagacgtggaggaacctacagaagatcattaaggagcgagaactggagctgcagaaggaacagcggcggcaggaggagaatgacaagctacgccaagagtttgcccagcatgccaacgcgttccaccagtggatccaggaaacaagaacgtatctcctcgacgggtcctgcatggtcgaagagtcgggaactctggaatctcagcttgaagctaccaaacgcaagcaccaggagattcgggccatgagaagtcagctgaagaagattgaggacctgggggctgccatggaggaagccctcatcctggacaacaagtacactgagcacagcactgtgggcctggcccagcagtgggaccagttagaccagctgggcatgcgcatgcagcacaacctggagcagcagatccaggccaggaacacaacaggagtcactgaggaggccctcaaggagttcagcatgatgttcaaacacttcgacaaggacaagtctggccggctgaatcatcaagagttcaaatcctgccttcgttctctgggttacgacctgccaatggttgaggaaggagagcctgatcctgagtttgaggccatactggacactgttgatcccaacagggacggccacgtctccctgcaagagtacatggctttcatgatcagccgtgaaaccgagaatgtcaagtccagtgaagagatcgagagtgctttccgggccctcagctccgagggcaagccttatgtgaccaaggaggagctctaccagaacctgacccgggaacaagctgactactgtgtctcccacatgaagccctatgtggatggcaagggccgcgaacttccaactgccttcgactacgtggagttcacccgctctctctttgtgaattgat

SEQ ID NO: 754 - DNA, 345 bp, Rattus norvegicus
  Genbank Accession No. AF087437
gcagtaaaaagttcacatggtactcctgttgttgccatccctctgtaaatagtgaatgtttcttactagttctgcactgcttctgtctgtcttaatgctggcgttaagatcatatactccttttctccggtagtgcaggttttgaaaattacttttaagttattgatgcaatttcatattttttcataatctatatttaagatgacatcattgcatcattttttctaaattcatctccattaaaacttgccttaagctaccagattgctttgctattagctttactgtacatctgtatgttttatttactttcacattaaaattctgtgtagtgaaaaaaaaaaa

SEQ ID NO: 755 - DNA, 2304 bp, Rattus norvegicus
  Genbank Accession No. AF093139
attccatcctaatacgactcactatagggctcgagcggccgcccgggcaggtccaaggcgtccgggtgtttggtggcgtcaggttctgcgcctgagcccgcccctgtacctgcctgtgccatggcggacgaagggaagtcatacaacgaacatgatgaccgtgttagtttcccacaaagaagaaagaaaggtcgggggcctttccgatggaagtgtggtgtggggaatcgtaggtctggaagaggtggttctggtatacggtcttcccggtttgaggaagatgatggagatgtggcaatgaatgatccccaggatggcccccgagtgagattcaacccctataccacccgacctaaccgtcggagagatacttggcatgatcgagatcggattcatgttactgtacggagagacagagctcctcaagaaagaggaggtgctggcaccagtcaagatgggaccaccaagaactggttcaagattacaattccttatggcaaaaagtatgataaaatgtggcttctgagcatgattcaaagcaagtgcagtgtccccttcaaccccattgagtttcactatgaaaatacacgggcccatttttttgtggaaaatgccactaccgcttctgcattaaaggctgtcaactataagattcaggatcgagaaaacggaaggatatctatcatcatcaactcttctgctccaccctatattgtacagaatgaactgaagcctgaacaagtagagcagctcaagctgatcatgagcaaacgatatgatggctcccagcaagcacttgacctcaagggcctccgctcagacccagatttggtggcccagaacatcgatgttgttctaaaccgtagaggctgtatggcagccgccctgaggatcattgaagagaacattcctgagctattgtctttgaacttgagtaacaacaggctgtacaagcttgatgacatgtccagcattgtacagaaggcaccaaacttaaagatcctgaatctctctggaaacgaattgaagtccgagtgggaattagacaagataaaagggctgaagctggaagagctgtggcttgacagaaaccccatgtgtgacaccttcctagaccagtccacctatatcagcaccattcgcgaacgatttcccaagttattacgcctggatggccatgagctaccccctccaattgcctttgatgtcgaagcccctactatgttaccaccctgcaagggaagctattttggaacagagaacctaaagagtctggtcctgcacttcttgcagcagtactatgcaatttatgactcaggagaccgccagggtcttctggatgcctaccatgatggcgcctgttgctcgctaagcactccttccaaccctcagaaccctgtccgacacaacttagccaaatacttcaatgacagcagaaatgtgaagaagattaaagataccaccacgcggttccggctattaaagcatacacgtcttaatgtcgttgccttcctcaatgagttacctaaaactcaccatgacgttaactcctttgtggtagatataagtgcccaaacaagcacattgttgtgtttttctgtcaatggagtcttcaaggaagtggacgggaagtctcgagattctttacgtgctttcacgagaacgttcattgctgttcctgccagcaattcagggctatgtattgtaaatgacgaattatttgtgcggaacgccagccctgaagaaatccaaagagccttcgccatgcctgcacccacaccttcttccagcccagtacccacactctcccaagaacagcaggatatgttacaagcattttctacccagtctggcatgaacctcgagtggtctcagaagtgccttcaagacaataactgggactacaccagatctgcccaggccttcactcatctcaaggccaagggagagattccagaagtagcgtttatgaaatgatctcaagaaaagtccccttgtaaatagcccttggataatattgtctggctgtcatctgcggactcctgtccagcccgaggccacmctgtaactgtgactggggaggaagggctgcytcatccktcctcacctaccttctggaagmcttagcagaagacttccggaagattgagcctctatggtgccaggaagccaaagcttactttgtagagctdgacrctaaattaccggaaggacttaggtgctctgtgtacttaaccccagsattccctttactttttaagataaagagtgatattgtagtgtgtgtcccaaaaaaaaaaaaaa

SEQ ID NO: 756 - DNA, 931 bp, Rattus norvegicus
  Genbank Accession No. AF099093
  misc_feature (1)..(931): n = a or c or g or t
agctccaccgcggtgngccgctctagaactagtggatccccgggctncaggaattcctttcccttccgggcgtgacgcctgagaggaaagccgagcggagatctcgcataggcagcgaggtgcttctcgggtctcccaagaccggcctcccgcggcttcggcgctccagtcgcggggcccgggttcctcaacacacntagcttcagccaccgtcagagcttgtcccccatccgtcgaagtcccggcggcaccgggcttcttggtggggaggatgacggagctgcagtcggcactgctactgcgaagacagctggcagaactcaacaaaaatccagtggaaggcttttcagcaggtttaatagacgacaatgatctctatcgttgggaagtccttattattggtcctccagatacactttatgaaggtggtgtttttaaggctcatctcactttcccaaaagattatcccctccgacctcctaaaatgaaattcattacagagatttggcacccaaatgttgataaaaatggtgatgtttgcatttctattcttcatgaacctggagaggataaatatggttatgagaagccagaggaacgctggctgcctatccatactgtggaaaccatcatgattagtgtcatttctatgctggcagatcctaatggagactcacctgcaaatgtagatgctgcgaaagaatggagggaagacagaaatggagaatttaaaaggaaagttgcccgctgtgtaagaaaaagccaagaaactgcttttgagtgatgtttattcaatagctagtaacttcacttatttcagggtctccaattgagaaacatggcactgtttttycttgcacctctacccaccttattgctgggacttctgttgtaacaagttggcaaactctggctggaactgggctgcaat

SEQ ID NO: 757 - DNA, 485 bp, Rattus norvegicus
  Genbank Accession No. AF110508
ctgtgtccaacatgctgctagaaattgggggcctggagtttccggctgcccctttcagcggctggtacatgagttcagagattggcatgagggacctgtgtgaccctcaccgatacaacatacttgaggatgtggctgtctgcatggatctagacacccggacaacctcatcactgtggaaagacaaggcagcagtggaaattaacgtggctgtgctgtacagttaccagctggccaaagtgaccattgtggaccaccatgccgccacagcctccttcatgaagcacttggaaaatgagcagaaggccagagggggctgccctgctgactgggcctggatcgtgccccccatctcaggcagcctcacccctgtcttccatcaagagatggtcaactatttcctgtcccctgccttccgctaccagcctgacccctggaaaggaagtgcagcaaaaggcacaggcatcaccaggaagaagaccttt

SEQ ID NO: 758 - DNA, 442 bp, Rattus norvegicus
  Genbank Accession No. AI007656
ccaaagtagaaatttcaacaattacacagtaacaaattccgaaatatctggggccagtgagaaggctcagtgagtaaaagtacacgctgtggaatgagagaacttgttttctgaattccacatgtacccgcattcacatcatacacgtatttaataataaaattacatgtatgcatgtatataacctatgctttaatccactcactcacaggagtcatttctcagtatatgtacatatgtgtgtgtaggttatattggtgagtgcaagaggccagaggagttggacccaggagctcaagttacaaacagttgtgaactgcttgacatggatgctaggaattgaacttaagtactctctgaagagcagtgcatgctcttaaccaagaagccatctctccagtccctaaggctgttttaaacacctcattaggttttctacatg

SEQ ID NO: 759 - DNA, 407 bp, Rattus norvegicus
  Genbank Accession No. AI007744
aaagtaattacagagcaggtagtgattgacgcaaacctcacttcagtatcaaaagagtctgtggggtgagtagggccggccagggccgcgagtggagctcgctgttggggacactgtcggagttgccccctgggctctggtgaagttgtctgtctcttgtgttttgagggtggtggagtaggaggaacggacaggcgtcaaactgcaaaagggggaaaaaacaaagaaataaagaaaaaagaaagagccataaaagaagggttgttgggatgaggggaaagggtacccctcgaagaagctcctcaacccaggaaggtggcgggcagggcaggtgggcagaggacacggcaaggcggagggtggggccacctctcctgatctccaggtcctttcccattgcaggacag

SEQ ID NO: 760 - DNA, 539 bp, Rattus norvegicus
  Genbank Accession No. AI007770
caggattcacagacagagataatgatctgttttattggacatctttcccccactccaaccagtggtgtggcactgggtcgacccgcagcgcaccataccgcttgtgtcagttaatgataatctatatttataaaacgatagtccatcaaaggggggatgaatattttagaagccgcggacaaatcaaattgtctttgtcaaatgggcatgtgctcccatgcccagtgtgttttatgactctttctggggtgagaaactcagggttcccagagccgactgaagggctgcctttctcgttgagatgagaaccgagacttgctcttttaaaacagccaatgaactgtggaggttgacattagctcagtggaactgtgctctgtttgatgaagttaactgcaccggaaaccacagacgtagcagcatctttatgggcaagagtccatttatactcgcttaaataaatgcgtgtcttcgcgagtctgggttagaaggagctgagacgggtggcacacgcctgtaacccttgcactcaggaggta

SEQ ID NO: 761 - DNA, 545 bp, Rattus norvegicus
  Genbank Accession No. AI007857
ctcactaaatagaataagcttgcggccgctagagtattttttttttttttttttttttttttttttaattttgaaatacattttattttcactgttctgcactggagagatgacatccaaggagtaggggagacagagatgcctgaaacttctacccttgctgtgcatgggtcacatcgttcttctgggtaccagggccatgcctggacaccacacagttcacatcggactctgggccaggctaaccatccccacagcagtcacctctggcaggccccgacacagctgggcattctccagaaaaggtcctacttgtcctgcagagtcccagtcccgggaaggtcggactgcatcaggaccaaagcagggaaccagtgacaggagccagaccactgaggacagggaggagggccaagggtgaaggcccaccccttgctcacagaagggacactacagggcagtaatgggaggaaatggctagttagacatataagtggtttctggagaactgtactgttactctggatggtgagcgccagactcaa

SEQ ID NO: 762 - DNA, 605 bp, Rattus norvegicus
  Genbank Accession No. AI007884
accaagaatagcttttattaagacctccattagaaaacgtcagacttttaacaatactccggaatagaagatgaggaaggggaataaccatgaactcagcagcgtgtagtgcacggatttggctcattaaacccgtcattcctagaattcatagcaaaagacggcgattgctacgagtggtgggtgaaacaggagtgctgtgtttctggatactgtgcacgtcacaatacttagatgtcctgggtgacctctgaagagaagcatcaaccagtgattccaactgtacaagagacgcgcacttggaaaccttgtgactgtgagaaacatatttatacctgtcttagtgggatccagagaaacaacacgttatatataattaaaatggagaaataatagtttctcctggtgtaaaggtacatttggaatttcaaaataaataatagttctaagggaaagttgttctatttttcaaaataagataaggctgaaaagtccttatgatggatttcacatttgctttcacttttactgttaggtacagctacgaaaccaagccacacgggctcggggctgtctgcccagttaggggagccacccagacagca

SEQ ID NO: 763 - DNA, 435 bp, Rattus norvegicus
  Genbank Accession No. AI007948
tgtttacccggctgcattgtgggagtttgacctccgccgccaaccgccgcctcagctcgcgccgccgccgccgccgccgcgcacgccatgggagccgtgactgacgacgaagtcatccggaagcgtcttctgatagatggagacggtgctggagatgatcggagaattaatctcctagtgaaaagcttcattaaatggtgtaactctggatcccaagaggaaggatacagccagtaccagcggatgctgagcacgctgtctcagtgtgagttctcaatgggcaaaacgctgctggtgtatgatatgaacctcagagaaatggaaaactatgaaaaaatatacaaagaaatagaatgcagtattgctggagcacatgaaaaaattgctgagtgtaaaaagcagattcttcaggcaaaacgaatacgataaaatcga

SEQ ID NO: 764 - DNA, 493 bp, Rattus norvegicus
  Genbank Accession No. AI008074
gccgctgtcatcctcctcatcagatcccacatcctcaatcttaggcttctcctcatcctccttatcttcctcctccttctcccctttctcttcctctgcctcatcatcactgatctccttctcgcgttccttctccagatagagggtgatggggtagcctatgaactgtgagtgtttcttcaccacctccttgaccctcctctcctctaagtactctgtctggtcttctttgaggtgaaggatcactttggtaccccggccaatgggctcaccgtggtctgcacggacagtgaaggatccaccagcagaagactcccaggcatactgctcatcatcgttgtgcttcgtgatcacaaccactttctctgccaccaggtaggcagagtagaagccgacaccaaactgcccaatcatggagatgtctgcaccagcctggagagcctccatgaacgcctttgtaccagacttagcaatggttcccaagttatttatg

SEQ ID NO: 765 - DNA, 472 bp, Rattus norvegicus
  Genbank Accession No. AI008095
accagtgaaagtgtttttaatagttaaattatttaaatagacttttcaatttccatgggaaatcataattgtatcatttttgcaagagcaggaataaaaagagtgcacacaccccttagaggaacgaagagctagcactgcacgctgtcaccagtcactgctggggctgggaggggtctccatggggaaacacagtataaactcagcacacacactgtactcaggttggaagttaaacaaaacccactggcattggcaggacatgtggagggccagggacttgagaacaatgcgagagaagcagcccctgtaccagaggtgagggcagtgcagaactcgggcggggtggcagagcacagatgcaggcgtggcagttcagggtccatactttttttcttggggaggatggtgaagggcatgaaagtaacattgagctggcacttactgccacctcaccgttacccccctgtta

SEQ ID NO: 766 - DNA, 432 bp, Rattus norvegicus
  Genbank Accession No. AI008275
agagttgctgagaactccctgggagcacagtggcctaagtggccatgggatgagttttaatgtgaggcaaagtcagtccacaatacaaaaatctaaaaaccacattcagttcccacctggctcctggggaaggaagcagcagagggtttcctttgcctgcaggggatgaggaggagcagaagaagccagagaaaggggagaggggacaggcagcagaggcccgctccccatcctggagccaccttcgcctcctgcaggtgtcttcttgtctttgtcgcctacaggtcatcccctgcctgcctggtctggccctcaagggtcaggcagcgccgcctcatttctccttcttctctagcctcttggatgccgacgcctctgttgattcctctttggatccagcagggttagactcctcataactgaaccctcgtg

SEQ ID NO: 767 - DNA, 512 bp, Rattus norvegicus
  Genbank Accession No. AI008371
  misc_feature (1)..(512): n = a or c or g or t
ttagatttatttgaatagacgaattgcacacttcaagatgatcaatatgcttaatttcagtataggtattttaggttttttttaaatgacattattattttcatgcatgcacagaggccagaggacaactgtgtgtcaatctgtccttcccatcatgtgggctctagagattgaaacttgggtcgagtttagcctttacctgtgagccatgtcactagccattacacaactcttaaatgaagacattttggaaagaactgctatatggaaaagcactaatagtctacactgcccaaggttcatctttgctcctagagctaatggcttccccagagctgggttttcattttatcctatttactactgaactaaagacaaacaaacccaaaattccccagacttaaggggatttgaaccaagtaaatgggtttttgcctgtgacttaagcatgtttggtctctctccagtttccagcancacacacacaaagaaaacctaaaaccttttgttac

SEQ ID NO: 768 - DNA, 511 bp, Rattus norvegicus
  Genbank Accession No. AI008393
gggccaagactgcatttattcaggagagttgctcaatggctgcaagcagctcaggcctcaagacagattttgctggctcagctcctgctgcccttatatcctccaacactgaagcatcccaggagaaggtcagcagggcagagggtaccagcccgcattcattcagggccagggcctcgttctcctccagcttctgcccacccgaggccctcagttcaaagggcagccagtcgttctgtagcgcctctcgcacaaactggaagagcacagatagcttctcccgggcatagaaggtcccttgcagtagacagccatccggcaggcgcacacgcagaagggcataggtatacttgcgcagctcccgctgctcctccttctctcgcatggctttggtcctgagtgaactcagcttgttagccgcttctgttctgagcctttgctcacgcttcagctcctcagctgtgaggctaaagaaatctgaggggagctcaaaatgtgaggccaaggctga

SEQ ID NO: 769 - DNA, 624 bp, Rattus norvegicus
  Genbank Accession No. AI008643
aaatgtaaatatatttaaaaaattaaaacacctaagaaatgcaatctatatacatgaaaaggtaagatatttatacagtaacagctagtacaacatcgcccacaagcagcggtgctgtccattgtgttcagattttggtttaatgtcgtaatggtagatcagtgtcttcagggaaattatgtaaggtatacagcatgaggggctcacagaagactgcaaatgggaaattaatgccaaggaacagtattttctctaaaaacaaatattagtaaacaaatatcttaaactaatgaaccacaaaatgagcttattaagttcaagatatatagtcaacttgcataaaattacatgtggccatttcaaaacaatgtttctaaaataccagtaactctgactattgggatgtccacaggagacaaaatgtcattcattctcttcttatgaggaggtctggtttaggaacattacaaccatgttcttagaaaatgctacagcatccttgagaggtcacaatagtaaagcatcaatgcattctggtgccagcccaacacagcggttctggatgtgacccagactgcatttctgatgactttggcttttattctcctccacatatgtcacata

SEQ ID NO: 770 - DNA, 180 bp, Rattus norvegicus
  Genbank Accession No. AI008647
cgcatttgtgaattagttcaagaatgctagaaaagtgtcaaggtgtgtacatccatttcttctttcatgatgtttaaaagtgaccgtaattcattttgtaaactaaaaaaggaaaaacctcgtgccgaattcttggcctcgagggccaaattccctatagtgagtcgtattaaattcgta

SEQ ID NO: 771 - DNA, 574 bp, Rattus norvegicus
  Genbank Accession No. AI008689
aacagtggtaaacagtttttattcaggcaatgaaacatggaaaaaatatattagtaattatcataataatttcttttgtgtgagtataacttttacaaatatttacctgacatataaaaaggggaattactatgtgtataaaatctatgaggatgattattctgcacaacaccgtcctgacagcaggagtcaatgcagtgtgtgcccccctgccactccggggcaccaggaggtggggttggggggtgggtgctggacacagtggaagcagatgtgcaaataaacacttggcacgttagtacagtgggtatctattggcaaacacagactcgctaacggcaatactagaaagttgacaggtgccttggagactcatccgagtgtctgagtcctctcccaaggactttgagggacagcactgaggctgagggtgtgatcttcacactgccctgtatctggtctggatggagtttcagagctcagatttctgtgtgtccatttgcaaagtgattcacaaataccgaatcagtttctttcgtgatgatctcttctctgatcaatgtaagcacagcag

SEQ ID NO: 772 - DNA, 534 bp, Rattus norvegicus
  Genbank Accession No. AI008697
ggaagctgaattatgccaatttattaccattttcagaacagtgtcttcaccccggctgacctagaacttgtggggtataccaggttgactctgaactcagattcacctgcccggccatcgtgcctgacccaaacttttgatgctgaaagagacttgtctgctgttggggggagggcctgtgagaagtaaatagatgtctgatcagtctcagttctgggctctatccgacagtgcagacagggcgtgttggttcagataggtctggtcaagcacaggttgtagaacgaattggaatcaaagacatggtttaccttttgccagcccacccatccagcagcttgcaattcacaacggttttttggagtgccccagtagtgtgggtccagtatcaagacatagacttccatatctggcccctcacagattcccagcagggccttggactgagcatctgcatctcctcccaccattactgggcccccacccgctgtgaagtgtgaataaagccgctccagttctcccctaagctctgct

SEQ ID NO: 773 - DNA, 551 bp, Rattus norvegicus
  Genbank Accession No. AI008701
agaatccatgtgggtaaattcagcttagatctcagtcaggctctccctaaatgagatcaaaggctagccttttagtgtccttgagatcaggagcagggtaaggtgcccttgtggtgccctctgcagctcgctctgtgcacatgtggtatgcacgacacccacctggaacctacatggctttgccaaggaggaagagcaaccgactgaacccgagccaagaaagccagaggcatggctgaggaatgcctcttccgtggctctatgcagacaccatggaggcttggcatagaagaggcagagccacacttgcagcagcaatgagagggctggttgaacaggtaagcagacagcctgggatggttggactccagagcgtcccaccaggacatccctgccacccagagtccccagcaaggctgagcaaacagcccagttaatgggccccccaccttggattcctgtggtcacctccccagaggtctttgctgagggcatcccctagcaagctgttagggtccttgggctggtttggaatgctgactgctgcccct

SEQ ID NO: 774 - DNA, 437 bp, Rattus norvegicus
  Genbank Accession No. AI008758
ccattagaaagataatgaagttaaaatgctttaatgaaaatgctcaaagaaaggaagtaggaagaactgacgcaagtattccttcatgttagaatttgtgacacaaatattttcaacttttaacggggcaagtcgctatgttccaagctgcctcttctcactaggagacattggtaattttttaaaagcacatttacaatgctttcccatcacccttgctgtgtttatgtagcacctatagccataactggcagtgagcagctcttctcgaggcgagctgacagtagcctggttgggtttgtatgcttggacctgggtttctagccatattctctgttcccgcttctcttgttgctggcctaatgacatcattacccacgtcttgccacccccttaaataagggaacaagattttggaccagcctagtaagggggga

SEQ ID NO: 775 - DNA, 479 bp, Rattus norvegicus
  Genbank Accession No. AI008787
aaaagtcaagaacttattttatttattttaaaataaacattgaagtttccccattatccaccaccctacaaaactttgaatgtggaatgttcaacagcctaagcagttttagtaggctacaaaaccagcaaaaaactccagttgtctaatgatgaatatctgagaatagttgttttgagtggctgattaccggcttggaaaaaaaaaagtttgcaaaaggctaaaagtaaaatttaatttctttacagaaaatagcattaaggtggtaagtagcctttgcctttaacaagtggaactgattctgcaaggcgtagatggagtgggacaagtggcattcagttcacaggcacacagctcgtgctcaaactgctagcacagatcccagcacaggacatctggttaggtcactgctgaactttgcatctctgtcaaacggtacactctctttatgcacctacggcagagtcaacactttgagc

SEQ ID NO: 776 - DNA, 535 bp, Rattus norvegicus
  Genbank Accession No. AI008796
accagacacaagggactttattcatttaacagatttgactatttgatacaaacttgaagcagattttaaaagtgaaattcttgcccatcctccctcttattccagctagtgactgatcactccagcagaaggccagttgatacgtcttcccagcacatgctctcaggagtcaccctccaccatgaagaccctgcattactaattcatgtttcccttctaaaggagctgtgaaaaattacccttactaggaggatcatgggctggctgagacaacactgtacgtaaagcataagcagctctgccaacaagactaaagccaacactcttccctgtgctgaagtggcctgtgggacagcatgtcagtttagggaccaaaaggttgcttagagcatgagttagaggatctctgggattattgaactaggctggtcttatgaggactgttattcaccattctctccagcagagggccgcatagtgatgtgggagaagtctggtgagagcggcaagagcagggtgggaacaaggtacaggc

SEQ ID NO: 777 - DNA, 413 bp, Rattus norvegicus
  Genbank Accession No. AI008985
gagtgcttactgtatgcaaggcactggggatacaaagaggtctaagtcatggctctgcccttaaggagctcacaatctagttggaaaacaagacatgtacatacaaaagtcaggaacagcacaggtggcccggacaatcaccagtgacaacacagatcctacagcagaaaaagggtggagatcactaaaggctgcagtggggaaggagcaattcacagaaaatggggcttaaactgttattaaagagaagagaaagcccagggaacaaccctcatagctaaaaggcaagagcttactcagtgggtctaagaaatgatgagttaacggtgactagagcataggttttgtgcggggagtcagagaagccaactgtcccaggaagggatgttcattctggatgttgcttttggagg

SEQ ID NO: 778 - DNA, 533 bp, Rattus norvegicus
  Genbank Accession No. AI008988
aaaactctgataaattaagattcataaaaaccactcttctccgcctctcttcccttgtccggcttgcagatgggctggcttggggtgccctctggtggcagcgagggaaaggtacagtctggggccagcctggggcttgcggaccacacctgggtgcatgtaggcccccttggcttttgctttgggtacttgtctcttggcagatggcccagagcttcggaatggctaggttacaccacaagaagggtctcattcccaactccgtgggtgggttctcttgtcacaggtttccgggtcattctgtaggcctctttaatgagatgactgactccaggcttttagacttcagtggaaaacaggatgctctgtctcttgctgtcaggggcagggatggcctccagctgcaggaaatacagcaatacttggacctgggacatgacctctagggaccagctgtcagtcatggtgatgggctggctggggttagcagggagcttgctctccttctccgagggccgaaacagcgtggggcc

SEQ ID NO: 779 - DNA, 536 bp, Rattus norvegicus
  Genbank Accession No. AI009019
cgctgcaccgcctccttgcgcatgcccacccggaagcacttcttgaggcgacagtactgacactggttccggtgatgctgatcaatctgacagtcacggttggacctggagacacaggccagggttcccagtgatgtgcctgcaaacccctgtgaaacaccagtgggggcttcctggcctgggatggtaaccccaaaagcactataggaactcagttccccaactcagaaggggcaatctgatcataatgggtgaaggacagcacacaaggggagccctttagaatgggttttaaaggatgcgcagaagttccccgagggggcagatggaaaagcattttctggcagaggatacaatggaaccagtttgaaacacaaaaggatggaaaccgaatcctattccttttactcggtcaccatcatgccaagtgccaaccatgaatggagttacagtactgcgctggttcaaccgtacagcctacggtgagaaggaacagacagaacctttctcctgagaacaccagcctgacacccatg

SEQ ID NO: 780 - DNA, 630 bp, Rattus norvegicus
  Genbank Accession No. AI009096
ccggctggaaccatggaggctgtaccagagaagaaaaagaaggttgccgctgcgccaggaacccttaagaagaaaaaggttcctgcggtgccagaaacccttaagaaaaagcgaaggaatttcgcagagttgaaggtcaagcgcctgaggaagaagtttgccctgaagacactgcgaaaggcaaggaggaagctcatctatgagaaggcaaagcactatcacaaggagtacagacagatgtaccggactgagattcgcatggctaggatggcgaggaaagctggcaacttctatgtgcccgcagaaccaaaattggcctttgtcatcagaatccgaggtatcaatggagtgagcccaaaggtgcgcaaggtgctgcagctgctccgtctccggcagatcttcaatggcacctttgtgaagctcaacaaggcttcagtgaacatgctgaggatcgtggagccctacattgcatgggggtaccccaacctgaagtcagtaaacgagctcatctacaaacgaggctatggcaaaatcaattaaaagcgcattgccttgacagataactccttggttgctcgatctcttggtaaaattggcatcatctgcatggaggatctaattcatgagatc

SEQ ID NO: 781 - DNA, 587 bp, Rattus norvegicus
  Genbank Accession No. AI009167
cagcgaaatggattcttttaatcactgaagacagtacaaactgatacaacttataaaaatttagaaatatgtttctaggccatgaaaatgtctatatcctttggcccgatgaacccattcatggaattttaaacaaagaagaccaagaacagtaaagctcaaccgacataggtatgttgtagtcatagcgacagatcgaaaccaccagctgtccagagaagtggtcgggtgagtgctcctgccacacatgtgggctcaaggcagtcagcactggagggatgccgggcagggtacagggtgggggcggagcttcacagtggtaaaacgaaggcgggctcctcgcatgttgtcatgcttccacacacagctagaaatacatgttacaagatgcatagagaaacagatgcccaaaacgtggagaacatgcagggtgaagttctgatgcgtttatccttctaggcacactgtgtggcgtaactgcacccctccagggactgggtgctgtcctcacactgtggggtgagttcactgccccagggactgggtgctctgttcgcactggtgtgagtgcagtgctccagcgttgg

SEQ ID NO: 782 - DNA, 519 bp, Rattus norvegicus
  Genbank Accession No. AI009168
ggcaagctttgactgggaacacagtgggcacaggagaaaaagtgaagatactacatgaacagggtgggtcaggctcactctcctgcagtgggaagatagctttgctctattattgtcctgaccagtttagaggaggagtagaaaacggtttcttccacgacagtccgtttttgaatgacagtaaggctttgcaagagcagaccccctatcacctgaagcatttgtaggttgatctttggccaaactcggggagctgtaataattcacaggatgctttcttttaaaaaggttaaaaacattatgggtctgtcagtttataaaagttgtaatttttttttttgtaattaggcattcagaggtacatggcagctctaagaacattggcagagagccactgtcagttggcataaacacaatccagcttgtctttcggttattttgatgtggatttgtaaggctcaagtgattggacaacaggaaactgcagtagaaataaatgaacggcaaggggcttgagta

SEQ ID NO: 783 - DNA, 536 bp, Rattus norvegicus
  Genbank Accession No. AI009197
gaccaacatagaaaaatttattgttcaaaatccttctctttgaccaatagcagaaagcagcccaatggggacagaacctagaggcacatttggtcatttttctgtgtgtggttatagaggggtgtttgaatgagggtgatagggccttttagggacccacacacgatacacttgggcaaggctcatgtgctaaggcaaagcaagtcatgtcagcctggcatgaggtgggacctcagggctttttgaccttgtgttctggcaccttctggaagctaagcaacatcaggcccgcattgatggcataggtggtgatgcaaacaatgcagaaatcatacaggacaaagaacaggatccaggccaggtacagagaaccagcgacagacaccagggaactcaggatcagtaggatagaggcccaacgtcccctcaagcaacctaacaacagctgtatggtgtagaacatgcaaccaaatatgctgttggattggttgaggatgctgtcagctcctaacacatgctccaccagcccaaagccc

SEQ ID NO: 784 - DNA, 525 bp, Rattus norvegicus
  Genbank Accession No. AI009198
agataactaaaaaattagatgtccagaagccgtcagtgtacaatgaaagagatcaaaccagttactttatcatgtatttcctcttcttcacaactaagcagagaaaaaaaggcattcttcaagggaaatgtcagaaaaataggccaatatatttttcttctccatgacagaaacagctacaggagatctggggtaaagtggacactaagttggcttttcatcacggcagcaggctttggcaggcactaggtgaacagactcctcctgcctgcaccgcacgctcagccagttccctcacaggcaacactgtagtggttcgtgcactggagcaatccatgccccaacagtctgtcccctttgccacaggcagagtaactgaaggccgatgccggtctctgcttgttcagtccatcaactgcatggcatctgcggcacacgtctgacgctgctcaggccttcacttcaggagttgacgaatagatggaatctgaattctctgaagcaatctcttccagctcttcttct

SEQ ID NO: 785 - DNA, 459 bp, Rattus norvegicus
  Genbank Accession No. AI009208
ctgcaacactttatttagcgtattggcgtggattagctgaagttaacaatcgccaggaagccaggtcagctggactgcataatactcgtcttcatttattgacattacttagcaatttattggacaaaggtcaaacttttgtttttattaagcacattccacagtacaaagccgtcatgataatatctgtacaatttaacaggttcaatagctgttcagacacatatttatttcaaacagataattggcaaacataattaattaccagttagaattagactaccccagtgctttaacacattaatatagcagtaatttacagttgttcaattacggttagcaaaataaaagtccagagtacagctgggagttactactgtagtcccagaaactggaattccttgggtacccaagtcccctgctataattagtaggcaaaattcaaaggtcgtgtgcata

SEQ ID NO: 786 - DNA, 498 bp, Rattus norvegicus
  Genbank Accession No. AI009350
aatatagaaaaggagcccgaggcagctggaccagtagtacaaagcaccaggagttaacactattctggtgaaagggttggctttataaaagtgaaggaggaggcaggaactgcccggcttccgggaccaggcccagcctagtacccagaggcttagagcaggacctggaatgagattcactggagggggctgatgggtaatttttgaagctgagtgagttggagaccatggtgaccaatgataggcatagaggttcaggcagtgagaagcatttctgtggctgataaagacagagaactgctggcttaaagctcctcagtgagccttggggaggggctctcagctctagggccaggtagaaaatgctacagatacttgtggactttgtgaatccagacatgactctagggtgggagggtctttccccttctccacaggagccacctttgctatgactacacatggggctttaagggcccaaggcacagaagaggctca

SEQ ID NO: 787 - DNA, 491 bp, Rattus norvegicus
  Genbank Accession No. AI009368
cctggcaagcatttattgatagtagcatttcagagtaaaccaccttccaaaaggcacacagctacactggtccgtgcaagaaagccaatgatttataagattccagtataataccaattgccaaggctcctgtattacaatctgttaaatattttaaaaagttagaacaatgtatcaattaatgtttacatgtcaaatcctcctgacagcatttggaacagctaagactttaacgaaatgattcccgcctcagtgatctattgacagcacagtcttcaaaaatagaataaagattatgaaatacatgactcagcctgggtccagggacatagtaggagtcaaagaactctttctatagggaagggtacatttcaagatggcaactgctgtgtcatcgtttattttgagttatggactgtatgagaaatcctttagacaaaccaccctaaatggacagcttgtttcttaactgcagttttcctttgccccag

SEQ ID NO: 788 - DNA, 471 bp, Rattus norvegicus
  Genbank Accession No. AI009411
ctttgttcaagattttattaaacgtctttacaagacaacatccagcctccaaatgcagctgccaagaccctgttatgctgtaggcactggctgaggcatggcgggtggctctggcttcccacccttctgttctgagatgggggtggtgggcaagatttcatctttaggttccacaatgctcacatgatcaggcagaggcttcttgggaccaatcttaccacttgggtcccagggcagcatgatcttaactttgatgcccagcacgccctgtctgaggagcacatggcgcacagcagtgtcaacatagtggttaacaggggctccgctgggaatcatcagaccatccacaaacttcatggacttggccctctgccctcggagcttcccagagaccacaaccttacagcccttggccccactttccataatgaaccgaagcacaccatagcaggcccttcaaactgcaagccc

SEQ ID NO: 789 - DNA, 445 bp, Rattus norvegicus
  Genbank Accession No. AI009420
acaaaatagatagaagagcccaaaatgcaaagcagtcaaccatgtctgacggatggggaaacgggaggcccttcccctcagaccctggctgactgagaaggggcgcaggaggagacaagcaggtttgttaatgaggagcagcagcatggcagggtgctgacctggagaggttggacctggagcctaccgtccctaccctctaggtgagctcaggagcatctctgggtagactaaacagagggagcgggtaccctaggggaccctagggcattgtgaggagccgggcaaagattctaatgggtgcccccacactgggttcttcccattcccctaaggcagccactaggaggagtggtaaaactcaagttcgggaaatccctgactcactccatgcctctacatctagataggggtcatggagaaccaaacagctgtcatgagaaca

SEQ ID NO: 790 - DNA, 531 bp, Rattus norvegicus
  Genbank Accession No. AI009467
aagcaaggaaacatttatttactacactcacacagtaatcatcaagcatcctgatgtttgcccaggtagcttaaaatagcaaatattcagtccccgcagaagaactgtcttcggttttaagccaagtcaaagaacagaaaggaaaactcatcactgctgagcactggcgctcaggctccactctcggatctgggacgaagaaacacaatcccaagtcagcttcctttctactcggcgtcactcagttaccagtcacggaacacaagctaaggtcctagcagcttatctgagacaagtttaactaactctaagatcacatgacttgacaagaaatgtacaaatgtttgctaagaacttaccgttctgtcaatcattttaaagagtccatgaaatatacatagcagtatttttgtaaccagaaactacactaattagacacatcatttagtttgttaagttctacctgaaaacatgccattttaagtaaaatcctaaacacataactcttaagttctatggtttaacaatcaa

SEQ ID NO: 791 - DNA, 439 bp, Rattus norvegicus
  Genbank Accession No. AI009555
ctcactactaggaataaggcgcggccgcttccaattttttttttttttttttttttttgtggctgcccatttttaaaagagaagctacaaagaagaaaggcagttttacattatgtagaataactgtttgcattgccattctgcaaaagaaagaaattttgatttaaaaaaaaaaaacctcaaactgtctaagactgtagtacaactaggtgatcctgtcccctaggcggcataagccagacagggacattagggacgggcagaaaatatgtaattttggcagttgattgactcagaagtctacacttttttcaggtaagactattccaatcacttttaaagataccatgtttttctgaagaagactggccagttgtcagatttcgcacaccaaccaacagctgtgtggtgacgcctgcgatgtgctgagaaactcaca

SEQ ID NO: 792 - DNA, 597 bp, Rattus norvegicus
  Genbank Accession No. AI009602
gacatacaaaaagacaatatttattttacttctgtataagtagttcaacagaaagcctcctagttgaagacattactgaaaacattaacattattgtatgccatcccttcagtgcccagattcagaaacatcatctgaatgaaaggaaaggaatgtaggaatgtccgctttatgttggatttacgtatgtaagtggggaaaaatctatataccttcgtcaatatatgaacttacaagttaccaataagcaatgtactgatatcatgaagagttcttaaggcctggagattacttttgtctgttaaaacaaaggtactcctatttgctgtctgtccccttcccccctgctactgtacttctgaatgagaatttgaagcaaaataggatgtctttgtttccatgctgtaagactgtcagcattgacggtttccagagcatttcaaaacatgctcttcagctccatcaacacaggccagtagtaaacaatggctctgtacaaggcatttacgatgctttccttctcagaactatgataccccggggaaggagtatttcacacttatgcaagaaagcgaagtcttgtttctactgactaat

SEQ ID NO: 793 - DNA, 597 bp, Rattus norvegicus
  Genbank Accession No. AI009614
aaaaaggaaatgtttattgttgtgttacaaggtgattataaactcctctaaaaaaagcaaagatggatttaaaatatcaatatacatattcatctaaaaagcaaaagagaaaaaaaaaaaccgaaaccctgcaaaatgcggggtcgccgtaattaaacatacacagagcttgtatactgcaagacaggtcacacaccaaggatccttcaaacacaaacgctcctccccttcttggttggtttcaggtttttgtgtgtgtggtttgggacttgatgaaggaggggtgtgcacacagaggtatttacagtgtccatagggacaggggtatcaggttccagtgggactgtgaggggccttctctaaggtgccttcctggcttacgtctgcatcttggagagagaaactgggctggcacctgttcgactgcttgctagagcattgccccgtccagaggggcggggctggaatgctgtcggccatggtagtgacaccctgtgatagagaaagccccttcctgtgcggagggggcacatgctgctttctcctcatgctttgccatggtctgcatagctttcctctcatgctacttcctgcata

SEQ ID NO: 794 - DNA, 634 bp, Rattus norvegicus
  Genbank Accession No. AI009654
ccatgggaaacaactttttaatagtaacaaattccaaatactttttttgtgagtacaatgttatggtttaataagacattacaaaatccttaactttgtaaagtattcgactgtataaatatcaaaagaatcccctcctgatataaagtttagtttctctatcatatcaaaataaaaacgtacccgttttctaacactgagaaatgagagaacacaacaaaatctccatacacaccatgagcaagtatctcaaacaactttagtacagttaaagtttatcctctgcttttctaaaacgcatgatttttcctaatttaataacatattaaaaagagaactggagggtagaagacacgtgttcatccgagactgtgtagacctcaggcattcacatctctgcaagtgggacagagtagtgtgcgagagaataaacagaggtaccttcttgtgtgaatccagcttgcaaggagaaaggcagagactgaaaaacaactgtttcatgagttagttcagaatcctgtcaatagcattattttttccccaaaataccaaattccaaatattctagttctcagctttgaccttttggcaaagttatcatttcgattcgttcagtgtgtgtgtgtgtgtactt

SEQ ID NO: 795 - DNA, 592 bp, Rattus norvegicus
  Genbank Accession No. AI009661
aggatttaacgtctttattacataaatgaataaatggctccacgattcagccgcaatagctttggaaggaatggggacaggggtagggtctgaatgtaactgcttatttcacggtcttatggtagctgaagaactgggtccaggaaccactgattcctatcacatactgcacctccatgaaggcaaagctacaataccaaggaccaaaaaactgcgcctgctccacgactaaatcgcaattttatataaattcttctactgctactctggctttccttttgatcagatacatcttttgccttttaggaagtaagtattctaatagtaaagattccccatgaagactcaaatctgattttcccaacatttccaacccgcagcaggaagcagagctgtgagctggagttaaaggaacgatctctgaaccgataggatgcgttcctcatgtccggtctcttgtgttcaccggtaactaccgccacgatcccggggaagagaatgcactgcaagcagcagcagaacttagccttttagaaatcctgttttgtctcaagacttcaggttctcactacttctcaaagcagtattactg

SEQ ID NO: 796 - DNA, 149 bp, Rattus norvegicus
  Genbank Accession No. AI009675
cctactcaggctttattaaaaaaccaaaaggtttagggccaagggagggaaaaagggcctggtcaaaaggcaaccccggcaggaggcggctaaacggtccttggaggtcaccccagggctcacaaaggcaaggaatttgcccaaaaagg

SEQ ID NO: 797 - DNA, 587 bp, Rattus norvegicus
  Genbank Accession No. AI009713
agcttggcaaattaattttaatatacagatacaaaatgacaaatagagattcacagcatttacaagaaatcaaacaatagtattaaaaataatacgaacaaacccttcattcagcaaaaatgcacatctagcacacaggtcctgtttcagtgtcaaagccagctcacaggctctacagcagcctttgacttacacggacgatggcaccgcggcatgggttagttatcaccaaaagcacagcctagatcggcaagtcacgcacagtgggtaccagtaagtatcccaaatataacagaagcggctcaaagtactttctatattggcaatgcctaggagaacagtaaaggcaataatggggtgcacgaggtggctaagcaaacttacatacattatacaagctggggtttctctctcccctctctaagactggctacaagtttctacctactttggcctaaatctttcaaacgcccctttccctggatcctgagaagaaacaatgtgtgggcacactgtgcccaaaatcctgtctgtcagctgctgaaagacattgacttatacttcttggcactggcctgaggacactt

SEQ ID NO: 798 - DNA, 546 bp, Rattus norvegicus
  Genbank Accession No. AI009747
aaagaattttaatacaaacttaatataaactatttcagtccctcttaacatgtaagacactgactcaaaatacttttataccgtttttttttcaagtattgcacaatataggtacaaaattaatatttacgattacattttcttccataatatatagcaaaaatctttaaacctttaacagaaaatacatttttttgaaaaagcaaatattcgtacattttaattccaccactaaaggaatatcctgtacacaattttcagaatagttgatgtctttaagatggatattttacaatttcagtaaaaaaaatacaacatgaagccgctgccacagatcactgtagtaaaaagatagaaatgcaataccgtgtcgtagaaacaatatatatatgtatatatatatatatcctctgatagtttacaaactttgtactaaattaaattatacaattagaaaagaccaataaacccacttattagtgccaattttttatatatatatataaaaaaaaatcagccatgtccttgctatatcttaaatactgg

SEQ ID NO: 799 - DNA, 547 bp, Rattus norvegicus
  Genbank Accession No. AI009752
aaaattataaaattcttttatttcaattatatgacacttcagtttgcctcaaattttactgaggttttggtcattttgcattccactctaccttgtaacagtagtatgaattcacatgattctgtaacgtgtcaacagcagtcatacagtaatcctctggtgattgtatatgtgctaatacttttagattcaactttacagttattttctaaatgattctttatatagaaaatacatacttccttcaggcagataaaacaacaactttccaataagaaaaatatcgagaaacaacaaataaaaatatctataccagatgcaaaattttgaattattacctaatgggtccctttgcacaagaacagccttttgtaatttttaagtagacattcaggcagaaggataactttaaaattgaaaaaaaaaataatggctgtttctcttcagtactaaagtaggaaatataatttcaacatgtcattagcagagaagagtaaaaaataaaatattcgatataaaatgaatttatcacatcacccgcatcttt

SEQ ID NO: 800 - DNA, 565 bp, Rattus norvegicus
  Genbank Accession No. AI009770
aaagtaaaatgggaaggaacactttgtgtgcttcagagtttacaaagtttaacatttcccagccgggggaaatgatatcgatacatctgaaataatccccatcacagttaattttctttctggcttcactgctttcaacttggaaggaaagaagaaaagagagaaaaagaaaaattctccttaagattttcatgactcacagatgaaaaaatatatatatttagccctttatttcaagaatatatataaaaaaagctggttaaagaaaatatctgacatcaataatggattttatgccaaactatagtaaatgtctaaaataatagaaaactacagagatgaactgatttgccaagaaagaaaaaaaagtagcagcgattgtgctgggaagatggttcagtggtaagagcagctatggctcaagcatgaaaaactgtgtccaaatccccatcatccgtgcaaaaagccgatatggccaactgtcaggagaatctcatgttcaaatccccatcatccgtgcaaaaagccgatatggccaactgtcaggagaatctcatgttcaaat

SEQ ID NO: 801 - DNA, 562 bp, Rattus norvegicus
  Genbank Accession No. AI009819
acagtttttaaaaacaatttatttatatattggcttctacatgctcttacatttatgtaaaatatttatacatgttctttacaatttgtacatatattaaacggctgtatcataaacacggttctgtggaattttataaaagaaaaatcaagtagggagaaatgacttagaaaacattaacaaacccctgatattagggaacaggaagttctcgtgctcacgctcactggatctcctcagctacttatttttggtttcattcacgtttgttggcccggacgtcccatctttgtaatatcatcatcaggtcaggaagtgacagcagaggatcacatcataaggcaactgtggaaggggaccactgtctgcagggagggacagcgtgtgctctgtgctctcaggccttgagccagggtcaggagtctctgaaggcggggacacagccacagacagagccagtctctgcttgtcaccagcttgctgctgcagcacgtccccgctcatgccagcccttaactttcccattctctgggaaacggagaggaacaggtgctgaacttgg

SEQ ID NO: 802 - DNA, 485 bp, Rattus norvegicus
  Genbank Accession No. AI009843
gaaaatgtttaattcaactgcttctttggaatgtgtaatttcgagcttaagttacagttcattctaggtggtttttatgctactcagagaatacaaatttcaagttaaggcttcgctgttcattttgaaacaatttacaagtgtcatacatatcatcatagaaaataaaaatttctgtaaaaaaaatttgcacaaaattttatgagggtacaaaacatgaagcaataatataccacaaaaaacgagacatcttactacggaaagtcttatagatttcaataaagaaaaaatacgtaattttacacctttaaaaattacgaaacaatctaaaacaatttaaactgaacattttgtaacactgcctttacaaattaataactttataaacatataacttttaaatatatttatcagtgcaaggtactttaaaatttaaagttgcaagatcattttttccttggctgaggacactggtccagtttgtt

SEQ ID NO: 803 - DNA, 104 bp, Rattus norvegicus
  Genbank Accession No. AI009950
ggcaatgcacacctttaatcccaggtcttggcataggtaatgagtctgaagccagcctggtcaacacagtaagttctaggacagccagagctatatggtgagac

SEQ ID NO: 804 - DNA, 585 bp, Rattus norvegicus
  Genbank Accession No. AI010084
aaattatatattacacgtttattaggaatacaactttcatgtaaaatttacattttatgaaaaaatcaaaagtatttacaaaattttggaagacagatgtgctctaattacaacccaaagtagtaaatgacgacccttgaacgctcactgtgctaagagttctgtgtttacaaattcttgttaaagaagcagctacaaagttatcactgtacacaagcaagaaccagcttgctagataagatagtctcccactgactctactgggtctttttaaacattagtgaatttttaaatggaaaaaagaatcactataaactcatatggctttaaaactgtaacctgtacccaatataaacttgcatgtcgacactcagtatgaaggctgtggggattaggaaagtgcacaaggttaaccaaccattccactcacttcaacattttaaggtaatacttgattaacaacagacagtgtcagatttcaaatagtaaagcattaactgcccaataaaagcagatttagtcaatattttagtaagtgtaattgaaactggcattttaaagattgtaagagtttaaaactctcat

SEQ ID NO: 805 - DNA, 541 bp, Rattus norvegicus
  Genbank Accession No. AI010108
gaggagaagcagagtttaacgtttattttacatgtgtccgcagacgcttgtacaagagtgagcacttctaaaactcccagcatggttttatagtgcagaggcaggaaggtagtgatgtgattctgtgaccagggactgaatggagccctctggcctgcacgcactctggggagggctgaacaccaacactgagaagcaggtatgggacgtggcccttgagtgggatctgagcctccagagaggtcaaacagcccatcttccacagcaggaacaggaagctgtgtcagacctgctggggtgcagcccgccacccgacagtgaattgtgagcccttagcatgcaaagttcactcttctcacagcgactcactagatggtgacctggaaacgctgactaccgcccttcacgccagcggtgggacctgaggcagagctttggagatgggcgctggttgggcctggctggacacagccaccagtggtttcaggcaccatggaatgttcgctagggctgttcctacccctgggaatggaggcacaaa

SEQ ID NO: 806 - DNA, 273 bp, Rattus norvegicus
  Genbank Accession No. AI010123
gccaagactcaaagaaaaaaatttatttacaatagagaattttatttgaaacatgcattctttttaaaaaaatcaaaccagcaaatgtgggtcaattgtacactccttaaggcaagagtcccgatgcaggctgcatgtgttcacgtcacttcagatgctgctcgccaaaaggcaaggccaaggtcagcaattcgtattctattagagagtctgatgatcctcctggtacaggaactccgaggtcaacttgctacgaattatactagaaaatgc

SEQ ID NO: 807 - DNA, 716 bp, Rattus norvegicus
  Genbank Accession No. AI010237
gttgccgttttcattttttttttaattaaaaataatttctattttgacttacatgattgaaagagggatgaatacaaatatcacaaaccgaaaagcactccccaaccaaaatcaaaacacagaagtgaatacaaaagatgtggaattaattatccatgcaatattcaaaaatgtttcaaatccacaagtaaaccaaacaaaagccctgtaatagctgtgatttcactttctacaaaagagacatttcaatcattaaacaaagactatagcctatacatactataactgtacaacatacctttaaaatgagagatatgtgcatatatgtataaatttacaaatatacaaatatgtacaaaggaacttcacagttgaaagaatgtgttgccagaagcctggcaaacaattttcactttaaaatgaaaggaatccttttaaaagtctggctaaaatgtaaatattgaaactaatatctaattggtattttatacaaaaacatccagaatacagttcaaattgcactcacatgtactgttgtgatgtcttggcatacccaccccttgcacacttagtaagagactcaatctttttcctggtactgagctgctgtggaaactacagggcagtttccatctctcaaggcctcctgtttcctagcctcatggagaatttgatagaagcaggaaccactttcagcacccccatattctatctag

SEQ ID NO: 808 - DNA, 765 bp, Rattus norvegicus
  Genbank Accession No. AI010241
  misc_feature (1)..(765): n = a or c or g or t
ggttgttaaacagtttaaatttttattgacctcacagttttttaaaaaaagttaaaggtcacacctctaagttgatgtactatgtacagatcatgcagaatgagtatgaagagataccaattagtcatgccaaaaagactgactagagtagtcatcctcataaatacatataaaattcttatgaaggtagaggggatggccaggttttctgagacactttccaaagttattcaaggcacaaaatatacaccattgtgactatacatattctagacgttgtgcctctgatacagcccaaagatttggtttcatgacgattataaagctaaatgtatgtaatgaatgagattgtttcttgggtgaaaagccagacctataaacatcaagtagatagataattactccaaaatatggagaatacaaatacaagcactttattttaaaaagcaaacaaaagatcatgtaaatccaaaagtgtgaactgtttcaagcttccattttggatcatttagtatctacacaagtttgttcccagcttatccatcactagtctctactaaggaatatgattctaaaaattaacatgggtttcagtatttaaaatctcactatttatataaaaacctagagagaccaataatatccaatagcttcaaaagataactaaagactcttagagttatcaactttaccaacgtctgtccagggctgtttaatatttacaaggaaaatacactcactatagttntttataaaatagcaagt

SEQ ID NO: 809 - DNA, 572 bp, Rattus norvegicus
  Genbank Accession No. AI010256
gaataaacaagtttatttgtaaatttagtcaacatacataattgacctaaaaacttcaataggatacttttaaaaaccacttgaaggccatctctataaaagggatttttttgccaggatagtaaccaggtgtaacctaacccatcttcattggcagagtccaataagctcaagctgtactcttacccccatgtttataaactccacaaggaaaagcaaaccttgtacagttttcccccttaaagattaaaaacaaaaccaaactcagtctaggtgtaagaccaaacacaatgaaaagctcactaactagattaggaacagatgatgctggtgtgaatagcttgttgttttactctagagcccttaaagaaaatccccgttagtgttttgtgttaccagccagagggtcaggggttagtgaacatgtggtagaatgaggacttatgcaaggtttaatacgcatagcattcttctactttgttaaaaacaaatgcagtctagtcagaaataccaactggactaaattacacacaccttaatgacaagactccccaccacttgtgaatgtaaaa

SEQ ID NO: 810 - DNA, 651 bp, Rattus norvegicus
  Genbank Accession No. AI010275
cccggggagcccggcggttccatctgttctgtgtttttttttttttttttatgccaataacttaatagtttattagtcagtcaacaatattacaaatatttaaaaatgacttaatataaatagttggcagcaaactattccattacagagttaaattaccagtacaacagacagactggagatttagacacctggaagataacaataaaataaactaaattatttaacaaaaattttaagctgaaggcgttttacctagtgtccataaaagcatgggttctctttttatttagaaaaaaataaaaaacggctttaacaccccattaggaatataaaataaaatcaactgaaaatattaatttgcatatcaaagaaccatttatagttacaatccaaacactccataaaccacttgtgcgattctatacagaaactgggaattagaaactagttgctttaatattacaaagatttcagctccaaaaataattcaacataaaataaactttagcaattagtgtcataaaattatatattttcacataaaaatacaaaataatattaatgacaagaatatgaaaaattattccaagtattttactactattaaaataaaataaaacccataaaaacaaaatagaaatatgcatg

SEQ ID NO: 811 - DNA, 507 bp, Rattus norvegicus
  Genbank Accession No. AI010303
  misc_feature (1)..(507): n = a or c or g or t
ccagattcataaggttttattgtcaccacaggatcaggattcatcttcaccaaaaccctgcactaggtgcttaagagcggctgtgacctatagcaagaggaagcaggcacaaatgaaccgaggtcgattgccctgagagacaggcagggccggctgccccctcctgcctgcccacagcagacacttctagaccatcaggcagtggggtttcctggcccctagggactagctcacatggtgtctcactaagtgtcagggaaccctggccattccaccttcccaaggtcattcacataatacagaagtgcttgtccagaagggagctgcctggtctcgtaaggagtatgtaagaaatgaaagaatattttgccaaagggcctatccacacatggagcactcagcaagaatagggcagccaggctggcaggtgtccagtcaccccaattgatgtgacttgaagcaaagggtacacacaggcctattatcagcgatntgacaaagcaatct

SEQ ID NO: 812 - DNA, 502 bp, Rattus norvegicus
  Genbank Accession No. AI010312
gttgttataagataatttattaaagtctaccctacaatttcccataataatggcacatataataattaaaaacagcaaagatgctcagtttgtttcctgtattgtggcgcactgtggaaaatgttgagtccatagcaatttcaggaggctactatcaggaaatccaaggatcaagctacatttctgaccaagagtccaggaagctcatctgacctgctgaaagggtttgtctatgaccttccagcaagtcctaaagtcccccctccatccagctcatacagaggaatgaaagtccaagttccttctttatgcttgaccaatccgtggggaacagcagctgatcccaaagaaaagaggaaggccaaagactagatgctttctgtaaggaggacggccagaagcttgtggccatgggtgagaacagttctttctagaccattttccattattttttggctttgatcagggactactcaagaaaatatccttggatccttagtta

SEQ ID NO: 813 - DNA, 592 bp, Rattus norvegicus
  Genbank Accession No. AI010418
  misc_feature (1)..(592): n = a or c or g or t
agcagaggactccgaagtttatttatggtaaaagtcatttcacacaatcctaagtgtgacatgagaaatcaaagttcagggttatttagcacaaaccacaagtgtggagtttttatattagaaattaatttaaagctaacaaaacagttgtacttattacaagtgagtcaattaggcacgtaagcggcaacactgaagcaggaccgtctgtacagcaggagccctcgagaagcaataaaggtacatacaatgaatccagatacagagactttattcaattttaaaagaaaataaaggtttcagacaaagctttgaccctataacaaagcaaacatgtccaactttaaatcaaattgcaaaagtggccaacttctacttgtcagcactggcacgagcaccctcctcgagctctactcacgtctctattttcttcatcccatgtggtataaaagaaaaccaatctagattccttgataagctttatatgatcgagtattacaaacggtctctactgtacgccaaaattgtttttgtgttctctccagacagctttactgtaacanattgcaatgtgtattctgtgagttgtaaa

SEQ ID NO: 814 - DNA, 641 bp, Rattus norvegicus
  Genbank Accession No. AI010455
catagaaaaataactttagtaaattcgacaaggggaaggagtactctgggtcgatgatcttattctgaaaacaaagcctgataaccggaggagaccaagaaggcatcaaagaccagaatcttcacgtccaagaggaggaaaggactgccgctgagctgccagaaaaaggggtcaagaatcttccttttcctgaaacttgcagttgatacaggtatagaagacagtctgtccttcatcagctgagcgcatctgtctggtgtagtatgccattccctcgtgaccacatcgggagcagcgcctgtcaactactggtccctgggattcaggtccctcatccacagacataggtatgacagtccccagtttgttgaacactactgaggtcttcacaaccttccctccaaaatctcgcacatcgatggagaagccacaacgagggcagatgacagtatcctgaactccaggcagcggcaggacggagccacaatctgggcagaaatccaagtctgattgaaagttggagcaggggcgggccagctccatggcggatgagagctgagtcctcctcccacaggatcctctgaccgcagagtttggagtgctaggagcctggagcctcagctgctggggagccttgtgcg

SEQ ID NO: 815 - DNA, 477 bp, Rattus norvegicus
  Genbank Accession No. AI010568
ccaagaaaataaatttattgaactttgaggggaaaaatccacagacataaaagaaagttaaatacagactgcaggacacaactagtcacatggtgaataatggcttgtgtggccagcaaagtaccaaaaatgacattctgggactgattgaggtatttagctatttttggctatagcaacgtggtcagcctatggtgaaatggtaagatagttcatcaaaacacacatctttaagctgaataggttctaaattgatgatacttcatatgaactaaatcatgtacccattggggaaaccatagcagcaaggtatcagaaaaaaatctattaaaatctactacagaataacacagtgaaccttaaacacccaagtctaaatttttcactgtctctcctgcatgaaagagatttaaaaaccactaaacattaaccctgtttccccacaaaggtctctgcaaaatggtaaatatcattgaa

SEQ ID NO: 816 - DNA, 442 bp, Rattus norvegicus
  Genbank Accession No. AI010593
acagaaaagctatctgatatttattaaacttagtttctccagctatggtttggcattatacaaagcatcataatgacacagtagagttaaaaagagttttacaaattgaaatgtgatacccttgtctccaaatattttaattgccataaatttgtttaaaaatacacattaaacgcatgtttgacactctaaactctctataatctcgataccacaaaatacatataatatactatacagatgtggaaaatctagttagtatgtaatactttgctcaccattaacagctcgttatgtgaatgcacatactgacttagaaaccctagcttttgagccccaaagtacctctgaaatttaacatattgcaacaaataaaaatcacagtatacaattgaaattttggttcaaagtgtcagatgcctagatattttggataaaagaa

SEQ ID NO: 817 - DNA, 426 bp, Rattus norvegicus
  Genbank Accession No. AI010605
gaggtgcagatagcttgctttattattattattttttaatctcaaggaggtccaacatttataactaccaattgaacatatgctggcatgaaaaagactacatcaaatcagtaattttttatgggcagttggtagtatggttttaacaacagcttcattggtggtgatgcttctcttattttgctgtggctcattgcttggttgcccagtttccagtgaaatttaaatttagaactaccacacgaggcatctgctgcacccgggacctccaggagttgacactgctctggcataagaatacatgaatagcttggttaatcgaggggatggccaggagatggtacttttcccaagccatccacgcactctttatgtcagagacagcgtgcagtgagcgaacaaagtgttggccgttacactttgctc

SEQ ID NO: 818 - DNA, 432 bp, Rattus norvegicus
  Genbank Accession No. AI010612
gaaaagtactgtgctttttattaaaaaacaacaacaaaaaaatacaatcaggtactgtccagacacatttgggaagggaatgtctctttaaaagtcctcagttttcaacatcatcatcaccatcaccattattatattaataatattaatgtccttgaaatttaaacaatatcatttttctggcttcagttgtaggaaatgtacaaaacatcagtggggcgcagggcaaggggtaacctccaatgacgtatgttttatctttgcgacccaaccaataacaattgaacagctttgtgtagaatatagctggctctgaaaatgactatgtccgctggatagccagctcgcccctctcccattcccagaaccacccagtagaagtaaaaatcacggtgttgctgtcgctaggagactttgctcaatcaaacataa

SEQ ID NO: 819 - DNA, 437 bp, Rattus norvegicus
  Genbank Accession No. AI010616
acaatgggctaagccgccaaacttatgatcagaacttttttttttattttctgaaatgaaaaccattgtacattgtacaaacaatatctaccgatggaataaataagtgaaaaattatactgctgtacaacacaccaaaaaaaaaattgtaagaggggggagaaaaaaaagattaggtaacagtgaaaaaaaggtctttatacctctaaccaggtcctcggcaataataacattccaagccacgacaccgtctgacgatgggcagtcaccaccctctaatcgcttcatagccttcccggttgtgggtgcaagtgtagcactttgtggaatgtgtagccgccattcccccaccttcaggttttgcgggagaagtttgccctgggagccctttaagccatggggcctgatgtccacggaaggcatttgcttaggatccc

SEQ ID NO: 820 - DNA, 464 bp, Rattus norvegicus
  Genbank Accession No. AI010618
aagaacatcagctcctttattatgaacattattatttactcttatcttccccctaaacaacagctcaattcacacaatgaagacacccccacccccacatacacaataccactagcctgcgtgccaggctgtctgacctttgcttggttcctggtggagctgcctgaagacagctctctgtaaaaacctgacttggacacaggggacacaataaaggggaccttagccggagaattaactgaggggctcccagagtccttggtggtgatggtttgagagccatggggtcatgctgcgaaaaatccagactgtgttttatgtggataaatcccatatggggatataagacctatctataacctcttctagacagagagtttagaaacacactgaggtaagccaatgagtcccatcaaccaagccacatataaggagggcccagagcaggggatctgggtggtggg

SEQ ID NO: 821 - DNA, 437 bp, Rattus norvegicus
  Genbank Accession No. AI010642
attggttaagtagttttattatataaagagatcctgtaacttgatatgaaaaacaaagcaactccaaaagatatcacaaggacattaacatttgaccaaagagaaaatgtagcttttcaaaatacacaagtattcaaccttactattaataaaaaagaaaaaaaaatcaggatgcaatttcttgcttgcttattcaatacacaaagttagtagcaatttttaccttaacttctaaaagcactcaaatatgtctgaagttaacaacaacaacaaaaaaaaaatggagtcattttaaaaaaacaaagtatgaaaattctgttaatgaagaaatcatgaaaagcattaaaatgaatcaacacatgtatgtatgggcagtaagtaaagttcagatgccagaagccaaatccttttgaattacattaaaggactgttaatgg

SEQ ID NO: 822 - DNA, 417 bp, Rattus norvegicus
  Genbank Accession No. AI010660
cacatacacattagccattcaatggagaagccgaagagtcaggcaaagatggtataacagaagcgcagtgacgggggtggggtggggcggggcgggcggagaggggacagacgggctggctgcctacttgcattccgctaggacactgaaaacccagaaaacaaaacagacagtaaactacccttgtttcttatgtatctcagtgcagagacgggggagggggttggagggcagagaagggagaccaggctgaaagaggagcagagggaagggacgctaaggggaagcacaccaaatccattagtactatatatatagagatactcgtatatactgcgtttcttagcctaagaagaaacttgtttgacgggacgggcggcctttgcggtccgcgatgctggtgctggtggggcgcac

SEQ ID NO: 823 - DNA, 406 bp, Rattus norvegicus
  Genbank Accession No. AI010662
ccagcctcaaagttttattatcaactgtgcacattcgagttcacatcccatggtgtacagcttataacacggacagtgagagacggcaggggctgcgtgagccatttggtgaaatggtcttgctcagaacccacagtcctgggcaagcaggggcctaagagatcccaggttccacacctcagcattgagcaaatgcacacagagtccttgtgcatacggaactactgaacgcaaacaaatacagggtctccagttttctgtagtgtgaactcataggtgttggtctcccagcaggaggtgtctttgtccagcatgcttcgttctgtgaaggtcacatggccatctgcatccacaaggatgatggtgttggttctggtgccataggtggcagagcggacacacacag

SEQ ID NO: 824 - DNA, 257 bp, Rattus norvegicus
  Genbank Accession No. AI010848
cccaaaatggaggtttatttggttttcatcacccttcagtgaaagggtggctcgttcaaactacataaaaaccttgtaaatacatcgcgaaagcagtaaaaacactttaaaatgagagaaaggaaggaaagcttgtgcaggcaggagggaaaaggttgaagcccccttgggtgtaagcagaagcaagaagaatggccccattgtttcattaaggcagtcacaaaggcatggggttttgctgttcccacgtgcttgcc

SEQ ID NO: 825 - DNA, 425 bp, Rattus norvegicus
  Genbank Accession No. AI010865
gcacaaaccaaagaattgtgacacccaatattgcaaaggaaaagattggtttccaggccaaacaacaaccataactgatggtggtcttcatgggaggatagtccttaaccttctgggatcagacacagggcctgaagctgcaaagagctgggcttctacaggtagggtgggacaacaagaggtttgggctcagtgtctccctggtttcccaggtcatcgggataagctccagaacggtggaaggaaggtcagattcacaggaggtaacacacacacacacacacacgcacgcacgcaagcacgcacccttaggcgtatggcaactaacctagggaaagcggagtgaggagtatggagggtagaggggatcaagccacagtgcaaacccttaattgcttgcctgacagcgagtgagcaatttgcct

SEQ ID NO: 826 - DNA, 461 bp, Rattus norvegicus
  Genbank Accession No. AI010917
ccatagtgccatgtctaagacttttaacaataatactttagcaatactgactaagtactttgagtacatttaacaaattgttcttgtatcaaacacttttcattccttcacatttgtcacttctcttaagcctcagagtaatactataaaatacattttataagcatccattttgctatttattttctcaaagtcacaatcagcagtgataaccaggacatgaatcaggaagttagattgacagccaatgtcttacctgctctgtcttgctgctgccatgtagccagcaatacatttttaaaaattatagtatatatatgtgtgtgtgtgtgtgtgtgtgtgtgtctgtctgtctgtctgtctgtgtatgcacagatgagcctatgacacctttccctctctctctctctctccctctctctctctctctctgtctctctctctccctcttcctctccctc

SEQ ID NO: 827 - DNA, 517 bp, Rattus norvegicus
  Genbank Accession No. AI010930
ccaggctttccagcagagaatccactttttgttttatctgagtcagctcctttttaatggcctgaaggtcatcacctttcaactttccagatttggaagaagatccccgttgtccactctttgaattgaatccacttttgccccttcgtgaggtgttccccgacacacgctggcgtttggaaggcaccacagctcgagcaatgggaggaggaggaggaacacgtgctgggtaactgtacatcctgtcataataatcgcgttgaaagtcatagtccaagtcaaatgaggaaccgtacatctccgctgcagatcgtttcacacccgcttttcctcggttcacttttggctctgcagccaggttaatatctaaaacctggccagcaatcattctgccatcctctccagctacagcagctcgggcatttctttcattaacatactggacataggcaaagcccttatgcacagagcaacccacaattttgccatactttgaaaagatggcctccacatcaga

SEQ ID NO: 828 - DNA, 316 bp, Rattus norvegicus
  Genbank Accession No. AI010936
aaataattcgctacaatcctgccacaaattaaaaaaaaaaattaacatggtattcacagagcagaattctttaggacaatcaaaatcccagagtacttagaataaattaacagaaggtcatttctcagaagggtctaaaattctgaatatttggatgctatcatccccccgcccccaagaaaatcgtcttgtttcaagtgtgagagcttgaagtagcagcaatccagagattcagtagtcggcgattccagtcatggagtccgaggatacagtaaggggtgagcagaggctcgcctgcttccaaagcctgagactc

SEQ ID NO: 829 - DNA, 485 bp, Rattus norvegicus
  Genbank Accession No. AI011020
atatacgtagaatttatttaattaaatataactatataatgtatataatcatttgtataattaaatttaacttttattttaacttttttatctttgcaaaataagtggctggaggaaaaatccattttacaaatcaaaatctcccctctggatttaaaataacgtttcaattaagcgcacagagtacatattatgtatgtctggatttatatagaggtaaactaaatttaactttttaatctttgcactataattataataatttatataattattgatataatttaattttaatctttgcacaagcgctttgtaaaaaagtgtgaggatttttccgggaccccccctactctgtactcacgactggcacacaggcgcagtagattccttgcaaaacatgttacaggaggtgcacactcacgaactttacacaacgcgcacacttgcacgtatcacacagggtacacattcacacatgtcacaca

SEQ ID NO: 830 - DNA, 237 bp, Rattus norvegicus
  Genbank Accession No. AI011070
aaagtggacaatacaatgtttaattctttgcaaacacaacagtaggactaatgatacagtaatttaagaatgccaggattatgaaatctagggacacattcattttccttcacaaagcattaagtcttttttttttaagtgtcttgggtttgactgtgagaaacttaataatagtattgagaccacaaggtactcagatgtaatgagaagttttcaataatttcaaccaattttaat

SEQ ID NO: 831 - DNA, 562 bp, Rattus norvegicus
  Genbank Accession No. AI011462
aagttctaaaactaccaacaacttatttcaaaaattcaaacaaaaggaaaaccagggaaatagaaatctccacatctttgatagtgttttatagtattatgattattttgcccaaggatggtgggctgtggttctgacagccgcatcaagtgctggcttcacctgggtcgccactttatgtcttttaccccatgaaaatgtcttttcaaagccgtgttgtcagcccacggggagtttagacaggagtcatcgtcattctcttccagtttcttgagctcctcctgccttctgtgatagaacagcatcagctgcttgtgctcctcactgctgatgagcggctccctggcgggtgcaccctgccctctctgctgaatcttgacaatgattttggttttctcatttttccccacatagtcagaaagcttctttgttcttcgcagctccttggcagcccaccacagctgtgcctccgactcctgaatgacttcaagcgctgcctgagttcctgacagatcttctttattttcaaacttcattcggataggatcgtatggcggcagcc

SEQ ID NO: 832 - DNA, 599 bp, Rattus norvegicus
  Genbank Accession No. AI011474
acagtgaaaatggtgaggtcatttttatttcagtacttgacaaaatacccataaagttcaaaacttagaccattatacaaaaataggtctctacaagtgacatgttgtcttcatcaccagtagcaaatctatgaagcagaaacttgtaacttcagtagctttgtaagaaaagcgcaggacaccgcacgctatgcatccggcagcattgccatttgaaaaagtttaatcttttcacccttccgataaatacacaaagtttataatttaatcatttaaattagcattccacaatatacatgtaatttaatgattactgtgcatgaacacacacaatgcttatatacacaaactccagtttgtcttcatgtgctgctgaggatttgtatacaatcataagctgtgtatgtattggtcccgttgaatattcacaatacaaaagcacaaaagagccattgatttacaaaagggaatccatttaatattcaataagtatttcaaaggattatctcctcatgccaaaatgaaattgagtagtcgaccctgactgtatagctccaagtcgccttttcagtgcctctagccgagtgacatagtctgtc

SEQ ID NO: 833 - DNA, 644 bp, Rattus norvegicus
  Genbank Accession No. AI011498
accaataaacaaaaagatttatttggaattttccaagtttgccagaagtggcatttgccaagccttaggcccaccctctttaagaccaactgcaaaaggtaacaacagatctccagctttccccttcccctgcagagtgcacgcacacacgtacgccccttctttagctgggttagagagctggcacattcccaccctcaggaggttccacctccccctgctcaatcagctatgggtgggcagccccatggcatccaggagatgatggcggctgcagccgcttgcatagattaagaaaagaaaataaggaaggaggcaccaagtgggctccctgaaaaaccccgttacctctgtacaaaaaagtggctcccacatagaaaaacctgctccccaaatagtgcaaatacccaaagagaaggacaaccagcagcaaggctgggcttgtaggaatggcaaagaactttggttgagaaaggccaggaagagtctgggctgggcctactcttccttgcccagctccccaaagccagctctgacactggccctagggtggagcctgtaaacatgcaaacccagcagcctttggttcggaaatgtctgttacaaagttaaaagcacagccttcagcagtcctacctgggcct

SEQ ID NO: 834 - DNA, 160 bp, Rattus norvegicus
  Genbank Accession No. AI011547
cagaataaaatgcagttttattatgatataggaaagactaaaagccatcagggaggagtcaaacagcccctcaaaatgacaagggaaaggaaagttacataaacgtcttggtaataaaacttcccgttgtcatcacctttgcagtgccggtggaggactt

SEQ ID NO: 835 - DNA, 471 bp, Rattus norvegicus
  Genbank Accession No. AI011598
caaacaagtcactttaattccatacccacaattttacagatctcagtactgaaagctgtcgggcaagagggacaaagtataaatatgtctgttccgcagtgtaaaccagaaatgacttgttaatcacaaaaagtgtacgcaaacactaggtctgggaacctcaatgccagcgtagcgggaagacactggggttggcctgcctctgggtcagtgcctttccctgcttggaaattgctagggttcctgaggggcatccgctcatccccactgctccctggatgcgtgcagaagcagtcatgttgacaggggccccgttgaacagcagcttcctcagacatcctcggtaggcagggggctctggccaggcagcttcaaacttgggcgggctcccaaggtgcaaaagcgctggagaatcagccaaggtctctggcaaacggcctgtggtgtggttgctgtgtgtgtcgacttcta

SEQ ID NO: 836 - DNA, 462 bp, Rattus norvegicus
  Genbank Accession No. AI011644
cgaggcaaggcctgtttaattcgagggcgcgcgtgcgctatggcttatgaggcagactgcggtgccagtgagtgagtctggggagttgagagcactgaagagaggccaagggtaggaacctggtaggcataaggcaggggccaggcccaggtgcctaggatcatacccgggaatggcttgcccaggcccacattccaggtcctggagttgcacagcaggataagcggcttgtccggaggctgccctcttaagagtcatggaacacccatcctctggcccctcagagagcctaggctctgcattccagaacccagcatgtgggaggcagcacaggggtagctaggcagagaagagaggcctggtccagggaccatcccatatgagggatgggacagagggacagctcctccaggcacagctgggcctgaggtcccctgactgtctgttccctggtctcttctc

SEQ ID NO: 837 - DNA, 614 bp, Rattus norvegicus
  Genbank Accession No. AI011749
acacaagtttatttggcattggatgaaatggttctcacagcatcttaagaaaagatcaatgccaacccgaccaaaaatacacccaaactaaaacctttaatgaaaggaatatgtaaaaacaggcattgagacaatgtacagtatcaaattccacttcaaggcaggtcagagggcacctgacctctcagaagagtggcaaggcaggcctgggaaaggggcctcctaggagcctgtccctctggggccttgtgggatgggcaaggaaacaccaacatcagcaaatcctggatttgggattattcaccagtaactggaatcgcaatagtgcgaacagccccaaacacaggccttccatgcaccctgaaggcatgggggacggggacccccgcaatcctgacaggcccaccactgcagcaccagcccactttagaccaccctctccacctgggcctcctattctcaaccccagcagccatttggtccccacttaagttccagcctgtacagtcttctgaggcactggtgtgtggtccttagggttcttttgggtggcctggcaccaatacagttcccaactgttgctctggagcatggctgcccagtgcctagcactt

SEQ ID NO: 838 - DNA, 383 bp, Rattus norvegicus
  Genbank Accession No. AI011770
acatccaggagagcttttatttgtacggaacagttttaaaaatacagaataaaatagcttttctctactgttattcacaacatctggtccaaatattacatagttttaaaatacttaaacgtttaatgaagccatgttagaaaaacaatatgaaaattctttttaaaaactccatgaaagaattacacatctcaaaaaacaaccccaccccaataccctcagtatgcaaaataaaaattaaacacaaaaaaaaccccaggaagatacataggcaaagtcagtcacaaaacccaaataaaacagaggcgtctctgctgtcttaaggacagtcagaaaattttcaatgtgtccaatcaaagttgttaggaacggacagaaaaggg

SEQ ID NO: 839 - DNA, 490 bp, Rattus norvegicus
  Genbank Accession No. AI011943
cctttaattagtaggacagattttcaaaggtctttgtcattttgacaacaactgacagaagctctcttgggaacaattgaccattgcacaaagacaagagcaggaaaagaggtttagtggtacttgtgagccagggcactggccactccagccaccaccttctggaaggcagcctgtgcactcggggtgaattccttgcccaggtggtggcccatcataatcacaatcatattgcccaggagatgtcttccttgtcctcagagcaagttactaggaaatacctgaagttctcaggatccacatgcagcttgtcacagtggagttcactgaggctggcaaaggtgcccttgaggttgtccaagtgtttcaggccatcatcgaaggcgtttatcaccttttcgccatgggccttcacctgggggttacccatgatagcagagacagaggacaggtccccaaatttagaaaagtacctctgggtccaagggta

SEQ ID NO: 840 - DNA, 502 bp, Rattus norvegicus
  Genbank Accession No. AI011949
  misc_feature (1)..(502): n = a or c or g or t
ctgagtttccaacacactaagagtaaatacagaagaacagaagcgcttgtgaaagtgccacactttcgggcagcagactgcaggcacattcattcggcaggcacatcggctttcctttgatagctacctgataataacaggatggtctcattggcacagttgctccctggactagttttatttatttattttttattatcttctgttgtttgcttttggatttcaaagtccgcgcaaatacgctgcttagaaatcatgctggaaatgcatgcattatttcatttggggggaagaatcaagttctagaaggcaatgttcacattttacttaagtaccaaacatagacataatggactatttttctgtattcacaacagacagaaggactgtcattttgattgcctgttaaggtttcggtgaatcacaacgttattaagcttttacatcagaggatcggttccttccgctaagtctaacantactataaagtaagaagtggggg

SEQ ID NO: 841 - DNA, 405 bp, Rattus norvegicus
  Genbank Accession No. AI011991
cactggagacaggaggttttattgatgctgatgggggtaggaaaggcccccaggagcatggggcctgagtcagtcagcaggcgcataagtcctgggcacatggggcaggttagggcacatttttcttctgaggattctgtggctcctcccttgggagagggagagaacatcttggagagcttactccaagagctaaggcagagagaggttagagcccctatcttgaggaggcatcacatcaggcagcaacaactttgtggaaagctggatgaactggtcagtaccaggaaatggaggggagcactgggttagcctcttagaaaggtcaacccgtttgaggtgaactcatggaatacttggtattcccaagcagagtggggtggggcccaaagcccctctccctgt

SEQ ID NO: 842 - DNA, 534 bp, Rattus norvegicus
  Genbank Accession No. AI012109
  misc_feature (1)..(534): n = a or c or g or t
aggggacactcaatgcactttattacacaaaacgaaggatccataaacagggcaggacttggagtcctgagcattcagcatggggacagttaccccttggatctggttgggatgcttgccttctctcctccatccttccttgggagctctcggctcctctatgggctggtccctttagctgatgatgagaagcagagttggagggttggtcagaggatgagagggcatagaagatggagggtccagtagcaagaggagaggcaagtggcagctgggttgctggaggcaggagagcgggccagactggcaacaggaagcaatttcttggtcagggctgggagtggcatctggttggagtctatccaggatgcatacgtggtctatggtgctgagccctcatccacgagcactttctcgtacttcccgtgtccagtggccacaaacttgtacctctttccagatggggtgctcttgatggtggatgagatcttggagcctnctttctgttcccacagacttttcttgctcatgtct

SEQ ID NO: 843 - DNA, 484 bp, Rattus norvegicus
  Genbank Accession No. AI012144
attcttaaatatggtttaatactcttctccatttctgtacatcacaacaccgagattctgctcttagggtctctctgcaaaggctagggagtgcagggtacggtttcacccctcacttatgtgtgtttgtatgcgtaagtgtaacacatatcggtatatattgatacacacatcaatatataatgcaatatatatcaccaaggagaacacattgattaaagaaatacaaaaatttggcatcatttccaaacttaaatagtaaaaataaaaactagaaaaagagctgcataccctaaatgtatcatgtgagacaacaagcatatgcaaatgtagtttacatccgatctctctggtcttgtcagtcacatcagacccatttacaatggcaaaaccctaaggtactgctgggaagagtgttcgcttgcttttgggtgttctgcaaacaaacagcagagcccaaagcaaaagcctgctctggtgaagc

SEQ ID NO: 844 - DNA, 398 bp, Rattus norvegicus
  Genbank Accession No. AI012177
gctcaagcacaggacttgaggtgtgcctggaccttcagcgtgcattaaagaggctgaggggatggggacagggatgacctggatgaggaaactgagaggaggggaggaaaggggaagtactggtaggagctgtctagaggcgatcactgtgataccgggggatgttaccgggaataccatctcaggagagcaaggcaagagaggtaatggacacaacagtggttttcccatgcccctagcaccttcatggagaccgcaggcttggaaaacaaccacagagggaagggatgggaaaaatggctgcccaggagtcttctccaccctggcttatcagaccccatccctatcacacagccccttcaaccacttgaaaatggagcaaacagagggagcaaaat

SEQ ID NO: 845 - DNA, 470 bp, Rattus norvegicus
  Genbank Accession No. AI012185
attagtaatagcttttattcggagtcctcattttccagacaggccacatgaaacacagccattaaacaatagcgttgagataaatccatacaatgtatgctgctttcgctgtcgtcgtcgccgtcgtcgtcattcaccaatcacttggtgcagcgaagaaccttatgaaatgatgggactgataaatgcacacagctaacctgcaaaaacactggggccaggagagtcagactttaatcaggtctcattcaattatgtttcaaatcaacacatcttgatagccaaaactcagatggaattaatgctctggtaaatgctgcctcttgtcaaaagaacataattagacaataatgagtaggtatatagtatgccagtccttggtctatttgatgaccccagcagcttccactccattagacaacaaacagcttttaacctggttctcataaagcatactgctcattactaca

SEQ ID NO: 846 - DNA, 551 bp, Rattus norvegicus
  Genbank Accession No. AI012208
gcagatttgaaatctttataggacatgcagcataaaaaagtgtaaaatatcagtaagcatataaaatttcagtaaccttttggatcagcaattgacttgcataagactgagtatctaggaagaacagacatgtcttggaacacagtttaaagactgaaacgtagaaccacttcccaagtgattttccttatataaagataaaggatatctctacatttaaacaggtatacagtctagtacattttcagttatgtacacagtttaaaaagtcaaactgtggccatgccagtgtctgtttcaaatgggaacaatcaaaataggtagcgggttggtaaagtgtcagcaaaactgaaggagtacacaagtcaagcagagttccaataaatgtatgaaagtgaaaacaaaggcctatctgcagtcttaaaaatatccccaagggcagagctgtcatgtgagcagggggaataaaagccttttgggtgtcccaggcacgcaggattctggagactcaggtacacaggtgaaattccacagtttgggttcagaaagac

SEQ ID NO: 847 - DNA, 574 bp, Rattus norvegicus
  Genbank Accession No. AI012221
actgaaatacgttgtcttacccaacccacccaaaaataaaaatcttacccttgtcctctaatctttcccttatccccagtcccatccccggccctgcacaagtgccccggatttcctgcccattggctatatcggagtgtgtccattatgtagcaacgtggaagcctctgtggagagcacagagtgggtgaaggacccttaaaaaggtgctcatttgagagccctggccacttgctcataggccagctctatctcttcatcgtcaggacaggtggaggcgaattcttcccgagcgtaagcgttgctcaagtaccgatgcactccacggaacgcctccgggatggtgaatcctctgtactttttgcacaccacctggactatgtgaagctttggcagcaggttgcagtcagccagggtgagctcattgccatccagaaacttcctctgagagatgccctcatcctcggcgctggtttcatccacttcttccgggaggggggatgtcaagtaattgtctagaaccttcagggctttcaggagtcccttctctaggttgtcattgagggccgggttt

SEQ ID NO: 848 - DNA, 548 bp, Rattus norvegicus
  Genbank Accession No. AI012271
accggtttctaccctcctttattagctgggtcacagctacgtaagaaaccgagctggaagcccagggcgtgcgcactctgcagtgaggtcagtctacaccgatgcacagattggttacgtttggtaccacaaggtgtttataattcaaacaaaattgggcagactaacaattttatgtacagtaaaacaaaaggggaattcaagtatcaaaatatggaaacagattaaataacatctttcttacagtccagtcccactgtccgccatgggcagtaacttccgtggggacctcacaagctaactgtgaaccgtcttgattgcagccgtgtgttccaagcgctcaaaaccaaggcttctcagaacccccaagtgggcaacctcagaggcagagtccaaagtaccccgttgggacgcagggcagccggctagacaagaggcaggccaaggagcctgtaaccgccgctgtgaggggattgggcacatcttgctactcccatcagaatggccccttcacagttcaggcacagccttggttgtcccaaggcatg

SEQ ID NO: 849 - DNA, 508 bp, Rattus norvegicus
  Genbank Accession No. AI012308
tatttttgtaaggatacattgaaacattcgatggaaacagctaatgacaaatatggaaatgaggtgtgggcatctagaagcactcctacagtaatatatgagtgtattttcattacatctttactttgatattggctcgttatacatgtggtataatggagagtacgatcagggaggcaatcctgcatttcagaggaggaggaaacccagccctgcctgtaaagggtgagggctaccctgacagccccagagatctaactcaactctgcagggaaagttctctaggaatcacaaggaaagggactctgcactcttcctgaacgcagacaaagagcagacaatggttatgctacaaggacttcaccttgtcactactttgaaacgtattcttgttgatgacagccctgtgcctgctcagctgccactctagagcttttgtcacttatacaggatcaatcgcaaaactgcaggaacgtttgaggaggctcatatattgtcatgcaagttt

SEQ ID NO: 850 - DNA, 459 bp, Rattus norvegicus
  Genbank Accession No. AI012353
caaaataagacatcacctggcccagatgcctggcatctgctggccagcagacaagaaaagctgttgtgctctcagctgtcctggcagacacaggcttggtacagaagaaacaagaataagaagaatccccctgctccacactgtggtggagatggatgcagaacaggccttgctgacaaaatccttgctcatgtgcaaaggcaggaaccagggcagcttcccaaccttgaagagggtctgagagactccttctgtgctgtagctatcgactaaggtgagtctggcaggcagtacactgctccagtactcacagctggagggctgaagggagctagagtcaaggacatggtggacactgcagagtctaagaggccacagggcagctccaggttcaggatgttcaacaattccagtggcctgagaacaggcacagacatccttctatccaggcctcgtgcc

SEQ ID NO: 851 - DNA, 636 bp, Rattus norvegicus
  Genbank Accession No. AI012356
ggatgttaaagtagttacagcaatatacaaaaacaaacaacaacataaaacaacccacaataatataaatttttacactagaaagtatacattggaatttgagtgcagtgaccaggacagaataaaagccactgtactgggaggccaagcaaactgcaggcatggctgggtgaggttggggacaagtggggccaaggggaggggaagtgggccgttccaagggctcactatgggtgattaacccagatacagacttcccagaacccctgaggtacaacacctgccccagagaagccctcaccttgttcctgggtccccaggattggaagccatcaacatgcccacgccttgccttcctaaataccctttcagtttatgagttcagcttattgtgtaactaaagaacctggccagggaagggagagcaatgactgcctcgaagcagaaggctggggtggtcaaggcaagcagtttgtcttggagacaatgtcctcactgcccttaattcagacactggttaactggagaaaaacaattccacagacagatcagctgagtaaggtggctttgagtcactgaatctagccatgcccctgtatcaagggaggcttgccttgaaccactcagtgttcaagt

SEQ ID NO: 852 - DNA, 561 bp, Rattus norvegicus
  Genbank Accession No. AI012379
aatggcaggtcaacaaatatcctgaaacatacatagattctgatagtcttctaaccccagttgaattcaaacttgaaagtaacacacgcgagctaagggaagtcaatgttgttccaaggcacttactgaatctccatgactagacgaaaacaagaaccattagggtgaacaattagacagtatataatataaaaataactttttgcttacaatttacaaaaggtattattattacactctttgatctctgataacctgcaatgctggctacacgaatccagcaagtttaaaattcagaaacagttttctaaaatttcagggcaaataatttacaagtaagatacacaaagacttaaaccatgcagaaattcttacatcttctgttaataatattttaggacttcaactttatcaaattatatacctacttgccctgtacatatacaaaataatgcatacatgataaaacagcaaaagagtagtcctttaactcagtttatcataaaagtattactatattaacaggtctacaagcagcttgtaacagggttaagagacatt

SEQ ID NO: 853 - DNA, 530 bp, Rattus norvegicus
  Genbank Accession No. AI012380
cctgaatgaaacagagcgtggaatgctgtttgtccttaggcccatgggtatacatcctcttcatacctgtggtaactcagactccatcactatgttcaaggcccaagctacaagctgaggagagagcctggaaagaaaccatacccagaggtcagggttacctaagactggtgcccaacacaggcagggtcgctctaaacactcacctggcagtttggacctgggtatggagggaggcagagggtgtcccatatttatactggaatgcagaagtatcacgatgcctctctgggggttcccagacagagtggggctcctgggctccggttcttgggagaagctgccgtcttttgatgggccactggagctccctgaactctagcttatgaaactgggttctggtctcacaggcctggtatgaagtacgggcatgtcgaaggggtgagagactggggctgcaggtcaagagtggggagctgggtgtagaactgcagggtgtaaaactgggggcctgagctcttggggaggtt

SEQ ID NO: 854 - DNA, 563 bp, Rattus norvegicus
  Genbank Accession No. AI012393
cctataaaactttattaatagatactgaaaattgataaaatttttacacaccagaatgtacaatttgctattttacatgaaatgtaaacatttaatctaaaatcacattaaatgtgaaaatactttaccctcccacatggagtcacattgacgacttagacagtgatccacaccttgggaacagagtgtccctgacacactggaggaattgagattcttcctcctctttgccctcctcttgttcctcccctttctctccctcttctccctcctgcccctcagacacacaggccatggagctgacagtcatggagacatttccagacttaagctggaagtatggaaggagagtcccagataaggaagcctcgtggaaggagaaaatgtgggacttgtaactcatgttatagaaggagatgttcctttcgtcatagtccacaaacacccccacactctgcggagcttgcctgatggataaggaattcctcccagagtcaacatatgcccaattcccactactagactgccccactgtccaaaaccccttctatggactctcaaaa

SEQ ID NO: 855 - DNA, 586 bp, Rattus norvegicus
  Genbank Accession No. AI012423
accaatggaacatgaaggctttattggggtcttatggtggagcagaggggagacagcacaaagatgacgacggttctgggttgactctctcatatttgcctcctcagactctctgccaggtcctgtctatctttgactctgtctcaatgactgcatgtgcttggtggtctgctcctagacatctatctgtacttagctcacaaaggagggagaaggcactaccccctgctcctctccaggaagacatatacagttcagaattagtcattgtacacatgtggtcattgcagcaaagtctctcaagagcttagaagtaagccagtggttagaacatggttatagaacacaacctattaaaatactttacatcgtgggggaaaactctaagtggaggtctgggcctttctattctgtctcattgtcatttcctcccactacacagggcaggcatttcaagaatcacagtgcctgttcctctttacggacaaggaggaagcccaagagatgtacagctatctggtccatggctacccctggggctaggcagctgtgcagtttacacaagagaaagaactagtcctgctgt

SEQ ID NO: 856 - DNA, 615 bp, Rattus norvegicus
  Genbank Accession No. AI012434
acaaggcaattatcaattgactttatttcttctcataaggtaatgcgaactttgcataatacttttgtaaataaaatatataataagaagttttttaactttatcacatatcatcagttgttacgttgtccttaataaaaactgcttggcatctgtaacagtctgctggtatttccaaccaggctctggtaacaaactgagctctccaaagggtgacatttattcatgtttaaactaaaaccccaatacaggaagaagccaatattgtcttgatttcatgaatgggagcattcaaaggaaaccacggttagcatctgataatttaattagaagtggacagcagagttacaaggttcacaatgaacagctttataaccggcaaacatgaaaaggaatactgctgacatttggaaatggccatcaccacaaaccgaactgtccccctgtcccctggtgtgtaagctcctgtctggaacacaggaggtctcgttttgagcagccctgaataaaaagaggattgtctccaacaccactagaaacacttgcatacacacgccacagagcagctgctgtaactttctattttctttacaaaaagcccttgggccttgtgtt

SEQ ID NO: 857 - DNA, 499 bp, Rattus norvegicus
  Genbank Accession No. AI012467
aaaaacaggaggacatttaatccatcccaaaggtcccacgaggagatggacggaactacaggaaaaccatctacctatggcataagggtgctgctgactccatgtttactcctagaatctcaagacttgatgtttccacggaactttctgttctttgatacttgcagcaattcaaataaggcatccatctgtaagagttctgcctgctgatgctgaaagggaaggcgtgtgctgcagagagcagcagagacagcacaggacaccagggcagacaggctccttcatggtgatgcagccagaatccataaaaactgggctagggcaggactcttcagtcctgttcagctacagcttcagtatttttatttatcggcttcagccatagcccctgggagcaaaccccagaaaaggcattcaagccccctgctggttggtttcatcattatcccgccttttccaaatctgaatgtacccctcaaacagggtgatcatttggggc

SEQ ID NO: 858 - DNA, 599 bp, Rattus norvegicus
  Genbank Accession No. AI012471
gaaggcaaagatcatttgctcattttatttaaaagtaaacagttgtaagatagaagggcagatgttttctttattgtagagacagcagttacaaaagagaagtaataaatatgacattaagaatttttgtttttgtttttgttaaaaaatacaaccccctggtatttgtgagaagtcccaagaaactcacaagataaaaaaaaaatctgtcccatgggtgagaatacatttctttcagttctttggagctgatgtcagacaccggaagatggccatgacttcaaaagaccttggatgtcacttgagaatttcacaggtccaccctgatttgcatggggtcggatgacagctatccttctactcactaatattaattacttctgacgattctttcattcttaacagtaaaggacttaaaatgactggattgtgaaatgaagaatgagagggaacgagaacatagacattgttaagtgccaggagacaggcaaagacagcatcaagttagtcccgtttcggagtggggtggggatagagggtctaattcacaagtcttcctttaaatcccgccatcatactaaggtggaagacggtgaaaa

SEQ ID NO: 859 - DNA, 434 bp, Rattus norvegicus
  Genbank Accession No. AI012516
cattttaatttccgaatttattaaaatgattaacctcaatactgcaagtgcatgtacaaaatatttgtaaaaaatgttttttaatgaaacgttaaagaacttacctcaaatgctgaaaaagtcctttttcattctttcagtacaaggaatacattgtatctcaaaagtattacaactcagcaaaacaatttaaaacagtaatttgaaaaatgattgaaaattgaatactttacatatatttctaggatcatttcctaattcttacaattgccaaaaactttaccaatcattgcataagctcgagctgagagttttattgagtgtaacctcttccagactggtcaagagtgtggggttctggcacccccacagtgaagttctacagcagatcgagaacagtctgaggcccctgccttgagaaacggaaataaggt

SEQ ID NO: 860 - DNA, 580 bp, Rattus norvegicus
  Genbank Accession No. AI012566
ggattgcagaagtgtcagcagtgggctgagaaacccagagggcacagagagagctgggcaaacccaaggacctctggggtggagagaaacagcagaaagaagtgatgcccctgcagttcctccaaggccagccctgtccccatgctcccaggtcatagaggtacccagagccaataaagaccgtactatattgggtcaaaagtatgtgtgtaaggagttgacatcctaaggcatagacccaggtagaagactccctcccacctggtggctcccaagggtgattgctggtctgagagccagggatatacataagacacaacccttgctttatgggcctccttgtccctgggaaaggcagtgagatgtgctgagggcgagttttactttagggtttgctccaatcttctactggtaagtcttcctccctctgtgtgcctgtctccatctctgtgatttgcctgaaccagacaattctctgaagtctttcaaactcttaagactttcccccaactttagagtgccctcagactggggtgaaaatattaaaaacatttttttttaatgctggggattgagccca

SEQ ID NO: 861 - DNA, 557 bp, Rattus norvegicus
  Genbank Accession No. AI012621
accaaatgcagcatttattttaaagttaaattaaaaaaaattgcatcaccaggtagtcttcttgattaaggaggcagcctgaccagggtgggccataactgggcggcagccattacacagggccatttaaggcagctccgtctggcagggcatctgtcttcctgtcctttgtcattgtccccagggttgcaactatggctggagctgttgtggttactgccatgattggtcctgggggtaccgcagtagccactgaggaagagaccactatggtggctgtgggagagcctgccttgcttggtgctatggtagccacggcaggactgatggtcacttctgaaggagcagggcaggcatgggctaacacggtgctgtcaggacactcggccctgccagcagcagcctctgctgtcctgtgtggcggagaggcctttccattatggcctgcgacaaagagcttccacagcacccgctgccttctcgtcatcgtcactgtcacatcccccagaggagctgctgtcagaggctaccaatggggccttcctagtgacacacac

SEQ ID NO: 862 - DNA, 564 bp, Rattus norvegicus
  Genbank Accession No. AI012636
aaaggagccagacatggcagctagactgaaaatcttccaaaattctgtacaaatgtataatatacaaatatacacaaggctattgccaggaaaggacataacaacaataaatgacagtggtggctttggtgttgacaaccactccgagcttctcaagcccccaagaagcagggacacaacacaggcgacaacatgtaaaacacattatatttacactatatacaccttgtataaaaagcccattgtcccctctgttcacaaatccttaggtgggaagaaaggttgtttaccaggtaacccacataagggagctcatttaaggtaggagaacccctcagaatgaagtggttcatcctaaaactattaacagcacaaggcatgccctagagacaggcagtaagagcaactgaagagatggcttgctccctgtgctcagcatggcttcgccagtctcactccatctcagtgaaccgggcaaacatggctttccgaacagcatctttgtaggaatcggcacctgacaacccatatgcaacgcctttggctcctaagccagctcctttt

SEQ ID NO: 863 - DNA, 565 bp, Rattus norvegicus
  Genbank Accession No. AI012641
acataactttaaacctagatcaagtaaccacctatctctcatcacaggaaaagggccctgcgcattttaacaggcaaaaagttttaagagatataattgccccattacaattttcctattttcttgagtatagtggaaaattgatagaaagacaggagggaaagtagtcctgcagcaaggctgtaagacctcacttaggttggtggtagttcatgttcgtcctccaaacaggtgcaagggaggtccaagtgctctatgctggtgttttctttgctcattcccagaactcccagccagtgtctgactaaaccctgtaaaatgtgttagggcctaattatgcaaaatacattagcgatccaagcaaggaggccacataactcccagaaataccgagtaattatcacaactatatctaaaaatttacaattgccaattaaaaatggaagtatggctacttaaacggtaacaaaatgagtatgaaatatcgattttcaagattaaaaggaccccttagaaggacaattaaatgagtggcatgggagaaaaggaaatggtatgcagctta

SEQ ID NO: 864 - DNA, 504 bp, Rattus norvegicus
  Genbank Accession No. AI012761
catggaaaagatgatttattgtacattgtgggagaaatatcaagagtgactgtttcgcagcaaagctactaacctggctgagaaaacgtcaaagaccttacactgtcatcaagctgtctggagccaaccacagcggatgccaaaggagtttgctttgctgtctgcaaattaagatcttttttctaaaacatctgagacttccaattaaatgtcagccaaaataaattcccagatgtacaaaatgtgtgatttgtccttaaaaaaaaaaactggatgtcagctcaccgtcgttttggtcaacagtcaataaagtgctttacagacactttggactacgtcgaaagacattatccttgctcacctgatatgtatctgtttaaaataaaaaacactaaagtggtaggtcgttacaaatgagatacaaatatgttttgattaataaatactaaaatgaaaaaattatgtaaagaatgctcattaaaaaaagttactttaaaaagaaat

SEQ ID NO: 865 - DNA, 159 bp, Rattus norvegicus
  Genbank Accession No. AI012832
gggaaaatagttatgcaaattttattgaaatttattgcaaataaagattttcccagtggtccacaaaatgaacttgaatgtcattcagcatttaatgatcaggaatgtcaacccttccacttattgcacaaactggtagctttgagacacaacagtagc

SEQ ID NO: 866 - DNA, 516 bp, Rattus norvegicus
  Genbank Accession No. AI012958
cagaattgggaacattttatttggaaagatttttttaaacatgatttatcttcatttttccattaaggcaacaataatatccttacttcgtggaggcagatgggcaaacatcatctgaggctacatgatgttcagactaaagtcacagccaaacactttgcattcggatgcagcgggaatactggttgggagctggaaagagccatctattggtttcctgagcccactgtcaggggatgaagttgagatcctgcatttccactgctttggaagacaacgaagttccattagtgggagtaagactttcactaatgcaaagggagtctacctttggttcacaatgctctgtggagttttagcttttggtaagttttcgtggaaattgcttatctagtgggagctattcaaattcatgctgtcccttttcggttttgaattccaggcagttcctagtcaacatggtactcttggcatccagctacatatgcgtatgtgcccgtgcaagcatttgggtga

SEQ ID NO: 867 - DNA, 466 bp, Rattus norvegicus
  Genbank Accession No. AI013033
attataattccatttatttatgaaaagccctcataacatgaaggaggttggagagtgacgtaaggtagtcagtgctgcttctggcactgtttggacacacagactggactctggtggtcaggccctcaaatgtctttatcagctgttttctgccaggtatcttgccagctgcttgtgcttaacaagaaactcatttcttttatcttaagagactcattggtgtacctatacagagggaatcgaggtcatcaagccccaagacctctgaccctttgggtcaagtccccctcctattggagagccccttcaggtgcataattctccgagtctcccaagttacattccttattcctgaggtgagttggccatttgtcttatcgtcagtcctctgtgctcttgtcttagggttttactgcggtgagtagaaaccactaccaacgagagtcttgtaaaggacaacatttag

SEQ ID NO: 868 - DNA, 556 bp, Rattus norvegicus
  Genbank Accession No. AI013075
agaacagccaagatatatttattactaaaaataaaagcaactgaggattaccctgggacgcaatgtcagctcaggaacatccatgacgaaatgtgtatcttccctgattctcagctggtgccttcttccagagtgagttttagtttacaactcataatgaggacaaggaagcgggctccatccctttcctgttcagtctgaagactgaattgggctacactgggatggagacttgaggtgctgcaggtcagtgtcaaccaagggttcatgtgtcaggaactcgggctggtaagacgacacgaaggcttcatgctgaagctcaggcaggtccagggagcctggcagaatggaatcctcatggtcatcatcaaacgtctgtgtcggaaaggcttcaaggctcatagctgcatcattctctggcagctcctgagagagctgccccttcctgggtttgcacgcatcgaatttcacccactggtaattgacgcagttctgagcttctggacaactctgaatcaggttgtggatggttggatgagaaaacccaaaggaagtc

SEQ ID NO: 869 - DNA, 447 bp, Rattus norvegicus
  Genbank Accession No. AI013098
ggaacatgaacaatataagtatttatttgaaaaaaatcattttccatttcagtaaaatggcaaatcagctttagcagtttctcactactaattctagttcaccctcacagttgctttgtctgttcatattcaacgatatcattacagagaactgtttcataattttttttctagaaaaaaataatacagtctccctaatgggtggttaattaaaacaataaggctgggtgaaagaaagctaaggtctgaaacatactgacatgaacacgaataaataaataggtactgaggagacactgcccatgatactctttacacggtaagaaacagtgacaagaatggaggttagctcacaagcctacgctacgactcgaacacaacacagagaaaagagatggtgggaagcacgcaaccagagtctacattggtgctgttttaaagctgtgt

SEQ ID NO: 870 - DNA, 468 bp, Rattus norvegicus
  Genbank Accession No. AI013160
gccttccttcaacaagcttttattgttgaagtatccgctgtgggctgaagatgcaggaattgtatgcagagttcgtgatggccaagtggtggcgtggtggccacctcatcacagctcataatgcagaggtgggaaggccatttcatcatcctcaccctcacagctcagctcaaacaccagaactctcagcccaggcttgggtttctggccggtcacctgctgaactagttctgtcaccctggtatgggaaggggtttggggagattttgtaggtgagcagaggcagacagagagcgacctagtgtggaccagagggcactggtgagccctcaagagcctcaaccaggagcatgagcggctcaaggcaggaaacatctgaaactattttaggagcagctggtggggcaggcaagaggcaggaagctgtgtgtcccttgagagtaggctgtgaagggagatgggggctgg

SEQ ID NO: 871 - DNA, 432 bp, Rattus norvegicus
  Genbank Accession No. AI013161
cactcatgacgtcattttaatattctgcagggtcccacgatatgaagatacacacatttgctacattttacttattcaataaataaaacaatacttgaaaccttctaatacatctttgcgcacacattcatcaaagcatttttaacgtaggaaagcatgacagatgaaagtgtgcgtgcttatttggaagacatctattgcatttattctctaaaagaaaaagcaggcctgaagggtcacgttactggacattttaaacatggtgatctggctaatgccagggcagacaacgctgttaaaccaatacttcctgctaagtacatgtaagtagaatgaattctatcctttacatactgaggccagattacagccttctcgatagctccaatctcattagacattcccaagccgtagtagcacagtgctccaaga

SEQ ID NO: 872 - DNA, 374 bp, Rattus norvegicus
  Genbank Accession No. AI013222
cgctctctgtgacaaggaagctttctcactgtctctccgagtgctacagtacttgctttgatgtcacactgaacaaacggacactgtctctttgtcctcggacacagtttttcacggaggagaacaaagactgcacgcacattggcaatgaagcaccatacatagtatgttcaggaatgtcacacgccacgtacatccgtgtcccgggagagggcagccagctcatctcacctcacatctgtgggaaggcaggaagagttgaagctatgaccacagatacagggccgcttgacaacttatgtcttaatacatgcaggtgatatgtaatttaaaaaaaaaaaaatcaaattttccacagtttaagtgtaatcaaa

SEQ ID NO: 873 - DNA, 368 bp, Rattus norvegicus
  Genbank Accession No. AI013260
ggcattccaatacactttaatcgaaaagactttggcatggcggcgggagagctgccctaggctgccagggctacccttgtgggctgggcctcagcggcggctgccactcacacggtggtgatggcgcagctcatctccatcctcttcctcatcgtcattgtcctcaaccatggtcagtgagcgcaccagcttgcacatggccacttcttctccagtggcgttgctgagagccgtgcgaaggctgcgcccacagccccaagtgttctgtgccttccacaccaagtcagtaagggggctatgggtgaccccatctcctgaatcccagatcgtcaccacctgcccggcctttagggtgaacttcggtggga

SEQ ID NO: 874 - DNA, 311 bp, Rattus norvegicus
  Genbank Accession No. AI013369
acacaaactgacctttatttgttgtactgaagtctgttttggttttgatacaaagtaacattttagtacatcatgtcccacctgtcagatccgtacctgcccacttgctgaacactgaacagggcctatgaccagggaaataacccctgacctgaaactgtgcagagtaagaacttgagagtggtctgtggcttttcttagttgtctgagctagaaaatgtgtgcctgtaaggcacagaacagccttgagggctgcaactgtgtctctctctctctctttaaacagctgtgcaagaaaatatatccctttt

SEQ ID NO: 875 - DNA, 670 bp, Rattus norvegicus
  Genbank Accession No. AI013394
gcggccgcacgtgttttttttttattttttttttttttttttttttttttccataataccaataaatttttttaagcagaaaaagattatagatttgacaaggagggttgcaaacaaagagctattttgaattggaggcaggttaattatattaaaaaaaaaagacgtctccagaaaaaaaaatctcttatttttttcagtgcaatagttaagttccttcatattatagagacatacacaatgttaacaaccatgaaaaacaatacaaaacgccctccatttaacaagtagaaaaatataactactatatatggcaactgtgaatctaatactgtacagaagtcatttgtgggttttacaaataaattatagcttaaatgcttttttaaaatttgttcctccccccacttcagatgtacaccagaagttacaacaggaaaagtcccgtgcctaacagacggcaaattagtgccagtcgaatgttctgcccacgagcttgaaaaatttcttatttggctcatgaaaatattcgtgcagtttatcaagtagtttgggatctacttgagggtgcgcccggcctttggactcatgtaagcagcggtccttgccactgtcccgcaggcagtagaagcccttggttttgttaaagtagaagttcgaggcgttgatc

SEQ ID NO: 876 - DNA, 632 bp, Rattus norvegicus
  Genbank Accession No. AI013396
taaccgtccactaaagggaataagcttgcggccgcatgtgttttttttttttttttttttttgaaaaggaacactttattaaatacggtgtcatttagctacatttacatttatctgtataaaattaactcttctgtggttaaaaaaataacttcaaaccacttggcctctgctgggcagacagcccttgaaactggctgactctgagtcatacttggggactggcagaactgagcttgcaaatccctggtgttaggtgcagtgttggctggataaggggctagcttggtctgtcactgctgctttcaacaactcagtgtaggtgcttcaggactacaagttgaaggagaggtcttcccctctagcagctatacttgtgtcagagatggagggtaaagggcagccttttccccacccatctgttccatagatatgtgagtagtagtccatcagaaccctaaccactgaggtatcctctcctgagccaagctccccacagggccttggctcaccctgtactgcagtctatatcaaccaacaccttttctggggtctgatgagcgtcggcatcgggcgccttaacccggcgttcggttcatcccgcagcgccagttctgcttacccctcgtgcc

SEQ ID NO: 877 - DNA, 612 bp, Rattus norvegicus
  Genbank Accession No. AI013397
accataatggcagtgccaactctatgcctcgtcattcaagagcaggggagaaacccaactctttgcatgagcagggctgggtggggaatgttcgtctcagtggcttctgtgctccagggccagatgacagtaagcaggccccgaggtctgctggaagcggatgttgactcccacccaggtgactctgcacaggctgtacaggaaagtgagtcatgcttctccaacaggctaggggcaaggcagccatgagaaccacaggtaaccaaggtgttccttctaagtggtcagtttaagacaaacaggtacacaagcaacagacttagtcaaacgcaacaggaaatactgtgtgagagccaggctaggaggctgcttcatcctgaacacacaacttcctcagtccatctgcttacagaggacagggagacagagactacaggctgtgttcaggagggaccggggccactgatcaactgtgggcatggacaaagggcagaagtgaaagaggctatgatctctaccagtcttcaggtctccactcacagagaggccccaggatggcctgttcagactctctcctcctggcccagcaatagttagactcttgggaactca

SEQ ID NO: 878 - DNA, 506 bp, Rattus norvegicus
  Genbank Accession No. AI013448
agaaaaaaattgtcactttttacaagctgaaaaccagatttgacttaatacattttcagggatcttggccaagtcttgcaatctttagcagaatgatatcatagtaccaggtgccagcagtagggttataaactctttaagtacacttatctacagttttacgaagaaacagccaaagtctagtccttaaggtatgagtcacccaatctcttgacctatgaaggacagaatcacctgagttttgtggtgggcaagctatggagaaaccagaggaagtttctcttttttgagacaggatctcaccaggtacccctggttgtcctaaaactctatagaccaggctggccttgaactcatagagatccacctggctctgcctcccaagtgctgggatcatgacgtgtcccaccatacccagcttcctggtttaaatattccaggttgctgtcaatttaataaaagcctatgacaagcggacccacagatatttggttttactggtgtat

SEQ ID NO: 879 - DNA, 457 bp, Rattus norvegicus
  Genbank Accession No. AI013466
ggtgtgagggactggttttatttttcaccattagaaatggattcagttgaaagtctgagcaacagttctgaggctgaggctgaccatcgacggcctctcaggagacaggcctggaggtgggatggttccgaaggcctagggcatcctctgcttcactgtttctagagtgtgactcttcattttggaatgtgttgtctcgaggttgcagaacagctgctgcagctccagatgtcacatcctcatctggatggacttacagctctgtggtgtaatttggcaataatgaccggaagaagagggcgattgtgtttccgtggctgactggactcagcctctccggtctgacgtatgagtagatggtgtccacgggaggcagagggtcaaaccccataacagactgtgtggtcacatccgagggtatggcagcgacagcctccttgatctcagcggcacgagg

SEQ ID NO: 880 - DNA, 605 bp, Rattus norvegicus
  Genbank Accession No. AI013474
gaagggtgagaatcttgtagcttgtcaccatggctaacaatgcaatggagaaaacccgtaactaagcacaaaaatagcctggagctcccagggagagccgcctactttagacaggttgcatgatgggtaaccccccactgatggtatgaggtcagatccaggtcactgagagacctgaaacagccgtcaaagcgtgggttccagaggagggccgctggagcacgccagagtccggaggcctcattctaactcggcctccatctgctccgtgtctgagcactgggacttattcctttcccattggcaaatggcattggcgtactccaccaccagcttatccatccatgtcagcggctctgggaacagcacggagccctcgaagaagcccaggtggcccccatgcagaggcagcacaaacatgacattttcccgtttctctgagagagactttggaatggttagaaggctttcgtgcaccaaggggtcgtcagcagcattgaccagcatgagaggcacgtatatcctgtgcaggtacctcatgcagctctcttcctcataatattccttcagggagttatagccatggaacctcgtgccgaattctt

SEQ ID NO: 881 - DNA, 696 bp, Rattus norvegicus
  Genbank Accession No. AI013477
cagtctctctgcatcttcttctacagctattaggtgctgtccacttttctgcacagaccctgaaccacgcatcaacttattttctctgcaacttacaataactctctcagtgacttagctttacccttcaagtttctgtaactttctcttcatatcctttccttatcttagccagattggtggggcattttccagcccctaggagacccaccctcggagcctgggggcagacctggagcactccctaccttcaggggcattgaagtcaacagtcaggagccttccatccatgtctggaacattctttctggcctctagcaggattctgtctttcctcagtggtaaagaagatctgtaacagttactaacaagcatctcacgtgggatggtgagaaaacaagaagggaatctagaggagagaggtccactgaagaggacaaatagcatttagtcacacagctaaaccaggaggcctttttttggacaaaaaggccactgtaaatataagcacaagctttgtctatgaaacagaaaggcgagcagagaggcagcctagctgttaccggctgtctctctgggcttagattttcccttaaggagtacctacctcccttcagtgtcagcttggtggctttgcctctcaagagaaccagcctccaaatgacactaggcttctagtaacaactaataacaaaa

SEQ ID NO: 882 - DNA, 464 bp, Rattus norvegicus
  Genbank Accession No. AI013495
agtcatattccatgaactggatttaggggtattttaaagtactgagagtttatttttgtaatccaacaactttatccaaaaatgcagaaaatttttctggctggccaggaggataacatttcagtgttgataaatccattgactgtaacagcccaggaagcatgctgcaagtacaatagaagagatggccttctttgtgtaactgctttgccagttcaaattgatgattgttcattaacttttcatttacaactaccacaagtggcttgcctttttctagactctccaaacagcttcctgcacctgcgtggctaatgacaagatcagcttgctgaaggtcttctttcaaagactccttatacctgaaccgtatcgttggcgaccacacgagcgacgaggtcgtcgaaactggtggtcccgacggtcacaaacgctctcttcatcgcgcgggttcccctcgtgcc

SEQ ID NO: 883 - DNA, 183 bp, Rattus norvegicus
  Genbank Accession No. AI013499
aaaggaaaaaaatttttattgttaaaaacaaagacacccggtattttaaaggaaatagggatggaaattgaaaaaattacccaaagtgagttaaggtaaataccaaaaaaaatgtacggtaggcaaccacttaaaaaaggacattacccaaaaagagcaggaaaaccttgaaacaaccaaaaa

SEQ ID NO: 884 - DNA, 590 bp, Rattus norvegicus
  Genbank Accession No. AI013558
tgtgatttttttttttttttttttgtaagaattgaagtctttatttgtgatatccataaacgttgctattctatgtttctattcaggaaggcaattttctcctattatcagtgtttgttttttttttataaacaacaacttgaattctattgcatgaagggctacaaatacacgttaaccaagcagaatacagatatttgtttttacaacttgcacctaaaaccccagtacacacagctgcttcagtagctatcagagcagtttggggctactgcccaagctatgcatagcagtttacatattcaaatctcacgtagaaaagcgactgatcacgggctgttaactacactcctgggaagcccgtctcagctacaagtaaatgcggacctttcaagtctgcagacttctggtggcaaactgctaaatctgatgaaattggtttttttaaaccaactttcttgcagctatactgccactctaccagcagatggtgctacatcggttggacttaaaaggacaaagttcagacttagggaagaaacggttttttttaaacctgctctgaaaatacatcttaaaaaaaactcatt

SEQ ID NO: 885 - DNA, 514 bp, Rattus norvegicus
  Genbank Accession No. AI013566
agtggaaaacattttctagtggcaaaactagacattttttctctagtttcctgtctgtattttcataaataaaatgcactagttggctgaactcttaaaatatttttttcagtggaaattagagcagtcttatatttttttaaataaatcaaagtatcttgatgatgtgtttggatttgattcagaataaagctaagattgtggcaaatatttacatttaccaatattcagtcaatataatttttaaaataacaaggacttgaataatcttctgtagcacgttgaaggaaaatggaactgtattcacagatacattcttatagtagtacaatgtattttacaaactgtacctgtaaaaatgagttgtgcaaagtaacatgatgtttagacttggggaaccggacgtgaagctctgtgccatttacttggagccgtcagtcaatgggtttgaccatcatctgcactgctctcaaggagtatgacccgcctctgtactcagcccagaaaattccat

SEQ ID NO: 886 - DNA, 482 bp, Rattus norvegicus
  Genbank Accession No. AI013724
gcctcatagaaaaccgacttgcagagatttaatagatgcaaaaaacaaaacaaaacaacaggactgtcaccagagtcgtatcacaggagtggttctcaaggcacacagagtggaacaaatgacaaaacggaccttttctgtgtgtggtcagccgatgactaaaagatgtctaagagggttaaaaagccaaccggccattcgaggtttattccgtggcaaagaaatgaaaaatgaatctgtgagatcctgcaggttgcaagggtaaaggcatcccgcagcttctcaagacaagaaaaatgagggcattctgtttaaacagtaagacagatgctgcgaacatcacctgtagctcctacagagcccgcctgcttttctgttccaagctggccctttcagctttctggagggtctctgcctcttctcgaagcctctgtagggcagtctgttgctcggctctaatttggttctcaaatgcttctgta

SEQ ID NO: 887 - DNA, 539 bp, Rattus norvegicus
  Genbank Accession No. AI013740
taagcctgcggccgcatgtgtttttttttttttttttttagactttgacaatactttttattgtttatttagcccttcacagctcaccccacacagagaaaggttcttatttgtagtgggtagctcattttgtagcttatgtggggaatatggttcaagcagaactcatgtctggctgctggtactgcagagcaaaggggaatctaggcacacccataaagtgggttgattggcaggctggaagacaaagctcccaaaaaaggcactttaacagggatgtagctcagtagagagtgcttgcccaggaggcacacagctctaggttcaatctcttgtaccataagcagtttccatggggtcagagaatggctggagagttgtggaaaccagaggaggtattgttttggagacaggacctcactgtgtagccctggcctcaaactcagagatccacctgcctctgcctcctgagtgcttggattaaaggcatgcaccaccaccgccgcctgacaggaggaagtttctgatggaggagctat

SEQ ID NO: 888 - DNA, 498 bp, Rattus norvegicus
  Genbank Accession No. AI013765
ccctatgctcaaaaacgaagatatggccttgctggtccctcccctgaaatctcatcttcaaggattgggaggcagaagtggtgactgggggtgggttggtatgaggccaaacatgggtgtcctttctactccttttctctacattcactccttgctttcagtgttcccttcccaaaactttaggtgtgtacacagcttgccaccctagggagcagggctggggtggcagagctgaagtcaaaagattaatgcccactttcaacgagtgatgggtccagtgtgtatctcgggtggacggacggggaaggaggaaaggctgggaccctcctacccgcaagggcattgggacctcagtcctgcccacccctacctctcccagcccctcttcctaacagaactggtcatcacagtcgtcatccttcatccccttcagcctaagcctcgcaaagtcctcaaacacgatgtcgtcgtctgtggcatagttggtatcgaattcaa

SEQ ID NO: 889 - DNA, 568 bp, Rattus norvegicus
  Genbank Accession No. AI013861
  misc_feature (1)..(568): n = a or c or g or t
atcaggatagaaatttatttaaatccaaaataatatgactatagttagaataatataataattatctaaaggaaatatcatcattggctctgaaacagtctaacggtgtcatttttctggagtcaaaaacatgtagtaaaaggatatacaggaagcaaaaatacagaagcaagccggctgagtgaggaagctgtaacaggagggtacactaagatactgtaacaatcgagacaggaagacaagtatagcaagctgtcttacctatcaacccctgcacagtaagtcagtaacccagaatgaaggaataatagcacgtggttaacaggacaaatttccctctaatttgtctttgtaactgatttctttccttttttaccatgggttccatctggttaacaaaacatttggttttatttgtaaagcagagtaaataaaatatcctgatcagagtgctcaattttgtttaaggtgctcaaggttcanacttaaaaaggtcaactgggctagtcagtgggaaccattgggtgtgtttgctaaacagatgaaagcagcagcatttaaaatggat

SEQ ID NO: 890 - DNA, 505 bp, Rattus norvegicus
  Genbank Accession No. AI013865
ggcaagcactctaggcagaacccaagggatgaggagaatgggacgccagcctctgtgtggcaatacaacctagaagaacagtgtcaactccctcctaggctttgactctggttccatggtgaggtcctcaagagaccagacctcagcctcaagacccaaatgcagagttcgtcagcacccattccttactcttcagacagcagagagaccaccgtgggctccaactctccagagacagtgtgttctttggatgtgtttggccgctctcccaggccccacaccaccaggcatgggagaaaagggtgtaaggggaaaggagacaaaaggactgaaccaatattcaggtaaccaaggaacaggctgcccgacagaacaggcttaaggggaactgggcacacaggccagctgtgagtccaactttcacattgatgggtggaaggcgggtgggtgtgtgtgtgtgtgtgtgtgtgtgtgtgtgtgttaatgacacttgcctcgtgccgaa

SEQ ID NO: 891 - DNA, 652 bp, Rattus norvegicus
  Genbank Accession No. AI013882
aaataaacctgttcaggggaacagctactagatgaatttaagggttttatgcaccttatagaacttatagcaaaaatagttttagttgatttcattataaataacgttttcaagaacctgtgcaaaactgtcaataatttcctaaagcacaattgatcagaaaaatccatgattgttcagccttcacacccttcttcatgtaagaactcccttcggtacatctcacagttacttattgggtggaaaggtatatggagaatggtcattagacgtctccacagtcacctgctgctggccacttgcttcctcaacgggaaccgtcgcagtctgcatgtgtgtgtactgtggtaagtaggctccttgcatggctgacgttgcaggcatgtatgttccggtgctgcctagtgacaggtgactcatctgctgggccagagggctgatcatagaagcaggttgtagtgacatggtgtgttccatggagggagttaacacggcaccaggatgctgcagaatgtatggttgaggctgcatccaggaaggactctgcaccttgagagcagggccccgatactttttctctctggtttcctttgccacctggtaggcagatacaggagatgcaatataaggtgtaagagaagtttgagtgatc

SEQ ID NO: 892 - DNA, 694 bp, Rattus norvegicus
  Genbank Accession No. AI013911
ataatcaggacagtgatctttaataaaaaacatctctagtaatcatgatcttgatgtagattgttcataggtacattcagaaatcactttctggccatgagaaaacatcatttacaaatttttaatgtcccaaaatacacattaatttaaaaaacttgatttatcctggccacttttttctcttggccagcaacaataatcctgagtgcctcaacaaaaattctgataaaaggaaaaatattgggaccgttaacaaatgtcttaaaatttgtctttaaaagggggaaaagtgtttaaagaacacatggagctttcttaaagttctttaacaaactaccttgggagctcaattcaaaaatagaacttgatgtactaaaacagacgtttcagcgcagctccaaaaatctttataaatacagcaatttgcaaggacgatcctggatcagaagtgttattccttgtgtatattgtgtgcatgccccatctcagttgtcataattgtctctgtaatttcctcctgagtagcggtcatagccaccctggcttctgccactgtagtctctagaccgcccatacccatatccatagcctccaggtcggctgtcgtatcttccacttccatatccctggtctccaccacctctagagtagctgcgaccacgcccatgggccccaaaagcaccccctctgggtt

SEQ ID NO: 893 - DNA, 673 bp, Rattus norvegicus
  Genbank Accession No. AI013913
catgtgttcttttttatttttttattttttttttttttcagctggaagaattccatttattgtggatgcattttcacaatatatttttattgcagcgatcaattatcagtgaaaaatattaagtgtttataacgtttttaacaatggcagattcacagaacatgctagtcagcttgcagtttcctctcttaaagataacagagagctgtaatcaaacaagtaaatgaggaatttgcttcttcaaagattaaatccaaacagaaaaacttttaccctagaactcattgtcatccaaatattggaataaacgttaggatcaaagccatcatttcaccactctgaactttcttaaaagcgaaaatgacacacaaaaagcctgtaagatagcaggggaaggccttggttaacacagattaccatgatccctcaagcatctgccttaaatcaaactttgatccattttactccaatgatggaagtcatgtctatgggtgtgccatgtgcattctattcatcttatcatagacttgtgtctactctgtcgtggggagatgacttgtgtagccttagtggctttccttcctttggcccaagtttgctaaaagctagggaatccaactaactcttactaattcatgagaaaagtaaacttccccaggcagtggtcacccct

SEQ ID NO: 894 - DNA, 400 bp, Rattus norvegicus
  Genbank Accession No. AI013924
gacagttggaaacaaacccatcaaactggaggtgatgacatcccaaaagcccaagaggcaagggggtttgcattttaccccctctacttaaaaatttttttaattaaatgcattttagcaaaagtgattaaaaaaagaaaagggtcaaagccccagatgtcagcgagcaaggtggtggctcaggaaaaacgggctcttcagtcctcccaggaagtagcctaaaagctgccactgtccctcagacacaagctcgagcaacccaaccaatcctccctgggcaaaaggcccctgtactggcccttgtgtttcctaaccccttcaaactcggaaactccaattctgtgtcaagccttccctgtaccctcaaagggaagctgaaagggccctggaggaggacaag

SEQ ID NO: 895 - DNA, 455 bp, Rattus norvegicus
  Genbank Accession No. AI013971
ggagatgtttgatcagatgtaataacactgattccaggccaggacagagggtattgcccctgaagcaaccagtattctgtggcccaaggtgcccctccgttcccagacctgagttccccgtcggttagttaaatagagggagatcttcccagggagtcttgggaggagggtccgagtcctgtacccgcctcgtccacgcagaggtgtctgagcacaagctatttacagtattcacatccactgtaccccaccaaaccaaggcaaatactacaagtggtccttccccgtggggggaggccagagaggctatgagtgtatgtgtgtacggggaaggtgggtgtccgagcgtgtgagcacatgaacgtgctgagggacaggacctgctttcagccaaagacatcatcagtctgtaaggtgcagattgaaaacaaagaggagctctgcctccgggagcc

SEQ ID NO: 896 - DNA, 429 bp, Rattus norvegicus
  Genbank Accession No. AI014065
acgtctttattgctcaaataactgtagggaagtaaaggtagtcatggccattatgggtggctcagaagaagccttcctcatgtggctctgggacaggcgttggcactcaagtgctgctccaaaatcttcaggaagagttgttctggggaaatggttgcagagtgcagagaagcagcactctcctgcttctctggaaaagagatcttctcatccggaaccaattctgcacatcacattcctccactcccatccatcgtgcgatgtccttccttgttcgcaagctggggtagcgagtctcttggaacaggcgctccagatcacgcagctgagacggggtgaacctcgtgcgactgtaccgcgggtgagccaagttgttcccagcctgttgacccctgctgccctcaggaatggctgcctcttgctgaggct

SEQ ID NO: 897 - DNA, 486 bp, Rattus norvegicus
  Genbank Accession No. AI014094
caatacataaatgcttttacttttccagcaggcagacaggaggaatttgggaacagaaagcagttatgaaggccatgtggcttgctctaggaagacactggatccacagtctgtgtccaggaggcacctcaccctgtgcatagtgaggggaggcagagaagccagagtgagcagaaggccctgagacaggtggggtagctagagggtgtggcagtacataaccgttctcacaatacactgccaggagttcaggagggggaagcctctggcttccacacaattttaaaacacacctcagagtgattctggggtcaatcacacctacccacactctgtaaagggcctaggtcctgacagacccagaacctctcctctgcacttctagacaggcagggacacatcattcaggtccgagaaggtcagtcccgcagtgcctggggctccactgaagaccctcatgctcttgtgtggaaagatcccttggca

SEQ ID NO: 898 - DNA, 508 bp, Rattus norvegicus
  Genbank Accession No. AI014169
gccattaaaaaactttattttgatttttttttttttacaaaggatagccccactttggggtgaaaatatatttggttaagtacaaaatatagtttttaatcatacaaaaagatacacaaaatacaaaaacaacaaagacgacacctccatcagctcacactttctggctgcacagttctcgggtggagtgcttagagtggagcttggagctctgacacaggacacggaacaaagtgctaaggcggagtaagttttggagtgctagaggccacggcgagagcagaactttctcctaacactggacaggaaatgggtctgggagcttccatggaaacctgcagttctcactgtgcctccatcactgttagggcatctcaatgtaagagtgtcaccagggtccagctgtcagcagcaacccttcatatgagtagtgtcagaatcacagaagtctgtgtgttgggggaaagcctccaaaagtaataaccaagctgggcctttaacctcagca

SEQ ID NO: 899 - DNA, 294 bp, Rattus norvegicus
  Genbank Accession No. AI028831
tttttttttttttttttagcaagtgttctgtttaataatccttggtcgtatgtagtgtcctttgggtgcctccctaattagttccacccattggggttcgtcctgggccctgcagtttgctcctaagttctgggacgggtgcgtcaaaagctgcttgtgtctcctctgttcatccatccatgtctgtgtcccttgatgtcatcactcagcatcccggggtccacaggtgaccgacgtggctcctgctcgctgtgccaagatggctctccaaattctgcataccatccctccccc

SEQ ID NO: 900 - DNA, 505 bp, Rattus norvegicus
  Genbank Accession No. AI028856
  misc_feature (1)..(505): n = a or c or g or t
tttttttttttttttttacagcggctacgtatttgaaaatttaagtagtcaagtcaataactgtccttcctagttatatttaaagactaactaaaatagaatctttgtgcttatatttcaaaggcttggttagtatattagaaatctaccaaaacttaaagatcaaagtttttgcttaaacactgcgccctgtctgatcacctcctcctatgactgaccgcgtacagttcctcagattccactgaagagcatctttcctctctgaagtgatccttttctacagtgataaatgaaacttcctcccaagccttttaacatggccctcagcattccacaatcaaggaactccaggcacttacactggactaaaattatatatagtttttctgtgaatttctgagaatgaaataagcagttgacgacttaggattaaaatgaataatatttgaactactctatcanaatgtatcacaataaatatatttgttctagaaaagtctgcttc

SEQ ID NO: 901 - DNA, 135 bp, Rattus norvegicus
  Genbank Accession No. AI028870
tttttttttttttttttgaactggtaggatcctttttattttttctggaggactatggatagaatacagagaccaagttctaggaaggtggctatccctctcatagcacagtgctacctgatcttgtacagccca

SEQ ID NO: 902 - DNA, 156 bp, Rattus norvegicus
  Genbank Accession No. AI028954
tttttttttttttttttgcggttccaagcatttattttttgagtacgaccaaagagtagggtacctaaacggggtgttagtaacatgcatgctgcttttggtaaaggatcaaaaatggggtttgggtttgggcaacatcaaaatggcctcgtgccg

SEQ ID NO: 903 - DNA, 352 bp, Rattus norvegicus
  Genbank Accession No. AI028975
tttttttttttttttttgccaaaagcagaatctctttattatcaaacagtagcgacagatcaacctgtcactgtcacacacagactggggacagtgaaaatgttactgctttgcagcttgctgcttgcagcctctgtgttcagcgggcagtctctgatctggaactgggcttcattctcgttgggaatgtccttccatgtggccaggaacatctgccggtccatcttcccgtcctccacgaagaggacatgcagtgggtaaaagtgctgaagtagaagacgtcaatgttgttcttcacagccacctgaagattgttcagaggctccatcttcatgactgagcccaccgtgtt

SEQ ID NO: 904 - DNA, 348 bp, Rattus norvegicus
  Genbank Accession No. AI028998
  misc_feature (1)..(348): n = a or c or g or t
cggccgcgggtggggagtcgacgcaggcgcttacgctttcgctcgggaacgggtgcaggaaggtcccggcagccgccatctcgccgtcgtcgcgcggggtccccggggcgttgttcaggccgcccacggcgccgggggagttctgggggcggcgctggtcagcgcgtaggtccccaccccgacccaggccatctgcccccgcccacctagtgtgcacgacctcaccttcggcagcccgtccatatcgcccgagcctgcagggagagacacttggctcangggctggataccccagagactttcgttcctgtaacctgngggcgatggaaggtgtangggctacaccca

SEQ ID NO: 905 - DNA, 478 bp, Rattus norvegicus
  Genbank Accession No. AI029015
tttttttttttttttttgcattctttttttcctaagattttttttttttaatttgagtttctgtagttttatctttttttggtatcgaagtcaggtttttctgggcagaaaaaaataaagaggaggaataaagaagcgaagataagtgtgaggaaaaagcaaccgaaataaaaataataagattaataattaagtactactaccacaggggaggaaatggagagaaagtgtctgtgggcttaacagctacccagaagtccattctactccagcaggaagaggtgatggtaaaccaaggtatacacggcaacgccatttctcaggagggaattgctgctgttggaaacagagcactcacactcgtacttagagaatacgaagaaattctgggacacagtttgttttttaaatggggagtctatagcattgacctgatctgaaatcctgaggagctgagtttctaaaggccacactcatt

SEQ ID NO: 906 - DNA, 300 bp, Rattus norvegicus
  Genbank Accession No. AI029026
tttttttttttttttttgcatatttggatagttttaatcattagcttacgacggtatgctgccaaaacccttttctatccttgcatttttcagagggagaatttgccaatgacgaatcacgcgctcagaccttaagggcccctctgaactcgctaacgcatttcaaatgggcaacactagccggtatcaaagccggagggggtggcctggatccagaactgctgtgagccagcatcccagcagtgaacagatggcacacgctcgacaggagagaatgacgatcgtggagagtcctgagca

SEQ ID NO: 907 - DNA, 377 bp, Rattus norvegicus
  Genbank Accession No. AI029051
tttttttttttttttttacagttatgaatgaaaatttttattcaagcttaaagtgaaaagtaattttagtcaagaaaatgaagtaccagataaacggtaacatattattttaactaagaagtatcaaaacaggatttctttgattttctaaagtggtggtctttgaaaaatgatgcttaaaggattctcttacatacccattcgaattaataatctgctgactatgatctgtcatctccttactgtggctttgggagaatgaacactatcttaaggccaaatgtgttttcttctcccacttcctagcttttcccttcctatgacccccacagtgggaagactcctcagtacaggcctggctcttctcagggtcctga

SEQ ID NO: 908 - DNA, 415 bp, Rattus norvegicus
  Genbank Accession No. AI029174
tttttttttttttttatagtttatacaattcaaaatttatgtaaagtccatgatacttaagttattcttaaattgcacaatgctaaagacagcctataaaagtcaaacacaccactgcaaggtaatccaatgaaggttttttttaaatgcgtacaggaaaaaaaaatcaaatccccaatgacagtctcccatacagcttcctgtctgcacagaagctcagggcccctggctggagcagcaggggagttagtcccactccatgggatgggtggacttgtggaagagttttaagttccctttgttctccagtgtgtcttgtacaaaatattacatttttaaacatatttacagagtttgcacaaatagaaaatggttacaaattacaaccaggcttggcaagataatagcttcccct

SEQ ID NO: 909 - DNA, 222 bp, Rattus norvegicus
  Genbank Accession No. AI029179
tttttttttttttttttcatctcagtacaataatttatatatcaaccttacagtatgtacaaaacccacacatggagaggagggatacccattctcatcgccagctaggacagcaatcgctctcgcttaataaacaaatgaatcaaaatcctgcaagcatcggggttgggggaggggttagtggggtagacaggataggtggggaaggattgcacttgttga

SEQ ID NO: 910 - DNA, 326 bp, Rattus norvegicus
  Genbank Accession No. AI029432
tttttttttttttttttccacggggacactaataactttttttaatgctgtttctgggactgattccaacggagggacgtggtcctgaacagcaggtggacacccatattattttgaggcgagacaccagttttgactgtttatccctgctgatacccattttccaagtgtggcttttcgccttatgtcctgaacttaggtgccagtgccactgcacttggaagactgggtgtggactgaagtagtggttcatgcctaatcctaggactccagaggtacaggcaggaggatcaggagagttcaaggccagcctttggttcataagc

SEQ ID NO: 911 - DNA, 459 bp, Rattus norvegicus
  Genbank Accession No. AI029437
tttttttttttttttttatggtcaaagccaggccatctttactggagtgagtgcaggagacaaatagcttacaacaacctctagcattgtcttaaccatttgataaaaacttcactataatatttattgtataatgaagaaaagacaacacattcagggaaaaattgagattaacttagttttcttaaaaggttcatctcaaggatggcaacaaagtccagcttgtgccgccaaacggttttacatgatcaaaccgtgtacagcttctttgtgtgaactgttgactacaaacatttaccaaatacataaatctctttttaaaaaagccattttaaatatagcaaagcagtgtcttcttgcacagcaaagtgaagaaagtttctacagagaaaataaaagttttacatctgtaaagttcttttcacattctaatcatctagcttttatgatccgatgcag

SEQ ID NO: 912 - DNA, 482 bp, Rattus norvegicus
  Genbank Accession No. AI029450
tttttttttttttttttacaattagttcatggtttttattaccctggctgtttacagaaaagtattttccactgttaatttgggcataagaatagctgtttattttgtgacctttttagaagttttaaaaaatgaaaaagaaaaactgtatctgagatcttagtatcattggttttaaaaaaaggacgggagaggcttctgtttcatccatcagtaactccgaccaaacaaggtgtagaacttggcaggattcttgccacagacacacatggctcctggctgcagctcacacagagggttgaaaggaatgcaaaggcttttggctcccatggatggagcaccaggttccacatcctgatccctggccgttgtcgttttgatccagtcttcacagtcaatttccccacagaatggaatctgtgcaaccttcccagaatctagcaccttctgaaagtcttccagtgtatccgatacaaccatgt

SEQ ID NO: 913 - DNA, 389 bp, Rattus norvegicus
  Genbank Accession No. AI029608
tttttttttttttttttcagttaccacagaattctttattaaaatgtgtcatcaataatgttagcatacatacaatatacacacatacatatgtacattctttgacacacctcacagattgccaacatcagtttagccaataaattaaaactaaaaacaagaggatgggggagggatactagaggcaaatttcattttttatctggtaagaaattgcaaatttctcagaactcccctgggggaaccctgaccagagaatctttgaaacaaaatacataaatccccaccctcccccaaaaaagattccaaaagatgcagttacaacagtgtgcttctcagagcaggggccttcactccacttcatactcttctggcttcaagacagtctg

SEQ ID NO: 914 - DNA, 515 bp, Rattus norvegicus
  Genbank Accession No. AI029827
tttttttttttttttttaaaggtttggggatatttattttctttaaacaagatcataaataacaaagaacaaagtcggtcccagactctggaccgtgcagcaggacaggggtaggaagttgttgggtgaaaaaacagaagagggctacacagtcacctaagacagtcacagaaagatgggcttcaggaggctgccctgcccctacccgtgagcagcagagggagtgggacagtgggctcgcccagatgggaagccatgtgcttggactggctggacctggcttacagcttggtttcttgggatacttgctatccactacctctccctgaatcctcattactctggatcttccagacttggaacagttaagactgggataaaggtacccgactggtgttttatttgaaagggaaaaataagggtcagtgtgtgcattgcccatcccatgaggaagggcagaaccatgccaagaacatcctcaaggaatggagatccctgagcctgggggtacactg

SEQ ID NO: 915 - DNA, 489 bp, Rattus norvegicus
  Genbank Accession No. AI029942
tttttttttttttttttcagaaggcacttaggtcgtattctaggtataacaagtattcggtcacacagaataacaagttaaaatgtcaggatgaatacatgagcatgaagattagagtctccaaactgatgttgatcactagatcccactggattgttaagagtgaggacagcaaccaactccttaggcagctgggatatatttgtttataatctgccttcatgccccctacacacacagccatatcctgaaactcttccctttctataacctcatcgcctagagcaggcagtcgagggtgttggcactcatcctccgcctcccagtcttcctattttttctcaaagtttctttcaacaacatattcatattttagccaatgaaacaatgatccacaaaggaacgggagagcaggaatgggtttaaacattccagactgtcaaaaatagatgcagtagctcaggagagacaagcagtatacatgaaaat

SEQ ID NO: 916 - DNA, 144 bp, Rattus norvegicus
  Genbank Accession No. AI030028
tttttttttttttttttactgatcttcccctactttggagaaaccaaggtaaccactgacacgtgctcccttgcaagggtacagccagaaaaagtgctatcttaaaatacatccctttaaaaaatatatcccttgttacctcaa

SEQ ID NO: 917 - DNA, 359 bp, Rattus norvegicus
  Genbank Accession No. AI030067
tttttttttttttttttaacattgcttgtctgtaaatctgtgggatggccttggagggaaaggcgaggctgctgcaagcggctaatcataggctgtggggatgctctactgtattctattccccgggcaggagaccgtgaacgaggtgaatttcgaggcgactgcttaggagatggtcggggtgaattccgtggggatggagaaaacctattaacagcagggtacacggcatggtgcatgctgtcgtcttcatcatccaagctctgtgcatccagttcctgatcgctgaacgtgccccgcctcgtggagttgcaagatgagcctgagctgcgacgagaggtggtggctgcatactcttg

SEQ ID NO: 918 - DNA, 420 bp, Rattus norvegicus
  Genbank Accession No. AI030163
tttttttttttttttttagagaaactctggagatttattgaacaatcacagtcacaactgaacatggtaagtcatcttttacagagctcactcttccaggagaggtgggtggtcttgggcttcccccacagaaccctgtctcagtgcccagcttccctgcctgcagccccccccaccccaggggaccccagccttcccgtcagagcagagtggaacctgttaagatctcgaaacagctattactctcacccagcagggccctgattcagcatcaaaaccttaaaccaaaatatgactaggatttgtcgtagaaagcaccagcagcaagtgttgaccggatgcagggtggaactgcactccttgtccctttcccactgcctgtcttcagttaaacacgccaccacttcttggctacacgca

SEQ ID NO: 919 - DNA, 373 bp, Rattus norvegicus
  Genbank Accession No. AI030213
tttttttttttttttgtgacagatttttaaaaatcgatacagagtgcctttcatagtaatttctaacagattctcttctatagtaaaagagaaatctggaaggaagatgttacaaagaacacttatttgagaagaactgtgcaagagctgccttctgtggagttctgccatgaaaggtggaaactactacgaaaaatatttactgattcaaaaagaacagatatgtaaacagggggcaagtggaatgacattgtagtttcgttccttgagaaagtacatcgaagtctgcaaatctcacctatttcctcctcttcgcctcctcccctgagaaacagggatgtagaactgtctacacacaaagtgagcatgagat

SEQ ID NO: 920 - DNA, 246 bp, Rattus norvegicus
  Genbank Accession No. AI030276
tttttttttttttttttacgtagcacagggtccagaaatacatttgtgtcagacaagaatctgatccctaatctgagaccctgctcctacagttctcggactccagccctgggagccacttgctctgctccctgtgtggctagtctgtgtttgggctccaaggctggagtgaggctgcccgccagagttttgcacaagttcctgtgctgcagtttgataaccaacttctccttctgagagtaaatt

SEQ ID NO: 921 - DNA, 394 bp, Rattus norvegicus
  Genbank Accession No. AI030301
tttttttttttttttttgaggacaaaaacaacctgtttatttccatgtaatttatatacaagttataaacacttccttctgctgctcagaacttttccggaaaggtctccatttcttctttaatcctgttttctacgagtaacgtgaagttactgtctgtattggagaggttgtagctgacaaacacctgtttgctggtcttcctggctaaacgctgagcaaggccggtggaagtcgtatcagaagtgtctccaaaaagggaggtgcacacagggatggagtcgaagcggctacacatggccacagcgaggttgcgtagatgcggcgttgcccccacccacaggaagagcgagtccgttagccgcatgacatgaaagtggacgagctgctccca

SEQ ID NO: 922 - DNA, 528 bp, Rattus norvegicus
  Genbank Accession No. AI030430
tttttttttttttttctcttcaagttttattgtgcctcttgcatggtgcagatagttttacagttcttttactataggaactgagctgtgatccaaacaatcaatgaacttattccaacctcagtaaatattcataaccatggaagatggcatagcacttagcctacagcgatgacagcatagacctgggcaggttttcagttatgtccagaagatcatcccaagtgattactgaaagccaacattaaacaaaaagcaacttgtttaaaattcctgattcagtatgaaactctgaaatcctccaaatgttgtaattcccactaaggcatgggatgtattcggaaagaggaacattaaaccgtcttaacacctagtaacaattttgcccttcaccccagccttcaaaaccaaacttgattttaagttttccaatacatcctatcaaaggtttgtaccctaatgaggtggcttatttcaacacacacccgggcttctggtgcaagtcactgggtccactataaagagtgc

SEQ ID NO: 923 - DNA, 302 bp, Rattus norvegicus
  Genbank Accession No. AI030494
  misc_feature (1)..(302): n = a or c or g or t
tttttttttttttttttcacctagcagtcagtgcagttcaagagacaatcacaaaaacaccaccacttttagctatgacaacatgagacatttggcagcgtccatagaaatagccttcctcaccccaagccatcacagagggtccacaaagtcctttctctttggtccagtccaagaagctgggggaggaagacngggtcgaccaggtaagaaanagctgcagaagcaatcacaccaactgcttagtgctgctgtccatctagcacggctgaggacgccgcagcctcaaacctcctgggtga

SEQ ID NO: 924 - DNA, 416 bp, Rattus norvegicus
  Genbank Accession No. AI030527
  misc_feature (1)..(416): n = a or c or g or t
tttttttttttttttttagcaagagaacagagtcaacaagcatttattgagcccctactgtgcgcctgctgtgtggcccctacagaggcagacactgcctctccctcaataagccctgctccctgtccccacaggaccctgcccctctgggcacccgcttgacttggtggctggctgtgggtgtccagcatccagtgctcaatgcccatgatcttcctggctttccagctgggtggagctctaggtgtggtggtggctgctgtctctgagtctctgtgccacctggacagtccctcaggcccacttgacccatttctggggccctgagacncangcagcggtggcagtctaggcctggtgtctccatgacaggagagctgagtccacagcacagagaccaggcttccatgtcctgt

SEQ ID NO: 925 - DNA, 348 bp, Rattus norvegicus
  Genbank Accession No. AI030599
tttttttttttttttatcttataggctttattatttcaatcactgataagctacttcagggaatgggagacaaatcatgatttaaacaaacagtacatgaaaaagcttcagaagagaaagcattccataggattcggtcaaaataaattgatacatttagagcagcaccaactaaaacataaggatgaaatacaattaccaaccagaaagaactgtcttaatacacacaagtataaaccttgtaacattttaagcataaaatttacaattccattgtcacagtaacacacacaaagctgaagcattaatagcattccaggatttttgtgggtacagatttaatgatct

SEQ ID NO: 926 - DNA, 447 bp, Rattus norvegicus
  Genbank Accession No. AI030668
tttttttttttttttttaagactgtgtcatatttttattttaagctataaaaacaaaattaggcaaacaaaacaacagaaaaactcaaaataggttcaaatgatgtatattcatcttttccaggaaagcagaaggtaggccctaccacaaagaaaagatgtcattaatggaggttaactttcaacgtacattaaatactatcaattaacgtctgaagagaacctagggtttgttcaccttgctataagcatgagttgacttttgttatgtcattgaaaacataaaaatgccttaaaaatctcagctattaagtatgatcttactggaaattcttaaccacaattttccttcctggaatgatgtcgtgcctgtgcatccctctaaacataacggaaagcacagctaatgcaggcgggcttcaacctgttctaccagctgaaacagctt

SEQ ID NO: 927 - DNA, 460 bp, Rattus norvegicus
  Genbank Accession No. AI030750
tttttttttttttttttcaactttcaaaaaactaattttaatcaaaacaaaaattgttgatcattaacaagtttataaaacagtgatttagttacataaataaattgatatcagtgtatcaaatcttactttcaacttcatgagcatgtttacatgagtgaagaagtacgacctttttttttctttttacctattataataaataaaatggagcgcatgaaatagttcttctaaacaaaaatacctacaaacatacctctagcatgttttctaatgaagggaacaagagacacgggacaacttttgcaccaaaacataaagttgctttaaaaagcacaaggttacagaaccatcagctaaagtaaagacactacactgtaaccaaggttggtattttaataatataatgaacagtttggtagttagatctccagtttggttattttaaagcattaagaca

SEQ ID NO: 928 - DNA, 463 bp, Rattus norvegicus
  Genbank Accession No. AI030775
ttttttttttattatttattgaaaaaaagaaaaagaaaacacagtttggagaaatgtcaagccgtaagtgaacagaagatgcctccattcttagaaagttccgcagcggaggaagagctctgtgatatgtgccacagaggaattactataaatgatggaaaatagaatatagatacaggaagcagacggggtgttgtccaaaggcggatcttctatttgcacttcatgtataacatagtgagcgctcggcaggacgagttcactggaactgatcttttcagctggaggcgctgccccagccggcgacatgggatcgtaattcttcacatccaggagtctgcgctgtctgaccgagtcctcgatgaaggctgggtttgctatctggacatcgttcttctggatggagttcagatgacaccggctcaggacgtcagcactgtcaacgatgacttgtgtgcactga

SEQ ID NO: 929 - DNA, 518 bp, Rattus norvegicus
  Genbank Accession No. AI030797
tttttttttttttttttaacattaatactcacttctattttctggaaaacatgcatgaaaaaaaagtattcagttcaattgcaaaaggagaaacaatcagcttaaagtgaatactgtacaagtcaggaacaggagctccctgctgcctctcctctgtggttactgctgtacttgacgcgagcccagaatttccctaggaaataagtcagatccttgtaaatactgtccagagagaaaaacaacaaaaaaacaaaacccaacaaaaacacagctgtctgcaggtatcattcgtgactgctttcaaaaccgcaggtgagaccccaagtccatcgaagggttgtttgttcaaagcaaaaagcaaatcccttcaccccaaaagttgttcctcattaagcagggagtcaaaatacccacttccaatcataagtctgaacagcattgggaaaatcagaattttcattcttcttcaatttcatgtaacttaatataagcttcagcttactcgggcctacagcagt

SEQ ID NO: 930 - DNA, 431 bp, Rattus norvegicus
  Genbank Accession No. AI030806
tttttttttttttttttaagaaggaagtgtttattttgtgcatgattccagagagataacattctacaatgggaagcatagtagcaagcatcaggcatgatggattgaacagaaaactgagagcttacatcttcaaacacaagtaggaagtagaaagggtggaaaagatatttgatgatgctatgcattgccgaagacagctcacagtgatacattccttccagcaaggctgtacctcttaagcccgccaaacaacaccaactggtgatcaagtgttcaaacatatctagggacagataaccacaatgttatctcacctgagaaagtaggcttcccactcttagcagaggctggatccaagcatactgctgtatccttgccaagaaaatttacccagtattgtacacaaaattcataattacctttcctga

SEQ ID NO: 931 - DNA, 435 bp, Rattus norvegicus
  Genbank Accession No. AI030833
tttttttttttttttgtcttatcagggtgtttattatagcaacagaaacgtgtctaacgcagtctgtgtgagcatgtgctgtatgtggggaggtgccccgggaccagaggaaggctttggctctcctggaactagagttacaatcatagctgcccagtgtgggtgcaggagtctgaacccaggacctcagcatgagctcttgcccacagatccttctctccaggtcagaggattactctgtggggtcggatctctccttccgcctttaagtgggttctgggcattgggtttgggttgtcaggcttggcagcaagtgaaccatctcactgtccccattgttgactctctgacagcacgtgttccctttctgcacttggggaccccagagatcacgccatcaatctgctttgggccacttcatcccctcgtgccgaa

SEQ ID NO: 932 - DNA, 516 bp, Rattus norvegicus
  Genbank Accession No. AI031004
tttttttttttttttttaacagtcacaacaaattttattttgattagtttctctgactctaaaaatgtggggattaaaggcaaattttgtggggaaagggataaagacatttggaagaaaacacaaacgaaaacagatatatctgaaaagctcttttggcagatttcaagatgacaaaaaaaacccagaatttttgaacagccttattaaagtatacagaattaaaaacatttacagtattatttttagaaaccaatattttggaatgtacatagcaagttcattctgtgagaatttttttcgtaggagaacaacgatatcacatctgaacaccccactgtttgtatttacggtttcttaaattttgtaagaaaatagaaagtttacaattaactatacacttctaattgtgtaatatttactgttgatctttaaattactttgataaaaccaatgtgatagagatttttttaaaaaagattccaggatttttttaagatcgtgacaaaatttctt

SEQ ID NO: 933 - DNA, 510 bp, Rattus norvegicus
  Genbank Accession No. AI031019
tttttttttttttttttcaggttttaaacatgtttagagtaaactcgcatcttttacagacaacattctgtgacagtgccatgtgaatggctcctgcattggtgttttttctatctggctggatcctgctgagggcatggagccagatgccgtcagctacagtgtctgctgtcttgtgaggcactgaaggtgtgtactcagccgatgtcaccgcatctctcagtgatgcagcacggctggggggtccctgctcctgtgccatctctcctcagctttgcagtctgtaattaacttgttcttccggagactgagtctctaaaaaccacaaggttgcttcaccttgcttctagaactgggaccaggcttcagatgtgacagcaagagtaaaaggattcttcaaggcctctgaaatgagcccttggcatacaggtctgaaagtcccattgttggcccctggctggctggagtggaaaggctgctcaccctgcacaagatgtgctccctgcatgt

SEQ ID NO: 934 - DNA, 470 bp, Rattus norvegicus
  Genbank Accession No. AI031052
tttttttttttttttttcggtattcaacaacaaattgtgaataccgaaaaagcagagaaagaaaaacttgaaaattctgaactgaaacagagaaaatctcttcatgagaataaattgaagagactgcaggagaaagtggaagtcttggaggcaaagaaagaagaattagagacagaaaaccaggtgttaaatagacaaaatgttccatttgaagaatatacaaggcttcagaaacgactaaaggacatacagagaagacataatgaatttcgaagtctaatcttggttcctaacatgcctcccgcagcatcggtcaatcctgctaacttccagtcctcagctatagttcctggagtggaactctcctttccccctcatctgcaggaagaacagcatcaaagagaactctctctccttcgcaaaagactggaagagctagaaactacacaaaaaaaaccctcgtgccgaat

SEQ ID NO: 935 - DNA, 341 bp, Rattus norvegicus
  Genbank Accession No. AI031058
  misc_feature (1)..(341): n = a or c or g or t
tttttttttttttttttgaagggaataataatttaatgctcactgtggcctggactggactcaggctccctcccaccagtgaggctatgcacacacaggcagatgggtgggagtggtaagagcgagggtgttggggacagggccaagggagctcataaataggactcggactgcgtctgatggtgggtttccaggacagcctaggcagctgaggatgtggcacttgtgctggctgccttgtcccagtcctctacagatacaatggtggctttgcagaagaagcagtccttgttgttcatcagatgctggttgatgcaggctttgcangatttgtgaccaca

SEQ ID NO: 936 - DNA, 339 bp, Rattus norvegicus
  Genbank Accession No. AI031059
  misc_feature (1)..(339): n = a or c or g or t
tttttttttttttttttggattataattagttataaatttattgagaccaatagcaggacaacagtctctgagccaaactagagactgctgtgcaaaggggtgagggtaggttttgtaatggcaaaacccacattgagtgtctgcaccagcaagccaggagctgtgctgctctgcttactaagacctcaaaatagtccttgaatgtctgcaaaagcaggttacagaagccaaaaaagcaggcagtcatgtcataacaggtcatggctgtacatttttgggtangagttactgagtcaggttcactgggatcttccaggaactggagtcagaaatggcta

SEQ ID NO: 937 - DNA, 512 bp, Rattus norvegicus
  Genbank Accession No. AI043636
tttttttttttttttttaagttcatgcacattttattgagtagtaatataaaatgctttttcttttgtcattggtacaggtgcatgctttgatcgccgacatttcagaagtcaaattacaaaggcaaggcttgagggtgtagtgaatgacttgggcacttatacaattgttaaaaaatatgaatggacttttcgctgtttgtcgttgttgttttcagaatgaaccagttgtaacctcaactaatatacaaagggcaaaaaaaacaaaaaaaacaaaaaaaacaaaaaaacaaaaaaccaaaaaaacaaaaaaaaaggtgaaaaaaagtacgtattttgtggcacatgacagaacagaacgaaataactaaactgttatgacatcaacggttaccatgcatttagagtttcacatgtaactacaaacttaattaaatttcacaaagtttgctaaacatgccgaccatctatgtgtgcactgacaagcttatgttaaaaacttttaagaatact

SEQ ID NO: 938 - DNA, 481 bp, Rattus norvegicus
  Genbank Accession No. AI043695
tttttttttttttttttcacgtttattacatatatttgttgcaaaaaaacaaaaaaccacacaggcacatacaaaacaaaaagtaggcttacattagtttaggacgttaactgtcttcaaacacatttttcatcttcttttcagcatatagtactctagttatatacatttaaagcagataaaataaggcttgaaactggtaaaatgttaatttaatccatattcagaaacttgtaaaataaaaggtaacaatgaagaaataattaagaaagttgtacaaacgaccatggttattatttccctttataaaagtattccaataaaacaaaataaaaactgtggaacacaaaagtcaaattagagattttggttgtagtaccttccctgagtttctttgtaaaacatcaaatttaaataaggccatttaaaaactgacctaacggccttacccctccacgccgccattacacacaatgcatgt

SEQ ID NO: 939 - DNA, 381 bp, Rattus norvegicus
  Genbank Accession No. AI043714
tttttttttttttttttgtggtataaatttttattaaatagaacatctggggagcctaaagagttgggtgccactgagggggtgaacagttggtgctcagagagaggattcatcaccctggtgacactgccggtcctcagctgagaaccatgtgcagaacacacaggtcacagttgctggggacaaacccggatgtccccttggaatcccaacactgacatgagggagaccccttggcgcctctctgcacatgggtatgtctggtggaggatgagggaccaccaatgccatagtcccagccctgtcccttgggctcccgaggctggacacccatgcgacgacacactgttccccggctcaggcccctcgtgccgaattctt

SEQ ID NO: 940 - DNA, 370 bp, Rattus norvegicus
  Genbank Accession No. AI043724
tttttttttttttttttaagttttcaaaaaggaatttaatccatcacagcaagacattctcagcctataaaaacatccgaacaagggtttcaaagcagttcccacccccaaagcaacacacacaggacaggcctgagatcagttcattcaaataatctttgtacgcagagcatcccagagtatcaccccagcctaacctggagaaacgtcaccgacaagtgcagcagtcagggtcagcaaaataaatagagttaatatatatgtgtgctatccttgaatatacagtgaagaccgggcccggtgccatagcacagagctccttacaagtgtcctagtggctggacagtgggcaccccaggaacccaagcaa

SEQ ID NO: 941 - DNA, 504 bp, Rattus norvegicus
  Genbank Accession No. AI043798
  misc_feature (1)..(504): n = a or c or g or t
tttttttttttttttttcaaaaagattttcctttatttaaatacatttacagcatgcaggttaacttaaaattatatgttgttttcccaaaccaattatgtttaaatgtaatcctaaacactgaaaataaaccaacatattccacaggtaggcttagactctcttctgttacctcaaatcaattcagagttgcaaataaattcagtaatgcatagtagctagtttccttaaattaggcaaataatttaattgatcaccatgaataaatactattcgtatttcattgagtttctcttctgaaccaattactaataccactcagaggaacattaatatatccagtcacaanaaaaagacactgcaaattaaaatatttcaatattctagatgattaaaaatgtccattttgagtgaatgctattttaaatgacctatcatagcaaaaaagagcagttcagttcactgaaaagaaatttatgaaattcttagtatactttatgaaag

SEQ ID NO: 942 - DNA, 498 bp, Rattus norvegicus
  Genbank Accession No. AI043805
  misc_feature (1)..(498): n = a or c or g or t
tttttttttttttttttaattttagtatttattgccatcaaaattagcgatttagggcttacacagaaaaatctgccaccatacaatctttcaaaggaaagctgtcttctctatgtgtgagaaagctttaacttattcctgttctaacataaaccatgtttaacaaacagatgcttgaacatgtgccggaatttagattaggcaaggaagttcactccacctagcaagcaagtctgaaatatcatctttgttttttaaaagtttgacctgaattactgaaatctaatggattctcatggtcagtcatatgaatacgttataatcagtaagaagtcagtattgcacattaagcttggaccaactcaagtttcttttttatgagttctttgccatatgtgttttgtgaaaagcctttttcatctagacagtattgcaaagatgtcatagtttatttgtctccacagttttatctacaggagcattgcacgttgcccgtan

SEQ ID NO: 943 - DNA, 451 bp, Rattus norvegicus
  Genbank Accession No. AI043849
tttttttttttttttttaaaggtcagaaaataggcttatgtttattcaaaagcttatcaccttgcacattactattttgtcttgttttaaacacacacaactcttttaagtgtggactttgcatccctgatatctagcaaaaatcatatctaatgacaaacacaagatttcaaggaaaattgatttgaagcatagacactggatctccaatctctaaaaaattgcttctattaacaaagattggggtgggaagtcagggagaggaccagaaaaaaagcagcttcaaattcagggaagcaaagtaaaatggagaggaacagaagtaactcaagtttactaatcctgaaacgtccaacaaagtgtcatcgtttagagtccagagcaactcatctggaattttaaataaataagcttaagtttattcacatcttctgcttcaagcatagcccta

SEQ ID NO: 944 - DNA, 465 bp, Rattus norvegicus
  Genbank Accession No. AI043904
tttttttttttttttttctaaataaacctcaactttattcagctgacatgttctgaaagcaaggggtgaaaatattgccaatcaaagctatttaaactcaacagggcaagctggcttttgagaaaaagcctgaaacgaaacctgtaacacctactgtttacttggtccttagatttagcattccttcaagtggccgtacatgaaatatacatctatctacttggagtccttctggcaccctacctgcttcaaaccctttcacttatctacctgctaggctgcagtttctgacaagctccaagtaagtacacagccctctccactagagggcactccaatcaggctaggtgcccttccctctggagatgtaaggacagttgtacccaatcagatcagagtgatctcacaaggcactgaatggaaattcgagggagagcaacctaggcaaccagctcaatgcccctt

SEQ ID NO: 945 - DNA, 488 bp, Rattus norvegicus
  Genbank Accession No. AI043914
  misc_feature (1)..(488): n = a or c or g or t
tttttttttttttttttgtcagtgaatgggcgtttatggggcagcagctacaagaacgtgctcctttggcaggctctcacaccagccacaagtacagtctcacctggcattgctcagtgggctgagctttctccaggcgcagcagcagcatggagtgaggaggcaagcggacagctatgaggtaggtggtagggggctgcgccaccacgacaaagggctctaggtgttgggacaccaaggcctccaggccctgtggcccaagtggacaccacacacgactttctacaccctttggcaggcaggagttccagagctcatcaaagaaacacaactcagagcccttggggagctgggggaaaggcangaagaggtcagcaaagttcacagacaggggtggtaggtgggcatggcacgtgaggccggccggtgtggtgtaaagggcagcacagcccagtcatcagtcctgagggccacacctcgtgccgaat

SEQ ID NO: 946 - DNA, 483 bp, Rattus norvegicus
  Genbank Accession No. AI044042
tttttttttttttttttacatataattactttaattttacatttgcctttcaatatcactacattcttccttagtgtttgatttaccatcacttctacaattgtctgtgtttacacaggaaaaccattttagttagtaagattcccacaagttaggtaaaatcactttttcctttggaggtttcctgtagactgactgtacttaagagacatgcttcaccagggaacttccccagttgtccctccgctcctggaagttttgctgccatctctcgtctgagacttaaggcttatctgactgcggctttggccgttatcttctcaacctgaacaaaaggaagctaagctttcaaggatggttctaaaccttgaagatgggctttagattttacaattcctgtgttgccctttaagacaaaaaggtgtgcaccctcacagaacacccctccagtgatcaacacagaaataaagtagctgtctgaaa

SEQ ID NO: 947 - DNA, 251 bp, Rattus norvegicus
  Genbank Accession No. AI044087
cggccgctcacttgcattttttatttttttttgcagaatagattttttttaatggctttggcattacggtacgaagcaggaaaccccctgaacatcggcacaaagtctcgtcttccagcccaaatcccgggcctctgaaaagaacgcctgagttccatagggcggtcactgacaggtatcacttccaggcagtggacttgaaaggacattaaccacgtaacaaggcgtgctcttcatccctacacacagat

SEQ ID NO: 948 - DNA, 299 bp, Rattus norvegicus
  Genbank Accession No. AI044089
ctgtcgcaaaggtttatattttttatttttgagcacaccgggtagcggggggctcgtcagatacacggagcctctgcaaacagacgcggtctctgattagccaccacctccgggcttggcagcaccgggccctccggccgcaactgcgcggtgaggcgcctactgctccgcgacgcgggtccttgtcctcgtctcctcaacttggacgtgcctcgatatcaaacatgtctcggtctgtcattaatcagaatgtcattgattactcacagtttcaggagtcaaatgatgcaaatcaagat

SEQ ID NO: 949 - DNA, 487 bp, Rattus norvegicus
  Genbank Accession No. AI044101
ttttttttttttttcttgctatcaatctttattgatgattgctctctgggaagtgttttgttttgaaagccaagcctaaaacaagcgggtacacaaagaaatccttcggccgcatcacagagagaaactacgcctcaagatcccgtttgcagagtattaacgagaaggtctacttgtgggcagcagaggaaacaaacattaagcaaagagcataaaccgtaggcacagcatgtgtgctgtcttcacatccagcctcatgttgacacggtgagatagggattcacatacaccaagctgtttcggagggcacgggtcctcggtgaacccaggggtgctgggggaagggggctggcttccagctgagtatttcatagagttaaaggaggagagagagttcaaatgtggccttgaggcttgaatatcctgggaaagttgaggcaccagcctgaaaagcctaagaatcttcctcttctcctccctcttcctc

SEQ ID NO: 950 - DNA, 516 bp, Rattus norvegicus
  Genbank Accession No. AI044112
ttttttttttttttattccagagaagtttgtatttgggccttaagcttttgaaaataaagtttagagacatagcatatgaataccactgtaatacacatgaatattctatcagaccctaaaaaattaacataaacttaaactttctcagtcaacaaaatagcggctggttgccaatttttattagataagttggttacagcatttttattatttacgtctatctaggtgtagctgaaattcaaaatgcacatcaaagtaaaactatatcacaactcaagccatactaaatatgtacttggcctctgaagtaaaattctagttggacttccattttgacttctttcttatgacccaagtggctttaatgggaatgcaggacttagtactgatcatgacacaacgtatcactttcttttcataatctctacaaaaagggggagatggtggcattagccctgtgggacagatcttgcttcattactttaataacactggcccagcctcgtgccgaattc

SEQ ID NO: 951 - DNA, 384 bp, Rattus norvegicus
  Genbank Accession No. AI044124
tttttttttttttttttaggggagtatatacaagtctttatagaagagccaaagtcaataaatacgcagcttgacagagcccagccccagcctcagaggccagcatgaccaggagggatacggactcatttcatgagcccaaaccaaggtgacggtgagagcccagccttggagcccagcccagaggatcagggccggcaacatcaagagcagaggacaaggggctgcctggacaagggggtggagcattgtagccaaggcctggagctctacagggcccttctccattccatccagtccggcaaagtgcaaatcggccttgaggtgatccggaaaccatcctgcctggcgctctggcacacgcgcgggcgcgccctcgtgccg

SEQ ID NO: 952 - DNA, 430 bp, Rattus norvegicus
  Genbank Accession No. AI044211
tatttttttatttttttagtcattttaatgcatttttccctgtgcacaagagaaataactgatagagccaaaagatacactttcctttatacatagcagttaaaagtaatgcaaacatcacatgacacttccagtaaaagttacatttccaattacaaatcaaaatgcattatgaaggtctcttcatgggagaagctgaggaactcttaggtaaaaagcactttcctggcgtcactacactgatccttcaggctgcacaaagattaaggtcatatacaatcaatctgcaactgttgacacaatgttacactgtaagttttctgtacaattaatgtatacttagagaaaccaggataaacatttctactatattttaactgaacttgcctaaccaacattttcactgagaaatttatcaaatatgctgtaa

SEQ ID NO: 953 - DNA, 474 bp, Rattus norvegicus
  Genbank Accession No. AI044253
  misc_feature (1)..(474): n = a or c or g or t
tttttttttttttttgtacacagatgcttttatttggatgttaatagatttcaacattgtctgcaagattctcttacaatgcaaagtttttttttatatattaaaaaactcaatttagtcagtgtaattgctgtattaatgtgaaaaccttacaacagaatgcagtattggtatgtgtgaagtcagtttccatgcacggatggctgctacctgtatgcttggcatcttcagaaaactgaagaatataagtgaacagtaaaaaaagatgacttaagatgcctaacatgtttatgattacaaatcttgcaaaaagcaacaaagcagttaactggaggattcaaccaataccaacccaaatatgtcctatgtcccataagcccaggcttatggacaatgtattaacatttgtgctaacttaatgctcaagaaaaattatgttttaaaatatgtancgtgtctgagatattttacttt

SEQ ID NO: 954 - DNA, 467 bp, Rattus norvegicus
  Genbank Accession No. AI044258
tttttttttttttttttcattttaccacatggacatcatggataataagggattctgattcattgttaattttattaattagattttctgatgtgagtctagaacttagggcaaaaacaagagacaaaactaaaattacacaggcaagggtgaagggaagcgtgtttcttaagtattaaaagtgaatagtatacttcttacctaagtttacaactggtggaccagacaccaggcactaaccacctggcgaggctttggcaaatccaccagacacacatgtgatttaacaaacacctccaccagcgtcatagattcctcctcatctcttgcagacagaactatgctatctatacactacttagacacggaaggttggtctgcactctatcttggtttgttggctatgcttcttttgatgacatatattatacagtatatatatatatatatatacatatatttttttt

SEQ ID NO: 955 - DNA, 337 bp, Rattus norvegicus
  Genbank Accession No. AI044271
tttttttttttttttttcagatgcatacattttaataaggaggtatgctgcagggccagcttctctggaagtctgtgcatggcgtaccagcattcacggtattcttggccagtgtttctcataataccagttagtgttgtcctctacgcctgtcaggctgatcctcacatgggactggaggcagcatatctggtaagttctgcagtagaagtaggcctgttcaccctttttgcacgaaggcctacagaatcctctgttgcccatgcattgaagggtaggatttttgcctgaccaagagagagagataaagatagagggatggagggaggaaggagga

SEQ ID NO: 956 - DNA, 284 bp, Rattus norvegicus
  Genbank Accession No. AI044299
  misc_feature (1)..(284): n = a or c or g or t
tttttttttttttttttcaatgcaaacacgagaatttattagttttgttgtattagcctcgctctgaaacaggcaattactggtgtgaatatacattttagaaaacataattttgtcgagtcaagagtgagcaacagtgtaaactcggtggaagtgttggcggtgagtttttttacgtgctgaggaagaagtccgaagaaaaacaggccgaggagttccttcacgggaacaccagtatgcctaaaacccagaaggagacagcaacacanaacaagcttcagaac

SEQ ID NO: 957 - DNA, 363 bp, Rattus norvegicus
  Genbank Accession No. AI044330
  misc_feature (1)..(363): n = a or c or g or t
tttttttttttttttttacctgacaggccatttaatgggggcattctagcaactgtggataccatgtgtatattctctaataaagtctgtctttacttttcagcccacttttaaattgcatttccccttattgttgcattttcaacgttcttggtcctccatggctccaagttctgcatccagattcaatcaactgcacactaaagtattctggaaacatctgtactgaatatgcagactttgtcattcctaggttcccgaagctttggccgaggtanggtcccatagctgcctgaagcacagtttgacccgcaggcagccagcgggcaaaggacacttcagcccaacccacttttggggaga

SEQ ID NO: 958 - DNA, 407 bp, Rattus norvegicus
  Genbank Accession No. AI044338
tttttttttttttttttcttgccaaacatagaactttattatatttctagttgcgtccctttgtattagattcagaatcaagtactggacagaatagctctgaactatgtccttgggctaataaggtttctactccacctgataaactggcttctatccccaccatggtgccagttggaggcacttggattacagagaaacagcagctggcttgaagaggggttttagtctaaaatctcccagtaggaacacagaacagattgaacttgtgttggggaggaaggttgctacataccagagtacgtttcagtttctcaaaccagaggggcacccaaggcactttccctgtccccactcatcccacaatccaccttacttgctgacctccacctctgtgtgtcaaagca

SEQ ID NO: 959 - DNA, 450 bp, Rattus norvegicus
  Genbank Accession No. AI044397
  misc_feature (1)..(450): n = a or c or g or t
tttttttttttttttttacagtagccttgtgctttattcagatccaccagtgagggcaagagacattcaagtaataccaagttccacttgtcttggaataggtcagaagatctgaactctataccacctggtccttgaggttgggcaggttctagtgccttatgggctcagagtcatcctcctaggaggggggacacagcagcaggtccccctgggggccagaaacatgtacttcagcctaggcaggtgtcctgttccacctaacagctccagttctcctgaatctgatgttcaggggtctgactgtcgtgggtcaatgccattggcaatggccagagtcctaatgtcctgtgagcagtggccatttgtcccgaaggtaactgacacagtagcagccacagaaggctggagggcanagccacagcaagtgacagatggactggaggactt

SEQ ID NO: 960 - DNA, 475 bp, Rattus norvegicus
  Genbank Accession No. AI044521
tttttttttttttttttaaaaggtaaaataaaattattttaattatcagaaacagatccggccaaaattgtagttactcttacaaattataagattatgtcattatgggtgatcaataaaaattgacaaagaactgataacaagtccttgggtaaaattactaacaattattcaaaaagtaaatgtatacagtttataaaaaagacatttgtccacatactgtaaaaaaaaaaaaaaaaaacaccaattcccaaggcaccaacattttatactgatacatacaaaatgggtatgatagattgcaagtcagacaaaataaggtgatcaaaattccatatacatcagttcaaaaatcaaaattatatgtaatacttacggtattattagattatcctgaatctcttaactttaattactaattctttatatgcaaaaaggagttgttttacatatagagataattaaatttgtaccc

SEQ ID NO: 961 - DNA, 480 bp, Rattus norvegicus
  Genbank Accession No. AI044539
tttttttttttttttttaaatttgttacagcattttattgatagtttccaaattataacgtccttttttaataactttattgtactcccaagcaaactggaagcctgggagactcgtctgtccctccaatacctttaaaaccgtcaccaagtccattttctagtgaatggcatggtaacatccggacatcaccaggctgttttacgtgtgcttcttaaatttccctgtttagatgagtctgttgagaagtcattctttggagtgtttccattcttccttatcaacaatccactcaaaccagcagcagtggctctgtccagaagaacccgagaggccccaccagtgggcaccagtctgctgaagtagcaagaagcagcctggacgcctccagaaatccttcggtgcatttctctatctcacttccttaagcaaatggcagcatgctgtccacattttgttcttttgaaacatggttttaac

SEQ ID NO: 962 - DNA, 400 bp, Rattus norvegicus
  Genbank Accession No. AI044553
tttttttttttttttttcaaaaacacttttacaataaccagggcaaaaagagagaaatactctttgaagacgctgtgctttcaggaagatggattgtcttggagccagaagtgttcattaaccaacactacttgttgggaggatatggggggaaaccagtgttggcatttaaaacaacagctctgcctaatgccaaggcccagggtgcaagagggtgatggggttgggaatgtcagccatgtctttgaaagttggtgagagagaattaaccccaaaggactcatttctgaccatcctctgctagaccctctgactcagagttgggacccaaagagccaaggttgagatgccaagagcatcttctggtctgtgggcaagagctcttggggatgtgggaagg

SEQ ID NO: 963 - DNA, 432 bp, Rattus norvegicus
  Genbank Accession No. AI044632
tttttttttttttttttgaaacaagtccattctttattagtgttgagggccctgtgaccttcacccaatcccatccatctgggctcccttctggaatccccagtctgcctgcggtgcaggacaagacccacacatccagccccaccccatacccgacttgaattcgagagagcggctgtggtgtttccccaagtatctggagtcaggaagcacagtgctttggggagcggtgatggtctttcggggggtaggggctggccaaatgaagaggttcaagagatgctcacctgtctcgcttttttagcctttgcccactctcccaactccaccctactcgccaaccctccttccctaggagctttagacgctcctttttttcaggaggatggagcccagaagtaattttccctttcaaaatcctcgtgccgaatt

SEQ ID NO: 964 - DNA, 567 bp, Rattus norvegicus
  Genbank Accession No. AI044740
tttttctttttttttttgcttttattttatcctaaatatgtcttctacatcctccaaaaaaaaccaaaatagttttcttgtgttgagaagggaggaaggggttatgaagtaggaaagacgttttgttgacactggcagaaactccagagcacaggtacctgacatgtgcagagaagacctgagctgtggccctgacactgggaacaggggcacgccctgctcagtgctggaccctcccctcccaggacctctcagtgacagaggcagggcaaagtgctttgtgcaaatccgctcaagctggctgctgctgagaatgagtctctggaagatccctatgggatcctcttcatcttagcacaaagtaggcagtgtcacccgaggcccccaagccccaccaggttgctgcccagacagacaatgaggcaaggtgattctgtgagactcatcgtcctctccttgtctttagcctgttgccactgagagaacttttcttcctttttaaatatgaaaaccagatgctgtaatttgtagtctgacagcaaagtcagtgccaggactgctgtcgct

SEQ ID NO: 965 - DNA, 443 bp, Rattus norvegicus
  Genbank Accession No. AI044747
tttttttttttttttttacaaagattttatttattttgtgtgagtacacttttgtctctttattaatccaagaacatgactgggttctctgctgaagacaccgagataagcatcaggactaaatgcttggaaaatgagaggttagctccattgggcgcttgggattcccatctgcagagaacgcaccaaacgccgcccccaccctgtatgttgtactgtcacacgcacaaacaagcttgtaagcagctccctttatttgagtaaatagcttgtaaataaatcattggtaaacattacaaaattaaatacattttcaaaagcttgccagtatacagaaaattcacaaacatagttcttttaaaaaataaaatatgtttaaagcacccttgatataaattgcctggtccctgttttcagacagggtcacctggagacttcttatg

SEQ ID NO: 966 - DNA, 372 bp, Rattus norvegicus
  Genbank Accession No. AI044794
  misc_feature (1)..(372): n = a or c or g or t
tttttttttttttttatgtgctcataggctgtttattatcaagaggaaggagagagaggaggagagagcccagacagccctcagggcccaagggagagtgaacagaaaggctcctcttcctcctcttgccactgacccagaagactccatctgcagagatctcagggtggcttaggggcctccaggaggcgtggcagctctgctgttgactggagatgggatggatccccacagggtcaggtcccagcctcggaatggcttctgtgtacacaaaatatctctcttcgaaaggcactggtggaggtgagcagtangaaggctgccccatcacaagccagactcactgtcccaggtctgagttctgcttcctca

SEQ ID NO: 967 - DNA, 391 bp, Rattus norvegicus
  Genbank Accession No. AI044801
tttttttttttttttttgtattccacacgtgtttattgatcttgctgcactctacctcctgctctgggaacttagggacacaactgcgcattatgcacagtccctgccatctcatgaccctctttactcattccttctgaataccattgactccctgaacacatgacggtgttaattatcctttcagaattgaaaatacaaacaaacatacataagaccctcttaacactgcacatcttcatcctgaatggggcttaatctaccgtcctgtagctgaacacaggacctttaaaagggctgactgcaacaatgcagggtacctatcaaaatgtggacacactttcccagaactgctgcacttactcatgtgcaattttccagttctgagaca

SEQ ID NO: 968 - DNA, 479 bp, Rattus norvegicus
  Genbank Accession No. AI044845
tttttttttttttttttgaagagttcatagaaaagtgactgtaaggacccatcagtcccttctgttgatgccgtgtaaaccttgggaacttcctttacccaacatgcactctatcctgtcctatatgacagaagcgggctcaaagccgcttatctggtgtgacgcgcgctggctccccaactaaggtaactggcagagggacagttttcctgaggtttgttaagagtctgtagacaaaacagaaatcacagtgaccaagtagaacatgagtctgtctcctcgggctctcacggggactaaatgacccgccactgcatgatgcttgtgtctttcccacccgtggagataaggtggctgtcttcacagaggaagtctacgttggtgacgtggctgctgtgtccactgtagatgtggctcggagccctgaactgtgagcatgggtatgagaagaggtgcactttgccgaagtcatcgcctgt

SEQ ID NO: 969 - DNA, 408 bp, Rattus norvegicus
  Genbank Accession No. AI044855
tttttttttttttttttgaaggtcaagatcctttactcaaaaaatttgaagaacagggctggtaaaacggttaggtaagtaaaggtgtgccaccaagtgtgatgcctgttccaggacccacgtgatggaaggagagcctactccccaggtttcctttcctccacacaagccgtggctcacgcacccacctggaacaccttgttctgcagtttgattttctggtacttttcttcctctggatgcaaatggatattgtccaggtacttggcgatggtatccacacccagcttcactcgatcccggtctctattgaatgtatgtatcttcatgatggaggcagccacagggtctgtggaaaagtgtgacaggatggcctgcttgatgtgggcatcccgctggtccctcctc

SEQ ID NO: 970 - DNA, 390 bp, Rattus norvegicus
  Genbank Accession No. AI044861
tttttttttttcattttataaattttaatccataaaaaaaaaaaaaaaatggtaaatttttaagaaaggaaatatacatttagtgcaagttatgaattacagttcatctccagtgtcagcagtgaaacatcctgaaataaaagaatgatctaatttgaaaagagtcccagtgtttaacatgcaatcaataccaggtacagctaaacagaatccttccttctctccatgtcacacagcagcatttggtttaattatgctcaacagcacttttatgtcatagtaggaatttcagaaatagaaaatttgcataacattaggtcacattatccataaagtccgaggaaaaaataaaactgattacagtcaagtttgcctttgattctgaaccac

SEQ ID NO: 971 - DNA, 486 bp, Rattus norvegicus
  Genbank Accession No. AI044887
tttttttttttttttttcctctacattggtaccattctttattgtttctatgaatgatgtctagatgttgtggcttacccttaaacaattcatgttgctacatgctaaaactgaattaaaagacaagacattttaacacatacaaacaaatgttaagatgcaccatttctatgtatttatattcttgaaataggacaggaaatagcagcaaatgagaacaaagatattttccatagcttttggagaaaaatccagtcagaacggctaggagaaaaagacttctcaatgtaagcaaggctgtgaggcaatgttgtcctaaaagctaacctacagtgtttacggaatcatgatggagttttgtcctcaaaaatagccacttacttctcaaaacacttttcctttctagagaaatctgaggaatattaagaccaaacaggtgaacaaacgaaaaggacacaggctatacagtaagctgctgctgccctc

SEQ ID NO: 972 - DNA, 388 bp, Rattus norvegicus
  Genbank Accession No. AI044900
tttttttttttttttttgagactgggtacccgcattgttctgaggaggatctgttctttagtgtactggaaacacgaggttaccagcaggcacaacagggaccctttggaacccttacaaaccagaagggtcacataaatgtactgcatgtgaggtggtgagggaaagggacaaggggaaggggttaagaagagaaatctctggtccactgtgactttcttcagcctggacagttgctcttaaaggggtagctttcttccagtgtactgtactcttcagagcagcagacggctgcagggtgtgcagccagcagcagacgtatcagaaagagtaagtcctaaccccttggttagaaaaacaggagacagaagttttaacacccacctta

SEQ ID NO: 973 - DNA, 485 bp, Rattus norvegicus
  Genbank Accession No. AI045026
tttttttttttttttttaaagttgcactgtctttattgtaaacttgcatagtacattgattgtgtacgcttttaagtatagcagggtagcccctatggtaccaccctcttgtgtggggcatttaacgctggtttactatgagtagggagccgggaccaaagtgctgcctgggaattaaaaagaaccgttatctgattacgcacaagtcagggagctgagggatctgagtccatctgagaatactgacaggagagactttaactgggttcaaaggaagcatatcaaaagggtacaggggactcggtgtcaggaaacaggaatcatgagcagcttgtggatggagaataaggagaaaggagacaggactcatgcctagtgtccaaaaccgagatgaatgacacctgccacaattgtgcccacagacagcactctgggtagcccagatgcacatctatggcgctaccatggctacagaaaagccacac

SEQ ID NO: 974 - DNA, 434 bp, Rattus norvegicus
  Genbank Accession No. AI045040
  misc_feature (1)..(434): n = a or c or g or t
tttttttttttttttttggctgttcttgtttccatttattagtctaggaatatacaaaagtgtgacatggcaaaatctcatggagaaagcagaatacacaggagggtggctttctcccgacgcctcataaaggcacacaggtgaggcttggttgggggtggcctcctgtcctggacccagtgtgctgcacaggaagccaggcacctctgtgaagaacagaggcctctcctcacaccagacttggggtgtggctcaggagagctcaggtggctgggagaacatctccagaatgacgctgagctgtgttcacgatgccaatctccagagtaaaaccagccaacagcagcgagataacccaacatggcacctgtgggacagccctgtcnctagcacagtgtacaggaggatgtctttctgggtcgggtgctccagct

SEQ ID NO: 975 - DNA, 395 bp, Rattus norvegicus
  Genbank Accession No. AI045075
tttttttttttttttttgattagacaaaatcaaagtcatttattactaaagtttggttttttttttctttgctccaaagcaagagaattgctgtaatggcggagtgttcttgcttttgcattttgtggttgttgctgttgttgttgtagctagaaacaggtctcattcatggaaaactatggtccttcaaggagtagctgcttctgatcctggatgaggatgaagttcaggctgatgttcccaggcagggcagccctcgctgggctctgagtcgctgagagattttgtagagctccattgtggccctggcatcttctacagagcagtggccccgccagttgttctggatgctcttgtgcagcaggcgcttgcacagcagcctcagggacacacgg

SEQ ID NO: 976 - DNA, 505 bp, Rattus norvegicus
  Genbank Accession No. AI045194
tttttttttttgtttttaattacgttttatttattttgtggagaaggcacatgtatgtgccccagggcatgtgtggaggctccgaccttcacgtgtatgaatgagcacaggcatacaccataaaaaaagaaaaataaaacagggtatttcgtaagattcggagttcataaatattagaatcttttttttttttttggtaaatattagaatcttaaggcaggaaagtggcacttctactagtaattgcttccaattcaaacaaattcaaagtagaggctcggaggctgaggtatgcatgaggctctgaggctctgagttctcagcaccacgaaaaccaaaccgaaacagactcagatgagcaagcagaatgtccagaatctccatcgacgtcagggaaacagaaccaagagcatctgtttgtcatcgcctgatacggaggacagcaagtcctaagacccgggcagccagaagctggcacagtgaaactgtcaggccactgctgaga

SEQ ID NO: 977 - DNA, 467 bp, Rattus norvegicus
  Genbank Accession No. AI045378
tttttttttttttttttaatggacctgtagccagcctttattctttgacacatgtcaggaagagggaaaaataaaaaaccaaacaagctttgcagtcactgacaacgatgtacaagcagcccgctccagttcccagctttgaaccagcatcaagtggggacggcactcgttcagggaaagttggggctttttctactagacacccctctggaagtaaatctctaactaataaataaatgaaaaactaaagcgggctatggtccctctaaagtggcggagtgggggcggtgtctgtctcaaccctttaagaactttgtgaaaagtttaagcggttgatggagaagctggctcaaaggcaggctctgtcgcccggtactgagaaccgcctgggtgcagtgcggctcgggccccagctgtcatttggggcggcagcccggaagaagtaagagtgccagcgcaaaggggac

SEQ ID NO: 978 - DNA, 439 bp, Rattus norvegicus
  Genbank Accession No. AI045441
tttttttttttttttttcagagcaacaaaaataaaagcttttatttgttcatttgaatataaaacaggcgttatcacagatgtacaaagcgtactggtggttgaacatacaagaaggttgctgtcctttgcacataaaaattttgtttgaaactgtgattggttgagtacacgagttttctctaaccagtcaccacactctgaaataacgctgctaacattcaactgataaagggaccgtccccttgggtaaagtgtcaagcagggttaaatatgtataatagacaagcaccatgaggaatctgctcctgctcgatgggtctgtgtctcaatgtccttgtgtaccctctttttgtgcaagttgattacatggttttggctgactccaaaagcacatggtcacaagacaaacattttttttttaaaaaacattctcatga

SEQ ID NO: 979 - DNA, 305 bp, Rattus norvegicus
  Genbank Accession No. AI045475
tttttttttttttttttccaaagtgactaacagagcagattcacaccttgggaggagatcgtgcgcacagctcaggggcagtgacaggtaaggggtgcacacccctgggcagctgtctatttgggcttcccctcgctggctcgctcgctgtgtccagctctgaacatacgctgtactgaaccctgacttagaagagtctaggtgctggtgattagacacattgtcacaagctagtcaatgaattgtatcagagtgttaaaaaaaaacctttgcggccgctccaacatcagaatggcctcgtgccg

SEQ ID NO: 980 - DNA, 364 bp, Rattus norvegicus
  Genbank Accession No. AI045509
tttttttttttttttttaaagtctgtctctcgcactttagtgtcatattagaataatatcaaatgttccgttgggagccttatgtttgaagccttaagataactgtgcttttccaggcccactgccaccagacctataatcccagctactcaggaggctgagacaggaggatccccgttcaaagatggctgcctgggctacagagtgagttccaggccatctcaggcaactcagtgagatcctatcacgaaataaaaaaccaaaaggggactggggacagagttccattacagtaagcttgcctaccactgctggtctggggaggttctaggttcagaccccagtgccaaacacactcacaaag

SEQ ID NO: 981 - DNA, 487 bp, Rattus norvegicus
  Genbank Accession No. AI045600
ttttttttttttttttaggtggtccctaaactatttgaaggcaggtagctgagtctaagctaaagtatttctcagtcagagtaatcaatcacctcagagtaatcaatcaccctcccctcagacgcccctcacaatgcaggaacagtgcaacagcaaaatcaaagagcaaactgtattttcaagaacagaagagtcgccagtgctgaaggacagagtagaaagcagattctttgggggacatcagtcagtcagtttccggcccattaggaagacttctctttcctgctccgaggagagtcggctccattcgacgtgaccgtgccgttcacaccattctctgttccttttctggaagacctgcctttggtcacagccggtttccttttcacgggaggggcctggaaggcagaatgttccctccacctccgaagctggaagttaatgaacttccacatcatgaaggcttgagtgatgcaaatggacgcta

SEQ ID NO: 982 - DNA, 317 bp, Rattus norvegicus
  Genbank Accession No. AI045632
tttttttttttttttttagtttttgttcaggaccttgtgtgtactaatcaaatgttctacccttgcgttatataaccaattccttccccactcttttgactccaccactcactttgaggaaatggtccgaagggctgagttgtcttgggaactgacgggagagcagtcaccattaatgtgcccttggtgccatgtgtcctcaccccgggcacaccattgcctcttcttcgttttcttcttcatctatgtctctgttcactcaaagttaacaataattgtaatccataaatgagtttatatttatactctaacatgtc

SEQ ID NO: 983 - DNA, 518 bp, Rattus norvegicus
  Genbank Accession No. AI045686
  misc_feature (1)..(518): n = a or c or g or t
tttttttttttttttttccttcttgtccttctcctttttctttggtttgttctgttggggctgtgagagggctgcaagctgctcatgcacggctttgagctgctcctggagctcagcccagccgctgggctcgctcttcctcagagtcgtcagtggaactgtcactgtcagaggaactatcactgctgctgtcactagatgagggtggggctaccacctttgtagggggtggcactgcaggggaggacaccgtaacaactggctcttcaggctcatcaggcatcttggcaaagcgcatttcaaacatcctggagttttcgagccatggctaccacttcatggtcagggggattgtacttgtagcagttggaaaacatcaatcggacatcagcaccaaactcctgggcatctctgtactcccgggactctagtttagacttgattgtgctcatgtccatggggtgtttaatgatgtcacagtagtcgtgcagacccagtgcctncacatccacgggctt

SEQ ID NO: 984 - DNA, 407 bp, Rattus norvegicus
  Genbank Accession No. AI045707
tttttttttttttttttggacatgctgtacatttctcttttaaaatgtagtttgtattatttttccaccaatcaaaacacatgatatattttattataaaacattaggcagttacttttgagatacacaacctgaaaggtcatactgtacttaccaccagcatgaggcatcagaggagtcatagcagacagactcacacacccagcccagatgaaaccagtgttgggctttttactttagatgcaggccctggctgtcaacaagggccaatggagggctttctctttctaacaccggggactggtctttgtgttctaaagatgagagcacagttctgactgcaggcccagtgcttgaggcactctgcagcccgagttctgaggccgcgctcctaccctgcctcgtgc

SEQ ID NO: 985 - DNA, 404 bp, Rattus norvegicus
  Genbank Accession No. AI045744
tttttttttttttttttaacacagacacatttattggcaaaacctattcccaagcacggcggtggggaagggcgctggagagtgggcagcaggatccccactctctttggtaatgttcaaggagtaggaaaggcaggagaggataggggtgtgcccagcggcgtggtcacatcagcaactccccacaaggaaggctgtgtgctctgcaaatgcttttcttatacggtgtcggtcaatccttccaactccctacaaggtaggtgcatccttgtccctatttctatgatgagggaacaagagtctgtggtgaggcagtcctgggaggcaaacatgggctctcaaatcccccccccccagcatcttccactggaagccccctgctgcctgatcactcagatcttctg

SEQ ID NO: 986 - DNA, 375 bp, Rattus norvegicus
  Genbank Accession No. AI045836
tttttttttttttttttgctgaaaacccacagctttaattaggtaactccagaaagggttttgcctctgctagataggaaggcctggccaaccgcgcctttgacactctcacacacagggaccagatctggagagcagggctcaacctagatagtgcctcctcttgatcccaccttctcaggccctcaagccatccatctatccatcccgctgtcaccatgccttcctggctccaggctgggggagggagagccaaaagtgggtccaatctgaagtcttgccctctgtcaactgcctgggtggaaggtagcacctttcagggaaagggttaagaaagactggaccatacatgattttggtgtaatcctcgtgccg

SEQ ID NO: 987 - DNA, 449 bp, Rattus norvegicus
  Genbank Accession No. AI045911
tttttttttttttttttgaatggcagaagcactttattaggctccagggcccttagaagccactctcacagagtctgggcaggccacccccagcagctccagctgcacaggaagtgggcgggtgagagaatccacatagctttctctaccgtgaaggcccgaagaagatgctgggcccacagctgcctccctctcttcctgcagcctctcctgaccccctatgtctacatcagtcttggggtggaaagggaagctcaggccttcagtacaggaaaccaggcctgcagtacaggaaaccagcttgaaaccagccacctgctgtgcttgaacagggagcagaggggagcacaggggaccgcagcgtgatcctgtccaggagagagctggcaggctcacaatcagactggctctttcctacaggccctagagctcctagcttggctcagtaa

SEQ ID NO: 988 - DNA, 322 bp, Rattus norvegicus
  Genbank Accession No. AI045929
tttttttttttttttttaattcccccccaagattaaattttaaaagtcaaaaaaccagactgacaaccctggactaaggaactgtttcttataaataaatgctagcacaagcaacaaaaggaaaatcagataaatcacactgaactagcatttaaagcctatgctgtggagaaactgttagcagtgagaacacccttcacacaaggggaggaaaggcttgcagaggactcatctgacaagagatttgcacccagagaagcgaaaaacctgctacaactcaacaataaaaacctccattgaaaataggatttggagcagggca

SEQ ID NO: 989 - DNA, 460 bp, Rattus norvegicus
  Genbank Accession No. AI045948
tttttttttttttttctgaaagtctgcaagtcttttgtgttaatagtcactgtcctctgcaaggtgcagagcagaacacaatgtattccaaaactattctgcaggatttctttgtttaaggaaatactattttgggaaaaagatggactccatttccagcccacataaataagcccacatctataacctaacagtaattctcctaggatccaagaggatagattgctctaaactcagtacctgtcatacttaaccgaaatgtggagactgtaaattgcaaagaattctttccttttctgttgctcagagcaagaaaaccctgtgctgtgactatatcccagcctcttcttttccagacgagtcactgaattctctctgcaaaccaacttactctatcacctagattcattcaataatcatgtcttaaaatgttaaaagaaacaaaacctcgtgccgaatt

SEQ ID NO: 990 - DNA, 436 bp, Rattus norvegicus
  Genbank Accession No. AI045989
cggccgcggggctccagaggtactgagccatacacacctgccctcaagaagccctgtgacccctctggcggctgtgaggccaggttctcagactcagaagatgatgtgtccagccccccaaaagccgatgaccctgaaagtaggcaggtcttcagggagcttgactgtccttacccacagtcctctctgatgcggctgacctacctgggcattccatgcctgtcatctcacctggggacctggtttatctgtcctcatcctccctgtttgactgtagtgtcttcgagactaatcagcttcgttggataaccagccagctcttcagctcttcttctatatgtgagcggaagtccccagaaggacgcagcaggaattcctactctcaagtttctctgtggaaataaaacatgattctttgtttcatcctcgtgcgaat

SEQ ID NO: 991 - DNA, 513 bp, Rattus norvegicus
  Genbank Accession No. AI058330
tttttttttttttttttgtgaatttgtctagttttgaaatattttcaagagacttatatgcattgaaaagaccattccagacaacctcctttcttcttgctttgttatcatttctagcacaccttcaagacgatgacagcatacagaaccaacaacactattaaatttattgtatccattcttcctggacattctaacaaactagaagtattctcagtggttgtatatactttcttcttaactcttcgttggctacgtcaactagccagtgagtaagagcatcacatgcaaaattgtcatggttattaaacatgtatgtccatatataaaatggtcaccacctgaattagactctcctctgtctttagatgttctcgttggatgacgtaccgttgtcttggaaacaggtacatgctgtgttgctgtaatatgagcagaagtaaatatttgtgttacagtatggagacccttggtcattgagaagtgtgaaatggtgggcctttgtgttgctgg

SEQ ID NO: 992 - DNA, 431 bp, Rattus norvegicus
  Genbank Accession No. AI058359
  misc_feature (1)..(431): n = a or c or g or t
tttttttttttttttttgctcagccaacagcagcagcacgttttattgcaaccagaatcccctggtcatgtgaggaagggacagaacaggacacaagacaggagatagcatgctttatggaccagcacacacagaccggtgggaagcatacccaatgatgctgacatggagggtagttggagaggaggcgggctccattttagcagagtcttccccacaagggacctgagggaaagggggcagttgacagtgcgggtcaaatgaccaaagagactcagcagtctctagggcaacttctgcatgggtcncctgtggatgttgttagatgaaaacaaagatatactctgtccattgagagtanggaaaacaaaggctcaaaatgacagtcactggccagcacccataggtgtgacctgagaccctgactccta

SEQ ID NO: 993 - DNA, 413 bp, Rattus norvegicus
  Genbank Accession No. AI058419
tttttttttttttttttcccagtgagaacttttaatgggcggtttcagagccaggagactcaagggccagggctcttaacgtctcaaacaaggcattcacttttgtaaacccccttccctgcagctaccactccactctcatccttgccaactcccactgttgcgctggatcactctgctcggtcacgcggcctctcgacccagttcgttcgcacttccgggaagcccaaatcctgtctcggccgtacttggcttccccgccgctctcctctgagtcgagtggcagacttgcctgggtttctccagttgttggtttttcatcccgggtcaaccctgatgctcctttcccaccccaggctactgcaaatcttcccgaatcctcacagccccgagctctcccacccctcgtgccg

SEQ ID NO: 994 - DNA, 449 bp, Rattus norvegicus
  Genbank Accession No. AI058451
tttatttttatttttttgcataccgctatatatttctctgtctctctctctttagctccctcccctgccttcctccgtcctctttacccgaaattcttttgagttccttcatcctttctctgttcccccatatctgtgcacccctgcccccatcccaggcaaagcagtgttctgagtaccacaccacacacacggatcagatgcaaaccgcacagaccagcctcagcttacacttggttacgcaagctaacaagagccggaggtaacttgtcctagcatttggaagaggaaagcaggaacccaccaaacaaaccagccaaccagacaaagaaaaaccccacatagaaagaatgtactctcttttttacatcttggtctataagccatcaacgtttagtgaaattatttctttctttaaaaatttaaagcgcaggagaatagcaatttat

SEQ ID NO: 995 - DNA, 489 bp, Rattus norvegicus
  Genbank Accession No. AI058453
tttttttttttttttttaatggaatgcatacacttccatgtatttttacagtaaaaatgcattaaaaaaatctttcacaaaagaaacttaaaaaaatccaagtacgctattgactccccctaccccccaaacattctttcaggcattggttgtgtcatgggggctggggaatcttaaattgtttgatttaaccatacaaaatactcaaccctcatcagcactcttatggtaagtgaaaggttggggaagaaggctcacaagaatcagtttccaatatagtctacagtagattgaagagaattctagatttcggcttaccacacgtagtttcccatacagtgcaaaccaaatctgatgtactgaatttaaggtgaacttgtcatagcaaaagtcctcagatactgagccaggctcacttgggtagcactgactttattttttaaactgagacagatatcatgatgctaactttggacccactccaaaaat

SEQ ID NO: 996 - DNA, 425 bp, Rattus norvegicus
  Genbank Accession No. AI058505
tttttttttttttttttgaatacggttttttttaaacgcttatacgccagtgcctcggggtgctgttcacatccacaactcaacttggatacacgcgccagacagactctctcccggaatggcggcgcagactcactgcctggtggagcccttcctcccatggtactgtgtggctaacatcaagacctctgcggactctttcctgctatcctccggtttcacgacccttgtgcttcggaattcctgggctagtctcttctgcaacaggtggcttttacatctgggccaaggtttacacagcagtgtcaccccggggtgcatgatgtccataggcatgtccacaacgtcaaggcacaagcttatgatcctgacatgatcaaggtctcggttcccagtggcattcggtgccatgtcactcagaatca

SEQ ID NO: 997 - DNA, 423 bp, Rattus norvegicus
  Genbank Accession No. AI058507
  misc_feature (1)..(423): n = a or c or g or t
tttttttttttttttttgcaagctttctgagcttctgcattcagaccacacagaacatgtaaatatttatacacagaccggagaactagcacacgccttacagcctgtgtgtcccctgccttcctctctcttctctcttaagaagtgcggagtgtttttttttcttttttgcggttttgcctagaggtgccccaggcccccgctcctagagagggtgacctttctgtttctccttctccttgttctccagtggggcaatgtgagggtgatggagccgggtcccttctagcagggaggactgcccgttactttgctggtgctgctggaaggaggagcccgggtagtgaccaatgacctcactgtaggtgggaggaggcccctccatgcgcccgccgctgctatagcaggtancgctgatgccgg

SEQ ID NO: 998 - DNA, 158 bp, Rattus norvegicus
  Genbank Accession No. AI058527
tttttttttttttttttgttaaatgtttccaatccatcaggatccaacatacaggacaaaccaaagttatttgcttgtacccacttagcattgacctgttatccatgaactacacagtaataatcacttttgtcaagaactgtttttaagtcacaaca

SEQ ID NO: 999 - DNA, 399 bp, Rattus norvegicus
  Genbank Accession No. AI058653
  misc_feature (1)..(399): n = a or c or g or t
cggccgcaccagcagcaccggacggtctttctctcatgaccattcctcagtggctggcaagatccccacctcactgtccactgtccatgccagtgacatcttagctgctagagtgtggagctggcctgtgggagtcaagtattggtggtgtgacctgttcatgcaggggaaacttgaacgttcgcagggttcctactacctactcccttatggcgtgcagtggcgttgtctctgggctgccttggagaggaattgacagctaagaagttggcacaggtgtcaggcgcagcggtcgccgggacaaggggacccttgcttttgcaaacgaagctcaggaagaatgtgaaaggcanangggtattttgagtgggccatgcctctgggttttgttattaaatc

SEQ ID NO: 1000 - DNA, 414 bp, Rattus norvegicus
  Genbank Accession No. AI058665
tttttttttttttttttcctgagagtgttcttttattttttaagatttatgattttattcttaattgtgtgtatatgtacatttgtgtgtgggtatgtgcatgtgagaatcatgtgagaatcgttgcccaagatggccagaggcactggatctcctggagcaggagtcacaggcagttgggagccacctgacatgggtggtgggacccaaactttggttccctgacagcactacacactccaacctctgacccctctctccagcccatggtgggttcagatgaggcagcctgcctttccagtgctgcacttccagttcctcccacacccagtcagcctgggctcgccgtgatcgcattgtcctgtgctcggtcacttctgttacttttcatgcacagagtacagtcctgctgtt

SEQ ID NO: 1001 - DNA, 206 bp, Rattus norvegicus
  Genbank Accession No. AI058772
tttttttttttttttttccatgctgcatttgctacctgccatcattcctggctcactgcatccgcctgctttccccagtatgtgaaaggaacctgcggacatggtacatggtgctcccatcgccatgatgaggaagacaaggaggaggcctaccttcctgcatactcccttcctcctcccctcgtccgtagaggctgatctcacat

SEQ ID NO: 1002 - DNA, 168 bp, Rattus norvegicus
  Genbank Accession No. AI058824
tttttttttttttttttgcctgctttttctgttttatttctttctaggtgattgcacttcaggctggcaacacccaatagagtgattaccaactaattttgttcctctgaactacaagccaacaacccgattcagcaaggagcagcaagtgtcgatagcttgttgggg

SEQ ID NO: 1003 - DNA, 225 bp, Rattus norvegicus
  Genbank Accession No. AI058869
tttttttttttttttatggctcttttcagtttattgcatgaaggagttacactagtccaggttaaaagcggaccccaaatgattacattatacaagctgtgaggttaagggagggctttcttctagttcggcattctccgcactctcctcctcttccgcgtccgcagtagtggtaccttccttgctgttatcatcaaccccctcactgcaaacgtcctcgtgccg

SEQ ID NO: 1004 - DNA, 444 bp, Rattus norvegicus
  Genbank Accession No. AI058890
tttttttttttttttttaagcatgggagcacattttaatcaagtgggcagttgtagttttaagtcagcactaaaacctggcaatgttagatttgtgttttcgtgaggtctaaatgtcatcacagagaaccacaggccacagagagaatgagatgtcttcaagttatgttgacctgatctcagcaaacacagaccggcggcccggtggcttgcggcgctccagacttgggaacagcccccttgtatatggaaatgaagtgggcggggcattgagttccctggggctgctcgcagctgctgtcgtggaaagaagcaagggcaattcgataggtgggtagaggaggcgggctgggaaacgtcatcatctccgcgtttgttctaaagtgacttagagacggtcatttattatggaaacacaatccccgaacagtttgctctttctctc

SEQ ID NO: 1005 - DNA, 487 bp, Rattus norvegicus
  Genbank Accession No. AI058942
tttttttttttttttttagtgattctgacatctttattgatgctccctgtctttgcacttatatcgtacatgtcatttaaggagcccggcaagcctcataaataatgtctcttacatccaccttggtagcagagatcagtaccagcagccaagtgtggaacaacccaggctaactctgggtccaggccacatcagcacttcagtgtttaagtcttctacatgcagtgtggaggacgcgtccgctacagtgtcttccagctgcatcaggcccagcccagtcagggagcagcatgggcctccactgtagcaccgaaggggcccaacccagaagcctctggcagaactggcggcatataggcagcacaggagaagccagcttccagcaaaggggacttgacaaatcttctggttgtccagttacagtgacagaattgaaccatgtgttgcctccacagctgtctggaaacgagaggtgtccgtctctaca

SEQ ID NO: 1006 - DNA, 492 bp, Rattus norvegicus
  Genbank Accession No. AI059175
tttttttttttttttttacagataagttcaaactttatttaaaactacatttaaagttaacacaccaaatgtcacaatgagggttaggggtcaagatcataagaaaaataaaagcaaaagaaaaatcccacagtgtgtcaaggtttgaatctgtccaggattcagactctaatgttttaaactgccatgggcagaaattagcacacccatcaaaaatgcagtgtcaaactaatttacattttatacagaccaaaacaaatgtttatttagtgtctttttttttttttttttttactgtgcggaaacgtgtgtgggacctttgttcttcgccttccaactcctggtgatgactccggagaaatatcgttagttaccctcttatcacttgctacaccaaactttttcttattcttttctgatgatctgttggccttcttctgttggccaccccactccatattattgagtctgtcatccacactgtcattgctc

SEQ ID NO: 1007 - DNA, 161 bp, Rattus norvegicus
  Genbank Accession No. AI059209
tttttttttttttttctgcaggcgaaatgagcattgagctggaaaggcatacagacagactggaaaaggaacttgcctctcaacaagaaaaaagggctctggaggagatgataaagaaagaagtaaccagagagcaggaagaggcggaggcggatgcggac

SEQ ID NO: 1008 - DNA, 209 bp, Rattus norvegicus
  Genbank Accession No. AI059246
ttttttttttttttattgatttgtttatttttattttttttttttgcccaaatccacatttattcgaacctaacagccgaattacagcttgaggtgtggaatcggctataaacaagacttcgaatgattttaactactgactgatggcggatggaccattcaattgtgtgtggtgccatctatgggctggcagtcctagattctacaag

SEQ ID NO: 1009 - DNA, 302 bp, Rattus norvegicus
  Genbank Accession No. AI059298
  misc_feature (1)..(302): n = a or c or g or t
tttttttttttttttttaagagaaccagaactttattcacagttagaaaggtcctaatctaagattcaaaaattgaaatccaatgtcttttaagaatgaaaattcttaaatccgtcagaccagctgacagggcaaatggaggaaaattccccattaagacaacaacaacaacacaatacacaactcagtctccctccactcccagcaccccagccacctcccacccctttaagacacagttaaagccaggcataatgcacacattcanacaaacaaaacgccaaacacccgaggagacctca

SEQ ID NO: 1010 - DNA, 272 bp, Rattus norvegicus
  Genbank Accession No. AI059312
tttttttttttttttttaggggaaaaaaacattttattctatgaaaaaacagttcgaacaaaaaatacagactagcattccggagttttgagggctatgcttcccagcgcctcagcatctgatgcatgagaaaggtatcttctgaagggcggggccgggcttgaagccttaaagggggcagcccatccactgtcaagtgcggagattcataccacagagaatctgggttgcacagcatggtcatgtcgggccccggcccaagcacctcctgt

SEQ ID NO: 1011 - DNA, 291 bp, Rattus norvegicus
  Genbank Accession No. AI059313
tttttttttttttttttaagtgagtatacaacacacctttattattaataattacttcacaagataggacttgaaattctgtcctctggagcaggggatggcatggcatctaagtaagtagatagaatgtggcagaactgatgtcaaggctggttatgacaggcaccaaatgaagattctttcttattcctgctattgtatttcttggtgtgggggaaaccagctgccatgggaaggctcctgacaacaaccacaagagtgcttgatttctgtcagctctagcggaacctt

SEQ ID NO: 1012 - DNA, 306 bp, Rattus norvegicus
  Genbank Accession No. AI059352
tttttttttttttttttaagtcttcagctttattgtccggaatttacaattacaaagtagtccaaagtcatttctcagtactgctgcataaaatatacatatacacatacttagaaaaattataaaatgttctttaaaaattacgctataataagatttctcctcatttactgaccaagcataaaaaatatacctcatatgcacctttatcttttacagtcctattgacatttgtgtttataactgatccatacattcaaagaactgaaggcattgtttcactgcaacaaacttcataaaaggatt

SEQ ID NO: 1013 - DNA, 243 bp, Rattus norvegicus
  Genbank Accession No. AI059386
  misc_feature (1)..(243): n = a or c or g or t
tttttttttttttttttacaggtgaaataaatttttattgatcagtataaaatatttcaacacacaatgtcttacatttgatattgtcttcagtctggtgactgtttccttgcaatagttgggatagaatctgaggcctcagacatgacaggcaggtcctccactactaaactatgccccagacccgaggggttctangcaagtgctctcctattgaaacatggccacagctcctcagtggta

SEQ ID NO: 1014 - DNA, 296 bp, Rattus norvegicus
  Genbank Accession No. AI059485
tttttttttttttttataggtcactgtttttttttttttttcatggttaaaaattcatacatgtagttccacacccctttatctatacattgtcctccatggccccagcctgtcccacttctccatgactcctcagccctagatagtcctccttatccctttcagctgtggggcctgacctgtctctccctgggcaccctcccactcttctccccttttgaagaaacggctgcaactttcactgcagtgtggctcttggcagctccagaaggcccttcagtgggaactggctggca

SEQ ID NO: 1015 - DNA, 472 bp, Rattus norvegicus
  Genbank Accession No. AI059519
tttttttttttttttttcctggtgaccttcaatgatcaattttattataaagaacagtatcaaaatatacaaatctgcttatgaaccaccaagaaatgcagctttttaaagggccaagtgagtatcagctttttcagagtaggcagcttctccctctgaggtcttcctggagaaatggggttgatgtccatgggccacattttctatatatcctctcaataacttaaagggtgagtctggcttctgaatccagatgtctatcacaaatcctcatgggagagtggctgtgtggggttttcctctgtgacttcgctttgtgctgtctgcacacaagcgtcttctgtctcctcaaagccatccggacacacgcacacaaagctccctggaacattgtagcagttttcgtttcttctcttacaggctttttcttctagtgagcattcatctatgtctgcacactgtccactctgct

SEQ ID NO: 1016 - DNA, 299 bp, Rattus norvegicus
  Genbank Accession No. AI059543
tttttttttttttttttgatcactgaacatttattcttaatcctagaccctaactgcagccatggtgctgtggctgtgttgtggtggtcaggtgaggcccaaaaggctcccatgagaggacccaaaggctgacgctgatactctatggctatgtggaagccacgcaggtggtgacatggtcaatgctccaactaggagcccatacagcagaatcagcatccagggcaggcttatagggactggcgcgtgtggaggacgcctctgtagacgctccaatgcactcccatgcattggggcca

SEQ ID NO: 1017 - DNA, 299 bp, Rattus norvegicus
  Genbank Accession No. AI059549
  misc_feature (1)..(299): n = a or c or g or t
tttttttttttttttttggccaaaaaacttgtttttattattaaaccttgtagtacaaacctgaaaagtaaacaaagaacgggcaatcaaccacacagaacctccctgcgggagggtgcagagcagcgctaataaattaaatgtcaaactgtaagccataggcgagagtttactgtcaaagaggaaaagtacacagcaaggccatangaactggacaaccacattgggaaacactcgactgttaggtgatcgttaaatattccaacagttcagtcttctgcaacaaccaccacccacgt

SEQ ID NO: 1018 - DNA, 316 bp, Rattus norvegicus
  Genbank Accession No. AI059664
tttttttttttttttttgaggaaaactttcttttttcttaatgtggtactgaggatggaacataagacccacacatgctatacagtactgctaggcagtacagacccacacatgctatacagtactgcttgctaggcagtacagacccacacatgctatacagtactgctaggcagtacagacccacacatgctatacagtactgctaggcagtacagacccacacatgctatacagtactgcttgctaggcagtacagacccacacatgctatacagtactgctaggcagtacagacccacacatgctatacagt

SEQ ID NO: 1019 - DNA, 124 bp, Rattus norvegicus
  Genbank Accession No. AI059728
tttttttttttttttttctgcggaaaggggttgtttttaatggagagttatgggggagagactatcgaggggaaagtgtggaggcttcattcgtcctttatgcacccgaacacagcagctggca

SEQ ID NO: 1020 - DNA, 418 bp, Rattus norvegicus
  Genbank Accession No. AI059925
tttttttttttttttttcaggaatgatagctaatgtaatttgttgagaactgtatcagagaagtcagatatttcacaagtaggaaagtgttccagctcatcttacacctcagtgcagagttctccagtgaagacagatgttatctgctgttccagcggtatatgcacacttctctccagggataggaggctgatctctctgcaccatggaggacaatggctgggtaagaaaggtggacaggcagtgaaagaggatgccttgatttgcaacttccagggtaagcatgggactggtactagtcatgagttctgctgccctttcctgagaaagtccaaccagactaaatccatccacaatgaggagttggtcatgggcacctagttgtccaacctgagccaccagaaggatgcaggtgtag

SEQ ID NO: 1021 - DNA, 411 bp, Rattus norvegicus
  Genbank Accession No. AI059968
tttttttttttttttttgggtttgaaagttaattttattaaatgaagataatatatgaaatacattcatcatgactagaaaggtgtggccagatcatgtctcaggtctgtagcaaataatcttgactcatataaaagtaacttcaaaattccagtttctttaaatagttatgcacaaaacatacagatacacacatacacgtacagttcctaccactgtgggtcagaggtgccctctcccttcactgagctgccccccccccttcactgctcaaagacctgtgcaacggggttcgaccagatctgtctcctaaggatccgcctcgggctagcttagacttgcctgaggcttcagctccctagtcacacagggcgagtcccaaacactaggagaaatgttcgctcttcctta

SEQ ID NO: 1022 - DNA, 337 bp, Rattus norvegicus
  Genbank Accession No. AI059971
tttttttttttttttttaaaggatctccatcttgtctttatttgcatgtggttacaattcataaatacacttgtactctttctcccgttcccaaactgtcctccacatgtggtaatgctactgaagcccccctgcccttctcactgtcctctctcccccaggagcaagggaggggtgctcctccatgcgacatcatgttcacccagggtctatcttggtccacgcagtacaagccctcaaggcctctgaaggttggggatgagcaccacaaagccttgcaaggtccccggatgtccttgaaagtgaccctgggcccagctccctcctctgccatgtt

SEQ ID NO: 1023 - DNA, 469 bp, Rattus norvegicus
  Genbank Accession No. AI060137
tttttttttttttttttcagaacatttgtaaatcccttggaggaacaaagtaaagatcaaatgtgactacattaaaactctttgtaaagtaatgtgctatttccataataaaaggttctgtaaactgactgaggaaaacaagcttatgatgaaggcttgagggaggatctgttgcggtctccagcccctcagaaagcacaagtgtcaccaggctagagagcgctgccgctcccagccatctgggtccctggaaggaacaccacatgtgtttagccccacaggctccccttgggcttctctgtgagcacaaagagctccgtgtgctgtaccttaagaggaacaaatgtttcaatagctcattaaaatagtagcaaccaatggaaatgacgtattaacactcaattttttgtctcttttcacaggcgccgatgttataaaaaatgatggaatttactccaggtattttttc

SEQ ID NO: 1024 - DNA, 485 bp, Rattus norvegicus
  Genbank Accession No. AI060221
  misc_feature (1)..(485): n = a or c or g or t
tttttttttttttttttgcgcgtgactgaagatttatttcatttagctcctaaataaagtgatatcattacagtagactctccatgccaactggtctgcatctcagagactgactctgacctttcaggatttctaaaggactctgtgaccttgcagcaatcttttatggccgatggcaacagtgaggctcggaagatctttggaggaaggctgccattgaataatctctccaaatcttagctctcatgcattagattagctacagtgaagaagaggtcacagaatctgggacaaagggaaatgacttatttattttatttactagccaataaatatctgaatattgttgaaaattcacccctaggagaatcactggattctcctagttattattggaaaagtatttattgaaatgttcctaaacagcataatattccaacgcatttctgagtcaatatcaaatgttttatcncaaaatagaagat

SEQ ID NO: 1025 - DNA, 321 bp, Rattus norvegicus
  Genbank Accession No. AI069939
tttttttttttttttttagtgaaacgtcttagtctttattgagaacatctcagtcctttgtctacatgtgacagcatttcatgctcagttccggctgggctcggtgtgaggaagctcatgcaggctgtaacatgtggtatatacataaatatacatacagagaacactgaggattgtatcttagcaacacgtttcttggctgaattacattcatgtaaagtgtccaaactctaaaatcaaattaaaagtacataacccaaagcctggaaaagctaacagcttttaggggcttattccgtgaacattcctcatactgtgctt

SEQ ID NO: 1026 - DNA, 504 bp, Rattus norvegicus
  Genbank Accession No. AI070068
  misc_feature (1)..(504): n = a or c or g or t
tttttttttttttttttaaggcttaaccagtttattggaatgtctctgtagtagaaatttttaaaaaatatgcaagcgatctgtcttgctcagcacaatactaaagtagatgtgccttagctgcgaagtcccgggctcgagtcccggctcccgcgtcgagggtcgccgccctccgctgagttacgcacagttcactgtccagcggggtgggggacgcctcgccccacccctgcggcggtgtccagaccgtctgctgctgcgtgcagaggctggctgcatgattgccaggccttggctctaaagtctctgtctcctccagcctgaggtcccctccttcctgtcttggcgaccacctgtggtgctggctcctggctccatagcccaaggggcgggcgggcgcacactcccctctcctcgtctcagtctcggtgactccgcccctcccggaaggtatcacgggtagggtagcttttgagggattgttctggggaatganggggcgct

SEQ ID NO: 1027 - DNA, 435 bp, Rattus norvegicus
  Genbank Accession No. AI070173
cagccgcaaaggtcagaacttatttcacagttaggtggactaggcgaggcacagtttgtgattacccctcactagcttaggttgtttgcaaatttataaatgctgtaagttggagctaaatgtcaggagataaaaggttctctgaaggacagcagagtttttctgtacaaacagtctcatttgggcttctcatctgtgctcaccttgaacctacaacctccatgggcagtcagcaggtgggaagacatggtgttcgcccttgtgacttccattttatacacactgggtttgtgtattccagttggctttttagtactagaaatccctcatatgatgtatcagacacaattgaattctaatctagtctgttaatttatctaaagttggagtttttttttttaaagtaataaaaaattaaatgtaaacctcgtgccg

SEQ ID NO: 1028 - DNA, 496 bp, Rattus norvegicus
  Genbank Accession No. AI070179
tttttttttttttttttaacattcctgaaattttaatctttatttagctcttggatgttcatatcctatcagtctgagtcttcagaagtaaagattccaaatccctggctcaaacgtcaacgaaagaaagctaacttttccttaagccaggtctcggtgaggtcgtctgtggtgcggatttcaaacacctttgtaagctccgcgatctgcaccagcctgtttttacttcccgcgtacatcatctgttgttcaggcttgcagcccacggggctggagaagatgaaacacaaagggtaggacaccctgccgtcgtcatgcacgtacttatagctatagaccacgaacctgggctgtctctctggcaactccaacttaagttcctctggggaaacattctggaattcgtcttctagcaccaccatctgccggtctttgtccactttcactggggagggatagaacacaggttacagaccctccccatcccaagggatac

SEQ ID NO: 1029 - DNA, 402 bp, Rattus norvegicus
  Genbank Accession No. AI070195
tttttttttttttttttgctgcagcaaggcctgcgctttattgtgggtgatctaaaggaacacggttgcccagcaggagctgggccttgctcttggtcctggccacacagccctcaaccaccatacataaatagggacagactctgcataggtggccccttcagccacagagcaggagcccactggtaaggggcctcgtgcccagcctggcactgactccgtcccagcggtgctggccatggacattccacgctggccaggcagcttcagtccagttcgatggggctgctgtcatcctggctctcttccccttcttcctgctctgaggagcccatgaggctgctcagcaggttccctagcaagcctccataggaggatgtctgctttggcggcacaccgaag

SEQ ID NO: 1030 - DNA, 354 bp, Rattus norvegicus
  Genbank Accession No. AI070214
tttttttttttttttttcaactaaaacaatttgatgcttaaaataaaagacaggaaatatttcccaatcagactttaggcaagaatatatatatatatatatatgtatatatatatacttctgatccgggggaggaggagggaggatggctgcctgtattccaggaagtgttcagccttcctgtccctagagaggagactgctgaaaattgcagcccaggaggccccctggagaaacgaggcaaaagggtgagtccagcccgtgtgcccgcagctcttaagttacagagagttggtgctccctgctcagtgctgatctgtccatctgttcgtggagactattctggaaggagct

SEQ ID NO: 1031 - DNA, 492 bp, Rattus norvegicus
  Genbank Accession No. AI070285
tttttttttttttttttccaagaaaaaagcaaacatcattccatttatttttctcctgactcaccttaggccaatacccagactaagtgaatagcaggcaaagtgggatgcaggtccccagataagcagattcttaaggttcttcttcccttccacacccttcccttcccttccctccagatgccttagtattgcttggaactggtgttggtatctttgaaaactcgaaaggccctgaggagtgactgctcactgtacaggggtatcctttctgctctacttcatgagggcttcagaaatcaagtcttccctagtcccttccaggcccgaggaacctcctactgttggcacaagagcagcccagacaagaacatgccagaggcctagacttgcaggccaatccagaaagccagggtgagctagacagcctgaggacactggtttcaatccagaaaagctgggtctggagacgctttgctaattgatgccctt

SEQ ID NO: 1032 - DNA, 493 bp, Rattus norvegicus
  Genbank Accession No. AI070392
tttttttttttttttttcctttccgcaggacttgcctttaattggaggtcagcctcacagtggaccccaggaccaatgtgtttctatgggaggccgcccagggaagagggaacacacagcagtggggttctactttggccccgcgagagactatgtactcctggaatcaggtccctcccttggttggttcgtctacactcggactaatacaacttagtcgttctggggttaaggtgagggggcagttcacgcgttcagagcaggaagtctgtgttttaaccagttcctccttgcatgggatggcagacggcagaaacccaaggcagaaacacagaccggcctgcgtatttgaactcattctaccaaagcagagggagggatcacgatgtcactggctgtctgacactgagatccttcttctagcgctgagcagcttgggaggaacagagctttgccatctcagccaagaaatacccatgtctgcctgctgctg

SEQ ID NO: 1033 - DNA, 515 bp, Rattus norvegicus
  Genbank Accession No. AI070508
tttttttttttttttttgcacgcagtgaggattttatttgtcaaattacagtagctcaaagatggctttcttgaaggcaaagcacacacacattttagaagtccttctgcttactcttaggccccctctagtgtttgaaaagctccaggcctcacaggatacaggaggaagaaccaacattgggccaggaccttctaaaacaaaaatccttttgctccattcatgtcaccaagaaaatcaggaccgtgtaaccataattcatatttcaaatccctgctatgatcatctgtctcaccaccctcagacccagcagcctttctgtgatttactgctcagttgcttttagaagacaaagacggaaaattaaagaaaagaagcatatgactcctatggaggctttaatttcacaaaccagaaacacacctagtgaagattaccgtgtaacccgctttgcttatgctgaagtgactggtaattagctcatacttgccgaaggatacacttacatctgttat

SEQ ID NO: 1034 - DNA, 466 bp, Rattus norvegicus
  Genbank Accession No. AI070590
  misc_feature (1)..(466): n = a or c or g or t
tttttttttttttttttgggtaaaaatgaatataaattttattgaaaaagaactccagcaacagcatcctcgacagccagcggcccacacaattcagcacacatgtcaggagaaatagtcacctctgtcggtttacttcacacaaaaggaaacttcagacctcagataaactgcctctgacatcccacagtagtgagctatgcggtcacagccttaacctggtgtttactgccggccaaccagtacggttcaagaattagcggagggagaacccaaccacttcagtaaatatggcaaagaaaaggccggaccactggggtaacttttctccttttcaagtcctttgagaatttctcagagtttattggcaacgcgtcnctcctacttcacaacaggaaatggttcttatatctagctcaaatccttcatgcttcagttaatctatttatgtctctctaatctccgt

SEQ ID NO: 1035 - DNA, 288 bp, Rattus norvegicus
  Genbank Accession No. AI070660
tttttttttttttttttcacattaatatctattttatttttcctgtcttactaaaaattggacttcataaatgcaaggcaagttctctaatccagtaccactttaaagccaatgtttctataagctggagcgatggctcagcagttagggatatgcctattctcttcatgaactttagttcagtttccagtactacatcaagtgggtcacaaccacctgcatctccaactccaagggagctgacactttcttctggcttccacagacaccacactcatgagcacagtt

SEQ ID NO: 1036 - DNA, 247 bp, Rattus norvegicus
  Genbank Accession No. AI070697
tttttttttttttttttacacagaaataagcttttatctggatccgggaaccttaccctaatctttccctcactgtaaacctctgtgaaccaggggcagagaacaaacactgggaagagaaactgccgcctggcaccgccttggagcacaataatcaccgccccagatgcagcctcctggaccaggttcaaggtgggtgttgacgggcagcagctgcagttccgctgtgagcctcgtggtggcagca

SEQ ID NO: 1037 - DNA, 243 bp, Rattus norvegicus
  Genbank Accession No. AI070710
tttttttttttttttttagtttatttatgtatttatttaggcctatgttatttaatttcatatgtctaaaattgtctgcccttctttcattttcacatacttaaggagaaagttgactgagggaataatgaattctcctgctttctcatgcagctcaatttcatgcttggtcagtgacttgatctgctgtactgcctgtctatttgtctgtctgtactgcccaccacgcagtcctgaatgata

SEQ ID NO: 1038 - DNA, 408 bp, Rattus norvegicus
  Genbank Accession No. AI070726
  misc_feature (1)..(408): n = a or c or g or t
tttttttttttttttttgacntttttggacaaggaatactttatttacataaaatgtcagaaacaccactgtatcttttcataatcctctcctggtaaataaagtggggagacatcagtaggaactttaagggtatctaagttgaaaaatggacataggaatatcaccaataagctggactccaaaaaaactctgtctaggattttattagactgctttttttccccaatatacctgtattggaagattgagacaaaaaggcacaaactcacattaaataaacaggtaatctaattagttctataaagtgtagtctgtaaaagaagtagcactaagaaccaacccaagaaagtcagaggtcccagcagggcctgtaaaaggagaatgtggacctcgtgccgaattctt

SEQ ID NO: 1039 - DNA, 472 bp, Rattus norvegicus
  Genbank Accession No. AI070775
tttttttttttttttttgtttcaataagtttattgtgaaattcaaagcttccacgatagcgtcctttagaaaatgaaagcattgcccgggatccgtttttgaaagagcagtgcagtctgctaagtccggctcgctcctgcagtggagcacaagtagataaggatgtgacacgggccaagtctggaagtcacaggaaaggaattctgaaggacctggatgaccccacatgcggcaacaggcttgtctccttgtcttgcacttgcgggccctggacaccacatgacaccaggaggacaggactggaacagccgatgtttccctttgtctgggccaccccaaatgcaggggagactgatgattgaggtcacagaataggaggtcacagcatgggttcccaggatgggatactgctgttggcaggcctcaaacctgcttcagacctgagcacggcatcctgacagtgcaatgggca

SEQ ID NO: 1040 - DNA, 344 bp, Rattus norvegicus
  Genbank Accession No. AI071049
tttttttttttttttttaagatcctacagagatggtccagctgccaggactactttggcaggcagcgtgttacaggacaaaagatgtaagaggagtctattaaggctggacagcccagggttatttatacccccttaagcccaagttcccaggactaaagacccaaaggctgattgactcattcctgattggcttagtggaacaatatcccattccatcatttaccagagtgccaggcattgatggaaggcaatgagccaagaactgccacttccaaggggatagtaggccttgtcacactaagtgatcaaagcccagagggatgatctctttgattcctgtaa

SEQ ID NO: 1041 - DNA, 377 bp, Rattus norvegicus
  Genbank Accession No. AI071131
tttttttttttttttctggtaggtttgtttgtcttcagagttttaatagctttttaggtcagatgtaacactgctcttacatcgttataaaatctggcagtttacagcggaagcaagactaaacccaggctgagaatgaggataaagaaaagcatgagggcatggttcatcccacggcacacggtctcataagcaaatttcctttaaacaaataataacaaagtggacaaaaaggcatccacattttttctaaattaagcatagcacttttttgtttttttttaaataaaccaaatccaatacctctcttcctttcacgtttaagcaaccgttctacatttttataatacatacattattgtaaatatatcatttgt

SEQ ID NO: 1042 - DNA, 504 bp, Rattus norvegicus
  Genbank Accession No. AI071166
tttttttttttttttttctttgggttcactttggcttactgatgagcacagagtgaagaactcgttaccacttaggtttttttttggtacacacactgaaaagatacatactgaagccccaatgcataataaagactgtgcttctaagcctttccagtctgggtaaggtgaggggacgcgctgtgtgtttgtggtgactagtcagccctgtttaccttccaggatttggcacatttttcgtctgcatccctgagtcacaagaatggtgtaacagctgattcctgtttgctgtcaggtccagggacccattcaggggggccctgaaaagccagcgaggcttcgctcagtgctgacaggacttgctgttgaaacagttttttttttttttctaaccgtcccatttgttgccataaccaccacagagttatagtttgacactttgccaagacagcttggaaatttggcttctgacagactcccatgtgcccggggctattgaggatt

SEQ ID NO: 1043 - DNA, 403 bp, Rattus norvegicus
  Genbank Accession No. AI071174
tttttttttttttttttccaaaacaaaaaccaagtttattcagcagacattttaattatgaatcctttaaatcaggaccaccacaatttcagacactccgttgcgaagtctacatcaacagccacatctggaggatgaacaagccattgaatcttaaaaaaaaaaaaaaaaaaagtttagctaccttaaagtttggggtggcacctcagaaaacggtgcccttgggtttcacaaggggaaaagccagcactttctcctcccggaatcatatttttaaaaaaacagtttcagtcaccaagaactgacaggtgaggaaagcgggagactcccaccaactctgcagagggccaaaggaacagaaaagtgtacccactgggttcatcccaatccacacctcgtgccg

SEQ ID NO: 1044 - DNA, 555 bp, Rattus norvegicus
  Genbank Accession No. AI071185
  misc_feature (1)..(555): n = a or c or g or t
tttttttttttttttttgttttaatttggactttattgaaacagcaaaaacataactaatgttttgtggattgttttttaaacaaaattgaaatgaaaaacatcacaaataaatgtcattaacatttctggtgagaaatccagtgacaggaaaacataaacaatactgagcaaagtcttctcccacctagactattcaagatactgcctggtcctgggttgggtttagccatgttttctaacaaaggcttctattctgtaaagagaagattggacagcttgtgtagaacattcatggttactattactatatgttctgtggccacatgcacttaacagccacacatgtgcacaaagtcatcattcctattaggcttagctaacaacaagaaaaaagaatacctttccaccttgttctgcaatgtgacaagcgttaagaagagggaaccaatgtatgtgttcagccattccatatagtcattcctttatggcactttccaggagttaattaaaggagcgccaagatctgcangaattcaagccttacctaaaaata

SEQ ID NO: 1045 - DNA, 401 bp, Rattus norvegicus
  Genbank Accession No. AI071222
tttttttttttttttttggtcaaatcacatctctgcaaacctttagttttgccagaaatatttatgggaaaagaggggtggaacaaaatgacctaatgatcccatctaccttttgaaagtttggttggtgataacagtccacgaaagggctcatggttaggacctcaaaagaggagggaaacttcatgaggagataaagaattctccctaggtagcttgccctgcacagtgaacgtgaactcagaagtatttgtgtttccttccaccatgatctggggaaggcattaggatagaccttcccagaagcttgctgggttttccatgggtaagaagatgaaggaaagcagccccattttttttctttctgcttttcttctttctggcctttttgccctcagtca

SEQ ID NO: 1046 - DNA, 429 bp, Rattus norvegicus
  Genbank Accession No. AI071230
tttttttttttttttgtgtgaaactcataaaccttttattgatatgcttatcatgccaaaaacattgtttattgaagattcagattccacttgagaaagaggcaaacaaatgagagttgaaatcccatcctttccccccaggagagatcccttgtccacgagaaaaaaaaaccataacctacatctacttgattggatccctcagaagtgcattctgggaaatttctcctagagctcccttgtaggataccagtgtgtctttagttggctgcagctaggaacaataaatccattctaagatttcttagaatacctctgggtttgaaactactgaacctcaaagatctaccacaactcgacctagaatatgcatcacttgctggctgtggcatccgccccatacgatggcttcagtctcccctcgtgccg

SEQ ID NO: 1047 - DNA, 442 bp, Rattus norvegicus
  Genbank Accession No. AI071285
tttttttttttttttttaaacaattgtttaagaagtttaaggaggagactgtgggaggaaggaagaggtccagagtctacaagatgggctgtaagatgctcagatgaggcaactccttctcttcctctttgttcatgcccactccctgttctcttccagcctttccctgtaatggtcttaaggtggggactggggttgcctgagttctatgaggtctctttcctaccaggggcacctttctcacgaagaagcaggaccaggcagcccggaaaataatgaggttcctgcggcgctgccgacacaggttctagccccttacctctctggatctctgtctgccctgtcaccttttctggttcatcaatctcctctgactcatctctgtctctccgcagaatgagggaactgaagcagaaccaagagctggaggggctgccccagc

SEQ ID NO: 1048 - DNA, 398 bp, Rattus norvegicus
  Genbank Accession No. AI071429
tttttttttttttttttactgtttcaagcattttatttgcagaatgcagctgaactcttaagagaatgaggtagcgactagtagtcatcttgtaagtacagaaactatctttgaaaggttaaatggcctgtctaagtctacaaaatggcagcgcaaaagttcccacaggcctttcccgcctcaagttttgtgctctgtaggcaccgccatctgcccagtcaatatttacgaggattctcaaaatgagatataattgtaaaatgtatgctagggcccatgacaaataaggcttctcagggagagatttatatatctgagggctgggcagtaggtgacattactttcctattgaaaatttgcatcagagcaaagttcaaatcctcgtgccgaattcttgg

SEQ ID NO: 1049 - DNA, 510 bp, Rattus norvegicus
  Genbank Accession No. AI071538
  misc_feature (1)..(510): n = a or c or g or t
tttttttttttttttttgggattttaaggttagttctctttaacagtctgagctcttcttttctatgaagaactcatctgaaaccagcacatttgacatggtctgggacatacactgtggtttgaaaaaaataaaaggatgattcagttatgtactaatatggtcaatctgcttgtgagaaagattctctcgggagaacacagtgctgtctgcccttcaagtgtggcactggtacaagtggcgacagcacgctgggacttctctgacgttgctacgcattcttcctgtcccagttgtcctggctgtttcctgagctggggcaggagcattctgcaagacagcccccagaagggaggagtaccttcgatgttggggcttttttacttttaacgggacacagaatggtttgtggggcanggaatcaaataggaaactgttttcttggcaaacatagttcattaacacatttaacattaaaactgcaccaagcgctggggacgtagctccaca

SEQ ID NO: 1050 - DNA, 498 bp, Rattus norvegicus
  Genbank Accession No. AI071578
tttttttttttttttttaccctaaagcttgcatatttattgaacaaatacgactaaaatagctaaaatacattgggtacttatggaaggaccacatgttacaaaagcctgcgttttcagcagcgtacaactgcaactctacgtaaatgccacaaatgcacaataccgtttccttgctctatttacatagctgatatatctaccctaacagaggtgggggtagggaggatgcacaagaaactcaggccagaggggaagcaagagagaatgagagggacagtgcatgcgtcattggtgtctaacagtcagaagcgcaaacagttcagaacaaggcctgccctgtcaaaggaagagctaaagacgttatataaaaattaaggtgggctttcagtccggctaacacaacaacattccgtgaagagacggcattgtcagattttatttttgtttatccatttcattgggagcaaggacaaaaatgtaaaatctataccttgct

SEQ ID NO: 1051 - DNA, 316 bp, Rattus norvegicus
  Genbank Accession No. AI071586
tttttttttttttttttctcagtttggtcattttatttttgaacctttgggaatctgcttcataagcctggaactcagcaccataaggttgcaaagcaccatgggtaccgcaagtaaagtcagctgagactccactttggtgcggtccaggttccacagggcattgaagatcctgtgcgactcgctggtgctcctgaggacttgtgtgatgaaggtatcccactgcaacctcagctcttcctgaggatggctcttgtaggccagggagacaggccccatgtagaaatgaaaaaaatccaatgagctcctcgtgccg

SEQ ID NO: 1052 - DNA, 519 bp, Rattus norvegicus
  Genbank Accession No. AI071698
  misc_feature (1)..(519): n = a or c or g or t
tttttttttttttttttgaaggagtctgttatctattgctaaggaaatcttcctggaatcaaaaggggacaggtaaaacagactgagagaaatgaagcacacagacatttctgattttatcagcacagacagccctgttctctcttagcttagtacatgttttagaaaaggcctagtttggtgaacttggcaatactcttgagttccctaattcaagtgagtcatggactctgctacctctcagttcttgcctaggtccctaatcaagttcctcctatatccaggaatcctaggattctaggccagaaaattctagaagttctctattggaatacccagtaagcttcagaaactagggaacggtgactgatctctggttcaaacatttaacccaagcttcagttttcacttattctacacgtttaatgagcaagcactggaaacctaccagggtttatacaacagagcatctctagcagaagggaaaaccatttcncaaacgtctcctcctcacatgat

SEQ ID NO: 1053 - DNA, 496 bp, Rattus norvegicus
  Genbank Accession No. AI071703
tttttttttttttttttctgttacactagttaactgtaaaagtttatgaagaaaagaatccagcagcaggacctaggagcagaacatggcttcccagggaggccaggggcagggtcatttcccaacaacacgctgctgggccgcacccaggactgagggttacagagcagtaatttctgtagaatgtaaacataggtgggtgactacgcaaactgaccagtgattctggccacacatgggggtcgggagttcccagtttctttctgtcagatttcccactgtgcaatgggagtaacttgagaagaccaagccacagaaacaatggtgcctgggaactcgacctggacctgctaggagaatggatggcgtggccgggtgtttgtcggaccgtctgtaggttcgttctccgcgatgccctcaggatacgacccgagagggactagctgagtagctgagacccagcctcttgcctccttacccctcactcgcagccctt

SEQ ID NO: 1054 - DNA, 360 bp, Rattus norvegicus
  Genbank Accession No. AI071935
tttttttttttttacttagaaagtaatttaatgcatttaggacaaaataaaacattcttagaaatgtttttccttttggtttttaagacaggtttttgctgtgtagcccagacaggcctggaactttccaacttcttgtctcagactcccgggagggtgttgcgattataggatgtgagctgccaaacccagatccctgcaactcttagtgaagaaatattttgagagcgtcccaactcttctaaaatactatgttgctagctgctgaggtaaacagttcaatccagaaaattcctgaggcaggtcctgggttggatagcgcccactctgagcaaagtgggtggcaggaccgtctgcatc

SEQ ID NO: 1055 - DNA, 334 bp, Rattus norvegicus
  Genbank Accession No. AI071958
tttttttttttttttttgcataaatgtgcttttatatttttttatgtaattaatcttctgtgacattattttcttctcctattggtgctgatatttgagcccagggtctttggcatgcttgtcgatcattctacctttgggcatctgacacagacagtggctcagacttgggccctatgcatccacgatgtaaagaggcaaaggaactgtcccaaagaggaaggaagctctgggtaagttgagtacggtgtgtagggaaattgttgggcggcttgggtaccagttaagtcgcagggaggtggtgggtagacagatgtgcttgccttgtggtcca

SEQ ID NO: 1056 - DNA, 450 bp, Rattus norvegicus
  Genbank Accession No. AI071965
tttttttttttttttttggcaagttcttttgaagtttattttcaaatagccagtaaaaattgacctgagttcaggatggttatgtaaaaacaaaaaacgtgaactaacagtggtggtgtaaactcatctccgagttcacacactggggaccaagtgcaacggccaggcaagattatacagggaaggagaacaagagtctcagccttcggtgagccaccatgcaaggaaagcaacagagtgtcaaacgggagaagcaacagagtctcagctttcagtgatccaccggtggcccctgagctcctgacttaacagtgcctcaacactgtcgcccaggggagagtccaaacacaaaggaactcaacagtgtcctggtgtttttgtaacacacctcttgctatatcaatatagctctgactgtcctgcaaaagaaataacttcagagggggggca

SEQ ID NO: 1057 - DNA, 337 bp, Rattus norvegicus
  Genbank Accession No. AI072019
tttttttttttttttttaacgcaaacagcatctttatttaaaaaaaaaacaaaaaaccaaatcaaccaacaaaacaaaaaacatgtgcaagacaggagcgtacaggtttttgtttcactgacagtctttgccccatcagcagtgtgttggggccattccggtcttgtgctaaatggattcctccttcaccctggggcatctccttcctcctggcgaggaaagaagcaggcagtctatccccaacctgttgttaagttcctcctctctgtccatctcacctcctgatttctctgtccttggacagacttttctgtcttggccacacacattctactgt

SEQ ID NO: 1058 - DNA, 279 bp, Rattus norvegicus
  Genbank Accession No. AI072036
  misc_feature (1)..(279): n = a or c or g or t
tttttttttttttttttggggttgtgcaaatgtttttatttccacatttatatcacaagttgtccacttactggaccaaatagcaaagttgctcccttctgcgtgaacacagaagtctaggtactgtacattcactaaggctccttgtttttgcaaatcgagtttatgacaaccataaggcaaacgaatctaaaggaatggttatgagtgtttccagcanacagacggctctcccctagcccagcagggcaactcacaccagtagcaccctcgggaact

SEQ ID NO: 1059 - DNA, 454 bp, Rattus norvegicus
  Genbank Accession No. AI072050
tttttttttttttttttcattttttaaaaagttctattttgtctttaggaattacatcagaaacttacatctgtaagtacagaactcaaagttaatttgtagtcgagtttaaaaagataaatagtagagtcagaaatatttaagcaagtacatcaaaccatttattaaacagggctttgtgtagcctcctgtcaagagataacctctagtgcttcagagtggagaacaagagtggctgttgttctgaagtgggtattgctgtgttgctgagtgtgatataaaactccaggctcaaatgatccacgcacttccccttctaaagtgctgaggctaaatggctcagttaattttgggacagtcaccaaggagggaatacagatatccacagaaatagtcatcagaatgatacattatccaggctttgaatacgtttctactatgaatccattttcca

SEQ ID NO: 1060 - DNA, 308 bp, Rattus norvegicus
  Genbank Accession No. AI072063
tttttttttttttttttcctgtccgagcatttattttttttttttttctctgagaacaagcacactggactaatggaggcccggtagtcatggagggcgggcctatgccccagcagcttccgtgtgctgggacgttactgatcgagacaccatcactgggcagcacatggtacacaggttgagctatccacacggtccatgcaatagtgcgtggactgtacataatggacagccacactgtccagctactaaagcaaggggacttgggaggctcactgtgaccacagctaggtcatccatctggaaca

SEQ ID NO: 1061 - DNA, 465 bp, Rattus norvegicus
  Genbank Accession No. AI072088
tttttttttttttttttgggatacgttactatttaattctcacagagaggtcaggtaatctggcttgtgtcacacagcgttcaggtgtgtggatttagagtttgcatacccaaccgccatgctcacctgactcaatggtgggtgagtggagagcctggcaggtgcgaggtgcgtgcttcctgccctctgggggcgccatcctaaggacccaagctcctctcacttccttggtcagcccccaggtccagcctctggaaagtccacaaccttcagtattaaaggaaatgaccttccgggaagacaaggcacgtaagtagttacctcagggaggccagtcagatttcgagcacaatctgttttcatcccatttacaaagcaatggcagggtccctgctaggatgacagacataaaccatgcctcgcttgaatgtattttggcaatgtttgttaactcctcgtgccgaa

SEQ ID NO: 1062 - DNA, 512 bp, Rattus norvegicus
  Genbank Accession No. AI072092
tttttttttttttttttcaaagaaagccatggccaggcaattttatttactttatatatctgcatgtatgcagtctgtgtactacatgcatgcagtgaccataggggcctgaaggggacatcagatcccatgggactggagttacagatgctgggaatagaacttggatcttccagaggagcaaccagtgctcttaatcttcccagctaccactgccacagcccccggatagattttagaacagcactgagtttagcagcattaaatacagatttgtactccccagctctggaaatctcatagccctgcactcagaagccagtatatggatggtgaccttgatcttctccacctccgttgtcagctcctggacttcatgcagtagtcgttggtacttctgctgtggtgtctcctttactcccagaacctctccaagcatttcatagtctccagactcatatcctgtcctcttggtctttccaatgcgatctgagaaatcaagcccctttgtc

SEQ ID NO: 1063 - DNA, 310 bp, Rattus norvegicus
  Genbank Accession No. AI072144
tttttttttttttttttgccttaaaaatacagactttatatatattgtgaccattaggtgctcccaatttcaaatgattacatataagagagatcgaatccttgttgcctccttttggggcaactatggaaaggaacaccatttgtttttatggctgctggagaaaatggagtcaacccaacacttctgatgccttgacggagaaaggggtgggaagctggtggaggggtagcctgtgtgctgtaggctgcaccaggctggggcctgtttgttgccttggaatggcctgtttgctcctccgtaacgccca

SEQ ID NO: 1064 - DNA, 538 bp, Rattus norvegicus
  Genbank Accession No. AI072183
tttttttttttttttttcgcattcaacttaaatgcttttattgacaatgtcttggaacaataagcaaacaatgcttaaaattttttcattcaaattcactttccacatgtcgaaagacctcaggatagaaaaaaataaaataaaaatataaatatctgagaatccatcttaataaataaattgaaaacacaataaaacgttttcatggaaaactgttaatgtcagaacattcagaccacctcaacaatgcatgatcagttacatgacaatgaacatggacgctgaagagctacagtacgtggatatagcgatttatttctatctaccggaaaataaagttctatcttttcttagtttaatattggtcatttctaaattggaacacactattgccaggaacacagtaggtattgttaaaatcagctgcactagatacaatccgaaaaatatccagcaccaggttaattccaataatgaacccaacagattagttaatgctatgagaagactaaggagaaagagaaaagagacacagacc

SEQ ID NO: 1065 - DNA, 377 bp, Rattus norvegicus
  Genbank Accession No. AI072197
tttttttttttttttttgaggaaaaacgggtttaatcaaataacttgaggcgaggagagcgaggagaggtaggagagccagacctcctgggtttgaatccccgctccggtccttcacaacctcgtggtgtctcggtttctccgtttgtagaatggggactctaacatttatccggtggttgtaggcagatttggatattataatacttcacatggtgtctggtacagggcgaactctacatagaagtgtttgataaatgcatacaagcatttacaaaacggtagctggaagaagaccctgggagtctagtgccttggcagcccactgggtcacccagtcctgtgggcgtagctgccataactcagaagacagtttca

SEQ ID NO: 1066 - DNA, 487 bp, Rattus norvegicus
  Genbank Accession No. AI072520
tttttttttttttttttaaggggagcttttaatccatattagaattcagttattgtaacttcataaatttaacacaaaccatcttctgagacatacattctaataagtatatcaacagtattgatattcaatggagagttggttacttgaactcagtaacatttcatttttctgacagaaatctagtggttttccccaattacatatctaaaacattatcttttaagaaaaaaaggaacaaaattaaataaaatggaagataaaaatactctgaagttaaagcaaactataatccttggcagatcaatcaggtagaaaacgtcagtgatagttggaagcacagagtaacggacacgaatctccagcacaaagcacatctttgaaaacacgaacatgactcttcagaggacaatggatagctaaatatccacgtttgaaaaatattgcttaacactttccaaaacacagctgcaagaactgaagaatt

SEQ ID NO: 1067 - DNA, 372 bp, Rattus norvegicus
  Genbank Accession No. AI072594
tttttttttttttttttaaagacaacaaagcgaacaaaacaaaacccccgaaaactagctagatcaaaccacagaataactaatcaaactctcaaacagcaagcttaaaaatagcacacacagccacattccacggcacctgtaaccccagaaccctggagactgaggcagggggaaggagagttcagggtcatgcagccagggggtgtacaggtctcaaacaaaataaaggaatccccaagcaaaccaaggctaagagagaaaaacagaacagagacacagacaatggggcctataggaagacaagagcctgtgggttgagaaagagggagtgccctgcttggttagggcatgagagatcctgttgcctga

SEQ ID NO: 1068 - DNA, 468 bp, Rattus norvegicus
  Genbank Accession No. AI072658
  misc_feature (1)..(468): n = a or c or g or t
tttttttttttttttttgaagcttttaaacccttttattttttattttttttaaataaatgacaaaacttttgattgattcctaaccgcccagctccctcatcagacatttgggggctggagtttggcactgcaggagtgtaggaaggaatggagccctagcagtatagcctgggattagtcctctccctcagagcataaggtggcctgtgtcaggaaagactggactaatgtttatgtgccacacaccaaggcaaacctcctggccaataatgtgtccaagctggatgcccaccttacggatgagggagggtggccggcttccaggagctttgggcctggacccatagacccattgccaacaagagtcatgtgcaggattagaacccagagctttatangggtagctacgtcncggaccccagagactatacacagggctttttagtgttgggtttctgttctctct

SEQ ID NO: 1069 - DNA, 307 bp, Rattus norvegicus
  Genbank Accession No. AI072733
tttttttttttttttttgccacctgctgttttttatattccttgtgacagacacacacacagctgcacataccgtcggatggctgaggggatggtcgggacaacataggcaatagggattggatagaaaggaaactccacaaaaggcaataaataaataaatacaaacgggaaggagggcaaaggccatggagaagcagtgagaacagccctgggccagtgtagaatgcccagaactgcgtcggctgggacaggagaccagccgcagtggcctcaggtaaacgtctctttgcctttctccttgctct

SEQ ID NO: 1070 - DNA, 335 bp, Rattus norvegicus
  Genbank Accession No. AI072738
tttttttttttttttttgacacaaaatatgttatttattgtcaatttctgcaaagacacatttaagcaacaaaatatacattttcaaccttttagaatttgttttatacattaacaaatacaatgtgctaccatagcaataaattagatgtacactatttacatcacataggcagtcaggatctacaaatcacccccctcactgagaggaagcaaagaaaagtcatcgtcacaggggtcacttccaactacacctcttaggttctaccacatgggtatctcttcacatggcaacaccggcaccctgggagctggagatcgggcggggacatcacc

SEQ ID NO: 1071 - DNA, 324 bp, Rattus norvegicus
  Genbank Accession No. AI072744
  misc_feature (1)..(324): n = a or c or g or t
tttttttttttttttttgttacggactccgtcttcatgttgctccccaagtggctacctcagcccctctattgtaaactaagatagggagggcctatctgggtgagggtaagcgggtccctggattgccttgggtagagaggacaggggtgacccacctggggcctaagagtgtgtggagtgactggggcctaggctgagatgttctggggggggcattgtcaggggtcatggcgacctcaccagcaggccagtgggggaggagatggggggaaggccangggtggggagaccctcagatttttatctccgtccggaaggtctg

SEQ ID NO: 1072 - DNA, 381 bp, Rattus norvegicus
  Genbank Accession No. AI072835
tttttttttttttttttagcaatcccaaacaattttattttgtatcacaaaacaggcaaggaggcatagcaggtgtaaagtcaagtggtcacaggttctgcagaatcttacactggaagaagctggtgcatcttattggcagatgaggtgaatatcatggtgattcagtggttggaagctcccactgtgcatgctttggaagcagatctataagctgattcgagtccacagtcacagtgtaagagatcagtggtcagcttcagcatagaagacactgctaatgttttaaacccaagcgaaaaatagtaattttgtgaacttttgagcagttctgatattggatttgcagaatatgataaaacaatccaaatgatgttccag

SEQ ID NO: 1073 - DNA, 350 bp, Rattus norvegicus
  Genbank Accession No. AI072841
  misc_feature (1)..(350): n = a or c or g or t
tttttttttttttttttggtgtgagctctatggaagcccagaacgtatctttaatctttaatgtgggccccgggccctgcctccccaccccagcccagatgacatatttacaggatgcggagggacccaggtccaggccaggtgaatgcagccccctcctctcttctttcctgggtgctgccaggtcaggccctgctanggtanggcaggaggatgcaggaagttggggcccccgtggggactggtcacaggaagtgttgtgttcttcaccaaggacacatgtggtcatgtccttgtatgcagaggccttcacagtggtacagaggtgtggattcacatgtctgcgccca

SEQ ID NO: 1074 - DNA, 262 bp, Rattus norvegicus
  Genbank Accession No. AI072900
tttttttttttttttttcacagtcatccaattttactttttaaaccatggctgctagattagtttttcatttcctttacacatggcttctttcttgtcctagctgaatgcagccaagccgagccgagccgctcccacacatctgagctgagtttccttaatgaacaagggaaaggcagcatccctagagcacaaaatgacccgcccaagccttaattcaaaaaactccaccctgtagctcaggcttatgggaaacttgtgtc

SEQ ID NO: 1075 - DNA, 488 bp, Rattus norvegicus
  Genbank Accession No. AI072992
tttttttttttttttttcttctccctggtacacgtctttattttatgactgaatggagcggcacacacttaacagattattcccaaactccatttcattaaagttttagggaaaggcaaaccaaagtcagtctcaaaatcagacagtctcaaaaaaccaaccaaccaactgaccaaaaaccaggtaacctcaaacacaatggcacaacacctcatgtgtcaggagagctagacagtttcttcaaaggactgggtctacagttcggtgattgtaaggtgatcggcagacaagagggtttaatccttggcatgggggtggggaggagaaagagaagtctctcatttctcctgggaaataaaatggcacggcctttgtggaaaacaatgtggcagtttctcagagttaagatagaactatcacgtgagccagcgatcttagtctcaggtagacatctaagagaactcaaagtagggactccctcgtgccga

SEQ ID NO: 1076 - DNA, 282 bp, Rattus norvegicus
  Genbank Accession No. AI073040
tttttttttttttttttagtgttgcatagctcggacgcttttatattgatcaagttatttttcagtagagtccctgacaacaagtcagaatgaaaaacattccaaatttacaggaacacatattgctgattgactaaagataactttacaaaactatggcttagcacagtcctgtggttgctccagtggtatgagagctatcaagcaagcgacattgctattctcagtcttcggggtttgattgctcaggctgagctcacaagggacttggccgtcttttct

SEQ ID NO: 1077 - DNA, 276 bp, Rattus norvegicus
  Genbank Accession No. AI073109
tttttttttttttttttggccataaatacactttatttcattcgaaatgcataatcacactgggagcactccctttggagcactcctctagcagcaggtccgaagtgctccagcatcgtcagctggctccaacacctacgtcaggaccccaagggagcacacggcccaggcttccactactccacagttgtgtttctgttctggtttttgtttgtttgtatgtttggggtgggggtggttgtgtggtttttttttttccattttcttttttgttat

SEQ ID NO: 1078 - DNA, 478 bp, Rattus norvegicus
  Genbank Accession No. AI073135
tttttttttttttttttgtgagggttccacatttatttcacagggcatcagcagggcaagaagaggccacagagctgcagcaggtggctggctgccctgggctttgctgaaggccattctcagccatgacaactcaggtctctggagccagctccgacttccgggatagaccaggcttctcttaagcaacagccagagtctgctaacgtgcctgtgggattacttcagcctcctcaggctgtcccatccctgtaggcagcagcttcaggtgaccccacacaatcacatacagtttctggggaacatacaggtccggggaaccccagttttaagacacttaacagaggaggagaatttcctaccagaaacagccagaatattcttacacttgttcctgaatctttcctttctgaatctctgagggagtggagcctgtttataaaacttaggctgcatctggtcatttgtacattgtgga

SEQ ID NO: 1079 - DNA, 399 bp, Rattus norvegicus
  Genbank Accession No. AI073207
tttttttttttttttttactacaagtaaaatcaagtttcagtcctaaagaacagtcctttgttctctactagcccagaatattattttggcatggtcataataacaaacaaaattaactactatgctaaatgtttgcctttgtgcaaaattaattacatacaattcaatgctagccatacaacatcctacctatgcagcacagttttttccttaaaaaaagaacaaacaaacaaaaacagaaacaaacataccaatgagagcagaagccaaagagaagtggggaagcatgaggagaaactgaggagagagagtccaagaaatcagtaagacataataaatactcatcttgtttttgaaaagtgacttcctcctcatatgaaaacaatgttcgagaacaa

SEQ ID NO: 1080 - DNA, 473 bp, Rattus norvegicus
  Genbank Accession No. AI073212
tttttttttttttttttgtaggttttgcgctatataatagcacaagtattgtattttatattattttctcttaaaacatacaaatatggtacaatacaatttattttaataaaatgccaaccggtatagtacaacaaaaaaaatgaatttaatacattaaagatgcaatacattataatattaaaataccacacaggaatggcagtacccccagggccccaatgagtacagtgtttgtttaatgaagtagttattcagtcctgctgatgtggatacattctagtgagggcgtggggattggatcagggcctcgagcccaagggaaaaggacagaaagggtccctacggtctctcccccggaaccctccccaaagtccacttttccccatgtcggctgcaaatcctatgaccgacatcccaagggtatcacttacatattctgcacccttgtctgagctttctctgactagatt

SEQ ID NO: 1081 - DNA, 334 bp, Rattus norvegicus
  Genbank Accession No. AI100841
acgttaacaaggaaaaatgtttaataatgaacatttctgacaattctgaactctagtatatatcagaaaacaatgaacaaattatttttgacaagtagagctgaaccgagtgcaaccttacatataggaccccacactccatggagtcaccacaccgaccttcccacagtacattcctccttcaatacactcttgactacagaagtaaagggaagctctgacatgaatcctcctgaaggttacatcagcacagagtacttagtctaaagtttaccacagtgtggaggaacccctcagacattcccacagagtactcagaccctgcccccagccc

SEQ ID NO: 1082 - DNA, 289 bp, Rattus norvegicus
  Genbank Accession No. AI101099
  misc_feature (1)..(289): n = a or c or g or t
acaccattgtgaggacgcccccacttcaggcgcagcagctgcacttgtccgaagcctctttgcagatgcagccctgggagcacttcgcacagcccacggggcagcaggaacagcagcctgggggaaaaaagttgagcgtgagcgagaaaccgagttagaggcaccctggacgctctgggaaggtgcggcgggctagggaccgcaggggcgcgaagggaaagggtagagaaaataaatccaactcacttttcttgcaggaggtgcatntgcattgtttgcatttgcagga

SEQ ID NO: 1083 - DNA, 473 bp, Rattus norvegicus
  Genbank Accession No. AI101229
aactctgttgatcacacaatgtcaaacactagaaaaacgaagccatacatgttgatagagcaaaatatatttctcaacaactcatgaaatttgtctcacaaagtatggcatagaacagtcacagtattaagtattcaagtaaagttgtgtgttaaaataggtgcacaggggtaataaacactgggatctggccttcagagaggacaacccatgggaccccatttgaaggttgttacatcacagaataggcttgcttacattgtgcgtctgatctttattctcctacacccctcccccccagtcctgaagaacaaagatagagaaagaagaatcacttgctacgaggccctgcttcaaggtccctcagatggaaaaacagacgaactctggtactttagtgagccccactacctgggagacatgactatcaggcttatgtcatttgagttgataattactgccaagaagtcctg

SEQ ID NO: 1084 - DNA, 426 bp, Rattus norvegicus
  Genbank Accession No. AI101270
ctcagtcacacacacagtggttttattttttcctttggtgttgtttacagtgtctcccacaagagaagagctcccattggcagagagggtgatgagattcattgaaccagtggcaagaataagtttctgaacagaaggccacggagccatgagcaacagcttgcccgtttcctggcctccaggactcaaactgggagaagagaggaggccactaaatgagatggagaacttcagaactctggccttgctctgctctggggagacagtctgagggaacatgccgggttaaagcctgggttttaagggaacactctgagagatggggtaagataaaacatatcagtgatgaggggtgtgtgtgtgtgtgtgtgtgtgtgtctctgtaggttacctctgcctgtctctcaactctgacttctgagtact

SEQ ID NO: 1085 - DNA, 534 bp, Rattus norvegicus
  Genbank Accession No. AI101330
attaaataataaacatgctttaatgccaggcaagagctacacaaccaactgataacggggccactccacatagcatgacatctatattattaaattcatctgtagacagtcccccggggagtattgctggggcgggatagtacccacagcatcccttctctatcttaagcgaggtatgaacagtcaggcattctgaaacatccttcaagtcataagccatttagtcatttagtccagtcccttgacagcacaagctgcctttacttggaacaaaacaggctccacttctgccagagatctctgaacaccaggaaaacaatgcctaggcacaggagtgacagatgtcttcaggcacttggccctcttgatgctgtgaagtcccttggtcaaacatacatgcataaaattacacacatccaatgccttcctggggcaaggtggggaggaggaaggaaacatacagataggtctgttaagtctgtgggtaaccacttctgggactcttcatgctttctggtgaccacagggttcgta

SEQ ID NO: 1086 - DNA, 508 bp, Rattus norvegicus
  Genbank Accession No. AI101338
gagccttacattcctatttattttattttatttttacttcaaaagctacatacatacaaaaaattgaacatgttatcacaaatgctttaaataaagttcaaaaataaaaatttctcaaaatttatttacttatggaaatatatatgacaattaaaatattgaagtcaattatatcctttttgctaatctatcagaaaatacttatattataaaaaggaatttcatgtctagaataagttttaaaatccttgagttatagttttaaaacaagtttagaaactgttcaaagaaatgcacgtcatttagacaaacacgtcctgagatttttctagaaggatcaacaccctgatgagtgaaactgttgagggacttaagtttggaaaagaagtacctcttaaactctgacagctaattatttttgctgagtgtttagcgatgtgtaagtggagggccacgacttttataaacagatgccgatgaaggccatctgaaatctctgaatggggaa

SEQ ID NO: 1087 - DNA, 391 bp, Rattus norvegicus
  Genbank Accession No. AI101362
tttttttttttttttttttttcattttctattttttttttattctagtactacagtttacagccattagatgatcaacaacaagacatcactgtttggaaatccatttccagagccaccctcaagttcagagcaattgacgtcgaagccgctgcctttctttcctaacactctgcctttcacacacagcgggagcacgcgggagcagctccttctcacatgggcttctcacgatttcctggtcctccttgtgctgcaggacgctggaggacattccatactactttgtttctaaggactttaaagaaaggaaggatgctgtttttctttttgtccaacatcacgaaggcaaaaataaattgcaagcagcctcggttactcagaacagaact

SEQ ID NO: 1088 - DNA, 477 bp, Rattus norvegicus
  Genbank Accession No. AI101494
cacggtagcttttattgccaacagacttacatctatagtcactgaaacaattaactatttaaaaatggttgcttctctcaatcgtcgagccgtggttattctgtgtgctgggagaagagccggtcacagaaacataacgaggtgcatcttctagaaaacgtctagctacaccgcttgttccatgctttggggactgtatggacggacgcaaaaacccacgtggtcttagtgtctaagtcagagggccagaggggctgctctggaatcagaagtgcatgggtggccgtcccgctgataaaggcacgcactccagtacctaataatgaggacagcagcattgtctagagttagcctgccacctgccatacctgggccacaggaggggatgttatatgctgcctccacttggttatcccagaagcttggctatggcgtgccgggactgtggtgaaaggcatgagaccagaagcaacaccg

SEQ ID NO: 1089 - DNA, 590 bp, Rattus norvegicus
  Genbank Accession No. AI101500
ttttaaaacctttattcatcactttaccaacttgacacacaatgttaataacagcaaacacaatgaacgaaatgttgacagacacaagctgttcacaaaagcaatatgagccaggccatatgtccaactaggtgactggatgccttgcactataggagggacagcagggccatcctgacctgacattctgagcaagcgtggtttagatgtcagcataagtgtctttgagtcaggacacctgtgacatcaacattacccatcacactgataaagtgataaactccatactccctaacattaataaaatagtgtaaaaatatatatcacatatatataaacttaactccctttcttgaaaaaaaaaacttagtacaaactagtagtaatagcatattattcctttcaagtttaagttgtacaggcttcctttgttgtttggcttggtttagttaagaagtctaaaggaagagataatttaatcatcccaagatggccacacccctaaactgtaaagttcaaaatggtcagtagtatgttggtgaggaagagctgtttggctcaatgttggaaggctattctgtctactgatg

SEQ ID NO: 1090 - DNA, 492 bp, Rattus norvegicus
  Genbank Accession No. AI101659
aatttagagaatactttattagtttttgtaatcaaacccacgtagataagaccttacatatttaatacagggtgttacccctgtacaaatggaaaaaacttaagttcaacatttctagaccaatatggctgttaatttctgtacagtgccaactcaacacagtaaacggggatacttttttccaaagttgacagcacagctaaagtttcaaaaaattcaaattatatatctggatatatatatatatttatatctatataaaaagaccaattatagcagtgtgttatgcatcaacagcagcaacagcttttccaggttctgcagtcatctgaacaaaactgtagagacatccagcacactccattaaaaaaaaaaaaaaagtaaaaaaacaaaacccgagaaaacagcacagttctgttactcttgtggtacctggcaccattttttttttaaattagcttctcaatcatcatctggaaagaaaacattctg

SEQ ID NO: 1091 - DNA, 458 bp, Rattus norvegicus
  Genbank Accession No. AI101847
agacagtcacaagattagatttgctggtcttctagaacattctctctcctagaccagaagcaccaatagtacatcccagaataataagaagcttgagaacacagaaacctgaacaactcttttagggtctttgtccctgagtgtcccaggaaatggtgaccccccccaacactttcataattcaaagtatatcttaagagcacacccaaatattcttcatgtgcactgctgtacaaaatgcagtcatcggccataaaaataatatttgcccatacacaaatgtaatcccatgtaaagtaaatttggaacacgggtagggaatgctatggattctcttgggatctaagctttttaaagtcaaatttgtttgattatccctctgctgggtgtagaaaactggctatgaatgcatccatcttccagtgagggctcagcacttcaatggctcctgcgtcatg

SEQ ID NO: 1092 - DNA, 486 bp, Rattus norvegicus
  Genbank Accession No. AI101851
cggctgtagacatttattgatttgtctgttgcaccaacaacacactgtatgtacgtcacagaaaacagaagaaacagaagaaaccacagacatctgcttgggggccttctttggtccttagtcatgtatcatacactttggcaaaaagcctagtttacagactctcgttggagacctaaattctaattctctgtgtagcctggcaagggagactcccaatggcactcattagttggtctaaggacgagtctcccaaatgtaaacatttgactgtacaagtgtgccaacgaatgacaggtcttctaagatcccctatccttacaacatatacaagtggaactggagacaaacctcaccatctcagggtgttaggtagcctcaggcagaggggctacaccacagctgggagaagagacattaccagaagcaggacctaaagcacagttattagaaatctgactgaaaaggccaacctattgacctaaa

SEQ ID NO: 1093 - DNA, 484 bp, Rattus norvegicus
  Genbank Accession No. AI101921
  misc_feature (1)..(484): n = a or c or g or t
atttgatcattttaatatgccagaccaatttacagaagaggacggagcacacggaaacacctgtatttgcagcacggagggcagatgtccgcagccctgggcatgcatgtatctcctgtggaatcaggcaaatcacgaatgcataaataccacagcacagccagacttgggggtggggtggggtcacaggccacaggggaccatgcttcaaaggcagtcagaggcattaaatacaggggctaaacgttagagtccatctcaccgtacacataactcatacattaaaagtaaggagaccacggtatgtacgtgcaagcagctttggtcagagaaaatgaacaagggaggtggagccatgcacaggaagggcttgcctgtctactctccatcttcttcatccccacaaagtcacctgggatcatagaatgaatcanctggtctcggtaggatactgaaaagtcgtgtctggtgtccttaagggcct

SEQ ID NO: 1094 - DNA, 499 bp, Rattus norvegicus
  Genbank Accession No. AI101924
cggtcccggtggccgccatctcggtgtcaagagacggttctgcagtttgagtacctgcagcctagaaatgtttcccacactcaacctctggctaggaggctgccaaaccacaggcttgcagagagacctgaatatccgggacctttaccgcctcctctccccactcgcaggggcctgcaagactgtcctgctgtccctgtatctgtctccatcggcaggctggtgatgcacaccacagcgatgcacgccctcagagaggtccactatggcagcaatattaaaaagagcttgctttcattagggagaaaagggagcctttatctcttcttgacctattcgcaagcactttctgggtcactcgggtgacctgccctctgtcccacttttctgaagtgaccgttttgctccatggctttttcaaactctaatcttgcggtcacaggctcattacaacagctctggggaccacagttccatcaaagtctgggaatggggtttg

SEQ ID NO: 1095 - DNA, 473 bp, Rattus norvegicus
  Genbank Accession No. AI102007
gggcctgggccgcctgcccgttcttctcgtctgaaaaaagttgtttaattacgtcaaagaagttactcaatggggtgcctgggtacacagaacagaagacaaaaagagagaaaaggaaaaaaaaaaaaaacggggcaaggggagagaaggagaaaaggagagaaagaacaaacaaatgaacgaaggagccttgacaagagaaagaaaaacccaacgagatgaagtcagatgggatggtaaagcaaggacaggcaggtagcaagcagggtgggcaggcggccagtggggtccctagtgccaggagcaatgcagtgggagaggctgttgctgtgggatagaccctcagacctccatacctccaaagtggcatgggacctgagggctgcttctgagaactgaggcccaggacaggcagtgagattcctccctcacccagtgtcaccctcgtgccgaattcttggcctcgagggcca

SEQ ID NO: 1096 - DNA, 610 bp, Rattus norvegicus
  Genbank Accession No. AI102046
aagaatacaacagttttattaggaatgttacacgttgggaaaatccagttcagggaggcacggggcaaaatggaacattgctcaagtcctcagcagggcaacagggcctgtggagatatctaaatggaagtactactacagtagcccaggtgagacttgtggctgcttctggtgaaataatttttgtctaaaagagcgctccagcactggtgaatctgaattccaggtaaaactgtttctgacagagaagcagaggacatgttggaaacagatggctcacacccagacagtgtgcaggtgagagagggaccctacatccctcaccctacacaacgttgacaggaacagcagatggatgctggctgaaggtacacaatgtttaggaagtgactgtcatagatgtgtggccctgtgccttgagaacttgactctggtttccagcaggtcctgagcaatactgatattccttcctgaggcccatgaagagtcactttagttctgttctgactccctttagagcagaaatgagcatgtccaacacaggttctgggtagtaatagctgaaaggaccaggaatgtcccgaccatcctgagacgcctggggcttaat

SEQ ID NO: 1097 - DNA, 675 bp, Rattus norvegicus
  Genbank Accession No. AI102061
tttacaaaatgtattaaaactttgtacaatacctcatggcaatgaggttcggtaattatgcccacacatgcaatttacacttttacggccattagtttgcttggcaatttttctgttcattgaagtacagctttaacaacaaaaagaaaagaattggaaaaaaatcctcaattgactaccgccaaactcccatagcttgaagttaatagcagaaatttgaagcaatcaacatttttttaaacatgcaagtttttttttaaataacaaaccaatttacccgcttcttaatctcagtaaagtttcctctctgaaaaactgatttgagtcaataaacatacatttctctttatacagtgcctatgaaaagtgtttgtgtataggtcggttggtttgctttatacaacttcatattcacacagcgttagcttcccgcactgggacaattacagcattcataagttgaaagatcacagtttcatgagaacaaaacaaaacaaaacacaacagctttcttttgtgttcaataccatttaaaaatctgacaggtgagttatttgctcatgacacactttctggaatgaaagtttatattacacctttctggaaatgtttcactggaacgagacctcttcctttcttttctaaagacgagaacaaatgtgcaacgagtcaact

SEQ ID NO: 1098 - DNA, 502 bp, Rattus norvegicus
  Genbank Accession No. AI102248
ggtgcataagatttgtttttgtttttttttaatatataaaagattttttttcttaaaaaaaaaacaaacaaaaaacaaaaaagtggtgctctttagaaacacttgcaggaagatcaagtagtccagctacagctcgcaccttcaccttcctcctttcgtggggaccaggagctcccagcctgaccccctctccaccattctgtgggcaatgggcactgcccatgctgccactggccgatgggacagcaaacagctgaccctgcttggaactgttggtggccagggccccctctggatgagggacatagacaactgcttggtggctgaagcagaaatccctctgccaggtggatgaggtagtgttctgggatatggccgcctctcccaacatgtgccaagccgcctgaaacagagtgagcgggcaggcacggctgggctgtcctggttggcagggaaagtcttatcagggactggcagcgatcgatagtcaaggccttcatcc

SEQ ID NO: 1099 - DNA, 686 bp, Rattus norvegicus
  Genbank Accession No. AI102486
aggaggaaaatttttataagtgactcatctgacacaaaggaacttttatctagaatgcattaacaaacttgtaaaacttcataatagaaagacggacaacctgaggggcaaacactcttaagtctctgaagcagatacacagcaaacatgagaaaagatgctccctcgtcagccgtcaaggatggcaactgcaggtcagatgagacacactccagtttcctcagtacggctagctgagagggcaagtccccaaagggtttaaaataattatcatatgacctggaaaacagactccaaggtatatgacagagaatcaaaagagacacatccacacaaaacttgcacacaaatttcatagcagaactcataatagctaaacactgcaacaagcgaaatgtccaccaactaacaaactacacagcacattcactgcacacgatagtcttacaatgggaaggatcgagtcaggtacaagttacagaaagaatttgtgtttacaaaggctctgaaagaaacatgtcagttgtgggtcaagtaaaatctttctaaaagattctaggtcattaaaattaccctatttaaaaagaactaaggtgaaaattaaaattaagagtaacttcagggagagtttctttagagaaactggacacatacatcatagcaggcataccttttcacacccgtgg

SEQ ID NO: 1100 - DNA, 536 bp, Rattus norvegicus
  Genbank Accession No. AI102505
gagcaaggtttaaatagactttattgttacaaagggggaccccatcaagcagaaccaatatatgtggtcccagttgtcaccatggagacatcgagaggtcatgattgcagaagaggtgactggaattgaataacatgatcccagggtaagccagccaggaatgcaggaaacatgatcaaggtgggctggcaagagtggtctagtcaaaggatgagggaagacgctcccttcactcccgcttcttgtagctttccaggtgtgacaggacccagcccgcaggtagaagacaacacacgaagcaggaagtgagcccaatggtgatatccaggaccccgagctgctcccgcggcggcttcgagtggacctgagcccgcggcaccataagccgccgggccgggccggtcaggctcctcagcagcagcggcgtcagggaagacatgacggcgcggagtgaccaaggacaaggaccagccgaagcccaaggtcaggaagtcaacctagtgccgaattcttggcctcgagggccaaattcccta

SEQ ID NO: 1101 - DNA, 631 bp, Rattus norvegicus
  Genbank Accession No. AI102519
gctccgtcttttatttggggacagaaacggtacaaggtcagatatctcccagagggcactctgtggatatttattccagcgggagtcctgatcccagggagggtttgttgagtaagcgtctggaatgagtggatccgggcatcaggttgttggtgggcatagggtgggttcatctgtaatactgcctctgtgtgttgaggtcactgtatacttctggcctctgaccctgaagctcctgataaggtgactcagtctcagccatgtgctgtttccgggtcccgtctgcagtccctcggcctcgagagaccaggcggcccagagagtacaccgccagggcgatgagcagagtcagcaccaagtcgcccagcacaatcccagccagtacacccgggctcacagaggaacattcgcatcctgggtaattgtctcagaaggatgaagagggagacacaggttaacaatcagggctcggcgttagcagagagagagagctagaaggaaaaggggtagcctgaggaaatcttgagaggaagagagaaagaccaggggtgttatggcttaccactctgggcctgtacgggacttaatcctcccacagtcaggaggacaggaaggaacagaaagccccagg

SEQ ID NO: 1102 - DNA, 599 bp, Rattus norvegicus
  Genbank Accession No. AI102520
aaggtaagcaattattttatttccctggcctgacagcaattgacttcaaagtcccagaacctgatgccgacaaagcgaacatacagatagctcccaacagggaggacgctcttcatttgtagagatgaattgaaatgtcatgtgtgaatgcgattcctgatgtcttcaccttgcgtctcctccatggttgggagccctccctctggttccccaagtcccacacgcacccctcccctacccccaagtccaggtgctcccatctgctgggcttctgcctcatttcccatagacactttcatcactgtaggccacatacagaaaatagtcttcctcgtggttgtcctcatacagctgtcccatggtagcactggtgggagggatagtgttgttgacaaagaagaataaggcgtcctcaggtctcaggtggatcctcttccggattaagaagtagaactccactttaacgccatccaaactgctggcaatcataaccacattccgaacagccctattttccaagaggactccatctaaatgtccgtgcgaatgtctactgccacaactggggcggtgctatgacacctgggcggaggaaaagg

SEQ ID NO: 1103 - DNA, 544 bp, Rattus norvegicus
  Genbank Accession No. AI102524
aaaaaccaactactttatttattggtaaacacgaaaacttgactcggagcgtatggtgccgctccagtggggctctcacgccggcacactacacacgtatgctttgtaacagaccgctgaggtcacagcaccaggaaagaaaaacacgagaaggcaaagtggctgaaaggaaaggatttgtagatttcaactttgggacttacataaccagtaaaattaaaaaggcaccaaatcagggtttttggagactggcagcaggggacaaaggccagtcaacccagatccccaaacaccatcacttctccaatagctcatgggacccccaaaagacatggaggtgcctgtaaggcagtgtctgacacagaagctgcagaccttgggtaaggcagcaaaggaccctggctgggggcagggaaggaagccgatggcccagtaggtaactctttgccccttgctacccacttcttggtcctgaattcccaccggtagctccagctgccagtgacatggccccctggcacattacaggcacctttaaggagcc

SEQ ID NO: 1104 - DNA, 625 bp, Rattus norvegicus
  Genbank Accession No. AI102560
atgtttaacatagtgttatatttggaaaagcagatttaaaaaacacttgaaaatacaagataaggtaatggttacttacgtaagttttaaccttatattgcttggccatttttttttacatataaattattgcttcctactttgataaatacacagcacagtcatatacacagaggcagagaacatgaactatgagaaaaaaaaatcaaacactgtcaatggcagtctggtaagtcaacgaatgtttcatatttaccagctcttataatggtggaaaactacgaggtgtagtccctgagaagttaggtagatgcccggcctgtgggctttctatcttctaattgttatcccaagctgacagcatcatggcagtcctaagcaatgagacgtccaaaggcaagagtccttgcttctggtcattgatttcatcctggtgtttaataacagcgtaatacgaatacaaataaataggctatgcaaataaatattcctctgctaaaaatgcttacttagtatatacagctttgctttatacagtagtacatttcttccgactttttggcaattttcaaaatgggttttccctagagcaaaacgggcccactcagtaatgagtgggctgaaa

SEQ ID NO: 1105 - DNA, 478 bp, Rattus norvegicus
  Genbank Accession No. AI102578
gaaatgttttatatcaagctatatatatatatctggattctgtcctgagtacatgcatacaaaatcaacactataaaaataattcacaatattaatgtcatcgacaagttaacatctacaagcatacaaaggctgtgtgcattgcttgccctggccagctcggtaaagcaagtacctgggaaaggggacagaggagagacttcagatcccagcctcgaaccatgaggaagcaagcctgggtcagggctgagcagggctttcatggctggagggaatgggataagtgaggctttgcccctggccctagggagctggatggggctactcaggccgttaaaaggcagactacagtgtaggaaggcaaaggtcgctctacccaagacaaataatcactggcaagaaatctctcacatgctcacacgtcaactccctttagtggggtctggaccccactggaccaacatctgtccaatcatgg

SEQ ID NO: 1106 - DNA, 531 bp, Rattus norvegicus
  Genbank Accession No. AI102618
gggggggaaaaggtttattttttcctcagaagaaacagactggggaacatttacaacccacattaacttgcagttggtcctaaccctttcgggaacaggtgttaaaatgttaggtgctctacggaatgaaggtgttcaccccagacagaatgtacatggacgatgcttgaagactgcatgttttttccctgagagacgtgtaagacaaacagaatttgctgagagccatctttccaaacagcccctccctcttcacactttggaggatgtgcctcaactattcatctagtcagcactcagaccacatgctgctttccttctaaatcaatccctttcccaaccatttgaactctccaagtcttcatagccctggaccgaaaatacctactaagatcctatctgtacttcagctttcacaccttgtgagctgggaagtcaggctcctagtaaacaaaacttccataactggattatgaggccaaccttttagttaccttaacctatagggtttattcaactacataaagtgct

SEQ ID NO: 1107 - DNA, 523 bp, Rattus norvegicus
  Genbank Accession No. AI102711
acaaagaagcaactttattactcgttcttattactcattcccagtcaggttctcttcttgctcttgccagtgactttggccggcgtgagggctggagctgtagcctggtacagagtggaggatatcttgttgatgtagtacagaccaaccatggagaagatgaagcaagtggtgacacagactcggtggatgaggccagatgcgaagagtgccaacagcaagcagaggagaatctcagggaagatttttgcttggaagcctttaccaaagaccagattctccagattattgaaggcagttagggagaagacgaaaaggccggagcccagcaggcccccctgaatggtgagccactcggtggaggccaactggcggctgtatatctgcatgccagcgaagagcagcagggacaggagggaggacagcgccaaggaggtcccggtaccgactaccatcacgccccgtccgtgggtccaatccgtgcctctggagaaagaggggagccaaagccggccctcgtgcc

SEQ ID NO: 1108 - DNA, 564 bp, Rattus norvegicus
  Genbank Accession No. AI102734
gaagttagaaaagtcttttaagtttttaaattaaaattgcaccctggtgcattgattttaatttgggaactcaatccaaggcagtttctccttagtggtggccctctggccctggacacacacacacagactgggggcccgcagaatagctggaacagcaagggatgggacaatcaaatatccattcatcagagggcagccaagtcttcagttctgcacaccttgctggtgattgggtgacaagtttcagagtcaacaagaggccaccaccagcagagatgaaaattgtctaccagtaatggggtagaaagtccatgattctgaggacccttctgggaccacctcccttgggggtggagcttttcaatggctggtgtgccttctccttcccagagtagcacggctatccagctgcatgctcactccatctacgatcaccctttgttccccacaactgggcagaggtgagccttgccctttgactggaacatgtgtataggccccactctcttacaaacattagctaaatttatattcatatattattatagttatttattaaaa

SEQ ID NO: 1109 - DNA, 691 bp, Rattus norvegicus
  Genbank Accession No. AI102745
  misc_feature (1)..(691): n = a or c or g or t
gagagttgaaaagagctccattttattacggaaagttacaaaaaacgaaacaaaccaggcagctgaccaaggagcaatggggagaagcgaggcgcctcctgagcgccccccacactgcaattcaattcaatgtgaaccacgtggaggaacagaattaaataattttcatggggttcaggattaggatccccagcctgccctcttgggggaaaccgaggcacagtaatactgagcaaagctgaagaaggttacacaccttcccaagtcactcacaatgaaacaaagggaaggtggaggatcccacaggggctccgcgggtaggcatggcttgtaaacctgggactctgcaggtgggattgggagctagtgggtatgtaaaccaggctgtgatcaagagggaagctgtaaacaaaggggtagtgacctagaaaagggggtgttcgtggatggagcgggatccccggagagtggctgagctttaaggaaggctgtgaggctggaggtgctccatctcaattccagataaattctgaattccaacccaggacttgatgctcactcttagctcaccgaggatgctccgcccaccgggaactttgggttaggggtcaatttaggctagcggctccgncccaggaacangatgggaaaagcaagtccgaattcgctcgcttgtcgcccttccctgcca

SEQ ID NO: 1110 - DNA, 531 bp, Rattus norvegicus
  Genbank Accession No. AI102812
acacttttaaatatacctttatttctcaaactcaaagcttttattccatcaagttctaatacatatgcactgagaagaaatctcatctgtgtcacataaggaggtgagtgaccggtaccaagaaggaaccccgtatctctaggcactgccaaggaatagttcaagcctatgcagatacagaagagaaagcttccaatttagtccaaaggaaattttacttttcatccatattaatgtggaaatagatgcttcaggaaatttaagttttcacaaatacacacacccacaggccaggtagctggattctcttttgtaaagaccacagatcatgttaattagttctaccctcctcagtggatggtcaactcaccttcctatataaacacacatgagaatttgcaccaaatctcaacagccaggcaaaactctagaactcaaaaattcttgaagcttatactttaaaagtatttttttaaagtgacaggtaaacaaggaggcacttgaattcaaaaaaccaaaatcaataaaagc

SEQ ID NO: 1111 - DNA, 564 bp, Rattus norvegicus
  Genbank Accession No. AI102819
aacagtcagaatcattaaaggctgcagactacaacagcaaagattctgactgttaaaaaaataaataaatttatttttcaaatcaaaattattataaaagtggaaattacaatagttaaggaaatagaaaaataagccaattatgatctgagtcttctgactatggctccaaatttaataatacaaatatctgtatataaaacttttccaaagattctgccagccagattctaacacagaacttccaaagcttctctacttatcaaataacctcagacactccatttcctgtggatttcttgctaacagggctgcagttaccctaagcactgaggaagcagaggttgaaaatctttccctgttacttttatagatccttaaaatatacttgattgagtttaatcatctgaaaaataagtgccaaaaataggtatacacttagttctaatttaaaaattattcattatggccaacaattttttctcattttttttgagaattattagtgacttccaaacaatttactattcctaactaaacaaattatagtgtatgacttagtgt

SEQ ID NO: 1112 - DNA, 420 bp, Rattus norvegicus
  Genbank Accession No. AI102896
cagctccgcgcgccgatggagcagcatggcctaggcggcgggcacggggcaagatctcaggcttggcccccgcgccaagctccataaacgatttcgcggctgcaattgctcagactcccaggtcctgtgcaggcgacatgccccggggactccgggctcgtacagaccaggtggcttaaagttaaaaaaaaaagcccccaaagggtttccgcaacaacttttggaagacgaaaatagtggggtgcaacgaggctgaatgtaccggcgcagggactaggcgatcccgtaggggacaccgccaggtcgtgcgctgctccgtgcttggttggagacactactgctgtcagcgtctgctcccggctacttcagtgtttgttcaatgtaagatttaaaaaaaaaaaaaaaaaaaaccctcgtgcc

SEQ ID NO: 1113 - DNA, 531 bp, Rattus norvegicus
  Genbank Accession No. AI102972
ccaggccatactttattttacacaagtggtggccccagagccacagggacgtgttctggagagtaggcacagtgcccaaggctgcaggagcctgacaaggggaattcatgccttctccttggtccccatgaccaaattaaaaaatatcacacagcacacactgccacacccatccccctcttccctttcagcatcagccaattcagctttctagccagacagtggctataactggatttacagagaaccatgcagccaagaaaccagagccatgaaggggagaggctttgcattgacttcctacacgcactgtcccacaggagcaaagtgactccaccaagccactgcgtggctggatgatgacaggacaggctttaagacaaggctgggaccccgtacaccatgcctggaagaccaccacttttcaggcaagatattaccagagccaaacacgaacctgaggctactgtgatgcaaagtcccttccctccccaggtcctaggcagtgcccgtggagggctggataatttt

SEQ ID NO: 1114 - DNA, 461 bp, Rattus norvegicus
  Genbank Accession No. AI103059
aacactgcatatattccttatcgttctgttgatacaacatggagaactttgtaaggagaaaaaccaaaaggtgctaagagaaaaagaggtgcagaaaccaggtaagaagccaggaagaggctaagataaaccagagacaagaaaggtgggtaggtaagcatggcgatgcacacctttaatgccggaaacatttgggaagcagctagtaaatcctaggccagtctgagctacataatgaaacattctcaaaatatcaaagtaagtaaacagaaaagtgtgggtggagagaagccccctcatctgctgcaacatttaacccttgcagtcccagaagcctagacagaaagctgctgggacaccccattctggcttctcagtacaagtgagaggtcaccgataagacagatccatcaggaaaaggaatacacatgtaggagctgagacagcagccagccttgctg

SEQ ID NO: 1115 - DNA, 394 bp, Rattus norvegicus
  Genbank Accession No. AI103071
actgtgaaatctgtaatacagaatgattctttattttgacacatttcaactgtgaatataacttggtaactaataagagatgttcacatgaagtaactcaagccctcttaacttctcagtggattctttagccattacaaatggaactgatgttgacagaccttaagggctcccagtaacctgctgtcctgcaaaaggaaacaatgcccatccactccattgaaacagaaggcataattatcgaacagtgcctagaaaacagaggggaccgagaaaagtacagtgttgcctgctaggaaattgcagttgcttgagaataataataaaactgagattcactgtcagaacaaagaccttcactgcacggaactgaaaaaaaaaaaaccctcgtgcc

SEQ ID NO: 1116 - DNA, 521 bp, Rattus norvegicus
  Genbank Accession No. AI103084
agattccattgatttttatttctctaatcgttaagtcatatctcacgaatcagactcacagtttgatttacttgaacaggggaaacaatttcactatattggcataaaagggaacaatgacttagaaaagatttcctaaaaggccatcagaaaaatccctaaactagtcattaaatttaaagtaattggtagggtttttttttttaaatacaattagttggtattatgctcttataggataatgagtgaattttgcattttataactagctactggaatatttagcatgaaaatatttgttaagaccataatggcaacaactagtaaccatattctcagacttcccaattccaaaggcatatacaattatagtatagaaaaatatgtaagttttataaagttaagctttcagatcaaaaagtacccccttaattattaggtttagacataatggaaaatagcccctaaaaatttcaatatagtttacataaagacaaacatgccatcaattactgggatct

SEQ ID NO: 1117 - DNA, 540 bp, Rattus norvegicus
  Genbank Accession No. AI103106
aatagtaaaacagccttttatttgttaatgttgataagaaatttaagcatgttacactatcttaaaaacctcaactagcgcacgtgaagagaaagtctcccccaccctagcccgcctgccccattcccctcaggaatcaagactctaagagaaggagttgactgaacgacggctctgcgaaacgtccatccagagtgcttacatgatggctggcgcaatactgccttcctacaaaacgtttcttctcttttctatttaaaaaaaaggtaaccttgatcacttattacaaaaaaattccatacaaaagttcatatattgaaaaacgcctttcccccctcccacacagcaccattttatatatagcagagaaggatcaagagcagatcgcctatctagggagagcgatcttcaattatgcctggacacgcagtggttttcttaccctccctgttccctcttaaaagaacttaaaaaaaaaaaaaattacatacacacattcaaaaaagaaaaaaaaaatgccaaaaacttgagggccccttt

SEQ ID NO: 1118 - DNA, 532 bp, Rattus norvegicus
  Genbank Accession No. AI103357
gagacagggtttctctgtatactcctagctatcctgaaactcaatcaatagaggctggccttgaattcagattcttctgccctgattccccagtgctgggcttgaagcgtatcttccgagtctgtgccagccaagcttccgtccaggacccgcactgcacagcccaggcaccaccaagacccctacaaggccggactgagccactatgtgaagctcttcagtttccatactaagatgcccgtggagaaagcggctcttgagatggtagagaagtgacgagtatttccagcgcctttgcaatgatctggaggtatttgctgctcatgccggccgtaagactgtgaagccaaaggacttagagctgctgatgcgacgacagggactagtcactgatcaagtctcgctgcatgtgcttgtggagcggtacctgcccttggagtaccggcaacaacttatcccctgtgcattcagaggcaattctgtctttcctgcacagtaggaccaggccttagctggcacctactctccctac

SEQ ID NO: 1119 - DNA, 572 bp, Rattus norvegicus
  Genbank Accession No. AI103391
acaggtacaatgtttcatattcgtatcaataaacgtaccgtacaaaacctgctgcccatcaaccctgggcaggtatggggttcagggagcagggacacactcagggcccttgtcccaaaggggaggcattgcacagtcaggagaacagcgcagggcctggacgagggctagtttgtattttgccctccagagggggagcttctcggcagctgcggggtaaccccgtgactggtttcacttcgaccttaagaggggaagttggggtccacggggcgggtcccgcccagccccaagtgtccagggctgagttcctggaaaccacctagcacagttcctttctaaatcggagatatggcttgaagaactcggggggcccaggccagtggccccgcagcctctgtaaacatggcagacgcagcgggaggatggcatcctgcgtgtgttcaccaggggaagggattagaagacagacatggacagggaggcaggtgaggtggggcgctcagcgtgctgcaggtgtgatggccacagaaaagaccttgatgcccaagtgtttggcctcgcctcgtgcc

SEQ ID NO: 1120 - DNA, 482 bp, Rattus norvegicus
  Genbank Accession No. AI103403
aaggttataaaactgctttaatggaaagtccccctccccccaatacaccatctgggctggggtagatgtggccagggctggccccaggacaatactgagcctgtagtcgttaccaaaatatacatctgtcaccataaaaaaatgctgcaccgcctcagccccacaggtataaaatcataaatatttacactcttccatgactttcacagaactgaggtgcagggtagctgagggaggaaagatgttctgaaagttcttggagccaggtttcttgaagcggtgcaacggtgagctgccatagtccttggtcaggccctggtcctcctgtccctcacgaggctaggatggaggtgggcgtccaggaaggacattaaggcctagaggtcagcccctcaactgggcatagtcagaggcgggcagagaacaaaactttggtccaaaatttgaaggtaggacacccacaagcctcagggttcaagttg

SEQ ID NO: 1121 - DNA, 635 bp, Rattus norvegicus
  Genbank Accession No. AI103465
tttttttttttgcctggggtctggttttattattacttgaataactgacttagctagaatgttcaggatacacagagagaagtaggaaagacagaacctaaacgcccttttcttcagatgaactaaggttaatcctggggtatttctgctagtctttcctccctgtacaactaaagctaactttagttagctaaaaatacaaatatctacccctagctttctcttgcgttgttcaatattcttcagcccctgttttccctggactagaggcgggctacagccagaggttcttcaaggaaaagtgaacactcagggtgtttccagttctcaggtgtcagggacatctgtctccagtggcaaagagttcataggtcaattgttccctttgctttgaacttcttggcagaccgctcacttgcccgaagctggaatttgcttccataaatgtaggaaatgaagtcatcaatttctatggtgaacacacaattttgcttagggataactttcaggtggtcttctttggtgatgatcttgaagacatgcttggtcttctgcagaaggattcccgtaactcccacataggaggggcacttggatttcgtgactgaaataacagcgccatgaagatctgcctt

SEQ ID NO: 1122 - DNA, 498 bp, Rattus norvegicus
  Genbank Accession No. AI103531
gacagctatgtgcttgtaaactttaatttcatacagtagagaaacatacagtacaagcaacgtgggtagtgggagaaactttacagcaaagctcacagatacacttgaaacactagggagaacaaagatgccctcgggagcctgctggcggctgggtggccatcttcagagatggctgccacacccagagctgcatgtggaggtgaagtggctcagtccttgcacctcaggcaggtacccactcctctttggccaccatgtggtcaccttgggagaatgagctgtcagggttggagaccatgtgaccatgacactctgctttctgcctgcctgggccagcacagggctcagctcagcagtgagggatgttaacctgctccaggtcaggaccctggcttctccagggggcagctacagggcctgctctccggggataccaggtggcagggcaagcagcccctgtcttaccatggggagtgggtgtgttaaggcagatgg

SEQ ID NO: 1123 - DNA, 405 bp, Rattus norvegicus
  Genbank Accession No. AI103548
ttttttgagggaggggaaccctttacttccttttgctttttgtatcagttgtttgaaaaacactagaagcagacatgaggttttctatatattgtccaagaacttgattttccgattttagcttcagattttcttccttaactgcatctactcttgcagaaagatcttcaagtgtgtgctggagctccaacacctgattaatgagtcgagtcttttcttccagttccacttgattttcagcatcaactgcgtccatgtcagcattcatcatcttggggaacagacgttcagctcccgaatgcaaactctttaatgaatggtcttgcgtttgaagcgccgggaaaaggcgggataggtaggacgcctcaggccgcggctctccgaccaactgacagccctcgtgcc

SEQ ID NO: 1124 - DNA, 499 bp, Rattus norvegicus
  Genbank Accession No. AI103572
gagacagacatggttacttttttatttgaagcaaaaaaaaaaaaaacccataagttttaataaatactgtggaaaacactgaccaaacaaacatacaaagtgacttcaacattaaaaaaaaaaagcaaaaaaagttctgctttataaccgttataacttattttctttttacaatatttaaatacagaaagcacttgccagcgattttgtaatactgcccaaagcatgacgctgtaccagtcagagcatatttgttggtaatgtctgagtttcatgggaaatgactgaaatggcattttcttgcagagacaaaacaaaatacttgtgaagacacagaactgggtgtcggaactaccttaatctccccttctgccccagtttaatggggacacagcttcaacacttcaaaaatgaagcgtcatcattgggggaaagaaaagcttgttttcaacaagcacggactataaaagatcaaaactgatttcttctctgaaaagaa

SEQ ID NO: 1125 - DNA, 377 bp, Rattus norvegicus
  Genbank Accession No. AI103738
ccagtagaaaggatttatttatagtcaaaaggtgacacaagccttcctttaaattccattttttttacagtaaataacgcatatttccctccttcccatgcaagatagaggtgtattaatctacaattcttatttaattgtgaaaaaataaagtgtctccctttataatcagattggtagcgtggatattatctgtggtaacggggttgcttactcaaggactggttatttggttaagtcctaaaacgttaagttgaaaaatccctcacccagtaaaaataaatactgcaacatgaaggacgtgaaaacctacggcaccctttaaaaaacctctgcagagcagcagcacggagctcaagggaccagcagggctgcag

SEQ ID NO: 1126 - DNA, 520 bp, Rattus norvegicus
  Genbank Accession No. AI103854
ccagcctcaaagttttattatcaactgtgcacattcgagttcacatcccatggtgtacagcttataacacggacagtgagagacggcaggggctgcgtgagccatttggtgaaatggtcttgctcagaacccacagtcctgggcaagcaggggcctaagagatcccaggttccacacctcagcattgagcaaatgcacacagagtccttgtgcatacggaactactgaacgcaaacaaatacagggtctccagtttctaaaaaaaaaaaaaagtctgcttttgttacctgtccagggaagaagagacccactggccaaacttgtgaggtgagaggcataaccctgctcatcagtaaggtgcacgtgtctgtgtacacagtagtggtggggctgaccaaggtacgtgtgttcacataggatacacctaggcccaactcagacctagtatttgactctgccattctccattggtacaaagacaaaccctgagctgaatacgaggacacagatcagaagggac

SEQ ID NO: 1127 - DNA, 437 bp, Rattus norvegicus
  Genbank Accession No. AI103874
gaagtaaactaaatttattatcttcttacaagaatgctttagttgtttggttttgtttcaagtcctgtgccttttaactttcaccataaagtattattttttacatgtccttgacaaaggcttgataagcagttcaactctttgggcaaagtcactagctcttatccgaattagaatacaggacacagaataagtcaagacaatccatgacatttttattgagcctttagtttatgaggtaaaggaaaagcagctctcttgaatactttacatagctgtaggaaaatatttgagacttaaagggagttacaggggattatgtttctcaaaagttgagatcaagtaaacaagctttaaattgtttaaattttccagttgatctttccttacaatagtaacaagctcgaattagccacattaggtttttatgtttgcag

SEQ ID NO: 1128 - DNA, 706 bp, Rattus norvegicus
  Genbank Accession No. AI103962
cattttcaagagtttactaagattcatcctcagatttacatgtgatatatttattgggttacccaaagaccaaagaatcccaagcagaatcaacagacagaatttaatatatgcacacggttgtatatataatgcagcatcacaccatgtagggcattgacttgttttatacattcagatcgtttgaaacacttcttaaggctacgaaacagaacatagaaaaataaacagcaatatattcaacacttacaaaagtggtatgataaagaatataaagtactattcctttcaacacttcaaaagatatgtatagatatgtatatgctttacaagtaacatcacaaagatcacatcttcacatgcttacaaggattattgtactcagtgtaaggctaggatcatttttcatacataaattttttctagctttgtaacaatgcaatttttttaaaccattcaagtaaattcaaccccagggctgctgcttcccagcattaagacatgcacccacccccttacaggattctccaaacttagaaaacaaagtcccaattatcagaagagccaagggccgacaataagtaagaaaattggctctttcaaattgatatgctcaagtgagccattgtgaagattttaaaaaagcaattagacataaagttagggagcaaaatacagtaaacagcaacagtatagcttcctcctc

SEQ ID NO: 1129 - DNA, 618 bp, Rattus norvegicus
  Genbank Accession No. AI103983
gaaacagatagtaacattttttattaaatattacagtggatcaaaaagtacaaaatatctcttgcctgctatgtgactgggaaactattggcacagaatacagtatcaaaagcagtaataagtacaatttggaaaacatacaaagttgagtgtttattgttggctcagcattcttctggtagtgtttaaaactaaacgccaaggctacccaataacctctccattgggaaattatataacatcactgggccaggttgctatatacaaatatcaccttacagagcatcaaggttacagagctggggttactcagagtgtacaatatttacagcatggggaggtttaaaaaagtataaacagccaagagattacgctgctattttttttttcagagtcctttccgccaaggggagacgagcagaatatcaatacatcgacagtcaacaccagagtggaggtgctcaaagtccctactccagcggtgtgggtctcactggggcaaaaccattcccgttactttctcagctcgggataatgagtcagatcagaccccacaggacttggctggccaccaccaaatgtaacttagtgggacaacacgagaagagagataaatgg

SEQ ID NO: 1130 - DNA, 463 bp, Rattus norvegicus
  Genbank Accession No. AI104113
gtactgtaatcttttttttctttttctttttttctattaacttgagtatttcttatttacatttcgaatgttattccctttcccggtttccgggccaacatccccctagctctccccttctttatgggtgttcccctccccatcctctccccattactgccctccccccagcaatcaagttcactgggggttcagtcttagcaggaccaagggcttccccttccactggtgatcttactaggctattccttgctacctatgaggttagagtccagggtgagtccatgtatagtctttgggtagtggcttagtccctggaagctctggttgcttggcattattgttcatatggggtctcaagccccttcaagctcttccagtcctttctctgattccttcaacgggggtcctgtctcagttcagtggtttgctgctggcctatgtatttgctcttctggctgtg

SEQ ID NO: 1131 - DNA, 522 bp, Rattus norvegicus
  Genbank Accession No. AI104117
gaagcaggactgagaacgtttattcccacgctcaaggcagcgcagacctggcagacagcagtaccacagggccaagaaggaaggcagtgtcagacgaagccaggccctgtgccagacgggctgccgggaccaggccagcaggaggttcaggccagggctgtgaaagcagtaggtgagagctggaggcacccgtggggtgccctgggagggagtaagagagaagaaagcagagggcagcaggctgagcagggccaggctaggactgcacgttgagcacgtgggcagagcgctggtggtgccagtcccggagacgtgtataacgtgggctctgtagctccaggacatacttttcccttgacttcttcatgaattcctcatccgggtcttgcatgaactctgtgcccgtgaggtgagcaaggatgcggaaggaacgggactggcctgtccctggccgcgggcgccagtcttcagtattctccatcagccgctgcttgctggcatcagggaccagctgtctgagca

SEQ ID NO: 1132 - DNA, 543 bp, Rattus norvegicus
  Genbank Accession No. AI104239
aggtaagtaaaaggcaagatttatttttcttagtttattaaagatgactatgaactgtcaggatgtgtgtaaattacagcaggtgaaaatccagttctaaacacaagttgtacacaaacagagcatttttatttagactcttgctccctttctgttagttcagcgaaagctctccacccctcagcagaggaagaggacttggagttttctcctcgggacagcgggtgttcccctcttgcagcgtccgtcccatcagtcctgggacgcttctccctactgtagcaggggatcctcagatatcattaagtgacaaagggctttcacctcacctccctgctccttctccccaactcccaaacaaacgagggtatatggtcagtaatgacagcacagactcaggggttctaaagggtatatgatctagagggactgggtaggggaggtggggaaacaggaaaggcggggagactgcttgagcctcagctttctgccttatctcctgcagagagctgttctagtcatccagcccatagagttgtcaga

SEQ ID NO: 1133 - DNA, 636 bp, Rattus norvegicus
  Genbank Accession No. AI104278
aaaggcatgaagatttattttcctcagagaaacgtctcccttacagtgcaagatacagatgacacaggggtctgggatacaggccagtgacaggctgcctatgcctgaggtccgagttcagtctctagcaccatgggaggggatgagggcttcagacttagtgcttgcttgtcctcactgaccctcactgaagccgtgccctcggcgtgcaaggactccagcgctgtttcatgtgtagtttttccctgggtcacaagcggagcaagtaaaagagaagaaaagacagcatagtcttaaatcgtcatcgtgcgcccttccgggttttggcttcttcaaaagaacactctgaggaagacctttgctcccactttcctcatcccttcagagcttaaaaataaacaaaaccataactcttgggctgaggatacacctccatagtaggtcatgtctctaccgagcatgtagccctagcttgatctgcagcaacgactactaaagtcattaactgccacatacgagaatgtgtctacaggcgctggaaagatggctgctcttccagaagatccaggtttggttcccagcacccactgggcagctcaccacagcctaacttcagttcaccctcttctggcctcc

SEQ ID NO: 1134 - DNA, 511 bp, Rattus norvegicus
  Genbank Accession No. AI104303
agttaaaagcatattttcattaaaatgttgactatttccagtggttagaaaacagtactgcttagagaggctggaggcacaggaattttaactaaaccctgacgctgtagcagagaaacccggggtcatgcgacagtttcttcccgtcagtgctgaggggcatgactctgaggtgctcttgctaactccttagctcggcgggtgataatacggcaggttccatgctctgtgtgaacatgatggaaacctgttcttggcatttctgtctacataacttgaaatcgtgggtatctcatctttgtctggcccctcagagctttcacctgggagcgcaggggaacaggtgctgtcagagtcccacaggccagcatgaagaccccctctgtcagggctgctgaggaagtctttcagaacttgcttgaagatgtagacaattttccagggaaatacatcattttctgccaaaagttctcgaaatctgctgagaacagttccggtttgacaaggttgt

SEQ ID NO: 1135 - DNA, 472 bp, Rattus norvegicus
  Genbank Accession No. AI104340
cacaaagacagccgcatcatcaaagccaacccagcatgggtgacagctcacaaagctggaacttgcaacacactgcacagcctgcaggcatcaccacaaattgaagagtgtccctttcaggtgactcagctggtctgagctgcttccaggcagctcatctggtctttgttttctctaagtagttcagctgtggctatctgtttcttctaggcagcagtctatttcctttgggaaggaggggcctagtgcatatggtcagtttcaggggcttcgagaagctattttgagtgtactgcatctcttagtgagcatcatcacagcattttcctccctgtgttggttcatttccctaaaacattctgtcttaagaaatttcacacaaaaatgggaggttgtaatcttaagaactgccacacactggtacaggctggcacacaccctattgtgtgccatcatgaaatcaggtgactaa

SEQ ID NO: 1136 - DNA, 476 bp, Rattus norvegicus
  Genbank Accession No. AI104349
ccctttgagaactaaaattgaatgttaggggggggagggggacacacacagttacttgtgttttgaaattaaaagttgaagggaacaattgggatttaaaattttctactttctaaattgaaacttaactttgggaataaaataaccacaggtaaaagtcattgatcctttcaaacaatttttacagcaacaacatagggagaggaggcgtgaagtgttttaatgtgtgcttgctggatgccatgtcctgtcataagtgcgttacccaatcagctcactggaacctcgcaaccctgtgacgtgagttcatagccgtgcttgacagaccaggctcagaggctatgtaaacctggcgatgtcctgcaacccataaaacatggagtcaggcccagtgcctttaaaccctcctcctgaaaggaaggcttatgaagctgagtttctccatgtcatgtccatccccaatcttgtcccagatc

SEQ ID NO: 1137 - DNA, 569 bp, Rattus norvegicus
  Genbank Accession No. AI104357
tttctctttacacaatgacgtgttgctggggcctaatgttctcactgaacagtagaaaaccaaaatttgtcatttcttaaagaattgagtacaaaaaccttacataaattaaaaggatgaatacatttacaggtgtcgatgcaaacgttcccaactcaaggcaagtaacaacccatggaggtcaggagggaaaaaaccagaacagaaactgggtcctaaggctcggactttcccaccctgttagactggcaagaaaagaagtggtaactagttcaggaacccttgccagcctcgggaaatcctggaagtctgctgttggttaataccctgcacagatcactacatggtgctcacagagatccactaggctggggactgactgacttttccacagatctccccagccaccaagtgaccgagccacatgaactaaggactaaatcaagatatgcacagggtattaaacatataccaagggaacagttaacttgaatacaaggtcaaaaatcagcaacaagttctacgatccagtgctgatatcagatacaagcttcaaggacaaatttctt

SEQ ID NO: 1138 - DNA, 532 bp, Rattus norvegicus
  Genbank Accession No. AI104520
cagttcaagttatttatttaagccatctcctcttacgagcaaagggatggaggagcaaagtaatggtcaccatctgataaaggaaagatgagctgagcatccaatgggctttcgtggtccacacacaagagtcagggtccaaatcagtgctgtggtcccttgtcgcctgggcgaagagccaggttctctttactcatcttcatagccagtcggaagcgggttcatgtgaggattgtggaagagggtatggttaccatctccccaggggaagggcttagtcctgatgcggagatgggggtaggcgacgaactcgggtctctcgtgctcttcgtgtcgcgacttcaggaaaacgttgagcatgctcactcccaccccgggcagcgccacgaagtaggtgagggccttccaaatacgagctgaaccctcctcgccgtgggcgccactcgacatgggccgccccacccgtgggagggcccggcccagcagcccagagactcgagacgcactcagcaccgccgacgcccctcgggcc

SEQ ID NO: 1139 - DNA, 596 bp, Rattus norvegicus
  Genbank Accession No. AI104528
aggacaggaataagttttattaattacttttctaggaaatagattcagtaaatacagcacttttggaacatacatgtgctgttacacaagttttttaaatttttaagagctcttcaatgatgtttatcaggaaaatctctcattggtggaattacttctccagtctccagaattgtatcacctggaaatattctgggcttcgtgccaacaatggcatatggtttagtagccacatgatatttgacgtaatagtggacgaaccagagaggtatgatcacatgggaaacagtgaagagactggtgcggtacgccttgaagatcatgtacttccacagggcccggtcccgcaaaaagttattccagaatcgctccaggggccacatcctgcgcgggggcaacacgggctcccgggggctcagctcttggtccttcagccatcgccttctcagctcccgcagctgctgcagccgcagcttctcatcgggcgtgtaccccgacatgtcgccggcgagcttaccagagagtgacagcgcgcacccgaacctggggccggtcacttacgcgcgatcccgctccgcaaagcgaccccttgtgcc

SEQ ID NO: 1140 - DNA, 517 bp, Rattus norvegicus
  Genbank Accession No. AI104570
acatttaaggttgcatttatttctttttaaaaaatgttgaaaaataaacccatgtctgtgtaagtccccaacccttctttctccaagcttttgggggtggacagagtgggcctcctcacagcttcccaacattcttcccacaaggcttctgccatgcccaccccagtccccttccactgcacctgacttattgctaaaaggaaggaaaggtgggtgaggccagctaacacaccagctctccctcagcccccaggctcagtcactaccacacacaaagggtaggcccagaggccaagccctccaaaggcaggcaggcaggcaggcaaggaggcagccattccagtcacagccaggaagccagagtccctgcaggccctgagatctagcccctggctgggggtttacaagctcaactgccaggaacacatgcagaacccacaggcagagtgacagacagggaagcgggttgggaggcacagacggagttgggggagagaaaagggtgagcagactgccc

SEQ ID NO: 1141 - DNA, 616 bp, Rattus norvegicus
  Genbank Accession No. AI104605
gtacagcagacaagtcatcagtggcactttattcagtcagtccttacatcaggtctttagaaaacatcatgcagcctgttagccccacagacccctgggttagcctagagtctaagaagtccttccttgtcagcttctacaaaacagggctgtatcacaggatgagggctttctcagataggtcccacaagtcaagagcctggaaccaaggcctgagcccccaagtgtgagctgacactcacctaggggccaaggggagagtcaagccccactaaaatctccgcacacctggtggtcagagcacactcattagagcttaaggtggtctgagtttccattcaatttcttgagtagattgctcagggttcagaagtatcactttgggctgttacacgaacatggaagatgtctacacattatttaggtgaggctctgggacccctggaagacagaagagggtacagaacttgctccttactgtggtcctaggacgcaagaccttgagaatggcttttaagaactagatggtgcccttcacatttaagatgttaatagtccaaagaagcctggtatttaggtgctagcttcccagatcctgtgcgggaaggtggtgttg

SEQ ID NO: 1142 - DNA, 481 bp, Rattus norvegicus
  Genbank Accession No. AI104744
  misc_feature (1)..(481): n = a or c or g or t
gttctcaaaaggaataaagtcccttgtgcccaaacaaatcacaaaaggatacaagatggtttactaggaccacctataaaccccgaatgccatccagtcagacaagttggagggcacttctttgtataaacaggttcttggagaactctacatggtttttggaacaaatcctggcatgggcatagctcaccctgcagcagagtacacacaaagcagcttctaatgacacaccatcagtaaaagtagttaatttttgtattgcttactgaagaagtttctagtaaaagtggcaccagaggatctgtggccttgacgtgtacaaactcagtaagaagctctaacaagtagcatggggtatggcttggtaaagtcatcagcagtgtgagcacatgcctcattgnacttctcatctctaatggagctcaggcagcttgcttctgggagggcattctagagatgctctgtgctctgcattcagtaa

SEQ ID NO: 1143 - DNA, 484 bp, Rattus norvegicus
  Genbank Accession No. AI104848
cagagttgaacagtttcatctttattggagatgaatatgttaaaaacagacctaaaagcccagtgttgagacagtcatgagtggcgtaaaaaagaggttgcctaggacttgaggtcctataaaaaatatcaagtgtttggaaaaggcttagcacccttgtggcagacatgagccaccatcctgttggttttccttaacagtctcactttgtagcagataaggaaacaggcttgtgggcctcctagtacaagatgacgacttcctctggccagagacttagtcttccaaccacagtcccaggagcttcagtgtcacattaaataggtaaggacttgactgacagcaacggactccaccctccaatgcgtgcaacagtgtcggcatcggaaccccatccctttgccactgtgcttaaaacgcaccagcgatcagctctctttaccttctcaatgctcagataatctgatttaaaaatgctcaaacc

SEQ ID NO: 1144 - DNA, 587 bp, Rattus norvegicus
  Genbank Accession No. AI104907
tttttttttttttttttttttttttttttttattgatgttcttttttatttttaaaatcacacactgtatacacatacaaatccgtctaaaatttattcaccaaacccccagtttttcagcaattagttcttactcagcaccaaaaactccagtctgtggagacagacagacttctgcagtgtggttgagcattgtcaggtcctaggttaattccgagacttgccccctttgatccttttctcttcatggctctctagacacaggctgtcaagacttcagattcatgagccatgactaccacgaaactcaacagcctttggagaagaactcaaaataatgagatgactgaaatgagagacgctacatgactggtgagcactctccattccgaggacattggtatttttaataagtttctagactgtttggtcataatgccatgatcgcactaggttatttctagcctgagactctgtgactttgtcatacatctcaaagaaaaaagtgatcagtattgtgggaacactttaggacaagttagggaatcaagcggcagctgagaacctgtgaacacagactaatgagg

SEQ ID NO: 1145 - DNA, 547 bp, Rattus norvegicus
  Genbank Accession No. AI104908
ataggctaatatttcttttattatcagtaagagtgagttacatactacacaaaatattggatacaataatcatgaaacaaacattattggtccagaatttaaaacttatgagagaagtgctggcacaggacttaataaacccctcagcccattccgttctactccccaaaagaataacctcccaacttatagaattaaaaacaaaactgtagttccttcgcatctccatgatttcacatcctgcaatgtttggcaagtgttactcgcctcctgtgacctatttctcagcatttcccttcatttcgtctatgcttttgtctgtgcctcttcttaggtaggaacttacgtgctcttaaacatagtcactattacctaagtagtgtgagctacggtgtttcagagagggaggaggggagagcaagtgagggaggaggaaaaggcatatcaaatgagggaacatattaaagtgagtatgagcaaaatggttacatagcctctctactcgatacgtatgattagtattaaatagtgaattgaggataaaact

SEQ ID NO: 1146 - DNA, 503 bp, Rattus norvegicus
  Genbank Accession No. AI104979
atctttcttccataggtttaatttattaaaataatttcctacaaaaatcaggacgaacactgagtgtgctgtgcatccttctcctggttctttacacaggacagtgctgttcagcgggttttgcttttcagtttctgtctggtacgttttccgggtctcttgtttgcccctttcttcccaggccttctggggcccttgccatgagccaccttgccccggaagctggagacatcgtcgtagctctcccgtgtgttccatttggagcctttcttctttccgccaaaaccaaacttctgatttttgtatcttcgtttggcattgggccctttacttatctgctggcctttagctcctcctgcctttgcacctcgttccacaggcttctgatcgccctcaaggaaatccagcttatcagagaagcctttctggtacttcttgatggcattcatcatatgcgctttctcctgctgcctcttgtgaaggacctcagtttgcaccttctt

SEQ ID NO: 1147 - DNA, 572 bp, Rattus norvegicus
  Genbank Accession No. AI105044
cacagaatagtattgtttattaatcatacaaggtgaatcatgtaattccagaattttaaagtgactttcagtatgtttataagtattttcacaatttctctaaaaagaaaaaaatcagggctagagatacagccagtacttatctagcatgcatgaggctcagagttcaatccctgcactgcacagaatgaaaatggttcatatgtaggagggtcaagatcatcatgggcggtggtggcacccagcactccagaggcagagggaggtggataatgagttcaaggtcaacttggtctacacagcaagggcagcgcatggactacacagagaaaacctgtcttgaaaaactaaaaaacaaaaaagactggctaaaacccaagttccaagttcgaatgtaggaccaggacctgagccaagtgacatccttgcgtggagctcccaaggacctgagagccgctaacttgcagatgagctctattcacccaggtccttcaccacagaagatcggcttcctaccatacagtaaagacctttagcacacagaaatcatgctcacagctaggcaagtcccg

SEQ ID NO: 1148 - DNA, 671 bp, Rattus norvegicus
  Genbank Accession No. AI105161
gagacagggtgtcttaacactaacctgggctacatctcgaaaccctgtctcaaaatcaaaacaaaaaaagccctaaaacaaacaaaaaaagaaacaaaggaaaattcgttaaacgtatctagatctccacaatgacaactctgctaaataggacattaagatatatttattttatgcatatgaatattttgcctgtatatatgtctgtgtaccacatgcacgccatgcatggtatatgcaggaaccaaaagcctgtgctggagatcctgggagctgagtgacagatgcttgtgagccatcctgtgggagctgggaatcgaacccaagtcctctgcaagaacaaccggggcccttgaccactgagccatctctttagccccagagcaaatttcttagcaaaggaatactcagacacacatattcaagtttcctcatgtctctgttttccagggctagtcctacaggcaggtgatgctagacccagctttttatgtcagtgtctagtatcaaacccaggtccttgtgcttacacaccatgctcctcatttgttgaattatctcctagccccctccccctttagagacacaatctcactacgtagaccagggtgaccttgaacttagagatccaactgcctgtgcctctggagtgctggtattaaaagtgtgcc

SEQ ID NO: 1149 - DNA, 504 bp, Rattus norvegicus
  Genbank Accession No. AI105243
atggtgagaatatttattgagaatggctcattacaaacaaaatatatttatgtataaaaccccctgctatgtaaaagatccctttcatcctcctgtggctagagtgatcagaaccatctagagtttccacgtgacctaagggcctacactgggtcgcacaggaaaacgagaagtctgagcgtcacacgctgtggtaagtatctgatggcaaggcttccttctgtggaggccacttcccatgagcactcacgccggtgtgtcacgcctcatcccatccactcgctgtgaagccttcacctcttcctgtcgcttggtctcagttataccagaccctcctcggaggacacccatatccatagcttctgtgtggtactcctgagcttaaatccagagctctgtggggccctgaccacccagcattaaggcaatgggaatgagaccagactgaaaccaatactactctccgaaacccagagtagctgcctagctgacagcactgccctt

SEQ ID NO: 1150 - DNA, 595 bp, Rattus norvegicus
  Genbank Accession No. AI105435
aaggcacaggctctttattttcctcttttatctgcttagtgttgaacacagaaggtactgctcctgggatagaggcaggaaggctcactgtgaagtccactacaccttctcacacaaggtctgctccgtctcagtggcttctgtgtcactcccctttgtctcttccagttccaaaaaacttaaaacagggtagatggagtttgatttcatccacagttaaaaagcactgagggccaagagccacactgagaattaatttcttcttctttctatagagcatatctgaatgaagaaagacatttcctaagtctcaaatcagtgtctcactttcaaccataaaagctgggtccatccattacttcttgagcaaagtatttctctgttgaagtgggttcatttttcaaccgtgaatgcctgaatcccagtaattgctctccccaggatcagagcatggatgtcatgtgtaccttcgtaagtgttcactgcctctaaattcatagcatgccggatcacatggtactcatcagaaatcccatttcctcccaggatgtctcgtgcctggcgggcgatgtccagggctttcccacagttgttt

SEQ ID NO: 1151 - DNA, 588 bp, Rattus norvegicus
  Genbank Accession No. AI105444
catgacacaaacatgcattcagttttattcacaaaacagcctggtctcctaaaacaatacaaacagcatgttcctcagcagggagctggccacgggcagggggcccctgggcacccacccctaccagcaggggaccacgaaaagaagccctttcttctgctgctgtgagcaaggctggaaaaagagggctcattttttctaggggaagtagccaggatcagaaatactgagatgtgggctccccaaatctcagcggatcaacaaatgaatagaattttcatctctccaaaaatccgtcactgttggggcgggggcgtcccagtcaggggacgatgggtgcgacatggtcgggcctgggtcaggaactcccagtcccagtgggctctggccgctctgcacacgtgaacggatacagagggggcttctacacggtgcgatcaacatttcctttataaacgtgagtggattctccaggcaaactatgcactatttcatggttggaaagaatcaaaggaagttaaaatcagagtggagttaaaactgtgctaaattacagtagtgcttattagtaactagattgcaaaaggt

SEQ ID NO: 1152 - DNA, 448 bp, Rattus norvegicus
  Genbank Accession No. AI111401
  misc_feature (1)..(448): n = a or c or g or t
tttttttttttttttttctgtgaaaagacaaaaggaccaaactttatttctctacgcagccttggctggcctggaactcactatgtagaacaggttggccttgagctcacagagatcctcctgttgctgcctttagagtggctacctattggcaacaagcgccctcagcagagcactgatgagtcctcagagctcgtcggacgtgatgttcaccttgggtaggttacattctttactagtttgacagctctgaagaatgtcctggtagtggttcttcagatcctcatacaaggcaacagttttctgcgagtgagctaagggtaacaccttttcattcagcagcatttgtatctggaatttttcttgaggggtctgtgcgtcttcacaatggtaaagcacanatattaggtttgaagcatatggtacgatgtgaccacttcggaactcc

SEQ ID NO: 1153 - DNA, 312 bp, Rattus norvegicus
  Genbank Accession No. AI111599
tttttttttttttttttgctacaataatgcacttttaatggtaaaattcttgacagcacaatgtctatttggcaaatcttctgttcaagcatccatccagtcacctctggaaaaggtgcacccactgcactgtccacttgtcagaggagcccttgaaattcagaaatgaaggaccttgtgtggagcttgccatgccttcagttaaagggacccacatgtggtacctgcaggaatatgctgtttagaaacatgtatttataacgtgttatttacccatgttcttaaatactgtttcagcttaacaatcaatct

SEQ ID NO: 1154 - DNA, 459 bp, Rattus norvegicus
  Genbank Accession No. AI111877
  misc_feature (1)..(459): n = a or c or g or t
ttattttttttttttttccaggctttccagcagagaatccactttttgttttatctgagtcagctcctttttaatggcctgaaggtcatcacctttcaactttccagatttggaagaagatccccgttgtccactctttgaattgaatccacttttgccccttcgtgaggtgttccccgacacacgctggcgtttggaaggcaccacagctcgagcaatgggaggaggaggaggaacacgtgctgggtaactgtacatcctgtcataataatcgcgttgaaagtcatagtccaagtcaaatgaggaactgagtanaggggacggagaagggtgttctggtactgacccgtacatctccgctgcagatcgtttcacacccgcttttcctcggttcacttttggctctgcagccaggttaatatctaaaacctggccagcaatcattctgcatcctctcca

SEQ ID NO: 1155 - DNA, 496 bp, Rattus norvegicus
  Genbank Accession No. AI111960
tttttttttttttttttactttttaaaaaatttatttaaggaacacaaaatgcatctaagtaattttttttttttttgttttgttttgagatagggtctcccaagtcatgggatcaaaggtgtgtgtcgccattactcgcagagtctaagtgattttttaaaaaccaaaatttcaatgtcatctgcttacccaccactctctccaggctcagggtgtgaagacatcttctgatttccgtactaagtgtctgaatgactgagtcaagagcatgcacaatccagtgggctgggcactttgccacttctggctcggaaccctgaccaccctcccgtcccacaccagtctcctaggcccacagtatacacttggagacagctggtgagggtcgcccaagttagaacaagttttcctgtaaaaacctaactagttaggctcaaattccagcacagcctccctggcctgcaattctggtcaatacaactgccgacactgcac

SEQ ID NO: 1156 - DNA, 495 bp, Rattus norvegicus
  Genbank Accession No. AI112095
tttttttttttttttttagcaggtaattttttattcttgggtgctgactccaagcacccacgcctctccctactaccatccatctgcctgtttggagccagaggtccaagtggactaggagctggaatcagtcgtagctatgttcacaggtcagcagctctgagtggtgcaactggagctggcagggctctcagtgctggtccaggatgaggggcatctgtgcgctgtctactcggggaggtaaccgctctcctgtacgcacgttgaacatgggcaaggtggatagaggccggggcacctcgcggctgcctgccatctgccgaagctcttccgtattcccgtggatggagcagtggtgaaacatctggatgtcagaagtggccatgtctctcttcagccgtccttcacgccgacagcacataatgtaaaccagcaacagggtgagcagcagagccaccagcacgggcactaagagggtcaccaaggcatctgtta

SEQ ID NO: 1157 - DNA, 523 bp, Rattus norvegicus
  Genbank Accession No. AI112107
tttttttttttttttttaaccaccagtatttattgaagagaagtgaagttatatgttcgcacaacattgtatataaatgttcataagcatcttattcataatgtcccaaactaaaaacagctgatgcccacaccaataggatatattcatgtaacagaatactactctctgaagaaaactgactcaagtaacaacacagatgcttttcacagcatgctgagtgaaatcacacccaaataaaaaccatactgactgatttcgtctaatacacagcagacagcagtggcttagtgacgattgatggatggtccctactcaagggacctgaggcgacttggatgatggaaatgttctctattttagttgtggagatgagccaacaggtgccacttccgtccaattccttaagtgtggtttcccatgggtggcttcattagaactcatcactgtgcttgaagaggaaacagggccactaagcctgcctcgctcctctgcacctgcacctgcacccgcagggctcaca

SEQ ID NO: 1158 - DNA, 457 bp, Rattus norvegicus
  Genbank Accession No. AI112291
tttttttttttttttttaaaaattaacattagtttttatttttgagaacattctctgatgtgtaacttgttttcataagtcatactttttctggctttttttttacaatatattctttaaatataaaaatcgacaagataaatacaattttatctagcctatttgtggtttttctaagatccatcattggttttataaaaaagtaccaggccaggaagcaatggtgagagtaattttccctttgagttctttgagcatcctcgctaagcaggcatgcatcatccccgacgtgcttctgccgttgacagcaagaagaatgtcaccacatctaattcttccatcattgtacgcgggtgttccctcgacgatggatttgataaaaaaaggttggttaccactgtattcttcataacctcccacaatgcataagcccaggcttcccgctgtgttccttcgt

SEQ ID NO: 1159 - DNA, 558 bp, Rattus norvegicus
  Genbank Accession No. AI112512
tttttttttttttttttgtatttaaagtagcaattttatttgagttaaaattatttacaaaaacccaaagacatacttcatgaaactggtacaaactattttttcctgccgttggcttttgctccaaagatcacagctgagaaatactgtataaaatacaaataggattggattcagaaaagtatcctactgttctaatatccaactggtagtatttacagaaatatttacaatggaaaaaaggttaccttaaaactttagttaatttgcaagtcagcctcaagtaccctaaaatgagagttctctgagggttaaaaacacagaaatgcactgcagttggtaaggtgagatcttcctcacaacccacacccaccaaaacctgcatctctatcagtgcttgacaattagttagtatttttaacacattacagacactgttaaacactgaggtaaatcaattatcaaatgatcaccagtgtaacagaaaaaatgtaattcgccctgattgatctcgtccaactatttactgttctgttccttaccagctgccacagtcaa

SEQ ID NO: 1160 - DNA, 493 bp, Rattus norvegicus
  Genbank Accession No. AI112969
ttttttttttttttgttacaaaaccttgtattaatcatttcccttcactctcaatataaccatatgaaatatagccatgattcttaattctgtgggaggaaatgagtaataaatacactgtagcaagtttagaccacgagggcgttgtcactggtaacaacatttgaaaactgtacacttgcgaagaacagcatgttcaaacattagtgtgtctgcatcagtagagcttttacatgtaacaaacatgctctttccatgtatgacaaatttaaaaaatatgcattgcttggcaacatgaactaggcaaaaatatttctttgttcactgactttatacagggaaacaggacaaaagtcatgcatgtacaatacagatgcctgcacagggcatgcaacaaaaggacgccttttgaaagtccgcttgcgttaggcataaatatgtgagggttatatattaataagggaggaagtcttctgttcgccatgactaacat

SEQ ID NO: 1161 - DNA, 499 bp, Rattus norvegicus
  Genbank Accession No. AI112979
tttttttttttttttttgcaagttaagaagatttattgacagactagtcttgcagtccagaaccgggctgacggaggctcaggaagttgtcatggtacaacccggtgtgggatccactctctacatgggacccctgttccacaaggtggctgctgttgcaaatatccggtaacatcccttacatggcacttacaggtcactggactgtacctccaggactagacatgccattccagaccctgacctcctggcactggagcacatgtgctgttggggtttcagttttgtttcttgtcaggtataaggaatgtcatcccattctgtatgcgtcataccaaaggaagaaaagtgggcatcgctcctgggagtgattgctttggctccctcgatctgcttggccctgggcacctgtgctttactgaggttaatggggcatgcccaacaataactctcccagggtttctgtcacacgccatcctgccctttcaggatctgtcag

SEQ ID NO: 1162 - DNA, 461 bp, Rattus norvegicus
  Genbank Accession No. AI113008
tttttttttttttttctcatttcaacattctttattaataaaatgtatttcaatgtcaaaaggtatcactgttttcttcatttcatttcattcttctttgccagtcaggttaaggacagttgtaccagactctggagagggtctgccctgagcgcgtggtgattgctcttgctgttctagtaggcacatcgatgttatagtattgatctttggaaaaggcgtagtaatcatagccgtcaggttttctaatgttgggcagtgttatcgcggaagtaacgacatttgggaaccctctccacagtgtgctcaccttgtcttcattgtggaggaagcctttgtcttgataagaggctttgatgggcaccgagtaatggatcctgaaggtgtgtgtctggaaaggtccaacagcacgctcaaagcggcgcctcctgacctgtgctgcctgccccatacactgagta

SEQ ID NO: 1163 - DNA, 378 bp, Rattus norvegicus
  Genbank Accession No. AI113320
  misc_feature (1)..(378): n = a or c or g or t
tttttttttttttttgtctttgataatatgatttattgtccattgacagagcaaactcataaaaataaaagtaaaggctgacacagagcaatcaggcgcactcggcttgttgactttcaacaactctcatgtacgaatcgccggcggcgtggggcgtgggatgagggggttggggtggggttacgtctcggacttcatattccagcacagacatggagttccaccccctcncctcccccccccaacccccgtaaccgaaagttcaaacagaaacaagatcaacaaagctttaaattatgcagcaagcccacagatgtgtcttaatacgcgtcaagcagcggtttggaaacaacgaccgttgtaacgtcatctgaagta

SEQ ID NO: 1164 - DNA, 523 bp, Rattus norvegicus
  Genbank Accession No. AI136516
  misc_feature (1)..(523): n = a or c or g or t
tttttttttttttttttgtatatccacacaacactgatggcttttattgcagatttgtgtcgttacaaggcaatatattttaaaaaaacaaaaatgaaacaccccccctgtatttatacacagacatgctacatggtacactgggagaagtgctgaggtaatgggctgtgcccccggatgtggacagtaccaagtgccccacctcacacgtccagcacactcacccaccggagggtctcgccttcttgatttatctgttgcccctggcgtggcagtcatctggtaactctaagcaggactcaggaagctactgtgctgcagtgcaccaggaaccccagagggcattgcagctcatggaaagtagtcagtttttccttctgtggccttatcttctagggagatgtagcttggtgacaggatgaatgaagttgttcccatgggcacanggactcanatccgcagctctctggggtccaacctattggcagtgacttctctccagtggagtgtctctggcanagca

SEQ ID NO: 1165 - DNA, 569 bp, Rattus norvegicus
  Genbank Accession No. AI136547
  misc_feature (1)..(569): n = a or c or g or t
tttttttttttttttttacagtaaagagatttattgctatggatcacagcgccatctactgggcgacattctgagtcaactgagtctgtgaaatgggctcagagaaccaacgtgttctcttttcaggattctcccggtcttcggcgctatgagtgccagaagaggggcataaaaagggaacacgcagcctcagccctcaagatccacggacagggctggcagctttcttaaagcctcgatcccccattgtccccatacttccccgggacgttgatttgtctagtccctttctacgcagtccttacgtcatttgtctaaacatagctcatcgctaatagatgctggtgtcgttcttcagcctgtttctcatcctggaaacaggtgtctcgaggtagtgggatctgaggagagttcatttatggctgactgcccctgcagaccacgcgcatagttctattggtgaaaccttgggaaactgcgatatgttaaaagaccctcaggagagaaaaattaagtgtcgtttcgttaaatgacattcanaagtcaatcaactaaccatttagttcccg

SEQ ID NO: 1166 - DNA, 503 bp, Rattus norvegicus
  Genbank Accession No. AI136555
tttttttttttttttttgtcgttcagtgtacatcaggtacttgttattaattctactggataagcacttataaataaaggacagttatttcttgtcctcagccaccttcctttgttaagagtcatcatagagagggttgttgtagtttccccaggacccgtagtcatggtcatccagcagccttccgtaggaggaatgcctgatcttcagatatgccgcagctccaaacaccagcaacaccacagcaatgactgtcacggtgatggcggcgatgctgcctgaacttaaggcattctcgacttcctgcatgatcaggaagggggtggtggtctcagactcacagatcactttgccaggctcagtgtcttggggtgatttctccttgggcacaggctctgtgacatgggaagtgggggtgtgactagaactgtgctcttctgttggtgatgcacgtgccattggagctcctgtgggctggatgttgttcacagtagagctgtggt

SEQ ID NO: 1167 - DNA, 560 bp, Rattus norvegicus
  Genbank Accession No. AI136747
tttttttttttttttgtccagaaaattttaacaggtttatttataattgttataaagttgaactgttgaaatgtgttcactgaaacattttgcttgcattaatgctttacatcttgcatttatattaaaaattcacacacaaatgaacgtggagaaactgccaatacctgattctgtcccctatgtttccactcgcaatcatatacttaggtacctttgacccccatggaaaaaaaatctcgcggccgctcccacttcagattggtaaccctcgtgccgaattcttggcctcgagggccaaattccctatagtgagtcgtattaaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctct

SEQ ID NO: 1168 - DNA, 473 bp, Rattus norvegicus
  Genbank Accession No. AI136842
cggccgccaacggagctgctctggggagctgtctgacactctgatttcagtagctcccggtggggggatgtgaggagcgaggggaccccttccccacccccatccccagaacacactaggcttacaatcattcagcacccctccctgcagcggccctaccccgcccccctgattccaattggttgtatcttccgagctgtgtgagcttgggccaatcacttagcttctctgggcctcagggagaactcatccaggagagagagagagaagacgacgtcgtagcccttggtttgtgacagtgcagaacacagtgctgggtgagtccagctcagacattcctcttgaactaaagaatgaatccatagagaaggacaggcagcctggagacagggtgctataagtgtttctgaagaattaccccggggtttctgcaagtgggttggaggagaacaggctgcctctctcccagactt

SEQ ID NO: 1169 - DNA, 523 bp, Rattus norvegicus
  Genbank Accession No. AI136848
  misc_feature (1)..(523): n = a or c or g or t
tttttttttttttttttagactgattcaaacaatttactgtgacaattggcacggctgaggtcaaaggtggataggctgtggtcaaggactgatccccaaccatagacaggcttctgtgtcaaaaccgctctcccaggtaccacagttagcattaaggggtgcctanaggccacggaacacagcagggacctagtaccatgggctagaaagattctcatgcttagtcccctaaatgccatctcctttactctggaaggttctgcatgatggctccctgcagcctgccctgagtggacctctcctgactagattctgtatctagcagagactggctcagtcagagaataggtgttgcccataactggcttgaacaccgtttccaaagtgagtactgtccttagagacgctggtgcactgggctttaggtatgtagtcggtgtggagccactgcttctcatggcttctggcagctcaagagttctgaggaaactgctggaactctgggtgtggattaaccttctc

SEQ ID NO: 1170 - DNA, 376 bp, Rattus norvegicus
  Genbank Accession No. AI136977
tttttttttttttttttaattcactcaaaattcttcagtttttacaaaactaacagggtggagtagggaagggagcagggaggcagccgcaggggtgggtaggcggagaggcaggctatgcttctgtcttcacctgagcctggttgcctgccacattgttcggctcacccttcatctcagcatcagtgggatggtccacctcaaatacaagtgtggcatttggttgccacagcaatatcccaagccttgatgacctccccttttcccaggtcaaaggagaatttgtccttgcggtccaaactggagtcaaactttgtgccatctagcagccagccagtgtagtggacaaagactcggtcccccctcgtgccgaatt

SEQ ID NO: 1171 - DNA, 550 bp, Rattus norvegicus
  Genbank Accession No. AI137114
tttttttttttttttttgtctgttgcacacagtttatttaacaatatgatataagaaatgagttggtacgttaccattctatacagtgattgaatcttcttgaattttcttatttatagtaattatagcgcttgcatgatttacactagaattgcttttcctcatttcaagtttcacatagaagaaagaaaagaatgcttcttctctattaacattagcatggtctaagagagtgatcatccctatttttgtctaaaaccagttttatcagagaaacaaagcaacaatttctacatctgcaagacaagaggctggcttaagccagcatgtatagatagatgtgtgtgggtgtgtacatgtgtgcacgccggagtcaattcctatcgtccaggggtaatacttggagatgcccacagagttcactatagaaaaaaatcttcccgcaacatcagctcgttatcgggacacattataagatgcattatttctggaagcagtttctgagtattatttttcttctcacttttaaacatagatgtttaagtcttga

SEQ ID NO: 1172 - DNA, 456 bp, Rattus norvegicus
  Genbank Accession No. AI137131
tttttttttttttttttaggcacagaagttttactactgaaaattgattgtgtactagtcaaaaaataaaacttcgtatttcaaaatccaagttataatcttaaagccaaccactgaacagtaactagtaatacaaagaaatgaccaagaaattgaaacagtatattagaccgtgcttaacacaaaacatggcagtaatgaagtattggggcttaatccaagagagcattaaaataatgaaaaacacgattacacaacccaagggctttcccttggaaggagccacagaactggcagagagaaatggtccggcttaatgctgtacacacgagatacacttaagtcttcctttttcttctttttgttacgagagttggagatcaaaggctgtgcttgctcggcaagcactcctgaggcagactttggcttaaaagacgtaatgtgctgaacgctggg

SEQ ID NO: 1173 - DNA, 572 bp, Rattus norvegicus
  Genbank Accession No. AI137286
  misc_feature (1)..(572): n = a or c or g or t
tttttttttttttttttgggtttatataaaggcttttggttttatttattattaacaaacataaactgcaagtagtaaaggtcactcgctacctggggcaggccccagggtctctggcttctcttgtttccgaccttcggggtgagggtttgggtgcactcggtctcaatgctgtctcggtggcttagctagggaaaggagcgcacactggcgtcacggatgattgctccatttggcatacatcaagtgagtgcaattaggtcttagtgtatttctaatttcaactgctcgacactctgtcattctacaaatgtcacctcctagctggggatggtaggtgtggccctctgcaagggctgttgaatgaaagcagacacaggaggatatagagaagtcagagtcatgtacaatgtgttattaatattagtgacccagattcatggcctcgaagcattccgattagggaagagcacgtcctcaagccccattcatttttcacctcaactccccacacactgngctgttattttccctcagcccagcacttgcatgctttcctttcncagcctcgt

SEQ ID NO: 1174 - DNA, 348 bp, Rattus norvegicus
  Genbank Accession No. AI137302
tttttttttttttttttgaggatagaatactttattcactcataagggccaaggaaatgtagctggggactatgcatggttctagggatccccggtgggacattccctatcgcccagtcccagagcaccccgacccaggtgcaggcatggaaggaacaattcaggtgcaagtcccaagtgcccctcgcttccccgccgtggctcagctgccctcgcactccgggcagcgctcggtgggcgtggcggctgtggcactggcgggtagcttgaagtctcggccgcagcccgcgcagatgtagagacagcgccgcatgtgcgcgcgacggtggcggatgaagtgtgagctga

SEQ ID NO: 1175 - DNA, 540 bp, Rattus norvegicus
  Genbank Accession No. AI137406
  misc_feature (1)..(540): n = a or c or g or t
tttttttttttttttttaaataagaaattttaatatttaattattaattaactgcttccaatattaattaatcttacaactgtgacatttctatggttctttcttccctatcataccagtgtcccttcccaagttggacacacctggatacattaaatgttttattttggtgacagacaattccttttattttagttagatgttttgaatgcctacagtaaatctgcccattccgggaggtcgcagacctcctggcctccccccaagtctatgatctcattttcacagataaacacccacttctcagaccagctacccaaagcatgcatgttctcgagtcctttgcaaaccggttattttgtctacataacctcctcatatcccttcctcacattcttcgtaggcagatgctggagctgttgctctaacctcctgagatatggtggcccgctgggggagtctgtttggcttcatttgaccttcncataccagctcncaccagtccagccctttctctgaggaacctggagaaaaattagc

SEQ ID NO: 1176 - DNA, 473 bp, Rattus norvegicus
  Genbank Accession No. AI137410
tttttttttttttttttacatttttgattaaatatctttatttttaaacatcatttaccaactgtgtgtgtcctatgctacctgtgtagaggactaacaacagattctggaagctgaagctgggtctctccttttgcctcaagggaccaggagatcaaactcaggtcaccacacctggcagaaaccaccactgagctgcctcagccatttttaagctctgaagctttttcttttacagaattccaaaattgagaacaaacaaatttgattccaaatatttgcctgttttaaaagtgtgctccaatagtattctggcaattatttattcaaccgcttctttaggttctcgaggtgttccacaccaacatcttgcaattccagtaccatgcctttacacgaagacggatcatatgaaacagtcattaggcaacacaaatctatcagatctcgctggcatttttgtaacccttcta

SEQ ID NO: 1177 - DNA, 416 bp, Rattus norvegicus
  Genbank Accession No. AI137468
  misc_feature (1)..(416): n = a or c or g or t
tttttttttttttttttgaagctacaaagacgctgagcggctcagccagccgggagctgttttattaactgctttggtgaccctgaaacatatgaggcaaagctagataaacacatggtagcctgggggccagcacaggaacagtgagaggtggaagagttggggcaaatggagaggagcctgagggagagtcagggaatancattcctggctgagggaatggggaatggcagatgctgggaatctgcattctgacatgggaccaaattgcttcagtggcaagcggggtacccttggcccgcaccccagttgccatcctcacaaggtcnccagctctgccacgtccagcagtcgctgtcncctcacggcctcgggccccgcacagagtgtgtcgttctgcgagaacatcttatgtc

SEQ ID NO: 1178 - DNA, 535 bp, Rattus norvegicus
  Genbank Accession No. AI137495
tttttttttttttttttactcgcttttcaccgactttattggctgcggactgtagcgggctcagcaccggtagagttcacttgctcttcaccttctggctctccgtcttcttgggcagcagcacggcctggatgttgggcaggacaccgccctgcgcgatggtcacacggcccagaagcttgttgagctcttcgtcgttgcggatagccagctgcaggtggcgagggatgatgcgcgtcttcttgttgtccctcgccgcgttgcccgccagttccaggatctcggccgtcaggtactccagcaccgccgccaggtacacgggcgctcccgcgcccacgcgctccgcgtagttgcccttgcgcagcagccggtgaacacggcccacggggaactggaggcccgcgcgcgacgagcgcgacttggccttggcccgcaccttacccccctgcttgcctcgcccggacatgctggacccggctcctgaagttccaacaccggctcgctcagttccgggaccctcgtgccgaattcttgg

SEQ ID NO: 1179 - DNA, 351 bp, Rattus norvegicus
  Genbank Accession No. AI137553
tttttttttttttttttgtcattttacagacattgtgttaaatattagaccaaggcacaaaacgtttagtgcataaaccagcttcttttaggacttagcatttgaccttagctttctgtctcactttggaccatttataaccagtactctacctactacagactacttaaccttagcaacaaaaagaaaagtgacttttgatcagatctgtaagggatatgacacatttacactatcaaagtagttgcataatcaaaagttcggcagcaaatgagatgcctacctcttttcgagaacaactgacaagcttgctgcatctttaatgcctttactatgtctgcaagacaatgt

SEQ ID NO: 1180 - DNA, 475 bp, Rattus norvegicus
  Genbank Accession No. AI137579
  misc_feature (1)..(475): n = a or c or g or t
tttttttttttttttttggggaaattattctttattgaaaaataccaataatactgacagattccaaaagcagttactgtcccagagtacaaagcgcttagctcatttaccccaaacctgtttgcatctcaaggttagcatttctgtaaatcaagatacaaatccgataacttcaataaaacattttccagctttattctttaaggagctgtataccttcaaagtcagggtcacgaggtcagcaggagcacggggcagaatgcacccggcactccctgggcgtcagtttgcagcaacactggaaaccacattgttggtgctggaaacaaaaatcccgcacaagatagctgccctccaggatgagagggatgttggaaacagcatgtcganagatagcttgtttttcttataattaacacactattattttaagattgctctttggaggaaatcttaagaatgcactgtaatttcc

SEQ ID NO: 1181 - DNA, 415 bp, Rattus norvegicus
  Genbank Accession No. AI137586
  misc_feature (1)..(415): n = a or c or g or t
tttttttttttttttttaaaagggtaaacgtttatttggagttagtcttctggcaggtggtattaaggcccttcaggcagagttcaggagctcctgtatggctgcctgctgctccggactgagttgagctatgcattcagtccacaatcctccagaagtctgtacttggcgaactacattggccaggcgtttggcacaggggtcttcatgtttgatggcctcatgcatttctccttctgcaattatactgaatattttcggtagattggtattatttgggccaagaacaattggatgattactttcaatcaggtcacacaggtaactgaaggtctggacagcttcttctttatcttcatgtanggggagccacgacagccagtgtggtaagacctcctccacattcacgcagtca

SEQ ID NO: 1182 - DNA, 221 bp, Rattus norvegicus
  Genbank Accession No. AI137864
tttttttttttttttttcaaagtttctaccagtgtatcagtgatggacaacggagagacatgctgtagagtgtttgcctagttgacaaagctgcttttgaatgctgttaatgaggttgtggcagggataaaggagtacttcaatgtaatgttgggcactcagctactctacaaatttgagagaccacagtatgctgaaattctggccgatccctcgtgccg

SEQ ID NO: 1183 - DNA, 487 bp, Rattus norvegicus
  Genbank Accession No. AI137925
  misc_feature (1)..(487): n = a or c or g or t
tttttttttttttttttacagacacagtctacctttattgccacaactgtagaactttgtctacatagcatgtaggagaaccagggcaacaatgtgacacagaagccacaagaagttgaggaggttaaggttagaatgagattagatccttgagactggagtttcttggagagaggtggatcaacagaacatgggaagaaaggggagagagagagagtctaagagccagatggcttctgatctcagtcaagtacagcaatcacctgactcacttctcagaatgcaggaacaggccccacctcctgccttggggctcccttctctacttaggttacaacatcctttaaggcagctcctaactctgggaaggaatactggtagcccgtggccagtgtcctccgggggaccactttctggccttccaacagcatgatggcacgctctcgtccanagattgcttgtaccacagcgctggggacaggtatga

SEQ ID NO: 1184 - DNA, 448 bp, Rattus norvegicus
  Genbank Accession No. AI137931
tttttttttttttttttgcagtaaatagttaaggtcagaacaaaaaaacgacctcccaggttctcttctcattgcttaatcaacctgaagcatctttggcctactagtcaacagcaagatggcttgaagaaaaaataaatatcatatacaaacaagtgtaactagcattcaagtctgtcgaacctgtgccttagtgacaagggagacaggaacctgtgtgcatttggcatcagcaagggtcctcacttctaggaaatggagagagaaggccaaagggtaacaacaccttctactgcatatttaatttaagacagaactttcaatagaggcaaagctatccattggcagagtcttgagccaagaaacatcatcttgcaggttctccagtcttatgagaaggatgctgtgggagcaggctggaatggccactctgttagcacagatgatg

SEQ ID NO: 1185 - DNA, 527 bp, Rattus norvegicus
  Genbank Accession No. AI137958
  misc_feature (1)..(527): n = a or c or g or t
tttttttttttttttctatacaagccatttatttgaaatgccaactatatggaggataaagtcagtgttacatgcgtatcagtaacagtagaaaaatagaaccagtgaaaacctctgtacaactgtgatggtacgcaaaagagaaacgtgtcgtttacagtgtttcacacagacggattcaagtttggaggtacctaaataaaaatactatatatttctttaaaaaacactatgtacaattgaagcgtaaacaagttttacaaagtactggttatgcaggttgtaaaaacacttgcataggacatgaaatcagtttaagaaagatttctgagcctttagcattgaaggcacttgactttaccattaacagcacaaccacaagaaacgctcagagacattccttttcnctctacatgtcaaatttgcatcccaaagtgcaagatcaaaagcctagtgtgcgaccgcccatcgcgccacacgtgacatcacaccgaactggcatccactcagcacagcatacaacatcc

SEQ ID NO: 1186 - DNA, 462 bp, Rattus norvegicus
  Genbank Accession No. AI137974
tttttttttttttttttgtgtggctctgaaaagagcctttgggttaactgctcgtaggaccgtttaagctctctctccacgaatgcggcgggccagctggatgtccttgggcatgatggtcacacgcttggcgtggatggcgcacaggttggtgtcctcaaacagacccacaaggtaggcctcgctggcctcctgaagggccatgaccgccgagctctggaagcgaaggtcggtcttgaagtcctgcgcgatttcgcgcaccaggcgctggaacggcagcttgcggatcagcagctcggtggacttctggtagcgccggatctcgcgcagagccacggtgccgggacggtagcggtggggcttcttcacgccgccggtggccggagcgctcttgcgggcggccttggtggcgagctgcttgcgcggggctttgccacccgtggacttgcgagcggtctgctt

SEQ ID NO: 1187 - DNA, 518 bp, Rattus norvegicus
  Genbank Accession No. AI137995
  misc_feature (1)..(518): n = a or c or g or t
ttttttttttttttattacaaaataattttttatttcatccaaagcaaagccaaatccaatcctacaatgcaaaatgtgtagtagaggcaagacaacctaattgcattcaacctgtgcttaaacacaagtgctgggcatgtgcctgtcggtgcctcctggggacactgtggacctgaggcccccacagcccatcactgtattgtttgacctataaagttagataggaagactgactatgggtactgttatccaagccagaggaataaaccatgcataagatagtcaaaagcactgcacatccagtgggagatgggtgagcaaggactccaacctgggacaaaataaaatgcagcaagctagaggattcncccacaaatccctccgttgggcatccttcctccaacacccccccccaagggcagttgtctgtcatcctgacatggaatcacccagttgaatccaggagcacagctgttcgtctctgtctcttacccttcttcagtttcncctcgtgccg

SEQ ID NO: 1188 - DNA, 416 bp, Rattus norvegicus
  Genbank Accession No. AI138093
tttttttttttttttttaaatcacaaaaaatttctttagctaaaagtcagagaaaaacaagaattatgtggatgccagaactcgagaacgtaattaactttgtagacaaagatgaatgggggaataagcagtagcaaacaggtctccagagtctgtgctgcccagcacctgcccaacgtgagtaatagtgctagaatgattggcatcagaaacatagcttagttgcagacacagaaatacaaggacatccagtctaccagacttagggaccagaaaaaaacagaaaggtgaaggactatgacaggccactgctttgttcaagtctagcctgggctccagatgactctccatgagaagacttgaaaactggagtgagctaaagactcccatgacatcataaaccagatactaaacaa

SEQ ID NO: 1189 - DNA, 577 bp, Rattus norvegicus
  Genbank Accession No. AI144948
tttttttttttttttttaaacaaagaatagatacttcatactttaactgaagaagtcacccctctcctcgctctttggtaaaattccaaacacaaacacaaaatgcttcgctgtagtaaacacacgcattcattaggaggctgacaaagaggactcttaatcattcaaaaagacaattcattttttacacactccccaacaattagtgacgacgcaaattttagagtaaaaggcttcttttgaccaaagcccgcctttaactttgaatagtatcccacaacggactaatacatgtaaccgctggcctctccatctcttttctccctatgttcccaccaacacaaaactgatctataaaagcctaagaacccggaactttaaatgctgcgaacacttgtaaaataccttttaagcccaagaggttctttacaacagacatttactaagtttgtgaagaaattaaacacggctcagacatgttcaaaaaaaaaaaaagtaagcccccccaaaccagcacatgtatccgggcgattcatatttccaacggacgtctttaaccgtgatcaagattttttac

SEQ ID NO: 1190 - DNA, 509 bp, Rattus norvegicus
  Genbank Accession No. AI145058
tttttttttttttttttcacaatgtcttagctttattgacattacagtagacaggacaaacacatgctccataaaatatacattcttacgtgagaaaatagaaaggataccaggaagcagccacactgagcaacttgacttgtatttctctttagagacacttaccccagggctgctcagcctgacaccctctaatgggcaagagaagagggggcagcagggagtgtaagtcactcgggtgaagaggccatctccagtcaccacgtgatatacttcaagggcacttggccacctgaagatcagctcctctctgaaaacagttacagttgctacaagatcacttcacatccaacaggcacagacaggtcaagctgctcttcaccctgcttatcaggacttccaggaaacaatgggcagcctggagggagaggactaaaccttaccttatagcacacctaccttgagagcacttggctttaattcctaagacatcatcacctcgtgccgaa

SEQ ID NO: 1191 - DNA, 443 bp, Rattus norvegicus
  Genbank Accession No. AI145095
tttttttttttttttttatttgcagctgaatgtttattgcagcactcccaagtgatcactgttggatgaataaggaaacaattcataaccaataaaaatgttgaactgccttttttacagtaattgtacactcattgtgcttagtctgtaaagttgtatcctcagctcacccataaccttcccagaatagaacactctgtcatacattaacatagagccttcaaaaggtatacacaaggctcaactctgcaggccataccagatgctgtcccatccactagacagtttaagagggacacagcaagggccatgcagaccccatctcaaacatcccagtactaatactctgtatttgcttcttgtgtctgctttttctgaacatcaccacatccagttttccttcgcaagaagtctcctctcactggccatgcatttctgctcca

SEQ ID NO: 1192 - DNA, 456 bp, Rattus norvegicus
  Genbank Accession No. AI145106
  misc_feature (1)..(456): n = a or c or g or t
tttttttttttttttttgggccagaaatttaataatctatgtagtcctaagagggcacagctcatacccactgagaacacagtcagagaacacagccagtaaacccagcgcacatgcaaccgggtttaacaccaagatcagcgctccacccatttgtgcaagttcacacacgtcatgcatcctaaacggggatcaggcctgatctcccctcacccctggccagaggcaccgggacttctcagcctccccccggccgcggagagcagaccgtgggcaaccgcagagggttcccgaggaggctcaggcactgatttccacctgcccagcctcgtcctgctcccggattctgtgcacgccagcagtccgcagtgagcgcgaggagctgcgtgagcggccgggcgagctcggggcccgcggtggcgacntgtgcgtccggcccgtggcgggggagcgcgc

SEQ ID NO: 1193 - DNA, 471 bp, Rattus norvegicus
  Genbank Accession No. AI145282
tttttttttttttttttaaatgtagaaaacaaaatgacatttatttttttcttaaactcaaaattaccaagtagggtaagaaattaaatataaacacaaagtccatcctagccctgtttatccaaggcagcataaccaaatagactcatggagaccacctggtcaacagaggatttattaagtatctcatcggcgtcttcggtctggactcctgcttcgtcttcggccacctctcctcttgccctttggtggaccacgaacaaaacaccagtcaacactgattggctgtcccatcaaatcttgaccatttagtccctccatggcagcctgagcttctttgtatgtttcatactcaactagagtataccccttcaagtatcccgtgcgcctgtccaaattcaggtggatattttttatttccccatattcagcgaacttgtcatggatatcttcttcagtggcttcttcgtg

SEQ ID NO: 1194 - DNA, 323 bp, Rattus norvegicus
  Genbank Accession No. AI145362
tttttttttttttttttggttttggggaaactttattttgttgttttcaaacatgaactcaaaaaaacaaaaaaacaaacaaaataaaacaaaacaaaacaaacaaaaaaaaaccacacaaaaggaatttgagaatgagcagttacaatcccaaaggcagtatggaaggtcttgggttacatccccttcagtgcttatggtcagcatcttttataactacctggtgaactacaggacaaaggtgcactgaagagaatggtgagttcatgtaagaccacagaccactcaagacaaatgcccttaggaagcagtttccaggccta

SEQ ID NO: 1195 - DNA, 404 bp, Rattus norvegicus
  Genbank Accession No. AI145454
cggccgcgccgcagctcacgctccaggcacaggcgatagtcctccgacagcgagctgctgcccatcctgaccgagcgcgggacgaggtgtcaaactagagaccatatcatctcagctgtgccactctccaccccgcacccagcaactccaacctggaaatagggaccttgagagcttagcaagtcccgggatctatgatccccttcagccatgagacagctcagtgaccacagtatctacagcctcccctccccgtgacaccttcagcaccgcttgctgatcatcctcgtatcaacagcactgctcccatcagctgaacctcttgcaaccaaaacccctctcccaccgaccgtccccaatggcggcggtgctacctgctagtcgccagctatctcagagagctc

SEQ ID NO: 1196 - DNA, 567 bp, Rattus norvegicus
  Genbank Accession No. AI145556
  misc_feature (1)..(567): n = a or c or g or t
tttttttttttttttttcatcaaacacagattctttactttgtaaacctcttattagggttatagagttctgcttcttacatgcaaaactggtaaccaagtcaggtaaagaaatacttatagagagagagttctggatgatatctttcccctctagttcaatgtgctaagactgagacagaagcagaatttgtttctgtcaagggcagggagggcagggagggcagggagggcaaagataggacctcactaggtaaccctggctaacttcaaactcagagatccagcctgccactggcctaccaggttctaggagtagaggagagcgccaccacacccagtctgttttttgagacaaagtctactatgtaagttcagattggcctttaactcaaaaatcttcctatagccacctccaaagtaccaggattaaaggcatgggccaccatgttttggatgaccttgagctcctgatcttcctgcctgnggtctgaactcagagctttgtagtgctaagccataactccaagtctataagccttcatccttgantcactgtgtatattaa

SEQ ID NO: 1197 - DNA, 510 bp, Rattus norvegicus
  Genbank Accession No. AI145650
  misc_feature (1)..(510): n = a or c or g or t
tttttttttttttttttatgtgtacaagaggcactttattaactggctggaatgcaattacgtaaccacagggcagggcatacaagagaagggtggggcgcgatggcacacaggcaggcataggaaagcctgggcctccaggctgggagcctctggtttccaacatcctggtatctcacggatagccatagtggggtgaggggagggtcttancatatgataggtaaagtgaggaaccagtctactggcccccaagattaagaagtttggcaaacagagtctctagtttcaagtgaaagaaaccagataggcctagttaacttggaatacacaacacacccacacctcatcccctgaaaccatcccttgggtgaacttcagtttctttcctctcacaaagagggcagtgtgtattactggaagagagaggggtggggaggcagaccctattttcactcattttccaacctcaagttttccgtttggaagccatcagtcaaaggtactctg

SEQ ID NO: 1198 - DNA, 565 bp, Rattus norvegicus
  Genbank Accession No. AI145761
  misc_feature (1)..(565): n = a or c or g or t
tttttttttttttttttgaatcttcaacgactgatatttcagtgaatagtgtatttgttctttcaacttttctgtatgtttggggttttctttaataaaagaaattgtggggaaatggctgtctattgagttgccagttattggagggtgtgtgtaggagccctgcccagtggaattcgacttgggagggtgagggaggggtgagcaatctgtctggggtgaggggggttcactantgatctctccttggagagtacaatgctgatgtttgggttactccatcctgaagtagtttggaagaaggccaaaggatcatgagacagacattaccgagaagggatctaagacctgaagttgcactgagaaagtggcacggtgggggtgacaacctgctgcttcccctgccctgcttccttcattttttccaaccctaagacctaagagtagagaagatggtactacagttgactgggacncacaangggtaaagtgtctagagaccggccaccctgaagtgtctgctatgtttctggtgttgcgcgccctctcgtgggcttctggggaa

SEQ ID NO: 1199 - DNA, 553 bp, Rattus norvegicus
  Genbank Accession No. AI145859
tttttttttttttttttggagatattgctttttattgaacatgtagaagatccacttttatataattataaacattttacaaacagttttgttaaaaaacatttcctggattttatcactgtatggttaagacataagacatatataagtatgaaggtcattctccaagtattagaacagaataccaatggagtcacttcgttttttttttttccagcgctcaggaccaaccccagggtcttgcacatgccagaaggttccttaccgctgtgctgcccttcagttaccagtaacatttttttcataaacactgtattaacctctaaaggggtaaactaacccggaggaaggtaatcctcaagacatattgtcaaagttcaccgaagtcgtctacagtctgtctttccttgcactgaatctggctgatgaatagcagtgtaagaatgtatataagataatcacactcacttcaagatacagaacacattgtaaatcaaaatttttatcatctttgctctatggggagaccactcatattaccatttttacattt

SEQ ID NO: 1200 - DNA, 478 bp, Rattus norvegicus
  Genbank Accession No. AI145968
cggccgcgattgtttttttttgttttttttatttttggtgcaagaatcctgaggaatgaaaaccagcccaattttgcttcacatttatttatttgtatgtagtggtgtggaagacagaagaatgattctctctttccaccatgtgggttcctagatttaactcagattgtcaagcttgggtgccctcaccagcccccagcctctgtaagtctgccttcaaatggctgctgtggctgattttggccacaatctgattcctactctttcagaatataaggctgctacggacagagctccaggagctaggacagtctctgcagtcagcagagagagcctgttgccacagcacaggagcaggaaaacttcgtcaagcattaactaactgcgatgacatcttaatcaaacaggtaaggacagcctagagagcctgccctttatcctgctctgttccagcccactccagtgtgaacgtgagagg

SEQ ID NO: 1201 - DNA, 538 bp, Rattus norvegicus
  Genbank Accession No. AI145991
  misc_feature (1)..(538): n = a or c or g or t
cggccgcagccaccgacacagcggaggcggcgggcagctcgtcctccacgttgatgatctccacagtgcgcgtgggcccatggtgcttgtgcagctggtgctgcttgcgcagcttgtagaaggccaccagcatcacggcggccataaaggtgatggccacgaagcagccgatgatgattttggtggtcttcatgacatcgtctaggtccttaagtgcgttctccgtcacgtccgtgatgggcaccgtgaaagccttctctgtgggccgcgaggagcgcggggctggtgccgtggtggacgctgaagccggggctgcagcgtcaggccggccgccaccccacgcgccatcagtcgtgggccccgggggctccttctcagtacctcggggctgctgggcctcctcccccggctgtgtctccagcgtctccacagtcaccgtggtgaagtaggtgtagccgcccgcnacccctgcancgcccccaccccctgggcccccgccaccgggccctccggcagccacagggtccacggncgacac

SEQ ID NO: 1202 - DNA, 352 bp, Rattus norvegicus
  Genbank Accession No. AI145997
tttttttttttttttttgagatttttcttttaatatgcgacgaaatagcttgattgtatattttccaaagtactttccagccacatctcccaaccatacaaaagtttgctcccatctttgaatgcagtaaaagatgctggattatagttccacgcaccttttctttgaaagcaatgtaatactaatggatttaatggcaatacattcctcatctaataaagaaaaacatccacaagtatcagaaacccagttttgaaagatgtgcgttcattttgaactgaatcagcttttgtggtgtttttaaaggcagcagtttgactcacaacttgctgatcaaacacatttctactga

SEQ ID NO: 1203 - DNA, 534 bp, Rattus norvegicus
  Genbank Accession No. AI168975
caaaggttcattgtcacatttattagtagtagctgcagctggactggggcttctatggggactgttgggacaaactttgaggggcaacaacaggagggaacaccattgatggtcagcaagggtcttaaaatgggatacagagcacagtgacggtcaccatggtgctgtcacagcacaaggagctactgggtgctcatttccttcctgaacattccctgagcctcagtccacgatggtcaacgcctcccacaaacctggagcttttggactctggctacttcctggaggtgaagtcacacaggccacgccctgccacccccaatcatggccagtcaattgtcttcagtaggcctcagtactgaacactcgtaactgcctgacacagctgaccctaccctacctagtgacagctggaggcattgtctccattcttgcctgtctgcctgtgacctgagaaagaaatggggaaaagaaacttccactttcccaagaaagctggaaaaaagagagggcagattgtttctgggcaggaac

SEQ ID NO: 1204 - DNA, 510 bp, Rattus norvegicus
  Genbank Accession No. AI169104
ggttcaatgcatttatttaaatctcgaggataataaaacatcagaagactgcagttacattaaaagtagacaagactccaggaatcccatgtaacaggttgcacatttaggcagctcgtacctaactctccaggagtttcttgattattttcttatacagaggtacttgccggtccaggcaaattttgctcccattcttcagcgtggctatgagctggggaaccgcacagtggggtcctgctttgatcacctccaggctggtgatgcgtttgagatggatcctggaagaactggtcttcacacacacacagctaagatctccgtcgctttcttcaggactagccctggtgacagcaaccacagctggcagcaacagcagacccagaagaagcagctcagggctgggccggaggcctcgaaacaccgcagtggcactcatgtcaagagggtgctgctagatccaagggctacctcggggaaactggggtctggggctctaagcctcgtgcc

SEQ ID NO: 1205 - DNA, 668 bp, Rattus norvegicus
  Genbank Accession No. AI169159
ttttccacataaaccttttgttttaataaataatatttgtggcttagattttgaatcacatttacagataaggaagactagacctaaatagtaacagtgcagctagtgttcctggaggaatgtgcgccccacatgcaccttacgcccaaagagcaggggacagcatgcacgactcactctagacgagagcaggagcagggaaagaatgggtctttgagggctgcacacaactgaccccacccatcccactgtaaaccagtgcacagctgtggcgtcagatgggctgggttcttgcccacaccagtggcccttctgttgacactgagccaagggcagtagctgtagagggtgtccactgattaccagtattagaacagaaagaggaagccacacagttaatctgtttctccaagagtacagccgtgggtgaactgcacctccttaggctcagtccagaaacttcctattggcatttgcaccaaacaaggctccgcggacttctggcatcatctgctgggctattaggtccagtcggctttccagagtgttggaaacctttatcttgcggtccccattatagatttcaactccaccagctatgtcctcaggcaggtaggcctcctggtcaatctggacgtcaacatcttttttggtggcaattttataca

SEQ ID NO: 1206 - DNA, 702 bp, Rattus norvegicus
  Genbank Accession No. AI169170
aaagtgaatatacaatttttatttaacattcaaacttcattaagacatgtgcaatatggcaattttactggggggttgttaaccctacctaggatgattgcttgctgaggcttagcaacagggtccagttcacacttagcactaattaaatactttattgaataaatacaataaacaaaatgcattcaaattttctctaaaaaaagatcactttaaagtcctttctagtcaggctaatgacaaacacaataaaggcagatatgctagtttaacataattggctgattttatacagcacttatatcttttagtccacaagtatattattaaatgatagagaacatctaatacaaccatttctacataactagtaaatgaatttctaagaaaaaaagattttacagaccccatcttttatacccacccccaacagtctaactctaaagaggataaagccaatgcctttcctcacaagagctcaggactaaagtcgctttgctatcagaatctgtatttgtgatccgttatgagcattgagacaagattcaaatattctcaaagaagcacaatgcacgttgtgatcgcctattcagcaacagcgagcactgcattccaaactatctcatcccaggaattaaattaggtcagccacattcatgggcatttcctccactgtagtattgtagaaagtctcaatgtcac

SEQ ID NO: 1207 - DNA, 637 bp, Rattus norvegicus
  Genbank Accession No. AI169177
aataatgacaggcaatcaagtttattcgtgttcacagaacatactaggcgaccccagacagccgccctctgacaatccatggacccaagacttccagtcaggaagacatcaaaggccacagaccgtattcccaagggtctgccaaagtcttacaacagagtcgaagtgctggaaaatggagtgttacccctaaacctatgccccccgaccaagactaaactaatcctcccacaactctgtctcacggaccctataaatcgtaataaatatctgtgtcacagcaagggggcatatctcgcacccctgcataagttagaataaatattacatacacccctccttcacctaggaggatatacataaatacataaatattaattagacaccgagaagacctccgtccgtcaccagtgagcctagccaggacccacggtgcctcgggctcgccccaagaaccggcatcttggcggtagtgttctgagttagcgttgccttataagtcccagtttgggatacgttcttgcgcaccaggtacccctggtgcctctttgggttttttttccggactgtgacccatcgcgtttagaatgccgccgggtgttgctggagaaaagctttgagatccagagcatagtcc

SEQ ID NO: 1208 - DNA, 351 bp, Rattus norvegicus
  Genbank Accession No. AI169211
gacaaaggcaaaagaatctttatgagttttaggtagtctggtttacatagtgagttctaggccagtagagatacacagtgagacccccagctccccaaaaaagaaagaaaaataaacagatgttactcacacttgatcttggctgagccagtagagatagctgtggaacgggcaaagagcttgacaggtattgtagttttgacacggcgaaccaaagggactgtaacacggggtcgcttcacgggaactgcccggggcacaggcactggagaaagtcggcctcgataatcaaacagcctgtatatggcagttgctgctctctttagccccttgggtctattaggcttgggc

SEQ ID NO: 1209 - DNA, 561 bp, Rattus norvegicus
  Genbank Accession No. AI169265
aaatcctgatactttatttcttatatcctagctatcaaatcccatatgaattttcagcattaaatagtgacacatatcaagtttcagagatttattcatcagtgtaataaactcaaaaaaaaatcaacatgatttcatgcattcggagacatagttcctgcttaagtggaaaattgtgcggatggcttctgaaagaccttcattgtaagcagctttgcagtgaacttcacagtttagaagtctgggccttcttttttcagtttgctgtagtccacgttcacagaatagaacttatattgttcattgggacccagtttgttccaaggctctgggttattcttcctgtcccagctgacatctggattgaacaatgccaagcgcatcacatacagtgctgctccagtaccccctgctccaataaacacgaagagagggatcaagctgggatgtttcttggcttgcccgaggatctggcggagcatgtttgcggcacaggcctacctacaccgagagagaagattaggacacacactaaaccgcttctgcaacctgcctcgtgcc

SEQ ID NO: 1210 - DNA, 581 bp, Rattus norvegicus
  Genbank Accession No. AI169272
tgctaaaaagtcatcggggaaaacattaacaaaatgaaactgacagatttaaatatccatggaatccattttcattcctacactgtgatgtgcctaaaatgactattggagtgcgccgccgccggcacccctggttgtatgggaaacatcactcacagcaccagctttgccagggcacggtgggtgcacgctgacgggagccctggttggtaggagggggcagagcgagcagagtggagccagaggttggctttcattcccaaggatgggggcagcaagaggccacctgcagacgacagcagagctgtctctgaggccaggcttcctcaccctggactccttcagatcctccccgctgtcgtctgtgctggtgagaccacagataatgcaaacagagtgcatcacccatgccagagtcaccatgaggacaaggacagacagatggacagactgaaggggaagggagaaagcaaagcagaaggaacttaagacaaatgaagggagggtccccttgctccaccgcagcaacttcctgtctttccaagttgagcctcctgcaatgctgccctgccctgccctgc

SEQ ID NO: 1211 - DNA, 561 bp, Rattus norvegicus
  Genbank Accession No. AI169311
tacacaaaacgagttcaacattcgctttagccaacccccagttgtacaaaaaaccatctattctgggtgtgaatctggttcgaagtctcctaatgctggccaatcagacccataggggaaattgccctacagagggatgaaaagaaatgacaagaaaggagcaataaatttcactgctaataaacgattgctttcctgctaaacaaccaccaatggccttccttctagccattccctcattgtcatggattcaatgcagggttcttcgccttccttcaggccgctgttttcttgaacatggtccctgaagtcttgaagcctcaattaacccattgtgaaaataggaatggtcatagccctcaccttgtaaagatggggtgagggttaaacaaagggtacaggagggctctttggacctgctgtttggaaggcatggcgttactgttagatgttaacacggacacctcactccctagggaaagaattggcggccaggagatgaagatcttaatccatgttcccatgcctcaccctgagtgtcctgctggcgtccttccacca

SEQ ID NO: 1212 - DNA, 482 bp, Rattus norvegicus
  Genbank Accession No. AI169512
acaaagcagatattgatttattaaagtaaatctcaatggaaaaaccaagaggttatttaggtctaaaatccctagaatgtatgctttcctagagagcccacaataaaaaacataagcagataggcaggcatggtggtgcacacctttgatcctagcactgaggaggcaaaggcaggaaggatctctgtgagtttgaggcgagcctggtctacaaagcaagtccaggacagccagggctatcacacaggaaatccttacaggccttaaaagatgttgcagacaattacagtataatagtaaataaagaagggcctacaggtttcttttcttactaggctaaatatacagtcttttagagatcttgtaggtggctctgaaaagagcctttgtgttcaaatttcaccccatcccttacgccctctcccctcgaatgcggcgggccagctggatgtccttgggcatgatggtcacacgcttggcgt

SEQ ID NO: 1213 - DNA, 569 bp, Rattus norvegicus
  Genbank Accession No. AI169591
gacacttaattagtcatgtttaattcactgaacgcaagattagattgatgcatatccaaacacgctattgcaatgcttttttaaaggacagtaaaaatgttgtcatagtaacattatctttagatattgctgaacacaagactttccctgaggtgtaaacatcaaataacttgaacagctttacacatcagccccattaaacagtttattacaacactacatctattgtaatcaaattggtgctgtttacagacattatcatatgaacattttaacaagaacaaactactataaaaacaagcatttacttgactttttccaattgcttgcacattataatggccaaatatataaccagtaataaagttgcaaaagctattaactttttaaatcacacagtttccttcaaataaaacagttaagcaacataaaaaataaaagtagagctactggttaccatttatgcagatttgctttattcagatctattcctgttcagtttatccatgaatccttacaggttcagttcaatcaagaagcaaactgttggacaagcgtcactttccccg

SEQ ID NO: 1214 - DNA, 655 bp, Rattus norvegicus
  Genbank Accession No. AI169601
gtaacaaaaatatttatttcctatgacaagtagaaaataacttagacattcattctgaagccaagggaatggtttggtcactaagagtgctgttccacagcatgagaaaggacctgcattcttgaaactgggctcatccccagaatccactttagaagtttggcatagtgctgtgtgccctaaacccagcgctgagaaggcagagccaaggggatgcccaacgctcagtggtaggccgatctagctgaattgatgagcctcgggctggctcaagatggctagctactaaggaacaagtactgaagaccagctttgacaggtcaggtacactgaggagaggtgtggagtcagtgattaatcaatccctcagcagacttgtgtctgagggagtaaaacttagttctctggggcctgcagaaaactctctggggctaggtccggtgggaaaagggggtaacaggtacgcgtgtgcacacacacacacacacacacacacacacacacacacacacaaagaaaatagaaggcattgacccgccccgtctggaggaccacgcaggtcatcacagtgttacttgaagagcagaggtagaagcgtcaagtttgaggcttgcccaagatacagaaagagtccatggttggcccagacaattcc

SEQ ID NO: 1215 - DNA, 571 bp, Rattus norvegicus
  Genbank Accession No. AI169615
gtcgagcaagaatctgttaacagttttattttttatgttaaataccatgggacaggattgtaaggatgaaaaactcagtcaacaaactgcctcacaagggataacaaaattctgccatgatattagcaaaggtaaaggagaaaatttacacagttagaggcaccatttcccccacagaaaacctcttggcatttcctgaatgagtgggattagcaatctaaataaatcatatttcaagaggtaacagcaacagataaaatttaaagggattattaaaataacatttacaagactgaacaattcttgaactcttattaaaatcacaaagaaagaacaattctttattatgaatttcataaaggactggatgtgcgactggcatctgctagtgatgatctggtaatatacaatttgtccagtagccgaacagtttgtttttattgtgttttctaaccgtaagagatcattaaaggcaaagcctatatgacgctgtacacacaaaaaaaaatggtcaccacgggccatggtcaccgtgggccatactaccaatgaaatggtaggtaaacaaatc

SEQ ID NO: 1216 - DNA, 597 bp, Rattus norvegicus
  Genbank Accession No. AI169640
ctctggattaagacctctttaatatacataatgtatagtacttcatataatttattaatgtcattttctataggacactgtaattaattcagtgacattaatattgacctcatacaaaggatgaaagctgggttttcttgtgtaccaagtacaaaacatgtgttaagaagttacatagacaacagttgcacgagatcaacttcaggatgactcggtttacagtagtcacttcacatggtttccatcaagacttggatgccacctggtgtagccaagtttgtgggacgacagctgtaggcctgactacctccttttgccagctccacttttgcctgttttactgctgccactacttgatttgccagaggattttgaagagaagagtcttgtcataaactcagagacatcaggcaattcatggttggaattcaacatgttcattgactgctccatctcccgtctcatgtcagggtcacttgtgttgaccactttgggcagaagcacaaatatcaataatgggagaaccatcatcataaccattgggttcatcaggaagtctgtccagccccatgattccctcttaataaagtaagaagg

SEQ ID NO: 1217 - DNA, 547 bp, Rattus norvegicus
  Genbank Accession No. AI169668
gatccaggagggtatttaatttacatagcagccacgtggggcctgtcaagctgggcagtggggtacttctaaccccagatggcatcccctatccttttccttcaggactgtcttcacaggcccttggataggtcgccccacattgtgcagaggatgctccagttgaaaggaagagagaaatctgggaaataaggctgtccccaagcggggaaagtcctaaacctggagttggttgcctacatggtagctcaggggtcttgcaaaaaccagtccacgtcctaggcacagttcttactcagctgggccttcagaggaagccctcccggcggaactgttcttggaggagggctcggtactggtcaaatcctccctcgacccgagtgacactgcctttctcgcacacccacagctccttgcacaccagtcggatgaagcgctcgtcatgagataccagaaccacaccacccctgaagttgttgagagcatggcccagagcttcaattgtctccatgtccaggtggtttgtgggttcatccagaatataaaa

SEQ ID NO: 1218 - DNA, 492 bp, Rattus norvegicus
  Genbank Accession No. AI169751
aggagggatgcagctgcagatggtggagcacgtcaggatcagaaaccagaatcctctatcaagtctggagacgaggagcattaagagcaatgatgacgacagtaacaatagtgataatgaccatgaggatgctgaggaccagggagctgatgttcaggcatttggcagtggatgcgtaagcctgggctccagtcatatcacccaccatcttccgatccctagacttcacagagtaggcatatgcaatgaagcccaggcagcagaagttcatgaagagcgtattgaacagggaccataccacatggtcaggcacagagacctctctgggcatgttgatcacggtagttctgacagaagccgatccgtggggtgcccccagttcagacacctcatattcttccttgattctttcgtagtttgggggttgtcccccagtggcagcgttcacgaaggcttgagaagtgtggttcatggtaccgagcaaaagcagca

SEQ ID NO: 1219 - DNA, 623 bp, Rattus norvegicus
  Genbank Accession No. AI169756
aacggtgtcataaataagtaatataactttattaaaatgaaaagacaatattcaaaataatgcaacaaaatgaacaaatcctttgtccaatactgtacacacagtgcggagatcagtgcattttctaaagcatgttttaaccttcatttagttcatactaaaaataagctttaaatagctcaaataatgtcattcagcagtttaaactgaacagcttgttgggacatggcagcggtgtccctctgttagcaagcaccttctctttgtgcttatctatacaagataaacaatcagaggatgtaaaaattgaacacaagctacacgtctcactgactctcagggcagtgaggcagccagctgtgagttttctaagcaggaagatgctgaagtgacctctggcattaagacgttctgtgctattggtcagaagtgtttcacttaaaaagcaaacaatccccaggaaatactgaataggaaccaacaacacaagaccagcttgtgttgtaatttaaagtctcaaaaacaaaacaacatcccatacaccccacgataactctcaatcatggctaatcactgggctggtctataaaacttatacccaacactgacggccagcaccactc

SEQ ID NO: 1220 - DNA, 455 bp, Rattus norvegicus
  Genbank Accession No. AI169993
aaatttatttctctgtaaatacaaattccaacatcaacaaacaatagtccagtggaaaaatactagccattaacattgaaaacgttttttattagtttaataaatagaactttggcattcaaatttctagctgtaaaccctatttaaaaaataacaaaacaaaaacaactcctttccaaaaaggaggtaaaaataaaaactcagaaggcaggagccagccagtggcttcacatttttttttacaataactgtatctcagttaagtcatgaacactgtatttacacatgaggtattctgtggttcaaaaactgaacctagtttacagacccaccagtcagtgactgattgcacactcggctgtgctcttaatgtgaccgtctagcaccttactacttctggtcaccacaccaacatgatgctcaatttcacgtgtaagtacctaaataactacata

SEQ ID NO: 1221 - DNA, 502 bp, Rattus norvegicus
  Genbank Accession No. AI170056
tccatttgttgtcgtttttttttttttttgtaaacaaagggttaatttatgatataaggtaagccaataagctctcatgtgctacagagagaaaacatacagtgcacataataaatgaattccatatactgagaataaataggataagcgtagtaaagaggaagtcaagaggagcccacagttacagtcacatgacgagaagttaaaaaaaaaataaaagaagaagtccggggagaaacaactttatttatttggagccatgcacttgttttagtgccaagggcacaggaagatggacaagataaggtcctgatcacaccagatgcttagaaagatctttcagtggctaacctacatctagaagagtcatgaggagtagtggcagggtgtgtgcgccacaacctttgaggaaagcgatccttatacacaggggaaccccaacaaccctgtcattttatcatgaacacatctgcacttcttgcttttcacagacaggatagga

SEQ ID NO: 1222 - DNA, 525 bp, Rattus norvegicus
  Genbank Accession No. AI170059
cttttgttcaataaatgtttattgctttttcaattatcctatttacaaacaacatgggattcttggcctcatgatacaaagcaatactgtagtctagcagtgtaggcaacatcatgggaaccagaaaaaggccaggccttttttgcaccagccaacattttccagttgaaaatactaatttacacataaagaacacttataaaatgcacttgcatgtaaacactgtaaaatcctgcatttaaaactctatacctcaaagaactctacgtacataaaaaatagaagaaatttctaactgataccaagaaggcatttttaaaactacaaacagctttctttattcaatttcaaagctaatactctgcaaatacaataaaatctgacatttcatatacattcctgctttatatttttatattttaaaagaagccacctgtaaatactattttcttttgcaaagtaacaaaaaagaacaaaaaaaaactttaaaaaattacagtaaaacataaagtagttctcaagtgg

SEQ ID NO: 1223 - DNA, 612 bp, Rattus norvegicus
  Genbank Accession No. AI170244
ttttttttttttttttttttttattttattatttatttattttaatacaaagctttggcattagcaattttatgaaaaaataaaatgtactaaaaataaacgcttgtgtggcatgattggtaaatgatgcacaaaaataggttcttttttccttcaaggcaatcagtcagaaagcagtgttttccttcttcaaaaccattctacctcattagcattcaagctagctgtggctctgatgatcatgtagcagagtgtgagagcactgaggaggccaaaactggcaataataaaccattcttttgttactgcaatgttgatttcacccgttcgaggagtgagctccccatcttgaggaagaggcgatatcccagaagttctcagtggctcaaggccaagggaactgtcattggcaaggtcaccaagggctgatcttcggttaactgcctgggttctggtgagcctttccatatcaaacgctacattatcagtacatggcagatttggcacaattcctagggctttcaaaatattaagtttacacataggacaggtacagtgttcactgagccagggatccacacaggatttgtggaaaacatgcttgcaggggag

SEQ ID NO: 1224 - DNA, 678 bp, Rattus norvegicus
  Genbank Accession No. AI170251
aataattgatatatatctttattatacacagataaaagaattaaaactgtggttatcaaaactatacctctaagcaggttcacaaagaccatgagacagagggaaggttacagcaggggtgttcaaactggccacagggatttttcagggtatgcttttaccctcatagatgaaaaaaacagtaacaaaaccaggctcactcaggaaaaaccagaatagagtattgcatttggaaaccaataatagtccctcctagaaaaatatctgtcagtttaatgaacgaacccacagataaaacaaacagggttaaaaaaaaagtttacatacacaactcacccgacaaatgtgctctgttaatacaaccagcagtacgctcaccattcaaaccatgaggtagttacagtacaaaaagacgggcacgcacctgcgcaccccacacactcaggcaagcctggggagaacatgcaggaaatggatttacaatctcattaccagacaagcatgaggccattttgtgtggcctgcagacacaacgcaagactttgcaggtggaactgggttcagccagactgtaacaacagtcttaaggaaacttgtaggatatgttataaaagtaaggcttgtaactttgtattaaatctgtgaagggtgaaaaagcggtcagaaacactgtaacaa

SEQ ID NO: 1225 - DNA, 602 bp, Rattus norvegicus
  Genbank Accession No. AI170279
cacaagacaaaaatttaatatatttaagtctatattggaaatacacaaagacaattatgtatgttattagcaagtcttattttgtacaaattacagaatatcctttttaaaaaaaacatacatatgacctttgttggtacatttctatgctggcaaatatatttctgatacaaaggcactttgaaaacccaatatggtttggtttgtaagtttgcaaggtacaaacaatttttacaaacgtatgattacactgaagaacgtcagcaactgtgacatcacatagaaaacacttctttttgtaaaaacaacactggttttatggggataaaagcagtggtttccagcagctgtagtgaagacattcagaagggtgaaggcctccggtctgaatttctcactggctgggtggggagataaggatggggtgaagtgatcagcgagaacccccagggggagagataacccagtaccctagaacgaacccagaaacctcagcagtcagaatggcttgaagggaaaagcacacaggcaggtctgggcggattggctgtgacccccgagctcacactggctctacctgcgtgcttggtgcttccgggctg

SEQ ID NO: 1226 - DNA, 635 bp, Rattus norvegicus
  Genbank Accession No. AI170313
tctttatttatatataacaacagtacaaattgtgtccttggcttgcaaaataggagtttcatatttacaataggtacatgataatatattagataacaaaatcccgctttattggaacattttaaatacttcattttcttattatttcataacacctgtaaaaacaacaaaaccagacaaccagcattgtactttcttaaaaatagatataatacagattccagtgtgtcatggggaaaagtctgagtaggagaggatgaggagaggcagtttggctcaaggccttcatgtgcctgtatacagagcttgtccttttctctcccatacattcaggagctttggtcctgtttgatggggaccacacttccttatgcttggatgtcaaactggagatcaagcatgtcaaaatgatgaccttgactgaggctcaaagaagcttcttactcccttcattgggttactagggtacaggcagcacatagcagggaggaggcagctcagtctggggagatggtttgggagagactatcagtgactagtaaacgaaagcaaagagctggtggaatgataggtagaaagctaaaatgagagcaagactctacaataactcaccctcctggcatggcatggcctgt

SEQ ID NO: 1227 - DNA, 604 bp, Rattus norvegicus
  Genbank Accession No. AI170363
cttagtgattctttatttataaggtaggcagaagcaactgttacaatgtagaagggagacacattacacgctgttatctatacaagtttcaaacaaaaactgcacagggagaggtcaactctcaatacaaactagcaactaaaccacaataatttacctttagaaagggtttgttttcagctgtgacactgcttttacaatgtgcaaaaacacaaacagaactacccaaggtgtttgtcacattctttctacattgaatttggcaacagtttatattaactttattcagattatactaacgtttaaaaactaaacaagtgagaagctgtaccaaggtacagttacatccattcctttcaaaggtttaaaataccacttgtctctattagaatgacctcgcagcgatttctgcatctgcaaaaaccatctcaagcatcatatgcacaatgcatcagctactttgagtcatcaaggttggtgggctaaaccacaggcactactgtttgcttatagtctgtaaaaggagcttgtttttcaaagaaaagagcttaagtcatttctaataatcatgcctttgctttaaagccataacacctcgtgccga

SEQ ID NO: 1228 - DNA, 688 bp, Rattus norvegicus
  Genbank Accession No. AI170379
ggttgcatcgagtgcctcacagacactataaaaccaaaacggaatagaaacatctcggtggttaacagaacacaggaaagccaggtacagagtataatttgtcaaacacaatattgctgctccccgccccacccccacttcctccaatttataaaaagaagaaagaagaaaagaaaaagccatttggataaagagcaacacaaaatcaaaattggcagctcactgaatgcttaaaattcaggaaatcgtttttgtaactgaaactggatacattcaccatttctaacacttaggctatttttttttcaatacatagtttaagtccattcttcaggtgaaaaaaaaacatgtctttaaacacaacaatcaacactgttttggtgttccttgtttgtgtgtgtgtgtgtgtgtgtgtgtgtgtgtgtgtgtgtgtggacactgatctatatactgcttctatgccattgcctagggtgggcagcatgcatgggtaagaggaagggacatgcactatgtcatccaagtgccgcccagcctctgccacagatgacagaccctgcatccctcatttctagatgagaaagccaaggctgtcaagtcataggctctggagggaagtgcgagtataaacactgcagtgtggaaatccttcaagaaggtttttaacatctacagaagctaaacattt

SEQ ID NO: 1229 - DNA, 705 bp, Rattus norvegicus
  Genbank Accession No. AI170384
ggaacactatttattaggtcaatagttcatttagcaatacaagtacagaatatatcacaatgctggttacaaacatacttagtgtggtttaatattacaaataatggcgggcactacaagtggggatggtaggaaaggctgttctgacccagtgaactgtcttcaggatttattaatgaccagagattctactatagaaattactgtggcacgatagtggggattcctgtaaagaatgacagtgattcgtttgtaattattccattaagggtttttctttttattttgagcctattaaactaaaacccctgttacttaataaggtataaaaatagtactgacctggtattatttaataaaatgtagcattcattcacataaaagtaaaactaaattgaaaagttttagtcaccatggcaacatattttcccataaaaggaatatacagaaacgagcaatgttatacaaatggtacctgcgattcagtgattccacactttgtgcaccacaaccaagtttcctagatatctctatatatagcatatatatttaatcttaaattttacttttgaaaaacatgtgcacttcaacaaactcattaaggccactcatgctatagatacctagactgcaattaacaatagtgttatttaataaatcctaaagcactctccctcaaatcgctatcatgggaaaagccagttt

SEQ ID NO: 1230 - DNA, 492 bp, Rattus norvegicus
  Genbank Accession No. AI170406
gccttttatttatttaataaacaaacaattccttcttgcttttctcacagacttctgcttacagagcttatttttaaattttcaaaacatcttcaatgagtcattatcaaaaataagtttcctcttgacttgttacaattctggttctttgtaggtaactgtgaatgtccctgtatgactagaggaaaggtcaatagacataaaaatggtttggggggaggggggagtgttgtgtaggacacaaatagagtgtctcaaaatacctatcaacagccaccttccctcctcccatccttcatgtgactcatctgtcctttgtgtctcctccaggaatgctgttgaaacctctgtctcaaataccttggctgttaaatggctcatccaaaatgttttgaccagaaaagtttgcaatatcagatatttttagactttagaatatctgcacatgcatggtgagatatttaggagaatgggatccaaatccctcgtgcc

SEQ ID NO: 1231 - DNA, 683 bp, Rattus norvegicus
  Genbank Accession No. AI170407
ctgggtacatgaacatattcacatacatatacacagtcagtttccacatcccacaaacaggctggattacaaagatgaggtatacactgctgatgtgtacatcagaggttcatggctaaagtgtttggttagaatactgcactaacatttcagagcttctctggtaaaaaaaaaatcccattaaaaaaagacattcaaaataagcacattcttctaacagtaaagactcttcccactttttttattttgacatcatgatagttccataaatttaaagtggaagatagctgttcaataaaagccatttcatatatataatatacataagttattttaaaagtctgtcatataacagattgatttggtgctaccaaaaacttacgatacaaataaatgactacaaaggaaaccatcactaaactaagacacacgggaacaacgttgcatttcagggggaaaaaaacccaaataatttctatcatgttaaaggaatcacgttcatttgtcattgtgtgcataatcatattcctttaaagcagactcctcagaacctttaaatttaaaaatgttcaggtataagtctttctgtacattcaaaaacaatcatattctgattacatacaatgctttcatcgtgcaaaaaaagccttagtcaattgttttctaaggtctaacgtcaaatg

SEQ ID NO: 1232 - DNA, 503 bp, Rattus norvegicus
  Genbank Accession No. AI170502
  misc_feature (1)..(503): n = a or c or g or t
ggcagtcttaaatacagctgtattttttcatctctgaacacactccaatcacacaccttctgccctcccactcccaaatgcaatccaaaggcattgggccagacacagcatgcgtgaggaggggcctgcccattcactgaagctgggggcaggacaaagcttgcaggcagagaggcctcgaggtacacgtggggcttcaagaagccggtgggctcacttttgtatcaggaaaagaggaccagggtgcagcacagtgacaagactcctgatttcagtcaccaggacccaggacccagaacccagtggtttcacagtgggccaagcagttgcggggttgaccgacattctgccctcaatagaggcactccctagtggggacactggaccaaggaaaagataagttctggtccagaataaggcanaaaggtgtctggttcaactccacatgctccttgaagaaatgaacgggacatgtccagggaggccaactttacagcatgtct

SEQ ID NO: 1233 - DNA, 333 bp, Rattus norvegicus
  Genbank Accession No. AI170525
catgtacaaagctaatttattatggacaaaataaatgtacactctttaaaaatattacagcataaatttaagagactaacaaagtgcaaaattttcaactatttttgatcatactatacagaaacaaatcaaacattaactcatatacattcagtgaagttcttaaaaatatttatgtgacaaaacaaaatacatcttgtgtacttaagttcataaggatgagagcagaacgaatgaattgcaccaaacagtaatttggttatcagaatgctataattaaggttatttacatccttataaagtctaaaacttgtttaactttgaaacccccct

SEQ ID NO: 1234 - DNA, 532 bp, Rattus norvegicus
  Genbank Accession No. AI170561
aaaaaaagctaattttgcagacaggtttccatgtaaaaggctaggtatttagccacctcagcattgattagtttcagatgtctaagctctgttacacatggcttcccatggcttcactctacaaaacatatttacaacgtgaagatacatctacaagaaatctacatttcaagggttttacaaatcaatcttgtatctttcccctgaattgactctcacagaccccgtccccttgtcatttcatttgcccagcttaacggtccatggtctactgaaatgcagctcaaaatgttatgactgggcaacagatttacagttcctctatgagatcatgtgcaattattcacatcttcaaaccatgaaggaattctgattttttagcttttcgagttccttaatttgttgtctcaaaaagagtatcctctgctctcgcaaagttgcttgaatttcacatactcgaactaatgatctcaaattttttaactcagtacatatttctgacatatgaacacttcccatattatgggcttct

SEQ ID NO: 1235 - DNA, 488 bp, Rattus norvegicus
  Genbank Accession No. AI170632
ggtcttgttttgatccaaacattggtgttttaaaggttgtacacaatatttgttaaaaagaacatataaaaatacctttttagaagcttctataagaaagaaaatacaacgtttaaccccacaactttcctctttgctagaactgcaaactaccgctacagttttaaatagactttgttgtttaaactatacatccaggaaaatctaaaaaaattaaagaaacgtgcatataaatgattgcatagcagaacaagaacattatgtgcaaacagtaaagaaacaaaagttagaaatactattaaatatacaaaggttctagaattaaccctccaaacacattccacaaacagttcttaaaaccatcttttgtagtctacaagcaaggactagatttctaaaaacagaattgaaaggaaaagtaaggtgatcctctaagaggatcgtcccccacaatatcttcactcacatctgtaagcagtgagtctaag

SEQ ID NO: 1236 - DNA, 591 bp, Rattus norvegicus
  Genbank Accession No. AI170663
aggtggtaccaatctgtgtttattgaaaacctatgtccagcacatggtgcatgtttcaacatcgacaagacataggtgtatcccctgttcagtgaaaaacaacaccacccccccacaaggagaaaaggcacagtatatacacaagacacgagggctaggctgccccacggcaggggccataaattatagtgccggctggggacaggtggaaggaaggtagagtaggtggggtccaagcacaggaagggcctgcccctacctactctctgcttcaaccagcttgaagggatgagaagcacaaggagggacaattcctttcaagtctctcaggaagccctgagccaagcagtccacaaaagcaggaccactcttctttctaggactcccccgatctcaaggcaagagacctgagtcctgctgcctaccctgaaaatgagaggcttgtggctgggaaaggtgtgggaccagtgtctgccgccctggcttattcagacaggaattaggggtaaaaatacactctatgggaggtaggagttagggtgggggaggaagaacaaataatcatgctgaagacccctggaccctcgtgcc

SEQ ID NO: 1237 - DNA, 478 bp, Rattus norvegicus
  Genbank Accession No. AI170676
gtactttccagaggtttttactgagaggacgtggggtggggggagggtcaccagagccagagggctgagggcccaggaaaggcacacaatggcaatagggtgtgtgtgtgtgtgggggggtctccctcttggtgagggctggtttagcagacacagcacctcctgtgacccctctttggcactgaactgggaacatggtgccctcattcttgcctagctggcagagggcacccccagtggcaactggcagtataggctagtgaggggccaggtttggcaccagagactaggtagattaaagggaccacccagtcacctcctgtgctggcagggtactcatgttggcaatttagacacctataaactgggagtccaataaattaggttgtagaggtggaggagtgggagggccagggctacattcttctcatggctcaggaggtaaccatgccattctgggggtaaccatggggaaggg

SEQ ID NO: 1238 - DNA, 511 bp, Rattus norvegicus
  Genbank Accession No. AI170687
cactaaggaaagccagtaactttactgaattgtctgcaaaatacaaattataccttatttccagcaggagaaacttttgaacatttcccacttgaattcactacagacagctgaatttaagtcccttgagatacacgcgtgcggttagcttaggtatgccatcttgtcatccagtggagacaaagtccagcttatgccgctgtgagcctctattggaatacttgttgcaaatgcttgaatgccctcatttacaagctattttaattattgtcattgaatggaaacaagtccccacacaaggaaaatgatgaaaaaacggtacggaaaaccatctgaagcaatccaagctctaagcctacggtgacccttgtctgcatactcgaatactgacgcattcaaacgacagccagaatccaccgcttaggcaacctctccgaattaaattgaggtatcaatcaatttgcggtatgaacagggaaggcaaaatgcaatacccgattatgaataacca

SEQ ID NO: 1239 - DNA, 594 bp, Rattus norvegicus
  Genbank Accession No. AI170793
gtcttaactacttgaattttattctcttttgacatgaaattgtggaacactcagataatctataccatgttagtattcctataagagaaaacaggtaaataaagtctgttaggcaatacccatacactttactgcaagaattagtggcatttaaaaagtttctggttcataactcatagttgttaaatgtgcatgacttcagtgttaagacactgtatcttaaaacagtctcttataatacaaactcatttacttagtttactgccggcttcacaggtcagaggaatagacacgttgtgccagagtcagagggtgaataacattctaaatgggagttagtatatgacctaagtaaagtcacaatctgttaatacaaccatggattttttttcacaatgttatcagatccattggaggagtgaagctctgttttccctgtgggcaaagttattaaagttcttcactttcatagagtccggattgagctgccagacgctgaaactctccttcagggttgaaagcttgtttcacatccaaacctttcccatttagggctaaatatttgctgaaagttggtcgaacacgcatttgctt

SEQ ID NO: 1240 - DNA, 349 bp, Rattus norvegicus
  Genbank Accession No. AI170842
ggtctggtgctccgggtcgggtgcccagctccgggtagatatttactgggctggtacaggctggggtgtctcccggccactcccaggcctctccaatccgttctgctctgattctggttcagggtgctccagggcatgccgggtgtctgcttgccacagctggaccaggtcggtaggggtcttccccgccatattcttagccatcatgtctgccccatgcaagagcagcagtttgatgattttgtagcggttgagtctcacggcatcatgcatggcactgtccccttctctgtctttggcattgatatccaagcccatggagagaaaatgttccacaatcttcacgtgt

SEQ ID NO: 1241 - DNA, 425 bp, Rattus norvegicus
  Genbank Accession No. AI170948
ctcttgtattcgtatgaatatccacatggccatatttacatacatttgcatacaatggggagggtgcaggatgacagttgggcatggggctcactgtgccgggggcagcagcaccttcagtggcacctggtccccctgggcagtgggaggcactgcccagacagccccagacgttttgccggtggtgctcctcttggaggtcaatggtgtctccagggtgagggaagcattggccatctcctggggcttgttgctggccaggaagcggaggaggttgtgcagggctttggccacgtcactacgggcaccctcgttgaccaggcagtagaggatggggtcagccacgcaattgaggctggtgaaggctagggagctgtggtaggcagagaagactcgcttctcgaagccacagtcccagggccggc

SEQ ID NO: 1242 - DNA, 469 bp, Rattus norvegicus
  Genbank Accession No. AI171019
tttttttttttggtcagttaatgtttaattttaataatacctgttatgtttaaagagtcaacaacacatgaggaaatgtcttctatgaatgtttacatgggtgaacacatgctttaaatatgcagtggaggagaggtgcattcagttaacaaagtttaaaagaaaatccctcattatcaattacacaaagcatataaaaatatttctctgaatgcatagattaagactcggaactcccctaagagcaaccatgcagtttccagtcaactgcagtgttctaataaaattaatacccaggaagttaagtttctttggaaactataggcactatggggaaaaagcttaagacagcagggatcctggtcaaccctactccagccctgctcttctgctcctctatgtgggccaagtcctttgtaaagttaagcaaacagaggcttgtcaaccttaatgatgccaaggaggggaa

SEQ ID NO: 1243 - DNA, 566 bp, Rattus norvegicus
  Genbank Accession No. AI171064
aatcttaaacagtcacaagtctaagccacatttatttgcacatatatagtaatgggcaacagatactccaggtccatacaaatttataaacaacaaagttaataatcacttggtacacttgtgtgttatcttgtttacatattcaagtctagatgaacttccttcattgtgtaaacttccatacaatacttccttaaacaaaaattcttgaaaacacaaattggcatgtttcagttatagccaacagaaaagacaagaccacaaattcaaaaaccaaatttagcagatatttttacccaccccctaaccacccaggaggtgataactattaacagatgacatactacattgttaccacacaagtaactgtgaggacaagagaatcttgttctataatcatgaaatgacaaccgaatagtattgtttaaattatctaccaactgaatggtttaaatcaaaaacagaaaaatgcttagattaaaaattgtaaatgggaaataagtaaatgttttaaaagaactattccccatcaaagctgtaaaaacctggcaactcaaaataacttt

SEQ ID NO: 1244 - DNA, 526 bp, Rattus norvegicus
  Genbank Accession No. AI171165
accacagtgtgtggaatctatttttattttttgagttacacagtaggggtgtagagatacattgtgttcttacatattttcataattttaatccatactatccagatagaatttatttctttaccaaaacaagtctaatatatactttgttctgagcaatccaatacacgtagaaaactctttagatatagaaaagattaatgtgtgcacacctagatattcctaaaagtagcagaccactggggcatatggataagacaagaattgtgcagaaccataaaggaactcttaaaatgacatcctaagtatgtgagctagggagggtggcttccttgcttatcggtatgccctagggaggaaccatatataacactgtatggcttcagtaggaactttggggtctccctccacccctagttattttcactcttcaaccactcccaccctgatgactccttggtgttcccttaactacaaatctacaggaaaaggtgcaaagcaggtcctggcagtccagaccaaagca

SEQ ID NO: 1245 - DNA, 626 bp, Rattus norvegicus
  Genbank Accession No. AI171206
cacaatctccatttattccattgtaaacatgtacagagtatgcgtatgagcattgttagaatttaaaacaaggtttacctttcccaaactaagttgttttgggcatgattacattgatcagattgattccaagtacagctagaactgaacagaacaggcaaagtttcagacatgaaaaatgggctgtacaaactaaaacaagacaacacacaatgttaattcctaaataacaatgaattaccagaactgtgaactggtatagaaacagtaataaaataatcctattttttatgaaggaatttattgtatttttgaaggaaattaattttatgaagaaaattattataaggttcctagtatgaaagacaataaacaatgagttgagggtcattaaaaaatatcgcagtagtaaagtctcccacatctgtctttccacatctatatgctgttcaatctaatgtcacagagaaaccaaaatcagatttctaccaacccaaaactaagacatgccatggtggtttttagggaaactgtacttcctgaactaaaataagaaagcccacgtggacagtgcaggccgtcgtttctcctttccactggaattgctctctgatgatcaagacatg

SEQ ID NO: 1246 - DNA, 564 bp, Rattus norvegicus
  Genbank Accession No. AI171209
aagaaagaaatattttaatacgatagtggaatacagcagaagggcattggcagcagaagacaggaacacagatatcttgagactgaaatggcactgtgcgccctcaaatcagcaaagtctttacaggaagtctctaaacatcgcctgtgcaaagcgggcttcccctggagctgtccttattctttgcgcttccctccactaattcacgtggaatattttccaccgttggttacactcaggcttaaaatagatatgagaaaggtcttcagggctgccatcagcaacattattcacctcatggacagctggatgacagcatggcgtgtaaccaatccaaatttacaaggtaaccttgttcaaactatgctggttcatcaaatacaagtaagaaaaggaaggtgctagaatagacttgtaagggacagtggaggaagcatttgtcaaaaagcatattgaacatgagggaaaatgtctgggaggtcacccagagaggctctcggcagatcttgctttgtctccatgcaccagcccctgtggtcagtgtcccgtcagtcctaaactatg

SEQ ID NO: 1247 - DNA, 575 bp, Rattus norvegicus
  Genbank Accession No. AI171231
caggattaagtgtttattttagttcagttaaaacaaacatacattgtttcattgaaactggcatagcactccctgccaacaagccacagtggcctgtcagcctctacagtacagcgggggcatttacactatatacatacaaggagtccacgtgacttccattgaaatcacatgacaagttaccagatagccgcgttgtacctactgcattttgaaaatttagacacctcatttaaagcttttagtttgatatctgaacttgcgttgatgaccaaccagtctattgcacatacaattaaaacaagttattttcaattttagtattatacacaatgtcaatattgaatcctatgtacaagtaatccggggacctatatataatgtgaatccatcaaaatgcagttaagaaaatttagggggaatatatacgcttgaacccaagacccaattccaacatgttatacagcttatttacaaatacatatggacaatgtatgtacagtttaccataaatattgaaaaataggttacctttaatggatcaatgctgctctataaataacagtacagttatt

SEQ ID NO: 1248 - DNA, 547 bp, Rattus norvegicus
  Genbank Accession No. AI171263
gacagattagtcttttaatagaaaaatcccctgcaaaaagtcaaaagccacatgtgcaacagtagcaacaacacacatttcttcaatccagacagtcgagtttcagttcttcgccttgggaggtggcctgtacacacctacaaccacagcgtggtctcgttcataaggctctagtgtcaactgctcctgaggcttcatgttctcttgctgcatctttttcacttcagatgcaaacacagcttctgctgaggctggggaatcaatgcagttggccttaatggaaatcacaaagtgtcctccattccgcaggaaggtgtgggcattcagggccacaattcgggtttggtctggctgggccacatcggcaaagatgacatccaccattgcaataagcatgcggtatttgtgtgggtgccgagcattttcaattacaggaataatgttggtcctcttcttggccaagttgatgaggtcacggccagagcggtgggagaactcaactgcgtaaaccagaccatccgggccaacaatgtcagacacgtgggaa

SEQ ID NO: 1249 - DNA, 425 bp, Rattus norvegicus
  Genbank Accession No. AI171305
aagcattcatgtaatttattttccttaaataattcgctacaatcctgccacaaattaaaaaaaaaattaacatggtattcacagagcagaattctttaggacaatcaaaatcccagagtacttagaataaattaacatcaaattgggtttatattcagatagcctgattctctcctctgaaatgaaatggagaccattgtaacctagggtgaacgaacacacttgttcttctgtatagacatgaattctttacataaactcaacaataatttgaatcaagttaggaatcctgagaaagtcacccacctacaggccacgcgacatattggaaatgggtcactgtgtgctcttccccggtctcagtgtttgtaacaagcatttttcgggacacttaagcaatggtacagtcctttgcctgacactgg

SEQ ID NO: 1250 - DNA, 397 bp, Rattus norvegicus
  Genbank Accession No. AI171319
gaacatgttaccttttatttaaaagtgttactagccctgcctggggctcctatacaaaaacaacacacaacccaaatgaggctgcttcccgtctctagactcggggacagtgttggggtttagcgagtggaatgtgtgctgaaggagggcacccaggaggctcctaccccagtcctcaggatggcaccagctgtcccgttgcctttctatttaccacagaggaaggaaaggcagtcttttgagatgctcagtagaagtcgagcatggatggcccttgagggtcccacgaagggtcatttgctcggtcatggctgcagatgttgcgagtgtcgccgcagcgacaaggatggcaccggatagcttagggagccaagcaccgcagcggctgccaccgcga

SEQ ID NO: 1251 - DNA, 710 bp, Rattus norvegicus
  Genbank Accession No. AI171350
ttttttttttactttttatttttggtttatttaatcttctttcacacaggcattgttagttcaacaattcagtgtttggggttacattaattgcaaactaggaacagagctgaacaaggtacaccaccaacacccgctatgcatttcacccctttctgagggtcagggtgcagcccaggactgctgcctggtcaggactgctgcccggtcatctctctgtgtaggatcacatgtgctattgcacagtaagagtagagttcgagccctgggtctcccaccttcagactgcaatatgacaaagcattgccattttgtaatgaaaaatagctaacacaacggtttagtatgttagacagaacaaacgttcacatgaaataaaatactagcatgcttttataagctaaaacattaataatcctgtggagttaatgtataaataaaatgttacctggaatgaaattacctttatgtgttaaaaaaaaaaaagaaacccagcattttactgttcgtaaacatgcgagtttgaatacctcataaacctatatagttcttggaatggaaaggtcacttcaaagtggaaaatattaaaaattcatttgattgacgttcccataaaacagtccatgctgcttatatgagacttacatttgttccaatgttaaagagacaatatccttttgtcacagaaaagatgtgtactgccatttatt

SEQ ID NO: 1252 - DNA, 478 bp, Rattus norvegicus
  Genbank Accession No. AI171359
aaagcaaatgacaaaaacccaaattaccagctttttttttttaaacctaagcttaacattacatatttaaacaatagtcaaactgacgaggttgccagcatccatgcacaactagaaaacatccttaatttacactaaaccagaaatgtattaccattgatgcagtaatagcttacatcactaaatactgaaaataaagttgaaatatttctgtagacattcatctggcaatggtaacttcacagcaggctgacactactcacaattcaacacagtgggaagcaaatccatgctggggttaaagacaatctcgtcctagcactactcaggagtcacagagctcacctcaaatcacgttttgtttaaagcaaagggcatacagagattacaacaattttaaagaccaaaaaaaaaaaaaaaaaggaaaaaggaaaaaggaaaaagaaagggcctattttggggtcccaacaacaaactc

SEQ ID NO: 1253 - DNA, 583 bp, Rattus norvegicus
  Genbank Accession No. AI171366
aggttggaaaatttttataagtgactcatctgacacaaaggaacttttatctagaatgcattaacaaacttgtaaaacttcataatagaaagacggacaacctgaggggcaaacactcttaagtctctgaagcagatacacagcaaacatgagaaaagatgctccctcgtcagccgtcaaggatggcaactgcaggtcagatgagacacactccagtttcctcagtacggctagctgagagggcagacagtgctgacaagaactcgctacaacccagccctcacctgctgccggccggagtagaaaatggaacggttctcttacaaacagcgtggcaagtccccaaagggtttaaaataattatcatatgacctggaaaacagactccaaggtatatgacagagaatcaaaagagacacattcacacaaaacttgcacacaaatttcatagcagaactcataatagctaaacactgcaacaagcgaaatgtccaccaactaacaaactacacagcacattcactgcacacgatagtcttacaatgggaaggatcgagtcaggtacaagttacagaaagaattt

SEQ ID NO: 1254 - DNA, 505 bp, Rattus norvegicus
  Genbank Accession No. AI171374
tacttttacattgtctacaaccatggtgaacacattcccggtataaagacacagcctttcgagtttgagatgtccccaactatgagattacatatataaaaccgcataactatagatgaggtaatcaaagtaagatagttactatctaaaataaaataaaatggaaataatttactcataagattcatatttaaatcatctttatttacaaaatactatcctgagaattataattccattaagcttcaatttgagcaaaaatataatcaggtaagtaacggcagttacttaaactgaaagtgagaaggcaatgactgccgacagacccaacacggtcagctcaacatatctcccaggaaagtcttaggggattcacatggctcatccccacagtgtgtcctcagcacctgagacaggatagagatgtccctgatccaggccatagtgtacaaagtccattcattcagttgtgatttagaatatatatacaacctggatggcattc

SEQ ID NO: 1255 - DNA, 515 bp, Rattus norvegicus
  Genbank Accession No. AI171460
agaaggctgaagtctttaacatccggcttgatacaggtatatcacaattagacaacagaattttctacttccaaggcaaaaatgtagaaattaatactgatgtgtagcccttacagaatgtccatgcactaaaactgctgctgcctgtaaagacagagacttcacaccttttagattacaactagtcacactttgttttgagacatgttcatacaaagatggaaggaatcatttgtagtatccattagctaatttgtttccattagcaaatgtcacccatatagatatgattgtctaattaataggaagatgtgtgcttgatccagatcaccattacagtaatatcatctctaattaggcagtgagctgtaatcctccatccacgataagaacatgtcctgtgatgtatggtgactctaaaggaaacacaacggcatgtgccacctcaagagcttctccaaacctcccaagagggatgtttttcttgaaatgttcttctttcaagtgttttgtca

SEQ ID NO: 1256 - DNA, 544 bp, Rattus norvegicus
  Genbank Accession No. AI171518
gcttgttttaaccgtttatatttacaatattaaggcacaaagtttaagcagcaaagaataggaaagtctttggctgaccaacaatatccatagtcactttcaggggactccccactttgcacacagacccatctacacagatctgcacaccacagatctgtcaatgcggtccaggaacacagatgccaaaggttacatgtggataccaaagtccactgcgaaatgcggcacatgccccaacagagacacacacaaccacacccatgcacacacaaggcagtagagagggcagtggctccagggcactcagggttggggtgaagctggtactagtgttggaccccgttcacagaatttgacacagattctgtgagcacctcactgaggagggggctccattgtccctccctggaaacattcaaacacaagtactatggctacgcctgtccccgttctgccttgtaataaatactcacaggtgtgtacgtgaggacagactctcaggcaaagccacaagtaaacacaacacaggcgggaaaacttg

SEQ ID NO: 1257 - DNA, 368 bp, Rattus norvegicus
  Genbank Accession No. AI171521
aacatttgaacagtatagtaacagataaggtagttacagggaaatgtacagaattttatagtttgattaccttggcaattatgctgtgaaaccttcctttcattaaataattagttcagtgattcttcttcttttccaaggtccctgggctgttgtcacaatttgacatttccagtttggtagtaaggagtatacttagcttgatctctaccacagtgtcaaatacatactaacctagttccttgcattcgtgtctaagaaaggaacagggtgaagcacttgttcatgatggaagtctaattcaggtgacccaaattaaaccgttcctccaactggatggtgctgatgggttttgatcaaagtaaaaa

SEQ ID NO: 1258 - DNA, 531 bp, Rattus norvegicus
  Genbank Accession No. AI171526
catttattaagcctttattaaacacctccctgaaaggcccaggatgacaccaggacctttagttaggaccgagatgtaaatgcaaggacagcacagaccaaactacccgctcgttagttcaaatctgacatggctctccattcaaccagagtctcatgaacttgggagtactccggctcattcttcctgaaaaatctcaaaagaaaaccgcaactggaaacccagttttcaaaattgcttttaaaggccaacaacaagttggaaggaaaaggggcagaagaaataacctctctgtacatagtaagtctacacagactgccacagaaagccccttgtgtggacgttaccacctgctgagaccgctcccccctgcacggggaaggtcgcctcatagcttctcctcggttttaccatatactccagaggtatgtgtggggtttgttttttacatttatacagtttacaaagcttgaaccataaataacacttgtgagattaacagggctcagtaccgagtatgtacatagcccc

SEQ ID NO: 1259 - DNA, 642 bp, Rattus norvegicus
  Genbank Accession No. AI171607
acctaacagggatttatttttatttacatggagtttggagacgggaaagctgttggcacttgcttggtcagacgatcagatcacagggtttgtggatcttttggccttccctcaggtaaaacatggttgctaatggtccaggcatgacatcctcaatcaagaagggagaggccaagtgagggtttcaggaaaggcatgagttcttctagtagctcctgtagacttccacttcaatttcattggccatgcctggtcacatgctcagccaaacctacagagttggctaggagaatgagaatctagatttatagtcacaaaggcagtgagagagacggaattgggactaacagattcacagagtatcaaggccgctactatggttcccctggaagacctgccttgaggcctcttgtactttgggggtgtctctttcataccttgccatatctcctgggactgccaagtcctttgggcggtcctactctattccagaggccccgcctgttcctctttacatgtcagaacagcaatggacctgtaaggggagaacccccaaccctctatttaggaaatacacatcttcagcataatacctcaccagcagatacttaagacagcttcactgcatttaaaccatcgttt

SEQ ID NO: 1260 - DNA, 617 bp, Rattus norvegicus
  Genbank Accession No. AI171646
gttaaaatttttatattaaaaagtggcatgaacttttcatgtagaacaaaaatttagggaaggcaaaactggataaaaccattaaaactgaaatacagtgcttcaagtgaatcccatcacctggtgatgctataagcagtctctaagccaacaccagatactagaaccaccaatcttaaaaaaaaaacaaaacaaaaaaacaaagaaagcagcagtctagggcctccaaagcacttcatgcaagaataactgcttgtaaagcaacgggacctgctccttctctaagctcccccttctgaagcaggataaccccttttgcagggtaagtaatcacagcactgaaacagagtgcctctcggcatctagtgtaatcccaaagaatggcatgaaggcaaaccaagcattgcctgcgactgcaatgctgcccttggaggctgactaaaatggagttaaaagttttaaagtgtgcaccacattgccagcaatgggatgtgtcataatatcagatgtcagaagagttaagctaatatttctctttaaagcacatctgaaatagaaaaatctttaatatacaccatttgtaaacaaaattgcacttgattttgaatcctcgtgcc

SEQ ID NO: 1261 - DNA, 755 bp, Rattus norvegicus
  Genbank Accession No. AI171655
aagtagagattttaatagatcttaactcatcacagtaatcgtttttactgtaatgatatgcagcttttactatactagtataaataaaaacagataaatacagctctaggcaacatcacaggttaacaaactaagcattcttcatgaaccaaaaccaaaaacgattattattagatgctgacacgctcgcccattttcatcataccttctcaaaaagggtactcaaataaggcgctgcacttagtatattggtcaataaatttgccaattagctaggcacatgtagttcatggtatccactatcttatctggttaaaaatcaaccaaatctttatgggaaaaaaacaaaacaaaacaaacaaaaggaaccaacagatagtaataccccccccccaaaaaacccaaacctctgaacgcattaaaaacggcacttttcatgtatttcagcagtaagacacatcagattgagaaatgtaacaaagaaatgtcagtctctgaagatgggtcatgaaagcagaatgtaaaataaaaggaaatatggaaacttaatcatgttcattttcatcgtgtgaagctacaaagaaaccggcttctcctttgaagacttagaacccagaaggggctgaggcaccaatcagccatgctggagactttagcccagcagtgtcttccatactggaagtttactttaagagctaagaactatcattaaaaatgagctcactctactgagccacagaacaacaagaatgttg

SEQ ID NO: 1262 - DNA, 594 bp, Rattus norvegicus
  Genbank Accession No. AI171774
atttacagggaaggagagagagatgaggatctacgtgtcccaggctctcatctcttgtggtaaaaggaagggtgatgttatctcttcttttgctgacgccgcagctcattgttgcgggtcatggcgttggctgcccgagctcgcggtccttgttgtgtgaagtggtacccgaagcggacaatagacggacactgctctagcacagtggccatctccatctctacagcatctccaggccactggcgctggttatctactcggagctcagtgagagtagcgttttctcgaactgccttcagcacagccatgagccctgtgctgctgatgaagttggattcgatgttcaggctcaggagactgcggttctcacgcaacatgtcagccaccgcattggcgatggggtcaccactctttgtggccaccagactgaagctccggacataggtattagtcttcattgcttcacacaagtcgcttagcacgggtatcgggatgtcctggatgttattgaggttcacctcctccagctctttgtcattgctccgcaccctctttagcatctcctcaatgttggtggggtttgggggttcatct

SEQ ID NO: 1263 - DNA, 705 bp, Rattus norvegicus
  Genbank Accession No. AI171799
agggtgtcaataaatttgtttaattgtatagagataaattacaatatagatggctacagcataaagcaagcttcacacatttctcttgataacaaaaggtgatacgtggtcaaatgaaacacggtgataaagaatctagaacagtaggttgcattagtacaagtctccctagcaaccagaaaaaccaaccctgtttaatagatgagaaaactaaacactgacagagctgatgagctcctctctgcaaatgtttggggcacggactacgtgccaggcacttgcttggtgctggagatattagtaaacagaacacgatacccgtaactcaagggattcttacccaggataacagaggttagtttccagtaatcaggaaatcctcacgcagcatactgagtattgtgagcaaggcatgccaagctgtaaggtgcaatgaattcaggcattggagcagctcacagggggcacatgtgagctgatgttggaagcgtgagcagtagtcatatagacagagagtttccagaaaggcaaggcgagagctattagcctagtgcatttactacttaaaggattagagtagcagagaatcctaggccttacttgggggcctcccaattcagtgctgttttgcaagcctgtttgcccgctagaaaagacatagtttcagcacagcagtcagtactcttgcacacaaagcaccacaca

SEQ ID NO: 1264 - DNA, 386 bp, Rattus norvegicus
  Genbank Accession No. AI171916
acggggacttacgtatttttattgaaaatacaaagaaagaagtccaacaaagctaaagccattccacgtccccgtacactaagctcgcacgacttagcacatcaccttccgcatgcttacgtaacggcgttacgtgtgagtctacctggcactgtgcttagtagcacagacacatacttctacagtcgtcccaacagtgtcgtcatggcaacagtgtcgtcatggcaacagtgtcgtcatggcggcatacctcactacttcgtcagcacactttctttaacataaagatttttctccaatgcacacatacacactctcatgcagttaacattttttcatcattctttagtttaaaaaatacaagagctcacaaggcaaaggacata

SEQ ID NO: 1265 - DNA, 657 bp, Rattus norvegicus
  Genbank Accession No. AI171978
ggagaatctctacatagttctggctgtcctggagctctctctgtaaaccatgctggcttttgtattcccttttcttgttctttaaaaaataagacctaccagtaattcaattgtaaaatcttattagtgtttctccttctgtcccctttacctttaaaaaaaattgcaggttatcatttgaaagagcatgtttaagcatcgccgatgtgaaagcactatgaggaatgaatctgtgccgtctagatatggctcctttatcattactgttctactacatggatggagtcctgttctgtagggtctcactttttaagatcatcttcctgttgtaaaagtttaaggcattttgctcaagtactttgtttacaattaaaatgaatagaacttaatagaagataaggttatggcttactggaaagcatcagcatgacttggtatagacttaaaagagtacatgtgattatactgtggaatgattattgatatataaggactctagtaattgtacctcctgaataaatgtccgtttgcgcattttctaacttacagtccattgtctgttctggcaacaatctcgctttgtagttttactctccaaaattcatgagtagtgtttcttcaaaggttgttgaagtaataatagttacataatggggg

SEQ ID NO: 1266 - DNA, 619 bp, Rattus norvegicus
  Genbank Accession No. AI171982
cagggcagactcagattttatttcagacgagggcgggatctgaggcttgaccactcatgatgaccactgctcgtgatgacctttgaacctcgagaagaacacaggggatcacaacgcagatggtggacgcggttatcaatcaacatgcgatgcacacagggggaggggttaacacacggcacgtgctcggtgttaaaggtctgttattggttctgtaataaggacgatatatatatatatataaaataaaatacctcaatgtacaataatgtatatagtaaaataccataaatattatatatatataataaaatacattagtgtataatagatataataaaataccataagttattatatatatataataaaataccttagtgtaataatgtatataataaaataccataaaatattatatatatatatatatatcgctgtaagattcactataaggtttgctataggatttgctataggatctactataaggtttgctatgagattggctataaggtttgctataggatctgctatagcatctgctttaagatctgctatagggcctgctataggattcgctttaggggccacgtgacacccttaagacgccaggccg

SEQ ID NO: 1267 - DNA, 620 bp, Rattus norvegicus
  Genbank Accession No. AI171998
tccaacatttgtaactttatttcaaaatataaatattttacattttacaaagatgttacatcagtaagttgtgaaagcaaattaaagctaagaaatggcatgtgtgtaataaatatttattgttgcatctgaacattagtttcctttcaaaccatctcacttcttcacctgagaatgctgaggtgatctattttccgggttaaatgattacaatggtatgttctatcttagcttcacaatcaaacagtagctggagcacagtcaagcacctgaacaaggggcactgcagggacagagtaataagagtcacacttctgggtcactccaacacagagctggtttgcacaataagcaaaaacagtgtggagaggtttccatatccttcgttgtatacataaagctggaaggaaagaccagtatgaagacctttggacttggagtcagagactcgtagccaaattctggctctatccttttaagatgtaaactctggagggaggagggcagaagaaggggaaagagaaggaatcgagacaagcttttcagggcttctaggacgtgcgtcctctgtgcagtcgctataatactgtctggctcacagggctgtcccccctcgtgcc

SEQ ID NO: 1268 - DNA, 669 bp, Rattus norvegicus
  Genbank Accession No. AI172051
ttttctttatgaaatttattttcttatataaattatgtatttctctgggcagacagccttcaccttattgcactagtagcacatctgtaataccaaactacaggacaagtcttaacaagaggtttgtgttcttgaacgtagcacttgtctaccaggcactgtagaagagaatgaggaaaagccaggacctgctcaggagcttaagggttgggttgggtgggatatggacagtaacacttctaacaactggttttctcccaggaaggcaaacatgcaaagcttccatctggattttgggagcagggacaggttggaaggcaactctgctccctttgtttctgagagaagtgggcacttacctcgcatttgtaacaaggcctaactgatgctttggggcaacaatcaggtgtggagttttcatcaccagatttataattagcagcaattaagaatgggccaccatcactgccacagtgaggtgacccatcctggcaccagggacccagaagctgtattctagataggtgccactaagatccagagctgggacctcaaactgctccttatctcaccatggctctgcaacactagttagcaacactccaggtacagggttcctcaaccactggtcaaagctatgatatggatggagtctgtaggcagaatgaa

SEQ ID NO: 1269 - DNA, 647 bp, Rattus norvegicus
  Genbank Accession No. AI172056
gggggggaaaaggtttattttttcctcagaagaaacagactggggaacatttacaacccacattaacttgcagttggtcctaaccctttcgggaacaggtgttaaaatgttaggtgctctacggaatgaaggtgttcaccccagacagaatgtacatggacgatgcttgaagactgcatgttttttccctgagagacgtgtaagacaaacagaatttgctgagagccatctttccaaacaggaagcataacaagccaacatgtaaaggaaggagaagccaaggttaattcaataagacaggtgagacacctagaaagaccaatacaaaaattccaaacaaagcttggcagtcattagtagaaaagaaatacatatttgttttattgacaccaggcttaaacttgtgttaaacaagtaaagcctgtgaatagcaccgtggtaaagattagtctgctttcccaaagcattttacaatttagtaagtcaacaggggatcaaatgtcttacatctacctgtgatccttaaatacagaaacagattggataattaaccctgcatagttataactcggatttgttctactacaaccagtccacacacacaactggctctgcatatacactagaactgatcatgacaaagtttt

SEQ ID NO: 1270 - DNA, 570 bp, Rattus norvegicus
  Genbank Accession No. AI172097
atgtatatatatatttatttgtgaagggttaaaggggactctcatgtaaaaatccaaaatacaattttatgaacaacctgcagggtcagtccaagtgtggctgtgaagctctgacccagagagcagacttggggctggggtgaaggcagcaggtatgcagccttcaggatcttcctcttgatccaaggtactgcccaagcccaagtcccatctgtgctccactggggttgtgctggcttgacctaggattccctggactacccaactgtcttgtctccccagaccagccgtgtcctaggaataggctgggggccaggcccaagccagcctgacaactgaaacctctaggagacagtggggtccttggctttgtggggttcagtgcccgtcagaagagagatggtgggatcatccgtgtagtcatctccctcagagaagtaggagctctcccccagctcaaagagcacaggcagttcactgctccctgtgtccacagcatcagggtccaacaggaacagaagctgagccgtgtagtgcaccagctgctttcctgagtcggcggttctattc

SEQ ID NO: 1271 - DNA, 557 bp, Rattus norvegicus
  Genbank Accession No. AI172126
aggtcagtttttatttgcaagctttcgtggggagcattaatacgtgggaaataaagcaacatcaaagtcactattatgttttgtacacagaattgaacaatgcagatagaaataaaattgaactgtcagtcaaagctgtttgtttcccactcagaacagcgaaggagacaattatcaattggtttcaagtacttaaactcctaagtcaggacactgttttcagtgttgggccagggttagaaccataacattgttcaatcaataaaattcccaggatctcctgcttctaggtttaccttgtgaagttgtccagggaaatggtgttgtactttcttttccttaaaaaataatgaattaatcaaaggaaaatgataggttaacctcttttgaatacacaatactgcgaagaattgacattacaatctacagatacacgcaccatggactatgagaaaagagacaatttagggggaaaaatcacattacaaaatgtattatacaaatccattatgcagcatgtgcccacatgcctgaacactttgcaaagagaagaaacc

SEQ ID NO: 1272 - DNA, 532 bp, Rattus norvegicus
  Genbank Accession No. AI172183
caggaatctttattacagtgtaaatccaagctcaaggctcgcctgggccccatgcaaagccccagcacaggggttggtggcctcagagacaccaacccctcacggcgcctccagcggcgggtcacggaagtgcagagcagcgtcctcactattcaactacaagtcccagcaggctccgcggccaaggagcatggtcttttcctggactcttagagcagagcctcttaggaaatgtagtctgggtcgctcaggcacttcccactgggaaatggctcggccgaatgggagagggtgtggatgcacgggaaatgaaagggaagagggctgctggggtgtggcaggcgtccctcgggcaaagacacccttctcattcggctttggctttggatccggagactgatgctgctggggcaagggttccggtccccgggatcttagctcggatcttagctttgatgtggctcaactggctggtcaccaaccccacatactggtcaatctgagcctgatgttgtctgtacagaagggggac

SEQ ID NO: 1273 - DNA, 625 bp, Rattus norvegicus
  Genbank Accession No. AI172263
gggtggtgggctttaaagaaaacaagttttattttttataatcagaacattctaataaaaatattattataacattactccctctgtcctccaggccttgactaacaggcatgctgtggagtgcctacacactggctccctgaggtaggtgtggagggacccactgcccagcctgtgggcagcccatgctgccagagatgcccactcctcccctcccagacgtgtgtgggctggaccttctccctgtgcagctaggtcatgctccagactggtacaggtgacaatggggggctgggtgggcacagagcctgcctgaggggcacagggccagaagaaggcccccatggcacagcaacagacacctgagaactcgccctggcaggcacctctgcaggtgaggtgggcagcatcagcagacaggagcccagccccctgcagggctgcagtttgtgagggcaaccctgcgggggaggggcagctccatcagtgacaccggcacagagaaatactgtcaactgtctccacagggagctactgaccaaagccagtctctaagtaaaaataggtttggggctctcggtgctgatggtcttgcctgcaccacagaaaattcccagcaggacat

SEQ ID NO: 1274 - DNA, 665 bp, Rattus norvegicus
  Genbank Accession No. AI172265
  misc_feature (1)..(665): n = a or c or g or t
gcttgaatagagtttacttgcggtttgaatagcatttataataacaaaagtgtttacatagtgacttacaatcatttccatataaaataagctggcatcatatcctctttcctttttacacttctcacctgttctgttccatatacagcaggcactcccaggttctgctatctggccaactcttcagagatgtacatgaagaaaatcaccaagcccacatccttacccactgtggctgggactggttcagccatgaaacagtaatacagacacttcaaaaatgacgtttcttctctagaaatccttttgtcttgaattatggtacatttctaattttacagcattttatacaagtcagcaggatttatttccacaccttcacaatcccatctctagaagcagtcacaatgaagccctgagtggtctggaaggtggcaatatctgtgatgatgtcatgatgtcccacaggcagagactccgggccccttcgaggggtgtcatcacttggtccaaccttctgcttattctgaatttcctggacaacctccgtgccttctattatcttcttgtagtaggatacagacggggaacccgtgcttcccgctacaacataggacctctctggggaaaccaagtcccagaaccttattntcatgtctgagcca

SEQ ID NO: 1275 - DNA, 579 bp, Rattus norvegicus
  Genbank Accession No. AI172271
caaggtttagcatgctgagtacagccatgatttattaaaagtaacacctgaaaacatgaataacatacctgtctctacagagaaacatggcatgatttctacttaacatttattaacacacttgcaaaacgccctgcattaacacagggggaaacaataaataccgacaatggctaacataagaacacaaagaaaacaggcaagtctccacagatcgcggctataaaacccggaagtctagactcagctaaggcatgtctaaactcagcaggctacctgcccaggctgggggatcacggttcctcctagaaaagtccttgaaaactagagttgtttgattttctacgtctcacacagaagatgtccagagttctttatgattctatcaggggatagtatgtcattcctttgctgggacaggcaactcgcgtagactggtgagaagattggaaattgtatcggttccgaggactttcttttctccacccttggagtttagaagctgaagatgaagcttatttattgcccaggtgtaaggaggatccatcacgatgtcagttcttggctttcccctgtgca

SEQ ID NO: 1276 - DNA, 625 bp, Rattus norvegicus
  Genbank Accession No. AI172272
ttttccgtctagatttattttatttctctcagtgttttgcctttgtgagcgtacacataccagaggtgtgcctggtgttcttggagatcagaaagagggccctggatcccctgaactggatagttgtgaggcactagatgggtgctggcaactgaagccaggtcttctataagagcgatgggtgttcttcaccgccaagccatctctccagtcccaacattttctgttttgtttaaaggaaagagctttgagctgggggtgtagctgggttcgtagagggctttcccggtactacatcagctggccacggtgacacaggcctctaatcccaagtattggagagtggaagcaagaagatcagaagttcaggtcatggggtctgtgcttcctgctccgtcttcctctcctggcaggtggttcagtcagcagaacttccagcgattcccacattcattgcataagacaaaggtggtcatgggctcatcagcactgcgtgtctgcacctggttataggtacaattcttcttcttgcacttgctacaccgcaagaggtcagtggtggtaccgcctgtcttggccatctggtgctcgcggatggcctcttgagtcatggcgttcctcaact

SEQ ID NO: 1277 - DNA, 668 bp, Rattus norvegicus
  Genbank Accession No. AI172281
gacatgacagaagcgtgcatttaattcgatgctttgcagagatacatgaccaaagttgtgtgtgtgtggcttgtcctttgggatggcctgggttatttatttctcagtaagaaacaccagtggagcaaacaactgcaattaagaaaaaaagtcttgatatacaagggaacctatgtgttttgggttaagacacatgcaagtattaaacaatattctaaatacaatatgagaggaacagttaaagaccctgaaatcatgatctgtctctcagaaataggatgtttaacagttctgtgttcacaaatggcatggattctttatttctaaagaatgttatagaaagaattatagcaccatcattaaaagtaataattttagccctgcctatctccagtcttggaatatcaacagaagcatagtacctttcaacacctaaaaagaataaacaaaaacaggaaatccatcccaacttgtagagatgaggtagctcatgctaaaaactgttgggtcatattttcttatgaatgttctaattttatttgagtgatcatcaaaactctgggcttctcgatcttttctttgtgatagcttcaggaaatgagacgtgcctgtgggagagtctcagcattcattactgtgtatgtgtattagaaaactgtgtgggcaac

SEQ ID NO: 1278 - DNA, 555 bp, Rattus norvegicus
  Genbank Accession No. AI172299
aacagtagtttaacaaaatgtggcacatatgaagaaatatcatgcatccattaaaaaagatgtagaaatacatatgacacagtaagataggcatggcactgttgagtgaaaaagttacaaaacagcatgtataatttgatccccattaaaaaaaatctgtaagtgtacagagaatctggaggccacacctcagacagcacttcttagacgatggaactgtcgccatgtttttatttttacctctaaaatttttttgtcagtttattatgacttgtattaataaaaaagtattaataattcttaaaaagtctactgccgtagaagtgagcttagggactgaggtacagaggtgtacatacattagtctaatatggcctcactggcttctcagggtgtctcgaggctaaaccccaattcaaaggcactgtgtggaagtatggtggttagagctcatctttgtttaagctgcggttcttagccttcctggtgctgtggcctctaatccagttcctcatgttgtggtgaccccaaccataaaattattttcattgctac

SEQ ID NO: 1279 - DNA, 662 bp, Rattus norvegicus
  Genbank Accession No. AI172304
  misc_feature (1)..(662): n = a or c or g or t
attggttaaaaactttatttcttattgatttggcaacagttgaatggtaggtagaaaaagggagggagaatcctgtaaaagaagagggccgtgctggatgtggtggtgcttgccaagaacgccgacacttgagaagaagaagtgggatgatcgcctctgagttataggccaatctggcctacgtagtaagttcccagccaccccggactacagggtaagactctctcaaaaaaaaagtgaaaaagtactagactaggcacgggagggcttgtgcagggaaagggggcaaggggcattctcaagtagggcgtatggaatggaaaagcagttacatgggacatgaaattgaaaattagccatagcgggaggcaataagcattggatccaggttggcaaaatgtgttccaaaggttagggtatgggtgaatgatttagggatgatgcatttgggtcactttaccctctgcagtatggctcccccagtggattggttggctccatttactccactgttgagtacttccacagatcgggttaaagcggctccgaacccgaaatgtgtacagcttctgttcatccacactaggcagggagaatctangctcatgatccactatttgttccgtccagcttcgatctcgggtgctccggtactgcaccaa

SEQ ID NO: 1280 - DNA, 520 bp, Rattus norvegicus
  Genbank Accession No. AI172305
gagggttcacatcagctttactgaaggatgggtgaatatagctgaagcatgaggcccaaatgatgcttattttgtcctctctgaagtgatgacagctgagctcccctcggctcactcatgaacttctcttcccagtcaggaactgaaactggaatgtggaaaacgaattttggaagggtccaacatatgcaggtcctgctgactctgattatggcatagagactggaactgactccaaaaggaggagaagtaggggaaatacaaacagaagcagtcccaggcccaccacaaggaacctagaaaaacgcttgaccagaggattgagccagataccgccggtcaggatggaatagctccatgacaaagcttggcgagcttccttcaccttctcctcttcagtcatcaaaaagggattttcatctgcttctaattcctcaaataaatccgcgtcttctctttctagcacaaacctagatggacaggcaaatagtatgtctacttcatcatcatccacttgggg

SEQ ID NO: 1281 - DNA, 506 bp, Rattus norvegicus
  Genbank Accession No. AI172326
cggttttgtgcacatatctttattggctctgccatccagctgggtgctagaggtccagggctacattctaaccgagtgccagcccaggccgcctgtccagacacctgatgtgtctggcagtgtggagggtggggcttgacactggaacagaaggtgcagtctttgaacagcactgactttcaaagcttgctgctcttgagaaagatctgtgtcctttatctgcaaacaaaggttaattgtacccagctctcaaagtctacagatgttaaattaggtaaagttggaagggtgcccagtacagtaggactaattgtgtccatgaagagggaaggtccctgctgagctgttcacctgtcttcaggtgtgggcacttgaaggtgctttggttctggggcagtgactagccagcgctcactgttggttgggaatgaaatgaaggtgcattacacggtgactcgactcaacgccttcattgctttcaaaggtcccattcaaatcctcgtgcc

SEQ ID NO: 1282 - DNA, 624 bp, Rattus norvegicus
  Genbank Accession No. AI172328
cactcttaagtatttattagagacactatgaaacccataaattacccatatgtgttttacactggcaagaatcttacatgtataacagggagttgggtagataacatcaaatacatccacaacaaaattattcttttgagccggggtctcctgtagcctgagttggtgcagaacttctgactttatttccaaagtgctaggcttacaggcaggaatcgccatgccttatttaggagaaaaccattataaaatttcaaagaacacttgaggaacaaggtagacaacaatgcttattatgtaattttgtatcactgtaacgaaaacatcttgttcagtggatttaaaaagacctgctttaagtgtattcactcaatgcaaaaaaaaattaaataaaatttacagtattataatttgaataggtgccaaatgtcctgttccttttctccaatcaggaagagaaaattcttttccaaatcacttgaagcttggacaaccccccccccccccaacattctgtagcatcccaggcagacttcagcccttcagagaggacatcccagctctcatgatctcgtcaaccaggagaatgttggtggcgatcacagtacaggagtgaagcagctg

SEQ ID NO: 1283 - DNA, 488 bp, Rattus norvegicus
  Genbank Accession No. AI172352
actgtggtagaaaagtcttttattctattggtcaggcttcatggtctgggcctagggcccagaagccactgagcagagcctggtcctctgtccccacctctactccagcttctctttgtcctgcctctgctcttcctccagtgccagggatctctcacgctcttttaccagctggacaccacagtaggtgacaaacaagaccgccagtgtggtctgggggaagcctgtaagtatcaggcgtcgggcaaccagctctgtgaattcaaggctgttgaggctcacgagattgtaaatgatgatagcccagaagtttacagccccacagagggcccggactctccgagacatctgctccgatagccgggcctcgatctgtgccagtggcccatgctctgccagcttctgtgcccagagctcaaagttgaggccgaagcttttaaggacagaccacaggtagacgatgtcacaaggtccgagccacagggtgg

SEQ ID NO: 1284 - DNA, 478 bp, Rattus norvegicus
  Genbank Accession No. AI172423
tcttaggtatgtgaacatttcgaccacaggcgtaccacgtgtatgcaatgcccgcagaggccagaagagggtggcagagttaaatggttatgagcagccatgcggctgtttgggaattgaaccagcgtcctctaaagaaacagcaagtactcttagctatggcaccgtctttccagcctaaaacagagatttagagaaaacagacaagtctacatccgtcagaaagtccgtatcaggactccatgtctaaggctctttctagaacacctcagtggttctgaaagcacacacatcattccccgacccacctcggggaccaggaagggcactcaatatgctgtccctctcttctgcaggtagtggccatggtaccttcccaagtggcgtattctttattggtgtttccaagggctagggttgtgacagtcaagatggttccagaggtggcagaggaaaagcttcttccacctttaaaaaa

SEQ ID NO: 1285 - DNA, 671 bp, Rattus norvegicus
  Genbank Accession No. AI172472
gacctgagagaattctttttattatgtctgaacagatgaactaaagcagattctgcctttcactgacagccctgtctccacatggggccgcagccaggtcctgggctgccctggcccctacacacaaatggggcctccttgggcactgaggaggcagcaagaaggggtaataggagcaagcagcaggtgtgggccttcctgggtcatcccaggcaggcctctctaccccagggactctgagccaagatccaggtgagggctagggacaaaagctgcagggcaggcctctgtaaaaagcccatccccaaagcacagcagaactccagatctgcagggcaagccccataagggggagacacctctcacaaggtgctcctttcaaagccacagagctacaccccccaccccgcaggggaggggagggcaagagccacatggaagacccaagaaaggaaagccccacagaagaaaaatcaaaacatcagtccaataaatgtttgttgaatgaatgaatgactccaaaggctcttcactacaaacagcactcatccatccaacagggaagtcaagaaacacgccttgactccagcggcatccatggagcccacactctgagcaacccggggccctcagaccttgccagcagcacgcccgggcatgtgtgcgcacac

SEQ ID NO: 1286 - DNA, 606 bp, Rattus norvegicus
  Genbank Accession No. AI172491
gggaagagctttttagtagctaaatatggcaccacgtgactcagggcaatataaattacagtatgcaaaacacactgactggctgaggtaaagcgcaccgttcctgcctcgtgtccactgtgagggaaattgctcacatgctttaaaaaacatctccatcatatatatatatatgtaaaaaaataatcccctagaaaggccaccagagaggggggctacaacgcccaccctttaccatgtacggagcacccactggagctgggtagtgtaatgtccacccctactgcttgcccaaagctctgtccaggttgctcttaatggtgtccaggaagtctgtggtgttcaggaagtgctcattcagcttcacattgctgaggccatggatgcagccagccaggtccttggtcatagctccgctctccacagtctgcacgcacaccttctccagagtctgtgcaaacctgatgaggtcctggttcccatccagcttccctcgatgctccaaaccccgtgtccaggcaaagatgctggcaatagggttggtactggtgggccggcccttctggtgttctcggtagtggcgggtgactgtcccgtgagcagcct

SEQ ID NO: 1287 - DNA, 357 bp, Rattus norvegicus
  Genbank Accession No. AI172567
tttttttttttttttttgactgaagaaaattatttacttttccccctaggtacatagatgacattattaaagacagttttgatacacaggaaaacccttctgtccaccttccgttttttttttaaatggatcatcacaacaactttttttttttacagttttaaaacaaaacacaactttcctgggctgaagcaattgcaacaacgtattggtatattacaactacttacaatgtttaagaataccaatggagaaaaataagttatttaaatattgatttcatatacaaaaagtgcaatgttgttagttgtcatacaacctgtttgacagtttgtgggttttttttccctcgggccg

SEQ ID NO: 1288 - DNA, 169 bp, Rattus norvegicus
  Genbank Accession No. AI172569
tttttttttttttttgtctccataccacagtctcatcaattacaaacgcgacaggacgagaacatacacactgcgggtaggatggatccatgacagccctggctacacaccaaaaaccctggctcatcatttgccccaggtaccaaaccctcactcagtcaaacaaaca

SEQ ID NO: 1289 - DNA, 396 bp, Rattus norvegicus
  Genbank Accession No. AI172598
  misc_feature (1)..(396): n = a or c or g or t
tttttttttttttttttcagttttcaaaaacatttattgaagtagaagatacaccttatcaccaattgttgacaaattatgaagagtaaaatcaaaaattttttagtgttcattttattttcctaagcagggtatgctatatgtatgctataactgtggcccattaggaacatatgagcagccatgttttgtccacccaagcattgggtaacattacaaggagggtctgtcggctgtgctgctttttgagaaggcctgaagtagaaatgagagtacacagcatagggcatcttcgtctcatgtcaccattagaaggacacaagagaatatcacagtcncagtccaccttcaactcttggccagtggaaatttgtctaggcctgtgtgtgctaaaac

SEQ ID NO: 1290 - DNA, 587 bp, Rattus norvegicus
  Genbank Accession No. AI175005
atcttggacacctctttattgttgtagtaacaaaaatgtgtcatataaacagaactcaagttctatttttatttatttttaacaagaataacagaagttacagagttgtaaccacccccaccccccaaccctaccccaggaggttgacatttagtttgcaagaaacacctgctggtgaaagcatatgactactcttttaaaaatgttacaaaatttaacaaaacattgtcctaagcagctaccttcatattcgtaaacagaacataaacgggctgatccagtttctgctgcacatcaaacagccgctgaagccacctctggttttaaaacaacaaagataatcctgctaaactaccagagcagacacatcggagtctgggggaggggaggattttggaggatacatcattagaaacagaccaacacacacagcatcctagacttcaaatgacttaatgtcctccacattgcctccagttctacagtgacttcttccctacactacaatggcactgtggctgtccagtccacattctctttcgaaaacacaccggacacttcggacacaacgggagagggggtctgtg

SEQ ID NO: 1291 - DNA, 580 bp, Rattus norvegicus
  Genbank Accession No. AI175011
  misc_feature (1)..(580): n = a or c or g or t
cacaatttttattgcaacgtggccacttttatgagggcagggagtttgatctcaaaacaatgttccatttaaggctcttttatacagaaattgccatcatgactgatattcaaaatatctgtagtgtttcaagactcatatggtaaacataaaactcctataattatacagtagtgtacactcattgggaatccaaagacatcaacacatctattcctttgaagaaaatatgcaggtaagaaaaatgaacactgagatactaggataaattgaggacaggtaatgaaacttaattggcattctttataanggactaaacgcattacaaaataaaagtgcttttaaccaataatgttaaacctgtgctgccatgtcacaataagcgagccaaggcgggtgaggtgtgtgactgctccagtgccgcaaagaactgtgatcaagtgcagctcgactataaataatactgaaacaagtttcccatatgaccagtggagaatactttcaaggcattcaattagctcaaccctctgtagtactctaagctattcacgctgacaatccgttgtagtgctcacgcaag

SEQ ID NO: 1292 - DNA, 627 bp, Rattus norvegicus
  Genbank Accession No. AI175025
aatgcgagtagccagacttgtatttagttacagcatacggttacattaggatataaacacataatatgacaggttatcatggggagtcttttacacagtaactgcatggctaatagtttatataacaaaagaaaaaccgagtctatacattaccagaacaaggagagggaaacaatacacccatataaattataacagcagtgacaatgggaccctcctccctccaactcaagtctccagtgtaaagtcagcgtgatgctgacacactgggccccatgacaagacggagctccgccccgacatcttctcagttcttgactggagtcgagctgcctttcattgttttcttcaggtggtggtaattgggcaagatcttcatcaagaaatccagctgtagtgtctggggctgtggccgctccgtctgcacccgccgcaggcagtcggcgccatagatcactgtgttctcagggatggcttcaaaggtgttcaggctgcagcaagcgccaatgatgcaaccgctggtcaagatgacattcctgcctacgtacgcttttgactcaatgacattattggctcccattttcatggcttgggaatggcagcccaatttaaacacgttgttggtgc

SEQ ID NO: 1293 - DNA, 649 bp, Rattus norvegicus
  Genbank Accession No. AI175033
cattggcattaaaagtgtttattgggaatatcatccaatctatacaagttatatacaaggcatgaaaatggcaaacagcacaaaatacgattgaggtataagctaagagcacagtatgtcatgtttcaataaatataatccaaaatttgtaaactaagtaaccagatagatgagtcattttttctagtaaaaccatataaaatatttatttcatgtgaggtagaggacagttttgtgtgtcgtgtaatgcaaccaaccacagcaattttaatcataaaactatatgcactggcaaaattatcaatcgagttatgctcaatgtacctaatgtgtttccgtagttgcagaagggaccattcacatactgccttcccaggttagaaactgcggggtaattgaactattacactgccttaaaattactacgggaagtccttccagcagaaaagctaatggtgactacatgtatcacaaactcacaactcaaaaggtgtcctagatttagcaattattctaatggggtgttctcatgagaattactttaatgtgctgtgctttctttattttcaagtgaggtatcttatattgaagaaaaaatcttataaatttcttttatactaaactaactttaaacactatttcggtttct

SEQ ID NO: 1294 - DNA, 649 bp, Rattus norvegicus
  Genbank Accession No. AI175045
tttttttttattattataataaaaatatttattataaaataatcacatttctttgcatataaactaaaaacataaatgtaattcacacattaataagttaagtgggcctaggcatttagcatccatctactagagtttaaagtctcctgtgggttcataaataatagggaaggtattttgatttaatttacacagttgatgctattgagatcttaaagcttttctctattactttacacatagctcgtggtatttgggctaattaaccaaatgccttagatctttggtaaacacaagtattcatgtgcacaaacgtgtagctgaaatttcagtgaaaacatcaataacaaaacaatgatacgagagataacccaaatgccgagagtttgtgtgatcaatcaaagttattgtccacaacttttatggatcacatctgaaatgcaaaacaaatagttgtggctcctgttgtcacaaccagaagcacctcagctctaagtcaccaggaaactaaatacacatttcaaactcaactgatacacaggactgataacattacaatgcagaaaagactttcaacgttaatttgacacaaattaattaattatttcaccttatcttgtaagagtgagacccactgaagaagccacac

SEQ ID NO: 1295 - DNA, 490 bp, Rattus norvegicus
  Genbank Accession No. AI175100
accttttctttctaagcttttattttttgatattacaaaccagttttctttattcacaaaccactgtaagtgatataaacactaatttctaaagacagatatacacattttctgggtttgcagattgagtgatgtgtgttaagaagtcactatatgccacattaatcttttttccataattcataatagcaatagttatttagataaatgaaaacattccaaataaatactgttgttttaaaaaatccaaaatgtttgtttacacctctgacatgacagtttaaaacgacttatcggcagctcagcggagtgcctagacaaaaggttctgcgacatcggttggcacccacttgctctaaatgatttttattaaaactacatacggtcgtgggggaaagtacagttcgttgatggaaatcaaaaccgcatatgagttttactttagccagcacagtaagaattccatgtttgtgatttcatacacaatgca

SEQ ID NO: 1296 - DNA, 357 bp, Rattus norvegicus
  Genbank Accession No. AI175281
tcaactttattaaggtgggactgcagggccggggaccgagggccttggacggtcaggtgggcagggtgtgatatttacagaccagcagctctttgctcatggtccctccaccccttcttgtccatgccctttctttctttctgcaaactcatgctttccgtttgctgaaacctgggggtatcctcacttactgcaacctcacgtcctggggggaactcatgaattccaagtccacagacttcactgccatgtttgaggtacgctgcctgatatcaagtgggggctccgacccaaaagccatgcattggcccggcaagtgtggtgttgaaacccatgacatgggggaaaggcccagtc

SEQ ID NO: 1297 - DNA, 550 bp, Rattus norvegicus
  Genbank Accession No. AI175328
aaaaaaaatcacatttattatcctggtagtggtagctcatacctttatgagaggcattaaagtgaccccagcttggcccatcgccatgtgtgctcccccaccgcccacaatgagttgaagtctcctggctccaagctgagtctctgcctgtcctccagtcctctgcctgtcctcagtctccttcctacagccctgggtgagggtcagtttccaaattctcttctgggtctctaccaatatggctggcaattgccattgaaagccccagagttgcctggagatggactgattcaccaggatcctgctatacttaaggcacacagttgaccaacagtcttcagtcagagtctgtcaacatcggagacctgtgttctctggaagggctctcagcataaggaacaagaccagcagcagaagagaccatgaggccgaaagggagcctggggctgagctattcagccagcatggcccagacctgcacttcttttcttttatgtattcgcagttgtatgtgctgcgtttgcccagagcacggaggtagatgcttgca

SEQ ID NO: 1298 - DNA, 420 bp, Rattus norvegicus
  Genbank Accession No. AI175348
aaaagaaaaatgttaagactttattcaagatgtttatcaggcattataacaaaacagcagagcttcagcctccggaacactgcactttacatcccttagacacgcagtccagtgtactattaattatttccatcctagagagacctcagaaataagctggaggaaatgcgcagtcacgatccgcaacatcagctctcccagcgtgcactgtcggaggatgaagcacatcttccaccacttgtaatacttcaaatactgtgcaagatgaagaaccgggatggctatgtgatggttgtgattgacaagcactcttaatacaaacacacggacagtttaccacagagaatgcatatatcaaaggccagcaaagtgagcaagctattcacacaaagccaggaggcattctgactaaatctccag

SEQ ID NO: 1299 - DNA, 565 bp, Rattus norvegicus
  Genbank Accession No. AI175375
acatttgcatatcactgtattgtcacatgaaatgcgcatccctaagtgtctgacttggaaacgacctattaggtcacacagagtccggcccctgggggccaaagcagcttcagtgcccagagaccatggcaggaacctcctccaggtcttgctgtgggcacctgctttccccaggcctcagggctgggtgttgggaaaggcgagctcacatcccaggtcctctggcccctgggcaccagtttcccagattcaataggttcctggtaggttagaagctatttctgaagacaaggctcctgtggtcaaatacatttcggaaatgctgagctaaacaagacttcaatggctgggttttctataggacataccagtgcctttctaaatactctgcacttgtgaacatccactgtggggccagtgtgcaggacttcccaaaatgcactggatcacaaaagccttttcccaagaagtatcttgaaggctgggacctccaggcaccattgggagcgtgctaccctaaaatgtctgtgaccactgatagatcggctcctgtgttcctcgtgcc

SEQ ID NO: 1300 - DNA, 382 bp, Rattus norvegicus
  Genbank Accession No. AI175466
tttttttttgttggcagtgatatttattatactgacagatgggagttatatacagcagtgacaagatgcccctcaccctaccagggtcttgtgggggaaaggaggaggtattgacagaaggcacatggtggtagccccaggaggccagaagtaaaggtaagagggtgtagtgtgtcctggggaacccagaggttgaaacagaggctcagtcagagagagccttgggccacacagcaagtgtgaggcagctggtcccgagagcttgtgctggtcacttgaggctacagcaggacacaggggcacctcccatccttcttcctaggggcactgggtgggctaggagggagttcttgctcctggtatttccggacagtccgcacca

SEQ ID NO: 1301 - DNA, 597 bp, Rattus norvegicus
  Genbank Accession No. AI175508
agaaacaaagcatcaggctttattttgttattacttgtaatacaggtattgtactgtagacatctgttagtcttgcaattcattcggccaatacacagaaatgaaaaggagcaggaactcatcacaagccctggctggcaccctccaacccaacacaccttgtccctttcaccctcacagcctctccccgagacaagcaaacctaagtcctttcccaagcacaacacccaagtgttcctttcccagtggacagtgggatagaaaagccagcccaatccacagcaaggaggcagtgtgggctggcaaggagccaaatcctggtcaggaaaaaacaaatgatgtaaaaatatgtgaatattttctatcatagaatgaaaaactgatctgcatctaaaagtgcaagaggcgaggtgactgagcccttcaccagacgccgcggaagtgcacaggccgtggtttaacttgttgaaggaggctagggtgtgtttacgctgacatagaaaattataaattacactgaattagtatccataatcactatatacacacaaaccagttctaaaatccactggtttacaagtgaaaaccttacaaggt

SEQ ID NO: 1302 - DNA, 641 bp, Rattus norvegicus
  Genbank Accession No. AI175551
atctttcaagcttttatttaagtgcacagacttaaggatgatttagattttgttaaaagcagccacatccatggactgtacatagtcctcaaaagcagtaatctgctcttccagcatatctgttccaaccttatcatcttcaactacacactgtatttgaagctttttaattccgtatcccactggaaccaatttagaggagccccacaccaagccgtccgcttgaatgcttcggacacactcctcaagtttcgtcatgtctgtctcatcgtcccaaggcttcacatctaacaagatggaagacttcgcaacaactgcaggctttttagctttctttgactcatactgagcaaggcgttcttctcgtagcctctttgcgtcttcactttcctcctcatcatcagatccgaagagatcaatgtcatcatcgtctttagcatctgctgctccacttcctgtggtatctgccacactgacagggccatacttgcccaaagatttcttcactcccggcaagctggccttttctttttcgtaagatttgatatgattataccaacgcagagcatgacacaggtcagcgggtggtggaccagagattgcttcaaatactgccacatcggcttgtgatggcacgtacc

SEQ ID NO: 1303 - DNA, 531 bp, Rattus norvegicus
  Genbank Accession No. AI175594
catcatacatatttacttaatctctacagaattgagtagataaaatcagattcacgttagtgaaaaatctctacaaaatgtctttgaaaagcaaaacaagactgcctcttaacaattcatatcctcatgaaagacgtgggctgtaaaaataaagcagtgtgtttagcacaaactagaagatatctgcatcattttttcacagttatttccatctacagtctgaaagaggtagattttttttctgcaacacctgagaattgaattgtgataaccaggtgtgtaataaaggcagttgcatacataactaaaaatacaggtctcaagaccagaaaatgtacttctacaagtctgaggatgaaatggcctgatacccaagacccaacttgtcgctacattttggggtctactgccactaaaaatatacatcaagattgcatggtagtgcaccatatgcagtaagtgaattcaacatttaaatcttttcttggccagcaaagtagcattacagtgttctagaatacggtagataga

SEQ ID NO: 1304 - DNA, 466 bp, Rattus norvegicus
  Genbank Accession No. AI175619
gggaaagaattgtactttaatgaaaaccaagttacatgttatcttcaagcagattcttgagctaagggaagtgcagttctaccctatctttaacaggatctgaagtcttttactccattccccaccagtataggttccatttcttatgcaataatcctctagctgtactgagtggcactgtataaaacatttgttttccagggctgggatccaatagaggatggcttcttttcacacatgttgttacacagttgtgtgtagtcttgcttctcagactttcggagctcagtcagtctgacctccaattcacagcaatcttcttgctgtggtttcctgattgctgggattacattacactcaaaaccaccagatgtctaagactcacatgaacagaatgaaataaagtctgttttgacccccatctatgactggctgagtgacatgtacttggaagactggtcacttt

SEQ ID NO: 1305 - DNA, 496 bp, Rattus norvegicus
  Genbank Accession No. AI175777
gaaacaaaatgtactggactgagagaaaaggggaatgctgctggagtgccagaggggcacagtggtgaactatttacatatcacttataagagcacacggctatttaaaaaagagtgtaataccaaagtgtaatacaaaatatagtggcaccgacatcagctacagagcagtaccttgtgagcatggtgtcagcgcatggtagtgtctggcagtgtggaccatgggagaacagtccataggaaatcatctatcaaccccgagtctaggtgagcagtgtgggcttggggcagcacagcgctgcaggagtgtggaggtgtcttccagccccgtacaaggcctaggtaggtgccccattcttcgctggctgctctgggtcagtcaaggagttgcccacacctgtccctgcctgtgctcagctctggtcctagctgcctgggaaggaagaccagccctggctaaatctacaaagttcacccagtcccaactgtgctgtgt

SEQ ID NO: 1306 - DNA, 395 bp, Rattus norvegicus
  Genbank Accession No. AI175875
atacacagcaaagcttacaggtttattagcggtctgtgtggcaacttctctttcaacgtttcagtggcagttctggcaacaaattcataaaaagcttaatttttatacaaatagttttattacaaatttgaattcttaagaaataacacatttaaagaaattacacagaaggccttagtagtcttaaaaactttttttttaaaaagggggtggggtaagggggacttttagtgtaacgccacttcaagcatagtgatcttcccctcctgcgcctgacctgtcggctccctgcaagatgaaaggccttggctgtcatactggaagtcagtcattcagtctgcggatagtgtggcaaaccctgaaaatactccgcgcaaagcggtaagcaggaagcg

SEQ ID NO: 1307 - DNA, 493 bp, Rattus norvegicus
  Genbank Accession No. AI175977
gaatttcaagaggtctttatttagatataaaaaaaaaggtacagtacatctcatgcaccagggtgactaatagatagtcattatccttacagcaattactacaaaaggaaatcgaaactttcgggaattgttcatctaactaagaaacctgaatcaaaaaattgttagcctaaatagcaaactgcttattatgcaacaagccttattctatgtttgtgagaactagagacttataagtgtcgttagtaaaaaaaaattaagagaaactaattattgattagacaaatgtcagtgctatctatagtcccctgcagagaggccttgttgggggaagggtccacaaaggagggtgagctgacggcatgtttctgcctcacctggacttctttttgtctatatgtcccttcctccagctgtgacccagtggaaagttactcagctccctccaagggagagatacagagacgccactgctcctgaaaaaggacagggg

SEQ ID NO: 1308 - DNA, 417 bp, Rattus norvegicus
  Genbank Accession No. AI175990
tgtgaggtgagggcctgtcactagtttcctgttggtgacaaggtccactccagcagctctcagcggtgacgacttatgcgcaaggtggtcagatgccacaacctcccaactgtggtgctaggtgcccatagccttgggtcttggtgcatgagccaccaagtctgtcctgagtgccaccacagcccttcccaccagacataccaccttgcacttcgggtcttctactctaccaacacacacaagagacaaaatggtcatccatcacttaccctattatctaccctcaaactacattctgcctctggttctcatcctctctcggaggttgggggggggggcaagagggtcatgttcttagaaactcgtaatgtgtcctacgttgaatgggtttggcatttgggacgcaagctgccattg

SEQ ID NO: 1309 - DNA, 519 bp, Rattus norvegicus
  Genbank Accession No. AI175992
caagtcaactataacaatcaatatcccaaaccctgttttctgcattcagaacagaggaagttgatgatgtgagcagaacacccgcagccaatcaaagaaaagaccatgtcccactagccagccaatcacaacctttttccagtttaagcagccaattgggcctcttcacattcctaaaaatgacctaaataaagcaccagagctcggacagcttccagggaagccagataccgaggcgcaaacttttaaaaaaataaagagtcagaaataaaaataaaaggtttccgttggtcaaggtttaaaaataaaaaggtttctttctgcagccaatcacaagtccatcccttcaagccaatcacaaaccaccttgatgccagccctgctgagtggctggctggggagggttggatggggtgaggggagcaaggggtaagaagacgggggtttgctgccacttcgcaggcagaggagccatacagatcttttggccatcggtagcttccaggggttgccaggggc

SEQ ID NO: 1310 - DNA, 475 bp, Rattus norvegicus
  Genbank Accession No. AI176004
ctaggttattttttttattttagtcaagaagagaagtgtgacataaattcaagattttattgaaatcatttggatgttaaatgaacataatagcttggcggtgagggaagatttttaataaggcacaataatgagttatacgaataaacagaaagaatgaaaagtgttaactgtgacatttaagtggttacatgattttaattattcttttgataataagcagtcttgtgacgtttattcaaggaactgaaaccagtgcctcccatggaatttgcaggagaatgagagctttgttttctgcctttggtaatttaaaaaaaaaaaagaagaaacaaatgagcaggaatgtaagactttataaaaagtgcacccctccacaagaaaggtgcaaaagggaggctgcgttcaagcaccaggaggagaaagggaaaagaattttctttcaaaaaaaaaaaaaaaaaggaaagaaagaaag

SEQ ID NO: 1311 - DNA, 653 bp, Rattus norvegicus
  Genbank Accession No. AI176007
attgttacaaccaatgtttatttacagaatataaatctcttcaaaaagatacattccttcatttaatcaatggtagaaagccttattaaacagaaataaagcctaagccgcactttatctcagaagaagattgcggcttcattgcaagttcatgaacacagaacacaaatgtacttcactcagcagctacgtcaatgaggctgttgattctcactggcaatgccattttatacatggaacaaatcttacttaaattaacagtagtaaaaattaaacttcaaacataaaaatatgtaacaacgaaggaaagagcaggaagtacgtctgctagcaaacaggatacgcaagttctccgcactcagacactcggtgaggcgtagggaaacctagctctgagtctctggccaggaagcctgtagttccaatcggatgggctttcctgctccactttcacaaacggctcaagagacaatgtggtgttttcagttctataactacctagtgttttattaaaacttactgaagggatctaaaggacctccatgggtaagacaaccaaaagatgaaattataactattttaaagggtatttttgcaagtacatacgccatataatgcacaacggacaaagatgtgttggtggtaccatcatg

SEQ ID NO: 1312 - DNA, 512 bp, Rattus norvegicus
  Genbank Accession No. AI176055
agtttcagaactgactttatttaggtaactgaaggactctcctttgtaaccgagatggaattcacagtatgttgttacattcacgctttaaaaaatatctctctatgtacaggactttgcaaagagatgtaaacacacattattttccaagtacacaccgcctttctccctggagggaaagagacagccacccagcaaggcagcccccccaggtgacaatagaggacagttacaagctctatggggactcacctcacctactaggggccacagagagaagccacagaatagagggacagcagctggactgcagataggacatggataccaatggttcccaggagaattaggcactgatttctagagggttcgtcactcctcactgaagctattaactgagccaatgtggcacttaacattctcactcgtgaagtaacccagcgcaggacagcgagtgtagctgagactggatgtgatcacaacaggcactggccagggcacacagttaaccc

SEQ ID NO: 1313 - DNA, 348 bp, Rattus norvegicus
  Genbank Accession No. AI176117
catgtactttaaaaagccaatacaattaagactttcagttatctttcagctctgcccctgaagtcacccacaagcagctgcagaagcacacaggacttgttcccatggtgggcacatgtgaagggcattgggtatctagaaatgggaatgcaagcctgtgtaactgatcagcagcctatgccctgaaaagcttaacctgtagggtacggagtacaaaaattctactcattagcacatttaaacttgttatcactacagagacacttgctgccacatcagcattaactgctgactagtaagtctcccagtacacgtcaggggaagtcccaacacgtattttaaataaat

SEQ ID NO: 1314 - DNA, 386 bp, Rattus norvegicus
  Genbank Accession No. AI176121
gtgttctagtgctctttattaatttaaacaaggacatggggctggcgttcccagaggcatcagtacccagttggttcaggcagttcccctattggctgactaggtcttgatacctagtgatagtcacacgtgtctaccatcaggtgatcctgtccccggagactccagacacatcacagacatggagcatatatgacccgacggcctcactggacatcatcatcatcaaagagatcttcaaaatcgttaaaaaagtccgcatgaactgccttttcattggctgccaagtccatcaggagcccggtgctacctccagcctcatccaagtctacatagggccccgcgccctcgggaaacatctcatccacagctggtttcctcgtgcc

SEQ ID NO: 1315 - DNA, 382 bp, Rattus norvegicus
  Genbank Accession No. AI176130
cacttcgatcctttatctgattcacaggccttgctctcacactctattgctggttgagtgtagagggtggggcatggacacacaaacaggacaaaataaaaatgccacagctgtatggttcaggagcaaatcagagtgggccttggcccaaggttacattcacagctcaaggtaagtgcaaaagaatggaatgtgaggacagtgcgtgagggctgctcccttttgagcgcaggcctcagagaggacccagagccatggctaccctctcttcagtgcatcctgctgaccccagggagcccttgtcccttccagggagaggaactttgttccaggagccagtgctccactgcagaccaggagtcttttctcctgccctcgtgcc

SEQ ID NO: 1316 - DNA, 425 bp, Rattus norvegicus
  Genbank Accession No. AI176140
gaaaaaaagaaagaaaaaaggagcagttaactccttttattttctctgtttaaaatcaaacaggaaacaaacatcaactctgttatacactaacggtcttcaaagtacatcatttgtacaagagaaggactaaaaaccaaactgtttacagagatccaagcacgagtgagagagcacactccttacacggctttccgatgatactcaggaggagccacttcataatcactggcactgaacagagttgcagaattctttgccaggtacttgaggaaatcatgtagatagttcagtaataaagcaaggcttttctcatctagaggtgtataggccaacatcgctccaattcgcacaaacaatctcagtaagtgtggcgctccatacacctgggacatgggtgcatccgggtgatcggccaaaatttc

SEQ ID NO: 1317 - DNA, 463 bp, Rattus norvegicus
  Genbank Accession No. AI176160
tttgttttcttttttttctttctcaaatttatttaaaaaggattagagctgatatagtaagacatttatgacagggtcaacataaaaatgatagctttggttatactcagcacatgcaacttactacagcgctaacacgggcaagcttcccatgtgaagctgcatgggtgggtggggcagagttgagagaacagggctcacgtggagtacaggagagcaaaggcataaggggccacagggaatgcctactgtcacactagcagcaaggtgcactgtatattacacaaacacctgtgtagcatccccttgttctgatacgtcccatgtttctagttacgtaacagcatttgcagtctgtggttaccagactaagctggtgatcacaggactaagaatctctacccaaccagtctggtgcgttttcatgctgaccccctcactggtgttgacaactaattaaaac

SEQ ID NO: 1318 - DNA, 469 bp, Rattus norvegicus
  Genbank Accession No. AI176170
gaaaaaagccagcataaagcacttttattgcaataataaaacttgaaccgcatatgtagtgcaaaggcaggggacaaaagctttctctcaccaaatcactacacgggacagcagagggtgaaaaggaactgaaggaggaaaagccaggaagctgggatcagcagagagccaagcatcaaaacctgggagatgctgaagctgtgatgaccagcatcattttcttagagaacactcaaggatttgttgtggtggctgggcatccactgggtggtgagtctacaaacagcaccttcagtttaaactttccaccgaagttctagaatttagtaagtggagcgtgatagttacaagattacaaaagtccagaaaatccattagaaaaaccataggatgaaaaacaaattaagccaggtcacaaagaaggcttcaaaggtccctgccgacccagggacagatattgtagtgttca

SEQ ID NO: 1319 - DNA, 477 bp, Rattus norvegicus
  Genbank Accession No. AI176185
ttgctacatctccggaagaggtgaggactggagtccagatgtggatgctttcaagtccttgaggtccacagcctggtgtgtttcacgcacagataaggtcctccctaggtctacgggaacccctcgagggaagacttgtttcttctctctgtaatgcaccagctcagtcagtgccggctgccctgccttctctgactgctcacagggctagcagtgtgggcgagctcagtgagtcataggagggctcgttgctgctgctgccctttcggtgggcagctgcgcagctagggaaggagtcagcctcggggtaggtgaagacaaaggaagacgtataggtagtgcagctgggagtgcacgtgacaacgggagtgcacaggggctccagctctgtgaccatgggccccatccccagggaactgctgtgcagaggctcccagtctgctgcatagaaggaaccagacaggtccacatctggca

SEQ ID NO: 1320 - DNA, 528 bp, Rattus norvegicus
  Genbank Accession No. AI176265
ctaagacaacatgagtttattaatgttcatttaaaactatgcatgagtttgtcagtatgtggattgggttcattccacctcagagatgacaaatgactgtccaaaaaatacactaacttaaacaacatgatcaacataaacaacataatcaatccaatccaaagggcatcttttaaaaaagaacatgagtacttagttctaaaaggtaagttagtccattaaaaggcatcatttttaatgggtcatatttgtcacaaagaatcattgtataatccaagctaaatatatccttgccaggcatatcaaatttaagcaaaatgtcaaaagaactaacattgcactaaaaagtaaaacatcttcatgaattgtataaacatcacagcacattattactatttgacaacagaaaacgacgcttcaatgttgaacttttataatttctagtaaggagaaacagaaacttcaacaacttatgtaaatcatataaatctaacaggtgattcattaaaaaaaagcctccctcgtgcc

SEQ ID NO: 1321 - DNA, 497 bp, Rattus norvegicus
  Genbank Accession No. AI176276
actgtccagttattttcttaaaaaactttaatgcttgataaaataaaacaaaattttagtaccatagaaaccttctgacatgtatgatgacttatcaatatgtacaacttcaaaaccaaatgcttccagcacaagcgaagtcatgctgaacgtcccaactagaggcaagctgatgaagcttcctgtttgccgtgtgagccttggcttggaagaacttagacagttagaaatataaataaaaccttcaatgagaatcaccaaaaaaaaaaaaaaatgcttgtaaaaatgaaatccagtcgtctggatctgggaagtctgtcctgcttatcagataccagcaagcaaatgaaactccatgaacgtccaaatgtcagcggtccaggagaggtcctgcaggtgcacagttgatctatcagaaaccatggcttcctaggtggcccttaaggaatcatatgccatttttcaccagctcatgaactccgttctcacctcgtgcc

SEQ ID NO: 1322 - DNA, 525 bp, Rattus norvegicus
  Genbank Accession No. AI176294
aaaaaacaaaaagcacagggttttatttctagctcattgggcagggctctgcgggacttggctgggcagggagcaggctatcagcgggctgaggctggcctctagtttacttgccagcgatgagcgggttccgcagcaccacaatgactgagtccccgcgcaggaacatcttggagatgtagcggtccttgttgacaggcttggacttcttcttgcccttgccgctcttggggacctcagtccacatctccttcacattttccagcaccatgttgcagtgcctgtcaaaggccttcacccggcccaggagcttcttgttgtttcgacagttaatgagcacttgcgtgttgtttttgaccgactgtgtgagcaccgagaggggacctgtgttgaattcctcctcctcccgcttctgcagctcctctggggtcatctcactcttgggtttattgaggagactcatggtgaaggtttcgctagcagatcactcccgcctccaagcgcgttgctttagcccctcgtgcc

SEQ ID NO: 1323 - DNA, 574 bp, Rattus norvegicus
  Genbank Accession No. AI176308
gaagggttttgtttgtttaatacatctgaaaagaattcatatacaaagagttgagacacaagaaagcattggttcggcactaacgaatctacaagatcaggactggggaaggagattacctaaacatttttaaaaactggaacttgcaaacaaaataatctgataaagtctctattaacacttataaagagtcatgaatctctcgccatttttgagagagcttcagccagttgttcaaggattcctcataggcatggaagaaaaaaaggggtacagccctgactggtccccatgttggttaaaagtatgctccccaccccacatgctcatagcttcttaatgaagcaggcctgtaacctcatcacctgaaggagatggcaatcaccagtgcggctgtgtttcccaacaccagcccttaaggaaccctgtgtatctcgtcttcagctgaatctaggaacactacacagtgagttgtaaatctatgctaagcatataagaaaatgactgacaggggcaaaagaactcttttaattaggaactcaatccatttggtgtatttcaaaaggtgcaatac

SEQ ID NO: 1324 - DNA, 605 bp, Rattus norvegicus
  Genbank Accession No. AI176331
tgaactattactacaaagaactttagcaacaggggacagtttgtgatccttgagtaaacgtcttgtagcgtaacagtctttgagacacacgtggagctgtaaacaccttgctctgaatcagctggcatacactaaaccaaggccatggaaatacgtgttcttaaagcatttccacaggaaatgttcatactttatgatatttctaaatcatttagcaatcattacatatgctacatgaactaaacacaggtattctttattgcacatttcaaagttgggaggatgttctagcttaagaggtgatctttacttagaagggaaaataatatatttttgtttggctcaaaaatgcaaactgccaaggcagcttagtactaaaaacaatctttgtaaaacaaacttttaggttttgatgccaatgaaaccctttgctgtaatgagtaatgtccacttcctctctgactcagcaacaggtcaaagttagggggtgggttttgaagcctgtgagcggtcctggacactgcttggagaggcaggttgggcttcctctcttgggcctgaaggcaatgagtctcttaaagcaggtggtgggtggtggataatcc

SEQ ID NO: 1325 - DNA, 558 bp, Rattus norvegicus
  Genbank Accession No. AI176354
tttttttttttattattggacggacatacagttactctttctctctgcacagtgctggggaaggaacccagggccctccacatgctaggcagcgacttcaccattgagccatctgcattcccagctctgaaaactttcttagagagaacctttgaaccagatgatctgtagaaggctcacactgtagtccatggtttacttggatgcacgcttgctgccttaccgcaagcaaggcctccctcaagctgcttccgagcaagaggaaggcagaggcatggagaaggagtcagagagtgtagaagggcccagcagcgtttgtctgccctgggcttatctcggtgctgacaggggaggctttgtgggcgtggactcctcctcctggctgaggaagggcccagcctgagccttaggagccctgtagctccacacagtgcccctggcgcaagatgtgctgcagcagcccattgaccacgtccagcgtctcgtccttctccaacacaatgtcataggagtccatgtaacgttctagccggtccttcaccttgtcattcaagaagc

SEQ ID NO: 1326 - DNA, 556 bp, Rattus norvegicus
  Genbank Accession No. AI176362
tttttttttttgttgtaggaaaaacatttattgcaattcagtgtcaaaaatgtttacaaaaatatgccaccgtcttatacaaacaactataaaaatgtcagttcctcatgcaagaaaggtgtgcaaataagttatacaggattcagattactctttattaaacaatcatctttgcatgtaatctgtccaaccttttgcatttagttaaaatgttcaacccactccaatagatttctttaaaacatacacttaaagctcctaagcttagacacagactataatatactctctttagccaatgtgattggcatttggtagtgtaaggaaggttccgaaagctcccaagtctgaagcagggcttggagccatgtgttaaacagccttgtgcatagctaataaacatcgtctatactaaaagacagagtcagactctgtaatgctgaagcaaatgacacatccagaaatttggagtttggatgtggccatccattatttttcagccaaatggagagagactaagttcagagagctttctcaagaaggtttgcttgatgga

SEQ ID NO: 1327 - DNA, 516 bp, Rattus norvegicus
  Genbank Accession No. AI176393
atacaaatagttttattacaaatttgaattcttaagaaataacacatttaaagaaattacacagaaggccttagtagtcttaaaaacttttttttaaaaagggggtggggtaagggggacttttagtgtaacgccacttcaagcatagtgatcttcccctcctgcgcctgacctgtcggctccctgcaggggctgtgacacagctcgagaggggctgggaagtggcctgtgtgtgctcaggtgtgaactgcctgccccaggattgcaggatgaaaggccttggctgtcatactggaagtcagtcattcagtctgcggatagtgtggcaaaccctgaaaatactccgcgcagagcggaaagcaggaagcgccaggcacagggcgcactatcatagacaccatgtttcggaatggttttggctttggttatgcaccttctctgatgtgggagtgagtgagaaaggctggtgttttcacattcggtggcctggtgttggaaaccctgttaaaggacagt

SEQ ID NO: 1328 - DNA, 430 bp, Rattus norvegicus
  Genbank Accession No. AI176422
ataaagttttattaatgacaaatatttcatgattttatgggacgttagatacaaagttttttacttcagtgtttgaaggacacttgttcagaagttatccaaacatatgggaggttagtttggcatacatttacagtattctagaaactggctgtcaagtgtgccagtaagtggaggcacttgggctttacatgccattgtaagcaggtcctcctccaccttctgggaccacccagttaatattttgacttgggtctttgatatcacatgttttacaatgcacacagttctgagcatttatctgtaaccgtaagtctgggcatcacagctggccctcaaatcaaactttttataaagctgcttggctaggtgtccatggcagccttctgcaaagattgtgactttggcatgcaactccaggcctcgtgcc

SEQ ID NO: 1329 - DNA, 499 bp, Rattus norvegicus
  Genbank Accession No. AI176434
aattagtataactggtttatttcaggttcacatgtcttgcctttcaactgccaaacttgttatatctaaaaaaataatcactttcaaaagcagaaatgaaagatatatatttaatatataaaagaaaatgctaaatctgacataattatattcttaaaaacattccatttatttacaggtgtataaaaaggcgagttattggtctactgagatcatgcttcttagttagggtgggagcttttttccaggttcttccaatgttctcacttaacttcgcttttcgtactcatacatgtaattttaatagatcagtttctcctaatgtaaggttaaagggtaagagtttgggggagattttggatttctgtcaaggctacaagattgttctaaagactaaaccctcctcaaactagccctgatagctcctaaatctgtcttaagaacaatgtattgtggggggttgtaatgacacctgcagctttccctgaaccctcgtgcc

SEQ ID NO: 1330 - DNA, 370 bp, Rattus norvegicus
  Genbank Accession No. AI176456
caagtcaagtttttttattttattgtcagttacatgctttatagaaaaaagtgtggagaaccggtcagggttgtacaaaaaaaggctaggttcctacgttgttttatttacaccattgtgaggacgcccccacttcaggcgcagcagctgcacttgtccgaagcctctttgcagatgcagccctgggagcacttcgcacagcccacggggcagcaggaacagcagcttttcttgcaggaggtgcatttgcattgtttgcatttgcaggagccagcgcaggagcaggatccatctgtggcacaggagcagttggggtccatggcgaatggaggcggcagttggagatcaacgagagatcgctcctcgtgcc

SEQ ID NO: 1331 - DNA, 650 bp, Rattus norvegicus
  Genbank Accession No. AI176488
ttcaagcacatgatttgtcttgatttaatgcctttttaagtgccctcaaaaactgaggggaaaataaattcactcaaaattattttaaattctttttaatcccctcaatttagagtccaagggctgaaggacttataatcatgattcccctttagatataaatttataaattgcacttgcctctgttaagtgtttcttttgtggggaaaatattatattaatttttactgttgcatgcagaggtaaccctttacccacatagaggcatttcttccatagagcctttgagttcaaaccattttttccctagttttcttttattttcctttttaagattttcaaactgggttacacactggaaaaggctgggttaagggccaaaatttaataaatctgtacggataactaaaggctacagagatttttatatatatatatatataattttttttaacttttagaaatcagagtgcttataaaatggctggctcatggctctgtccccagcccctctgacgccgcctcctagccttcgttgttgagataaccaggaatagtgactccatgcgtaaacaacaagaatactaaccaagaaaactagcttatcatgcaaatattaaggcatctagaaagtcagttaaaatttattg

SEQ ID NO: 1332 - DNA, 607 bp, Rattus norvegicus
  Genbank Accession No. AI176500
aacagtttttttattattttctgcacatttgtacagctgtaaactcaaggaatcatccaatagttgtatacatctggagaaccattaataagcaccttcagtggtttccacagcttaagatttaccatgtaaaacattttagaagggatctagtaaaatgaataaaagttataaaagttgtatatcatgaggaacgtgacaaaaaaagcaaaaaaaaaaaaacccaaaaaacaaaaattcgaggctactttatgaggttgcatgaaagagtcacatgttccctaaatcttgtgatttaaattccaattatgtaagtaaagactcccttccaatttaggttcccagtccaatgtaagcagggtgaggtggaggtaggagatagggttggagggctgactattgcaaagctagaagaaaaggaggtagggggttctgttccccaagaaaaacatcagacaagttcttttatgtcttcaaggataagcattcttttggaaaatgttccatttttctctgaagttatttaagggttttagttttagctgcctttaagcctcttccgtgatgtttcttcttgggttttccattcctgttttcccctcgtgcc

SEQ ID NO: 1333 - DNA, 655 bp, Rattus norvegicus
  Genbank Accession No. AI176505
tttctttacaaaaaaaattgcacataatatttgaccactcttaggttctgatgcactggcatttgcaatggtttctttatcttcaagttaaacagtctcagcaaggagtccagcacgcagaaagggcagtcaacaaccctgctagaacattcaagtgcaactagcagacttgtggccatggcagctacactctccttaagatggactgcttacgtctaaaccctgaaatgaagaatctcagagacttaaaggggaggaactaaaagggactgcctgcttttttactgtaaacatggccctggaaactaaatcccaaacaagaatctctcaggcatcagagagtgtcaagtggaccaggaatagcacaacataaaggtagggaaagtaaaaaatgaaaccaaaaacaaagtaaaattaaaataaacgtcagtcgcttcgaggagctatacttacgtacatgatgttagagagtctggcagggcccagaagcaggccaacagggagttcatttatccgttccaagagtgtcactcatgttcattgcttccggttttacggatagggcattgtaggaaacttgatatgatcaataatgcttgtctgccttacacagaccttagccagggatcagcctaatcttgaagaatcattcaaa

SEQ ID NO: 1334 - DNA, 498 bp, Rattus norvegicus
  Genbank Accession No. AI176540
cctttgagcttgttttattgatattcgttagtgaatgaaatcttgtcaccggtctgatgcattacaacaggcttttaggtagtgtggctcaatgttgatcaccggtttgctaactacactatcacgacctttgaagtgccggttctcacactggtgtttccagtgcggacaggaggcccctttgaacatgtgacacggtccatccacgccaaggtggtcaccctcctttgccgtcctacctactgctttaaaaatacattcaaataaaagggtacgttacttggagtgactgcacacgtacacggcagccaggagagctgagaacatgatgaaccagctccgtctggagaataaatagtttgaaatagtgggactgaagtttgctgcttggggaccttctcgagcatccttggtggacataaggtgaccctcgctcgattcaaggacacatcttttgctgggggaggggttgttcgtgtgataatttctagtacacag

SEQ ID NO: 1335 - DNA, 678 bp, Rattus norvegicus
  Genbank Accession No. AI176546
atctcatctgtatttacctttttaaagcagaatgtgattgggcactgttattttcacattcacaagccttgctgagttacaagacctaggggaacttagggttttgttctcagtactttggaaaacaagccacttggggaattcctgtcaagttgttttagcttgtgtttacttctaagactagtacatgcagaattaactacagggaatgaaaaaaatttaagatgaaacttaagtcatcttaatttggtctactaaaggaatccagctcaacagctaaacacttcagaccacatagttaacagtaacagtaggttacattacgtcttacaacaaacgttctatcaacctcttgagtcaaacctatagtatcacagtatcacatgtagaaatttttaccttcccctagttttcatgccacacagatgttttaaatgttaacaaaaataaacaaaaatcatggaaaatatattatcagaaggaatgaaggtaagcatcaaacacatagttctggtgaagcctagtctacttcttccatgcgtgatgtgtcatcatctccttccaggggtggcatttcttcagttacagcagcactggtatcatccacagtaggatcatcctcatcaatacctagaccaagcttgatcatcctgtagatcctgttagcatcctcgtgcc

SEQ ID NO: 1336 - DNA, 575 bp, Rattus norvegicus
  Genbank Accession No. AI176584
taaagaggagctgagccctccacattggggtgattttttttcccacatttcgttttttgtttttttcccacaaactggtttgctattgaatttttttttcaatccgtttcaccagcaaaaagtataagcattttttttttaaagtcgaaaacaaaaaagaagagagaacagagctatggtgcctgaacgcaacactacaaagagctaatagtaataatgtgctgtgaatattgctgtcgtaaaaaaacaaacaaacaaaacaaaagccaaaaacaaccggtaggcgtctcggaatctgaaggagtcttgtctgaactgtgctatccgtgtgacaggctatctgtgtgacaatgacggtcggagatggggactgaggctggtgactagggaccagagaagtggggtgaatggatgcggggtgacgagggatccccccctcccctctgaccctctaccttccttttccccatccagaaagacttagagaggaggtcagagcctgtgaagtggtgaaagtctatactccattaaaaaaacaccaagaaagtctgctcaaagaaataagaacggggaaa

SEQ ID NO: 1337 - DNA, 605 bp, Rattus norvegicus
  Genbank Accession No. AI176588
gtcttcattttttttgagtgtacagttttattgtcttttgaatacacatttgttttactgccagtccagataaacaagtttataaagaaaatactaaactttgcttttggcagaagtcaagataacctgtgcagattaaaatgacttacttcagtctaagaaatggttttgaatcatacaaatcttttatgaaaaataactgttcaaaagcattctcccagcttaacacattttcagaataactcccccccccccaaaaaaaattcaaaaatactaccataaaaatatgtcaataccgtatggctttatgaaataacttctaaattttttgatttttatttaaaaaggttcccaagttttaaataaacagctagcaacattttcttcacttaaaagtgcatatatctgggaatgggacatacataactttttgaacaaataattttacaaattaacacacacgaacacttaaaatattctaagaggcaaagtttttccagaaaaagtcatctagactgcaatagatgacctttcacctctttctctctatagcctttggattatcaaggagatgctttggcagttttaggacatgtgacagtctc

SEQ ID NO: 1338 - DNA, 571 bp, Rattus norvegicus
  Genbank Accession No. AI176792
ttattagaacattgcttgttacattaatattcttttttttacattaatattcttaaaaaatataaaatgattttaaacacttcttgagtgattatcaagcacttatatagacatgcctgtagtatctgaacccatttttaatctttacacaaatctatgagataataattactatgtatttttttgtttttaaatgctgggagcaatctagaaggatgtaaagaaaacggttttcaaagcaaagagcaaaggtggaggtaattggagaaggcatttatcacaagtaaaggcgggatggtgtaaagagagctttctagtgtttcccaacaagtacaattttctctcttctggcccttcacttttaaccacagcagactttataacccttaggcagaaatcaggtagctggtgggaaaaaccaccggtgcagtatactacccatttcaatttcatgagacactaaaaagaaacaatattggcatgtttcttcagtaggtattctaggtttctactatccagggttttgtttgtttttgagacaggctctttcttgttatgtagctgggattcg

SEQ ID NO: 1339 - DNA, 599 bp, Rattus norvegicus
  Genbank Accession No. AI176810
tttttttttttccaattacagaacatagctttatttatagaatcttacaaataaacatttacagttcacatgacataagttattttgttttctaattcttctaatgacacctgagttatttaaaaatatactgtgatggaactgtaaagggaactctgactaaaatcctttctttttgcaaaactcaccctgcttatctgcatgtctttggaagaagggttgctaaaactggatcctaggtggtccaggcagagagaagtcctttaaaacccagatgaaaggtactggagaatgctcccccagctgacactaaatactggagggcagccatggaggactgaaggtgaggtcagagatgaggtgcttagtgacagaacccaaggcctggctaagggctcctccatgtgacaagcgctttccttgctagtgttaacaggggacagaagctaagggcactaaggccagaggagaaatgtctgctaagcaactcactgcccctgagacctctaatatgtacagatgcttaaaacagcaagtccgacatttaaaagtcaaaaaaaggtcaatggctgcatttccgactcatgggcgaatctgtc

SEQ ID NO: 1340 - DNA, 662 bp, Rattus norvegicus
  Genbank Accession No. AI176841
ggagttattaaatttttattaaatatactctgttggcacaaatcttcaaaatatataaacatatataaacaaagtatcttcatggcatcaaaatagaactccagactggacagtgaccatggagaagggcagccacagaggcagagagcccctaagccagagctactgggggtatatggggaagcaagaagatcagggacccatgacaccctagcgtctcctgcccagccggttgcctgatgcagggcttgagccatctacatggtgcaacctgttggggtggcccaggagcttccgtcacctccagcctcctggcatggggtgcccagcctctccatcccaatatggggccaggcagggaacagagtgggcagtacactcacaagagcacagtccctctagccaccagaggttgccaggatactgggggacatggtggggacgcccatcaccatacgaggaggcagagagatggccgagcatcacaagcacaaggtaagaaatacagaacgagctaggaccacagcaagaactgcacatgcctggaggtcaagccaccctgctcaggtcctgcatgtgagacggctgccgtctgtccatctggctgtgggaatcaacacccaggtcaccgcactgcacaggatagggggtttgtatgtgca

SEQ ID NO: 1341 - DNA, 411 bp, Rattus norvegicus
  Genbank Accession No. AI176951
ctctttgccttttatttatttaataaacaaacaattccttcttgcttttctcacagacttctgcttacagagcttatttttaaattttcaaaacatcttcaatgagtcattatcaaaaataagtttcctcttgacttgttacaattctggttctttgtaggtaactgtgaatgtccctgtatgactagaggaaaggtcaatagacataaaaatggtttggggggaggggggagtgattcaggttaaatgtccgagcataaattttagtggctttcaagttaacaaaaggttgctcaaggaaacctttccccctctgcagtagatgagtttagagggtggctcaaggtgactctagagggtcctttcagggactgcagtctgatcatatcaaaccattagtcacaaggattg

SEQ ID NO: 1342 - DNA, 542 bp, Rattus norvegicus
  Genbank Accession No. AI176961
cacacccggcctgaatagtatattttctcagtagccaccagagggtgtcttcacttgagttcccaaggcaatctcttgagagttctgcaaaggttgtcactgccccaccccatcacagtaggtccatgttgtctatctctcaggagacctccgtcactagcgtcagtagctgttgctcacactgtaccgcaccgcctgggagtgaagcggggtgagcagcttggcctggatcccagggactctagtccataagtccttggagcagtgctgtcactccagaaccacagtgccacccactgcctccaaggctgccttgatcttctctgcctcagctttggcgacgttagctttgatttcctggggcagggactccaccagcttcttggcctgcacaaggtttatgccctgaacgtagttcttgatctccttgatcagcttcactttgtccacaggcttcgcttccgtcaggcgcaccgtgaagtgtgtctgctctttctgcttaaggaggtcttcttcctcggccgcctcaagggctggtgctg

SEQ ID NO: 1343 - DNA, 595 bp, Rattus norvegicus
  Genbank Accession No. AI176963
atttcttaactttttattgacattggcaaattaaaatagaataaattaacaagtattttttcaaaaaaatgttttgtacaaaaatactgtcaaaatttcctaaaaagctttcaacacagtagtatcttttcatgtactgaatataactattagcacagtgtcaaaaatgttgaagacagaaacaaaataaaaatctgtgaaatgtttgccactgacgacattccacaccctatttattgtctgtacatatgggggagggggagacagccaacttgaaagtgaacggtatgacttttcctgatccagaacggtttggcccacatctgttttaatcttccagtttagcatatttgaaaacttaagtctgtactcgaatgcatagtttaaaaaaaaaatgaagcgagacggcagtttgtgcagtaatatctgcccttcaaagttcatgcagccaagaaatgcaatttttcctttcactcataaatctgaatgcagtgcgcagtcatttgaaaccatctacaaaatccacaagattaagcagtttgccaagcttaatatctaacagttgagcacgggagaaagtgaggaaacaaggagt

SEQ ID NO: 1344 - DNA, 537 bp, Rattus norvegicus
  Genbank Accession No. AI176995
gagaggtctggggtttatgtacaaggaaggaaatggtacatgtacaagacaaagtgccctgcattcccttccagggtcaggaagcccagcagggaattgagcagtcagtctgtgaggctcctctgttgcccgttcctgggccagaatccacaggctgaggaaggtgagcctgctggcacatccttcctctagcaatcttggagctggtacagacagtgcttctgctcttcagtcagtgggaagacagtgggcagggtggggtccaggcccttcctgtcattgtttggagcaggaagtgcccatccagagggtggccaccaggggtcagctggtcccactgccacccactctccatgttaaacgttagcccttccctttccacttttgaaagcctcaaatcttctcccacaacactttggttttaaggaagtggagcaagaagctcctgcagtacaatattggcagagtccaagggtccatcaatctgaacactctctagactagtgctgtgtgtgtgtgctgggggcggggcgatca

SEQ ID NO: 1345 - DNA, 595 bp, Rattus norvegicus
  Genbank Accession No. AI177049
tgaaaattatttaaaaaattgtttacagagaggtggatttacataacttggcaacatttttaaaatgtacaggccatttcatatttattgcacttactctttaatatataaggcattttatcttacataaataatgtataatgtacaagtgtggtgccaattaaagtcaaccctacaatgtaatgcgatatgtgtgggagggtgtgaatgaaacccaacctacatgagccttcacgatattgtcttacaactacgatttgtgtaacacattttacctcatagcttactgtgagtgactgaccacatacaaagaaagaaaaagggttagaacaataccattagtgttcactgcaggaagtgtggggatttattagactaatcagcaatactagtcatgccttgaacactgaacacaaataaatagctttctatctcagggtcagagacagggctagctcttgcttcttcccttacattcccagttagctgggaagatccaggccaaatgcttgatgacttaacatggtgtagcaagtcctccgtgtactcttcagataggagctctggggacacttggaaagaggccattgctccc

SEQ ID NO: 1346 - DNA, 629 bp, Rattus norvegicus
  Genbank Accession No. AI177055
ttttttttttgcactgtggtatcctttatttaaaaattgtgagttaactacagccatagagttcttgttcaccatttagatggcataataaactgagagaacaataacacaatcccaagaaggcattaccctataaacacacgtatgaccacccatgcacacatacacacaacatacacacaaagattataatataaacaccaagtgatgaaaaaaacactttgaatgctctaaatcaaattaaaacccctttattataataaaccgtggcaatattgtgactataatgaaagatattgtaactgcttaagaagaaaaacaggggaatactggcaatttagcagcagcaaacagccaaggaagggtggaagctaagcagacgaagcagcatctctctctaatgttggcactgtgtaggactgcacggaagtagtttaagttcagtttttaaggaactattaaaacatcctttgaaatactaatttgctgcactttacaaacagtggaaaagaaaaaaaaagtatttggaatgttagacacgcacgcacacgcacacacagaggaaacatactaagatattggtttatggtctttgtttatgacctccaaaaagttttataaggaaaaat

SEQ ID NO: 1347 - DNA, 605 bp, Rattus norvegicus
  Genbank Accession No. AI177059
cagatcctgaaggtttattgagacctctacttcccaccactcccagcccccagagttctctgctgcctctctcatgacaatccctagggaagtaggggaccaaattaagctgcttttccgtggctccttcagagtcgatgggcagcagctgtggtgagtgtggtcttggtgttgaattttgagggatgagtgaaggcagatgggtttgggctccatgatgctcacttaagggagttagttgatgagaccaaggtaggaagtattctgaggagagctgtgggagtgctggggtgtgactgtggccatgcctgagctgattggcaatgccataggtgctgtatttctctgtcgagggtagccctaaacagatgggtctgcagtaaggaattggctgaggtgggatgtataagctggcagctagaaggtagcttctggctttcagctgtcgtgaaagggtagaagcaacttggagttttatggatttcagctagatccaggctggaatggtttggccacagaaaagcctggagggcgctgacagcctaacctcaggtagagtgctacagagcctgcctgtatgtggggcagggatttgccagggcata

SEQ ID NO: 1348 - DNA, 594 bp, Rattus norvegicus
  Genbank Accession No. AI177099
ttagaagacagagttttattttcaaagctaaaagcagcctgggaattctctgcactgtaagatacagctttacatgtgtatcaatagagccaataaattactgtttctcttcaaggactactatgtaaatgtttgaatcggaaacattatgattgcccattgcaagctttgctattgtcatttggaaacactataaccacacattaaaaaaatatcaatatatgtatgactctcagaagacatatacatatacaaacataataatccatattcccggtatgtcacatatttgatataaacctctgaagcatgtttggataaggcaaaaatcagagctctccaaaagctgaaagtttaatttacttgccaaatatcccctattaacccgaacatcaatattttaaagtctctatgtaaaaagtatgctttcagactgcttaaatgctataacgcacacaacaattttcaaataatagaaccaatagttttgctatttgaagaatattaggtaaaagatactatgtgacacacaccacaagagtcaatgataaaaagctggcctctctcctacaatgagtgcaaaacgaccatcgg

SEQ ID NO: 1349 - DNA, 560 bp, Rattus norvegicus
  Genbank Accession No. AI177105
gagtgaaaacttaaacgacttttatttctggtacaaatgataaatattttgtattaaaaatctggaattcaagttttccttgtacttcatgctccctccctgcctcaaaaccttgccaaagttcttcagcccagaggcaggaagaatcggtgcctgctgaagtatccaagttgggtctcagaaaaggcacacaaattgggtcttgggggcggcatccctgctccccgttgcccccagggtagaaagaaggcactgtaactggacacaagagctggggcatgagtccccagctgtccctctctggttcccttgctggtgaaaaggttcccttgctgcagggccacgcctccagaacaagttccacaaaagcagcctaggctggtacattttgattccacatatgtgggcacttcaggggaaaggagaggcaagggtaccagtctggagaactgctttaaccccctctgcctcaagatgggcgcagttaggcttcagggctgcctcagggttgcccacactgcaaccctctctcaattcatgcagatgaggccgtggcttca

SEQ ID NO: 1350 - DNA, 568 bp, Rattus norvegicus
  Genbank Accession No. AI177119
agtgatctatttatttttctctcttcccacctgaaaaaaaaatagtctcataaaggtctcgataaactgccactggaatggaaccagtcagtgattcccagagaaactttgaggagacagagggctgatgggtcaggaaccagggtggacttcctgaaggaagaggtctgagtgaggatggggaaagcagagggagcgaggcgggcgtccgggtgctggacccagcctgccattctagtcaggaaacagtaggaaaccagagaagacgctgtcagagccctcagtgcccaccatgccgttgtagtcgttgacggccagccacaccttgtcgcccctctgcagccgcaggagtactcctcctgagctgacctgcttgctgttggacatgtggtcgcaaaagctggtcaccttggcattgttgaggagcaactgcacgcacaggttggccgtctgggatgtgtggtggaccaagtagtagaggccgggcactttgcaggtgaacttccccgtgtttgtgttgtaatccccctgaggattggtgatggcggaattgaacttgacaaggcca

SEQ ID NO: 1351 - DNA, 549 bp, Rattus norvegicus
  Genbank Accession No. AI177183
ctttagttttgcttttaatgaagaaaagatcacgacatggaagagggccaataaataaagtaatagtagactaactaattaattaaacaaacaaacaaaccagctgtaaaagaacatcaccaaagcaaggattgcaggcccatcacccgtgagtatggagtagagttcattcctggtggaaacccttcacgggcctcccagcttcgatcagcaggcagcaggtaggggtgctgctgggggcacgtcctgatttttctgtgtctgtgtcattttcgatcaactgtgtcatggggcttcctgtttcagctcccagttattctcagaaccttccaaaggctcacatccatgacagtcttctccttccttctggatgaagaaggcaggacaccaggagctccaagaacgcatagcactggacgtagactgagtttgtgctgtggaaacctctgcacaaaatgtcatagggcggatagtccacaatgatgaagaccagaggagacagagccacaagtcacaggttggtccagggagaagctgatagacggtctg

SEQ ID NO: 1352 - DNA, 455 bp, Rattus norvegicus
  Genbank Accession No. AI177256
tattttatggcttttattattaaaaaaaaaacaagcttgaatcaaatatgacagtgagtccacacttctaaatgttaggtactaaaaaaatctattatgttgtatagttttcgaattcccccattcactatccactatcaatatccactatgattatgaaatgtttatccaggatacaggttgataagaactgagaaagtcatttacaaattcataagtgaaaaacacatgcaaagcaaaactccgtcaagtaccacatggtagagaacctagagtcgcaaagagcaaaagctgttgttctccctcgtcgccgatttcccctttccagagtcaaatactgctgccagtttttaaggtttactttcaaaaatcccgaatgcatccgcgagcatgtgtgccaactctagaggcacaggatggactttgttcgcaatacagaatgcatacctcgtgcc

SEQ ID NO: 1353 - DNA, 306 bp, Rattus norvegicus
  Genbank Accession No. AI177280
cacagtagagacagcatttatgtcagagatggaggatgggagccaggcaggacctgcccatcagggccacaggggcgggtattcctgtccgtgatgtcaattggtcccagcggaggcgggattccctgtgagagctgtcaatcattgtgggatggtgagatttcctgtctgacataactgagccaacgacgtcacggggagcggtgggcgtggtctagggccgcagcaggtccttcctcagcgtctccgagttgacacgctcgtcatcagatacgcggtcccggatcccggggatgggggggagga

SEQ ID NO: 1354 - DNA, 476 bp, Rattus norvegicus
  Genbank Accession No. AI177312
accaaaacagtaactttattacgtcttcattacagcacacacagtcactgcattctcgtttcccacagcattcatgggccttttctcactgcagtcgaaacgattggaagtgggtagccagggcatgcaaacctgtgcgttctccaaaacctgtgctgcaaggctgctgtctgctccaagagggcgcccaggagctaccttaaagcggcttctcatacggagctacacagcgatgcttccctctgaccttggagagcctgccatgttctccacctttctttactccatcactgtacctgaggtagagccgagggatcttagactcccaagctgctgggatctggtggctgcagcccacgaagaatcacatgcctcagctctcccacggactggcagccagcacttgagcacaggatttcacacgcctcttcctgcttcttaagtttgcatcacccgtttctatactgactctttct

SEQ ID NO: 1355 - DNA, 594 bp, Rattus norvegicus
  Genbank Accession No. AI177357
cggagctggggatcgaacccagggccttgcgcttcctaggcaagcgctctaccactgagctaaatccccaacccctcatgtgttatcttaaagtgatattatcctaatatcccccatgctaacaatgggaggagggcacctataatctaagtaaagaattgtttggtagtggtaagtctaataacttcagtgtctgattcttatgctcccccagcccagagctctgagggccttatgccctatttaatatccaggtgatctttagccctttagccatcggtcacgctatcttggccacaaacacatctgatcctgtagcgatagaaattccaagttgagctctcctcttcaagatgcaataaacgctttgctgcagaaaaaaaaaaaaaagaaaagaaattccaagttgaggaatgatctcctttaagagaagtaagaccacctcataagcctttcccatgtgatcaagaaaaccttccacccagcctgagacaatgtacacaaagcctaagaggtatctgtagtagtctcagactggagagagtggtgtgaaatccaccactaacattctgtatttgagaaagcctttaggtc

SEQ ID NO: 1356 - DNA, 618 bp, Rattus norvegicus
  Genbank Accession No. AI177366
gtattttaggccttttattttaataaataacttcagttaacagcactgtcaaaattaaaaggcacttaaaacaaggtggtgactagcttgagtcagggcgagcacagcagggaaggcacgtgcaggaggtgcacagtggtcgaattgctgctgaggggccctgcccaggccctacagtcctgcaagcagcaggacggcttacagtatttgtgaaaaaggcaaatgtacagccacagaaaagaaaaggttataatagagtctgacccccaaattgcaaacagacacattagagattagaggtgataaaggagcaccaggaattaaagaaaaacaaagcagaacaggcccctgctccacaatgctactaaagttatggccttatgtaaatagtgctaagtcagggactttttagcagagaagttcccagtacttttatccaagcttggatttataaagagaaagcgttgggagttacaggatcaagtaactcacaatggcacacaggttttaaagctaagttttcctttccacatctcagaatttttccaatggacttgtaaatcaactgtgtcaaatttattttaattggaaactgtcaacacacttgtcttccgcacg

SEQ ID NO: 1357 - DNA, 407 bp, Rattus norvegicus
  Genbank Accession No. AI177403
gtttgagggagtggggtcaagaaattttttgtttttatttttatgttttgttttccaacagggtctcatgtaatctgaactgtcctcaaattcagcgtgtagctgtagatgaccctttactcttgatacaccaggccaatttcaattaacaggatttattctaatcataatgaaatactcaggttggtttttgggatttgatctaattctgtttgagtttaagaaatcagaaagagcagagtcctggagactttgaagcaaaccatgtccgtgcaccagagaaaatgtgtcctgtcttcaccaggatggaagaagcctctgctctgccatatcagattccagagaacattcccacactcttccagctcatctcgctgtttgcacagcagactaaatcctttaactct

SEQ ID NO: 1358 - DNA, 529 bp, Rattus norvegicus
  Genbank Accession No. AI177590
gtgtctttattctgatgtttatttgtgaacatcatagccttgcctttaggtcaccaggagcctccaagctctctatgctgtcagcatgtgtgctgtagtgtgtctgtgtgagtgactgctcatgggatagatggctgggttgtgtgctccctgctagtccccacctctctgtagggaaagctatcgtaaagtagccctctctgcctccagccttcactgctcctgggaagaactttgcagtgagtgagtgtactccttgcttcctggtttccgtgcagtggtaaggtaagcaatgagtgaccggagttccttgtcaaactgcagaccacctagcctgttgaaggtggatttcagaaccactttttccagttcaacagcaacaaggctggtcatgaggccagttaggctgtcatagatgaccggggacaggctggccttgaactctgccatctgctgttctaggctgatgatgaactgctgtacccaggggtcatttggcctcatagtcgttgaattctttcttcttgat

SEQ ID NO: 1359 - DNA, 434 bp, Rattus norvegicus
  Genbank Accession No. AI177683
tttttttttgaaaagttaaaaattccttaattttttattcctggtaccactaccacaatttacagggcaatatacctgatgtaatgaaaagaaaaagaaaaagacaaagctacaacagataaaagacctcaggaatgtacatctaattgacactacattgcattaatcgatagctgcacttttgcaaactgtggctatgacagtcctgaacaagaagggcttcctgtttaagctgcagtaacttttctgactatggatcatcgttccttctgtggcagatttttacagttcctctaatgcatttaggacgactgtctcaaagtaacctgcagctttcctgacaactcctcgctctctctcctgctaagaactgtagccgtttgttttattttaaaaccttctgctaccatatccaccacttccaccctcgtgcc

SEQ ID NO: 1360 - DNA, 587 bp, Rattus norvegicus
  Genbank Accession No. AI177706
ctaagacattttactttattccaaagaagccaatatacaggatataaagggcacagtatttacaacagtacagtaaacaggttggttttctggtagggtcagtagtctttttatgagtacaaacccctcccggtgattttcagacccagctgacagacacagcaacggtgggtagggtgggactaaaaaccaggtagatgctacaatgtgcggaaaggggtcatgtcatggtggggaattcacatctcttccgggcttgggaaggaactggaaaggtgaggcatttgcctgagactcacacacagcccacgctgagcctggaaatcccttcccagagagactgtatgtctgaggagagcctccagtttcctggtccttcatctaaaaccaagcttgaccttgacctggagtagacacagacagggctgagctctgagcatcggggtcccttctgtgccggctccagctgcctgacaactttacacatagtaagcccctaagccccaaaggagtcctgtgttccccaaccccacagaacttccctcctactttctccacacagcttaatggaaacaggtctggccaaa

SEQ ID NO: 1361 - DNA, 550 bp, Rattus norvegicus
  Genbank Accession No. AI177734
aaataaaaacaagaacttcatttatttgcaatttccagaaggtaatatacataaagattcaatttcatatacaactgagtgtatatatgtatataccacacacacaaaatgagtatgtactgaattttcagaaacaaaagttaaaataataaatagaacaataaaactttggaaaaaataacacattttagttgtggaaaatatgattcttaattatatacagttacatatataataaaaagccacctcttttcagattgcacaaaacttgggaccagtaaaagcatattttacagcatgtggtgctatgatcccaggtccttatgattaactccaggctaaaaaacacttacattcataatacagtaaagatatgcagtactgtttgaggaagaccgccttctcagcttacgttaaccctacaaaggctgtacaggaaatttcacaaaaagaaatctcaaataattattgtgcccacttcatgctgaatcaacagccaaaaatgggcttcaaagtaaacatggttgtcactggatatttttaacacctt

SEQ ID NO: 1362 - DNA, 551 bp, Rattus norvegicus
  Genbank Accession No. AI177765
tctagtatttattaaattataaagtgtttttaatcaaaaagaaaaatgcagactaagagaaacctccaagtacaaggacaagacagcaaaccttatggaaaggaacaccatgaagtatgttatagagtctgaaacttaatagctacagcttgacatttctatcttagtgagaccaactgtaaagtagttgttagtcatctatttttaactcccaaattcacatctcttttccacattaagcttcctgctcatgataccaagtatctcacagatgccaaattttagtgaagattttataccaatccatgcagaaaaataaggtagtgcaagagtcagatgagagccattaatgcacggggacacactagccaaaagaactaaagactttaaaaaacaaacactctaatgtaaacagatgccaagaaaactgtgttatactgaacagctctcaactatcaacaccccaattcctcacattaaataaatttcagcagagacatgttagacattttcctcgtgccgaattcttggcctcgagggccaaattccct

SEQ ID NO: 1363 - DNA, 449 bp, Rattus norvegicus
  Genbank Accession No. AI177804
aacagaactctgtgacctccacagagaagtcacctgctttattgcatagatggcaagttttacaagcatatactttaggtataattacataaagtcggaagacaagatatttatgtccaaatgccactccattaatgaacggtttaaaggtacacagtgtgtgaaattaattttgaatgttactggtgtctgcctctgaacgtcacaagtaacacagcacagaaagtaacttttccaatgccctcagtattccacaagctgatcgcaggagcaccaatgatgtgactgcttttcctacaaacacaactggaataccagtgactatgctttataaatgtcgtttaaggcaatcctcataggaaacaaggtcaagattcataattgcacatatctgtaaggtcttacatcgttgatcacaaggtgcgctgctgtcataactcacaaaaaaa

SEQ ID NO: 1364 - DNA, 482 bp, Rattus norvegicus
  Genbank Accession No. AI177843
gttccctgcaaggacctaggcaggcagtccagctctttggctgacaagatcggagaggatctttcaaatcctttctttgaatatttggtcaaaatggctttagtttaagtccactggtcctgtgagattgtaggtgaggctgggatgacagactggtagaaatacttgcccagcacttgtgaggccttgggttgtaactggttttcctttggtgttctgattttgttcttgaagggaaggaaaacagttatgaaaggctcccatcagccacctgtgcttctaggagtgctagaccctcctaggcagagaaatggagtcctctccccctccataatattcccatcaaaatacacagacataaataaatgtagccatcacttgatcagttcttaggagtgaggtaagggacctttttctctctaaaacaaaaacccctgttgggggtggccatcctaggtttccaagaatttaaaaagccggga

SEQ ID NO: 1365 - DNA, 630 bp, Rattus norvegicus
  Genbank Accession No. AI177871
aatgaaaataagctttattacatcaagtaataaatacaaagatgcaacgtttcagtcgttttcttccagatgttgtgatcggctcacagtaaacacggaactgagatctagtctcaggacggacatttgcagggtgcttggtaggttgggtggattgctctttcttctgtatttataacctgtgcattttaaagattgacttcaaagcactcagtcatgcaaacgcttaagcagagaagctccgtgaagcagggtctacactgtacacaggcaggccagctactaagcaaacgtgctgtggtctgcactcaactcctcagaggcaggtgagctcatggaaaggaagtcaactggggtgatgcaaatggaaaatgtatccaaagggaggttaaaggggacactggtatttggggacaaacaatagcttgctgtgaagtggcttgacaaacatctttcaaatgcttgaaaagaaaaaagagctgggtcattcctaactacttaaaatgcacatcgtcagttactgcaaaatgtcttcccaatcttttgagtgtgggttcagagcttaatgactgtggtagaaaaattactgccattttgaacaaagcctctcatctccatggggtagagatg

SEQ ID NO: 1366 - DNA, 395 bp, Rattus norvegicus
  Genbank Accession No. AI177911
aagggggtgaaaggtcaagattttattgtcttcataacaaaatcagcttagaactggatcacttggccctttctcttcttgtcacctcctagttcaaaatgcttgcatctcttaatagccagcatcctcttagatctgcagttgggctcaacgcactccagtctcagcacaatcttctttgtagttttagcctttttgcggaaaatgggcttagtctgcccgccgtagccactctgtttcctgtcataacgccgctttccctgggcatacaaagaatccttgcccttcttgtactgcgtcaccttgtggggttggtgcttcccacatttcttgcagaatgtccggcgggtcttaggaacgttcaccatgtttgcaggagcgctacccctcgtgcc

SEQ ID NO: 1367 - DNA, 501 bp, Rattus norvegicus
  Genbank Accession No. AI177962
agagttttagagtttaataatctggaatcttgggaacatatgatatggaagcttaagaatctagaactttggaccaaattttagattatcatcacatcacagcttagaaactccatctggggactcttaaagcttttgaatttcagagtctacaatcacatttccttaggaggcagaattttatataaaataatctataatcataaggcctcagaaactgtggttgaccatcactaaaatcttagaaattaaaaaaaaataaaggtttgaaattttatgatctggaatattccaacatgagccttaaactgttaaattggagaacagtatgccttaaaaccttcatgcctagaatctttagaacttaaaaatctacagtcttccactgatagaaccccgggctccagaaagataaagtctagaatcattgagccttagatcctggaatctcagagccatgcaacctaaaaccatgggggcactaccaagattttagaacca

SEQ ID NO: 1368 - DNA, 524 bp, Rattus norvegicus
  Genbank Accession No. AI177967
acaaaataggtggtttaattgaaaattgtataaaagggcaagaaatgtgtcagggaacccaggacaggcccagggcactggtgggaggggctaggcatgatgaactggtgccatagaaggcacccctctgtgtccgtccatcctacatcgagactgtctgacatcctcacacacatgcagactagaggaaggctaggtgcactctggaagctcctagtgctcagttataatgggaggctaggcgcacgcagctgctcaggcccgaggtcgagcaggcgcacagtgatgtggttggtgcgtgggtgcaaatcccggacggcaaatacagcggaaggaaccatcagtgttgacacagcgcgcattgacgcagagtggggaggttgcctcagcctcgtcacactcgttgatgtcgacgcaggacatgcgggtgatgtccaggcggtagccgtcgaaacaatcacaggtgaagccttctggaacacgtacacagcggccgtgggcgcagccatccaggataccacact

SEQ ID NO: 1369 - DNA, 558 bp, Rattus norvegicus
  Genbank Accession No. AI178025
aaagaaaatactttattacatcatgaaaaaggtatccaacaactagattcatacttgcttgaatctataaaaaaaaacaaacaaacaaaaaactgaaagtttattcattagactgtatgtggggtcatgttccacatgggaacagagaggcacaagggcttctaagtattgcacagtcttgaaaaaaaaaaaaaggagttgggaggagaagatcacatgatactgggaacgtctcacattatgagaaactaccaagaaacattcgaaaagaaaaccctctgtttctacagtagctttagtctgcagttcttggaatgactattccattgaagacatcttagtaacaggaagcttcgtttgagcaatcccatgtgcaaatattaataggaaaatatataaaataatgcatctcttgccatcacccccggcaattcaggaccgtattttggagaactgttttgtttgacactcggttaagctgtgagtttggcctgaagctccatctctgctgcctgcttgagcgcaacgtccaccaggagctgaaatccactaaaatcc

SEQ ID NO: 1370 - DNA, 432 bp, Rattus norvegicus
  Genbank Accession No. AI178069
ccaaaaaattttattgggggaaaactacaaaacatttacagtacaatgtttacagtcacaatttgtagtgaactgattccccaaaatatattacaactcaagttgacttatctcgttacattcaaaaacctacttctgtcaaagtagtccagagtgcactcgtggtgctccaactgtacctacggcacaaactaagcggctgatcattcatttgtcatccggcaaagccgggagactttcctgcctctttacaatgaaaaataatagtacaagttctggactgtcattaagcaaggtatattcgtgtaccaccaacaattcagcgtgaagacctggcctcttcacatcatagctatggttaaaaaaaaaagtggtaaaattcttttcctcttgtgcaggctaacccatcccacattcaaattctcaagcact

SEQ ID NO: 1371 - DNA, 599 bp, Rattus norvegicus
  Genbank Accession No. AI178214
atcaactaacaacttcggtttttaataacagaaacaattttgccattccagacacaatttcaggggagaaaaaaaatctgccctataaaaataaaacttaaactcataaatatagctctgaactttagatctaaaacgcccctcggcagccgccttcgcctcacgccgttcctgtaccatcgtcacgttccgaagagaaatcaggatggcagcaaagcttcgctccctaaggatctgaaccaggggtttcttcttagatctttgcctctggagcctttttcttccttcaggctttaaacctgctgctgtagtgaccagtgtttgggagagaacatcagtcttcaggagccacgagctgacagagtgccatccagtgacctttccgagacacaaggtgtggggcacacgccatggagcgaggttcggatgaggacagaggagggtgctgcttcatacagtctacttcaagtaaaaaaaaaaaaaattcacagatacccatcagctgctactttatgggctaacagtgtcttaatcggagaaacgaatgctttgcagacgctaagcacgcttggaggagtaattaggggaccaggtggctg

SEQ ID NO: 1372 - DNA, 648 bp, Rattus norvegicus
  Genbank Accession No. AI178222
actgagaaaataatttatttgattgtaaaccagaatgtatattttagaaatgtctaaacatcacctttaataaaatcctaaatttactcattaggaatttaaattgtagatgcatttttatttagaaaaatcaattcgctccaaattccttctgtcttctcccctacactttcagaaccgattatttctttggttcaggaccattaaaccctcccactttagactggatctagcacaaggtgagagatagacaggcagaattcttaacagatgtgcaggctccacttccttttgcaacgcccattggttcgggaattctgtggggtttgttgccttgggatatgcgacttttttgtttttttaagtaagaggtggaaccatgtagacacgcacaagacccttttttattgaagccccacacactgttcaccaagacagtgcaatagctttttaaataaatggcttaaaggtagaaactgatgacctagacgggaagacaagcaaaatataaatatatgtgtacacagaaatacagatcgacttatttgcttaaatacccatatagagaaatggttctctgcttcccagatactgtgaccttacgatacgggttacccccaaccacagaatcatgttcgcctcgtgccg

SEQ ID NO: 1373 - DNA, 510 bp, Rattus norvegicus
  Genbank Accession No. AI178245
gttagggcggcggcgaggtgcactttataagttacaggccaggatcccgctcaggctaattatggctattggagggagagggtgctgggaccagcttttttttggggggcgggggggtcttcaaggctagtagtctagaaggagcagatgcccgatccagccgagctaaggaccaccacctttgagctccaacctgcctatggccctatagaatccaccagcagaaacagtggctacagcgagaggtcagcagtgaccggcagtgggggtccaggggggcgccggcgagcacttcggcgtcctgtgtctgcacggatgtagggctggttccgaagatctgtgatgatgtcttcaatggccccatctcggtcactctcatagatgagtgggtctttcagctgcttccgttttagctcagagatgaggtccatctgttgtcgcctggccttgggaggagacttgggtgctggaggctcttccctggctgaggtgtcccgagctgcttccttc

SEQ ID NO: 1374 - DNA, 532 bp, Rattus norvegicus
  Genbank Accession No. AI178272
ctgagcagtaggtacctgtgatctttaattaactctaaatagataacgtatctctataattataatatagaaatgataatgaacaaaaaatagatactcggggagtgaggcagggatttttctaaaatattgctgtgagcaaagtacgctcaaggttttcagcatgagcagtcgcgcagccagggagcttggtcagcacttggggactgaggtaaatatccggaggccgtgcatgcccttgatctcttctttcagtgcctgattgaccatctggtgctgctggaccatcctcttcgctttaaattcttctgactcgattttaatttcatacatcgccccgcagcctcctgagatgtctgtgacttggatagccgtggctcgaggaaacttttctttgagaacctgggtcactttgagctccccctccgtctgggaggcgaacatccgatgtgcacagtgccacagagggagcccgcggctcccgcggagcaaaggcatagcggccacggggccccatgccgcccctcgtgcc

SEQ ID NO: 1375 - DNA, 568 bp, Rattus norvegicus
  Genbank Accession No. AI178277
cacaaataatatttatttcaacgttcagtcaaggtacttaaccacatgagctaaaggcttacatacagcaaatggcatcccgggtgcacagcagtagcacctcagcacttacagaactgacccatggacagcactgtcacaccatccgacagcagcgagaacgcccatctgctgaggccaaataccactgtggtcggacagccggtgaggacgtactctggtaaagtgccccactgtgagagcatgccatagcgccatctgctctacagatgcagctgaccatgaatgctcatcgaagcctctgcacacctcacagcttcacacacacgacaccactcagctcacgtgactgaacacatcttaagagcttgctttcttcttagaacagttctgactttgggtaaagtacagtgtcccttatatacaaatatataataaaccctaactactagcttttcaaaatctctagttctagttccaacatgtcttcagagaggaaaacaagtcattcacccacctgcctttccaccacattaagatacaacgtgctttcaggtgaggagaagct

SEQ ID NO: 1376 - DNA, 600 bp, Rattus norvegicus
  Genbank Accession No. AI178283
gattcttaaaatttttcctaaattaatgattttattgattatcacttatcaggtatagaaaaggcttaaacatgtgcaacatgtgttctacttgatgagctgtttccttctgtgcaggagtcataagtaactgacactctgaaggccaagcgaagcttgcacttccaggactcaccctgcccgtccagggcacctctccccagtgtggtacatacagaagcacacggctcttccacaagctggcctactgccgctgcgcaaggagccagagagcacatttcactttattaaacattaacgcacaaatggatgtgccctgtaaaagggggctgaaggataccacaggagcagaaagggacacctacagacagaaccacacagcagagaccaacttcacagaaagggctcaatattgatttccagagaggaacagggcatggtcagctcaaatttggtaataacatcgggatgaaggacgcctagcttcccgatactttgacccccgacaaagatctcggcacaccgtccagggaagaatgcagaacctgcggaggctttgatacgtagcccccactttcctcaccgggaggcacatcgagc

SEQ ID NO: 1377 - DNA, 543 bp, Rattus norvegicus
  Genbank Accession No. AI178361
ttttttttttcacgcttgctgtactttattgcaccgttacctcactgcaaactactccacaaaaaggtcccaaggctagcctgctgtcctggcgccatgggctttgtgtagtgtcttgacacccactgtccagagctcagcacagggcaggcggtgcccaccaccaactagtaaggcctgactgctgtgtagcagccgacaatggatagctggtcattagcatccaaaacccactcttgggtgcccatctgctccgacacaggccgtgatgcccatcacagcctgccctctcgagagctctccggcctttgaaagaggccaggatcggggggagcagaaagtggattgtgattgagggccagagtgtgatcacatcacagagggtccttgaagtggcccggaggtgatctctggtctgctgggtggttcttcattgacaggagtgtgagccttttgttaaatacaaaatagtgagttaaaggtccctccctatgggaaggacggagcgctggccactctgctgcatgttctgaatgctggttt

SEQ ID NO: 1378 - DNA, 531 bp, Rattus norvegicus
  Genbank Accession No. AI178384
ctacttttaattctattttatttttttaatgtgcctgtggcgtgattgtatttatgtgttcacagtatgaaggtccaaagttgatgccaagtgcgttctcagtcattctccacttttaaactcttggacacacactctcccagcaatgactctccattttcatttactgaggcagggatgaactggagtcctcaactctgactaaagatccagccgagtttggggttggctttctgttttcctgtctacgttaagcagtgtgttggaatatacactgactaacatggaaagacctgggtttattctggcttagctacttgcttccagagagagcccatgaaaattggcctgtccaaaactccttttccctgcctctaagacaggcatgatactatctggcagcaggttattaccataggtaagtaaattacaatgggtaagtgcctggcacaggccagggtaagtagggcatgtatggaatgttaaacattacccttcatcctgaggtagtttacacaagcattcctggct

SEQ ID NO: 1379 - DNA, 360 bp, Rattus norvegicus
  Genbank Accession No. AI178394
gaggggcatgtcattattttaatgatgtaaatctttggggtctccctcattagcagtaaactgtcccctctcctcccaccacaatgtttctatgatgagtgacaaacaaaaaggaaatcacattttcatactaaaaacaaaatgatcaaagccttgatttctccactaaaaactacacgtacagttcaggattccacatgcaacacctcaagtcacagaccaagaccttacattctgacctggaatctcctccctccaaccttgggctggctttggcctatgcttaggtaatactgacacccataggtgctgcacggagggtcttgtggaaggggggagcttggtggacatgctgggggc

SEQ ID NO: 1380 - DNA, 552 bp, Rattus norvegicus
  Genbank Accession No. AI178527
aaagcattagtatctttattatggcataatgcagtactttatacagtaattcattttaatgtaaaaacattttatgtacaatttcagagaaacaactatatagacagctggaacataaaaacaggtaattcaaaagtccagagttacttgataaactggaaaatattttctctgtagaaaatagtaaaaatgataacatttcccactaagcccatttaagccaaataagagctgaattatacataaatattggatagattgtgtgacccaaaagaaacttctcttgctttatttgaaaagccatattttatttaaattgtgtcaattgaaattctttccttctttcccttcactgtttggttttccgcagatcattttttctatagggtaacccattaattcaaaattcaaaaggttttagttttaggctgtcctcttggaagtagagccagcatgtccttctaccatcttgaaatggcgaattcttacccaatagtgaaatgtttcattaaatcatgcccatatttattacaagccagagagtcgtcaaca

SEQ ID NO: 1381 - DNA, 513 bp, Rattus norvegicus
  Genbank Accession No. AI178688
  misc_feature (1)..(513): n = a or c or g or t
gcctgaggacggccatttatttccaagacatagactgtacttttacgacagggctttcagaagcagggatcttagttatagcctagagaggtgtcaagaacacagtggaggagccatgcagacgtgggggctttatccaacactgttacaacactttttaaaatgagcaaaacatctttaaaaatccttataaattctttatatgttacacattagagacaatatttacagtgaaagggaggggagagactttacagcaaatctttgcataaaccagaaagatggacagacctgggcagtagggcaggtcaccccactggggctcccctggaatgagtgagggcagaggggcgactagtgctttaggtttatttacactgtggggaaagaggagctgggtcccacccaccctgctggaacagcctggctaagaccctatccatcagtgccggacagacttcttcccgattgaaagtgagagccggcatgctaaactggcaagaagcanggtga

SEQ ID NO: 1382 - DNA, 421 bp, Rattus norvegicus
  Genbank Accession No. AI178738
tctgaaaaccggggtctccccgcatgagtttctttgtttggttttagggttgttttgttgctttcttttttgcatcaaacaggttcttccaagaaccattcccaaggaagacaaaaccagaaatcctcaatgaagtgaaacggaagaaacaaggttaaaaactcaccagacacaaaccacaccaaacactcatcccatttaatatcctgttacatgcaccgaggaaaccaagaacattaggtctcagggcaacaatgctctgagattctagcccaggtcccctttttgtgacacattatgcacacatacccacacacacattgacccaggcagaaatcacatgcatgcacaagtgggtagagaaccgctgggtgggatgggaggaagagctgggccaaggatatgccagcacctgcatact

SEQ ID NO: 1383 - DNA, 563 bp, Rattus norvegicus
  Genbank Accession No. AI178740
aggatcgctattttattgttgccctttccgttacatgaatgcacacatcaggtgttaaaggtacaatacattctacaactgagcaccactttctgtaactcaacaggcaaaggatcacactgaacatcagcatctggcagtatttttgggaaaaaaaaagtgactaaaatgggtttaaattgattaacactattaaatcacatctaatatttgatactacatgattcaatacagctatacgatacaattatacaaaatgtgttaacatcaaagaatacaaccaaaattaagatagcaaacaaaacctatataacttttttttgtacaggaaaaatacttttgaagtatgcatgtaactgcccattcttttaaagaaaatctaccgcaagcaagtcgtcaccctccagaaagtcacacagcattactaagcatatccccaaaaagtgtacaatatgcacacttggaaaatacaaaattaaaaaaattgtaagcaacaggtgagcttcgtatttataagaatgtgaaaagaagtcccatttttagcactgttgtataaagaattg

SEQ ID NO: 1384 - DNA, 542 bp, Rattus norvegicus
  Genbank Accession No. AI178746
aaaaatagagtgtctttattggtacctgtcagctcaggtacaatgtgttctcacaagcacacaggctggcaaggcctcctgggcaaggaggcaggcccagagcctgcgtttcttggcacacacacacacagagaaatgaataaattatagttctgacacttagagacaatataaaaatgcatataaaatccaacatcagctaatgaagggcataaaagcccccaagagccacctctttcttgccaactggccggggggtgtgtggtgggtcaggatggattcagtgcccagaaaggctagagacagtgatctggggtgtgcttcatgtcttagggcctctggctccccatcctacatagggcctttataacccatggccttggggagagggaaatggacagagggcatgttagagcgtctgggcagggggcagagggagttttgatcaccgatggtcaagcacagcctccgtctgctcagctcgaacctacacgccacaccgaagcccagaccggcgggggacaccgaagactttgcctcaa

SEQ ID NO: 1385 - DNA, 529 bp, Rattus norvegicus
  Genbank Accession No. AI178751
ggacttcgttctttttaattcaggaaaagaaacagagggaaaaattgaatgtttaaataactgtagaagaaaaaggatgtgggtgctgggacctaccttttctagaatggtgactcatggtttaagcaaaacaaaaggaggaaaaataaattcttcttctcaatactgtttgtcgtaatcgcagtactttcccacttctcatcacagcagcttcttgggagagcggagacaggcaagaacggccactggtacagtgactgcacgatgattagagccctgagaggttccgctacagcccttctcggtatactccctttttctctacccctgcttttgaaacttggaaggaacaaattcaagcaaagttcttcatatattagtttttaggggtacttgcctcataccaaactttaacacactccttacgtgtgactgtcccccaaccaggaagctgcttgttaatgtcaactcattaagaatgggaaattattatgtggacactgaagggaagtgttttctgcctcgtgcc

SEQ ID NO: 1386 - DNA, 621 bp, Rattus norvegicus
  Genbank Accession No. AI178816
agttaccagtgtgaaaaggatgaactcataataataaccacttacagagcattcttctctcaccagcggtctccactctgccacccacagttcagcttaccctttggtctgtgacagccacacctcatttcactagatccaaacaatacacagttatgtagtgcagacaaaatgtcttcatgtttgctttaaatgatacaaggaatagatcaaggtttcaagtttacagagaaccatactgcaacaactgaccaatataaatagttcttaatacttgtttattatgttttattcagatagtaacactaatgttcctaatgcacattcccctaaccttccttattctaattttctggccattaagtaaaaacatcttaaactcaacactcagtttatagccactgttcctatcaaatggtgatacaccaaaatcccaattctcatgaattttaacatattctaagtacattattaacctaagactgaaaaactgtgtcttaactttatcaaaaaagatagccacatcagtttaattacatgtgatactacctattcaatttattaaaaattgtaataaacataataataaactagtgctccaaacttaggctgtgcatgggg

SEQ ID NO: 1387 - DNA, 688 bp, Rattus norvegicus
  Genbank Accession No. AI178914
agcaatcaaaagggtttaaatatgaatgcaattcctaagaatggcaacaacaaaaatagatccattttcttttctcagtaaaaataggccagtcactagaaggtatcacaatgtgaagacattattttgaagccctagtcaaagaagcaagcctgtggaactggccactgggtttctacttcgtgcctggagaaccttaggaaaagcagtcctggcgtaacaggatgacgtttgtagagcgtaatactggagtgagagaaccgaggtcgatggctgcaatcacgttcctatgtatttcctgttacatcgtgattattcatacagtccgttggtccaatagcataaaaagagagaacagcatctcgaaattcatctcattccatgttcagagacaagaggcgtaaccattctccccgttattttctggaggcaagtcctgtgtgcagtctgatggcaatcacgtgctggtagtttccaaagctactgtatgaagaggatgctgaaggccatcactatacagcatatggcgacataaggactcttacgttcgccaattggggcacacttccaaaatattccaaatagtccagttttatttctgtccaagacgctgggtgccaaggatcggacataagcacacgtacatataagcagcaagtttacagtcaatagactctgttaaattgaa

SEQ ID NO: 1388 - DNA, 570 bp, Rattus norvegicus
  Genbank Accession No. AI178968
  misc_feature (1)..(570): n = a or c or g or t
aaactgcacagcgacatttattgttccagcctngaaaaaacatccctttgaaatttcacacagcaaagcaagttaaaaacttcactcatcaaataaatgataatttaaacaagaacttgctaaagaaacctcatcacaacaatgctttagggcctgatcacttaagtccacagggccattatgaatttaaatctgcaagccgttttcctacaacaagagggaggaacatgtttccttgactcaggtgacacagaaaagaaatcatgatttttttcttttgctgtaacaggcagacattgatttcttgttgtgatcaggaaagatggaatgactgttggccttctcttgctgctatcaacagtttgtcacgcattatctcaatgctcgagtagtccggtaacttaagatagttcacacaagtcattacagatggtaagaagtcatctgggttttctgttgattcaaatgtcttccgcacaatcgtcagaggtggatttaaactccgaaatcctccgactggcaatcgtgggctaccagtcacaaactggagaaacaacctctcctcgtgcc

SEQ ID NO: 1389 - DNA, 539 bp, Rattus norvegicus
  Genbank Accession No. AI178971
tttttttttttcctacttttgctttattcaaagacaggtgcaagggagtgaagaagggcctggtcagaaggcaagaccgacaggaagtggcttaacggtacttggaagtcaacacagtgctcacagaggcaaagaatttgtccagagaggcgtgcatggcgggtgtgaaatccccagggtggtggctagccaaggtcaccagcaggcagtggctcaggaacttgaagttgacaggatccacacgcagtttgtgggcatgcaggtcgctcagagtggacagggcaccaggcaggtcatcgaggtggcttgcagcattggtcagggcatcagcaaccttcttgccgtgagccttgacctggtcggagccctcacttgtattaaagtgagggaagtaggtcttggaggaggggaagacaatgaacaacctccctatggtctctgcgccaatttcagcagcatggttaccaatcttcacccaggctttcttgatgttgtttttgtcttcttcagagagcaccatgattgcttcccctcgtgcc

SEQ ID NO: 1390 - DNA, 465 bp, Rattus norvegicus
  Genbank Accession No. AI179147
cttggaaaggcacagttttattgtggcgtatcagggagggtctcagatcctccccacctccttcagcttggccaccaggtcttccgtggtctctacctttactcctgctaagcgctgagggggctcctccacactgatcacggagaccttggaggtcaggtccacacccaggtctccagccttgatcacttcaatcttcttcttcttggctttcatgatgttgggcagtgtggcatagcgaggctcattgagtcttaagtcagcagtcaccacagctggcagtttcaggcgaatcgtctccagacccccgtcaatttcccgttccacttttaccttgtccccctccagtgtcacctgagaggcgaatgtaccctgcggccagtccagaagtccggctgtcatctgacctgtctggttacagtcatcatcaatagcctgcttgcccaggaacaaaagcctcgtgcc

SEQ ID NO: 1391 - DNA, 261 bp, Rattus norvegicus
  Genbank Accession No. AI179167
tcggtgctcgtgtaaggtttttcttttcccctcaaattttatttcaataaaaggagacttgggcgaggtggattccccatagccggattctccccctccccccgagggtggctaatgctatctggggatgtcttcacagggaagagagaactatgggtgggctcctgcctgaggtctccaccctcagcccagcggacatatcacaggcagcttaaaaaaaaatcctaaaaaaaccaaaacacacatttaaatcctcgtgcc

SEQ ID NO: 1392 - DNA, 457 bp, Rattus norvegicus
  Genbank Accession No. AI179227
  misc_feature (1)..(457): n = a or c or g or t
aatgtttaaaaacatttaataagagtcagattcatgaggtaaaatacccactcatgagtgaagcaggaagatgctcatgaaggtgccagcagttatcccaatggaattcaggcttcatctggtcagcaagtccatgccagccctcctcccaacttctggcagtcgggttgaagttcagcctggtcactatctgcagagagtgcaggaacccaactcttcctacttgcctgctgagggacctggcagggcttgcctgaagaaggcacgaagtgccacaggctaacacaaaggaatgggacaagactcctccttcgctacccacttgttattcaggagaagagcaaagccattcactgctgctgcctttagggtgttccttattaagtagtgggtgcttctgttccccaaaaggtcacctagtcncctcatgactgataaaccagaatgtgagctttgc

SEQ ID NO: 1393 - DNA, 467 bp, Rattus norvegicus
  Genbank Accession No. AI179260
gaagcaaagacagcccacagggtgatatatgtatttctgtgtccattttacttttgctaagtaaagattatgatgtatcccttaacttttgcacaaatactgtttctatggaaataaaggagcaaaggaatttctaaatgctttatttgttggggacacaaacatttcttctcctctaagattcttcttgatagaaaacataagagcttggtaatgcatttgttaaagggacacgaagtgtctatgttggtacatagaggcaatactacactttcaaatacactggcaataaattaaggttgtagccgttgctgtattagagaaaatgaatgggttagtctcagcaacaaaaactagtctgaaaatagataagctagtgttatcaaagctggaaaaaatattaacttcagcccacactccactatacgtaagtgtgcgttgagtaatgtcagctatggaatgtcatg

SEQ ID NO: 1394 - DNA, 606 bp, Rattus norvegicus
  Genbank Accession No. AI179356
gaattttccatctgactttatttccaaatactttcttaaaaaaaaaaaagcaatacactttctgtgggaatgacaaatatcagaattaggaaatccaattatacaaaaaatactacatctagtctggggtagatatatttatttttgggaacatacattaagtggcactaattacacagtaactataaggtaactaacatgagaccacagaactgtaactctgccacagctgcgtggacttgggcctttctggctgatcaagtttccaaacactgggtgcccaccccagagctctgccaatggaatctgttaaggagtaaagctctgaagtagtgactcaccagagttcctcgcagctgacagaaaataggcaggacatgttagttataaagtagttacagcccaattcacaaaagttaccaactgtttctctttctagaaagaagcaggaagttaagaaattctttgaatgagcgcctggtgtcaagtggagtgcaaagagggcgttagagcagtgtcagaaggaccctggctggtcagacaggctggacatcattaataatcatgggtggcttctaaatactgggagcaagatgacttctgatt

SEQ ID NO: 1395 - DNA, 582 bp, Rattus norvegicus
  Genbank Accession No. AI179366
tttttttttttccttcacagaagaaattttaatccacttgagaaaaatacagaactacaagttaaaactgtaacatgtctaatcctcagtgacatactgataccattgtgtagcaccgtggtctgcctaaacacggcacacacatctctgagccaagcccacccctgccctcagcaggcagggacactatgacagtcatttgaccccatccaaccccaggagccctgtcactgcagatcccttgtcacattctacttacgattccacacagggttgtatgcttgtccccaaacttgagacagaatacagatcaacttatagacattctctgccaaaaaattatttcccatcggactctgagccctgcctgatggagttaatgacaacattcatgagaaatttcactgccacaatggccttgagcatctagataggaatcacattatcaagatgtttactgtaccaagatttatgggttcatttttggcctaaacctactaattctgaatgcgatttaaatttggtatttgcaccctgggtggctagtttagacaggaggcccatgtactatcccctcgtgcc

SEQ ID NO: 1396 - DNA, 508 bp, Rattus norvegicus
  Genbank Accession No. AI179380
actcagaacgagaaaatttattatcgccaatgctggtgcatcaagagtaacaagcaaatcaggagggagggggaagggaagaaagaggcagagagggagagagggagagaacatgagtatcaagcacccaggtggacttctgggtaggtttaaaatcttccaagtttgacagcataagagctcaaaaatcttttctagatacaggtagggtttccttttacttgacaacttttgcaaacacttcttacaatatgaacgtcagttatactcttaccatctgtcaaggtaaaaaacaaaaatgacaatcacaaaaaaaacccaaaaaaacagcaagcgaaatttccctagtataaaagggtattagaaactttgtctttgggctttcccatacattttatttaatgcacgaacttaaaaccttaaaaagacatccttttttttctttactttataagtcatcacaatagatcagggaccacagtagctttataaatcatgaagatgcatg

SEQ ID NO: 1397 - DNA, 622 bp, Rattus norvegicus
  Genbank Accession No. AI179388
cctggacactttagtctttaattaagcacataaaactgtactacttgatatatttctccatgaactttttgtgaaattcagatcgcagcgtatcgtttacaaatcttttgtctttcttttgatcatctataccctttgcacagttcttaaaaacaacatcatcgtcccaccttcttttaaccttgaagttggcctgaggctgggacgggcccgtgagattcaggagagggtttccactcagaatgttttccatgcgaattctctcttcctctgctttttgttcttgctcctttctggcctgctcttcagctctctccttcttgatcttttctagctctgcaagaagagctgcagtgtcatcgtcatcgctttcctcttcaaaatcctcatcttcctcatctgtgagaggatcgtcagcatcaaggttggcagcaggaatctggtctaagcggggcttcttggacaccgaagaggaagttgtgtgttctcgggttggacggtccctatttttctcccttgcagcagctctctccctctcttccaactctctcctgaagtcacggttgcgaagctcttcaggggcatcctgtgtggtttgtctgtactttatctttgtatgaga

SEQ ID NO: 1398 - DNA, 650 bp, Rattus norvegicus
  Genbank Accession No. AI179391
atggcagttgtttattgagtatatgctcattacagcatcactacacagattacatttctcatgtgatttttttttaattaaaaatatatccaaaagcaaaagagcagctgtacacagactttaaaaggtgaagaaagaaaagacagcatggacaggttcggcacattacacataagagtccaataccttaagcatttggaggtgaggggcaggacgcaatacatttgtgtaagactgtctcatggtttcctctgcatcatggagatgactgaactgcaaatgccgaagaacattaatgctgcactgaattcacactgcagtaatgacttttctatggaagctccttggaaagagtacattttgtcatagatcattttaaacatagttttatatcaatattcaaaggattttgtttacaaactctttgtgaacaaatggttacttttgttttaataccatggccaaataattaggcttcagtttttacatggggaaggtaaccttaccaaggggaagcacggagtcacaggaacacaagcaggttactaccttgactggcaacagtcagacaggacaacagagaaacaatcaatctgggcccgtaaaaatctggacaacgtgaaatcgaatgagggatgtaaagtcttgca

SEQ ID NO: 1399 - DNA, 589 bp, Rattus norvegicus
  Genbank Accession No. AI179399
  misc_feature (1)..(589): n = a or c or g or t
ttactttttgtaaaggtggtcattgtcgttgttttaatctaaactgccatattgaaaaaaattaagtcaattaaacttgagaattgtaagtaaaataaatattctgaaggataaggtggtcaggcacttcagatcatatgtacaaagctgatgcaggaccagccattacttcaagagtctcaggatgaacttcaaacagtcacagttcttgtgttggtcattgatggtagtctcgatacttctggacttctgttacatgaaacaaactggcccaatttcaaagccaaattcctggtctgcattgccaatatccacaggaccgatatctatgatgggcaagcgggccacattctgtgttctgtattcaaagacagtcttgcctacatttccatttcgctttgaacaggtatcttgaagaacggtgtatctgaatctgatgtttccttctccttttatttctaagtcatttgaccctttaagaaccacagctttcttgaggtttttagtttgatcatccatataaccaacagtgttccctcgtgccgaattcttggnctcgagggccaaattccctatagtgagtcgtatt

SEQ ID NO: 1400 - DNA, 668 bp, Rattus norvegicus
  Genbank Accession No. AI179422
ggttattgaatatgtattttttaactgaaaaaatcattcataaattaacatacagaaatgtacaaacacatgagtgaacaatgtaatgacaaggaccatttctgtgaaaagtgtttttaaaacatctttaggcttcagtgcaaaaatgtccccctggcacctttaaaacaaagagcaagctcagaacaaagacagtaatggtggctaagccagtggcgtcagtgcctcgtcgatggtatgcacagtcagtgtgtgctctgccgctctgaggaaggaactcgatgacaggagtccccattttagcaaaattaaagttttgcaaatcccccctccccaaagaaagcctgtgcggacagagaccttgcacacacagggcagtcagtcaagggcaggtcggcttaagggtcactcgtctgtagcatggagtaatttcagctgccaaagtacaccaaggtcacacttgattctcaatgtcattttctttaagcaatgacctaatgtgtggtccagtggtgtggctctgactgtgacatttcccactcggtatgtgactgggcggacaatgactgacagtgcccacaagagtccacactaataacaaacttggacatgattgcaagggaacataagtgacccgacttgagcagtaaaaagactttctttgtccc

SEQ ID NO: 1401 - DNA, 567 bp, Rattus norvegicus
  Genbank Accession No. AI179464
aaagaattaacttttatttttgcttagttttattaaaaaaataaatatgtcataaagcttttgtttcctttagggagaaaaaaaggaacaagttccataaaatcaaacaagcaatggtaacatgtctaacttgaaaacgattggggatcactggtttacaagttataactgaatgaatgattgctacagttgcccatttcctcctgccaatggcagcaaacaacaggatcaactggagcaaaataaataactgtgtggaagccctgataagtgcttaaacagaccgattcactgagacatctgtacagctatatcttgctttaaataacaaagaagttcctgtaaagtttgggtaaatgagataaccacaaacatacaaggagagcttggtatctgaaggacttctgtggtttattttatcaacaaccacttttcactttactcaggcttttgctttgcttagaagtacttactactgctctgaattgaggcaacagaacattcacccaacagtgcttttgctgggccagtggcacaatttccaagtctgtgtttctattaaagtaa

SEQ ID NO: 1402 - DNA, 613 bp, Rattus norvegicus
  Genbank Accession No. AI179610
attagataatgccatttattatttcacacagaagttagagaccaaggttacaattattaaataccacccacccctcaaaagacagccctacttggttagaataaaaaaacaatcgatacaacaaaaaataccattacactggtagaactggggaaataacaaaaacaagacagaaacacaagacagaaaatctctgcacactgatatcaaagtggccatgacgctgggggaaagcagtcatggtcagtcaacatggacgccgactaccaagggcactgggctcagaacagccgcctctaccgaccacagttctggggctctgttgcaggatttggggctgctggtttccaagttcaggcccctggctgtgcttttggtgagggaaatgtgccaggcatctccttccattccagagagacaaaggaagacacaggaagggggcgaggaaccccaaaagctttcttagaggcccaagaaaagagagccaggcaagattctcccctgcagagagaaggctacatgagacagagttcacagcctctgggggccaacactgcatttacatggcataaattcccactgccacggtcgccaacaggaaactgagtgttga

SEQ ID NO: 1403 - DNA, 310 bp, Rattus norvegicus
  Genbank Accession No. AI179700
agcagggatagcaccgtttattaagaaaaaaaatcagataaagaccacagggggttcccccaggacccaagagccagagtctgggcctgctgaccccttacttgggctcctcaggctcccagatgggcagggctatcatcattcttcctcaccttcccaagctgacatctcagctgtccccaggagccttctgaggaaacctcttccagtccccttgtcctgcccaccagcctcggggctctgcccacgcgtgtgtggggtgggggtgggggaatgcaggtggaggagggctgggtgtgaggggagactg

SEQ ID NO: 1404 - DNA, 390 bp, Rattus norvegicus
  Genbank Accession No. AI179854
gatagtgaaaatatatttatttttttaatacaatagctgccagcaatatactggtgttgatgttccagagagaagaaaatgcaagcattttgtaaagagctttcattcctacccaaggaatcccatgaaatgctccaaggctgtccagcattaccgcctgggagtccaacttttatggcttgggactcaactttttttccttgataaaataatttgtttcccccactttgatcattacaacaatgaacttttcaaaagtctgggagttttgctaacaaatgcaacacagaggttctggaagtataactgcctagattctagagccggtccgcctgtgcacaaaccagtcagaacctctcaacagtataaactgctcatgagcctcgtgcc

SEQ ID NO: 1405 - DNA, 520 bp, Rattus norvegicus
  Genbank Accession No. AI179916
ggtgttgtaaaatcaaagcactactttattaaatgagttattttacacaatatgaacatcaatataattacaattgtaaaaaaattttataacaagaatggactgatttttcagatttccacatcagagtcaactgtacatttacacagaattgtctttgcatgaagcccaaagggaacagcataaaaatgagtgtttctgtagcccctttattttttgctgatcaacagtttgtttaaaaaagcagctgcaggtttgttacctaatgtctgagacagtagaagagtccaaggtgtcatgaattcacctgtaaacaactttatgcctgaacatcagccaattctggaggaagtggagtcttagggtgcttgctctcaaagtgctgcttgaaggtcttggggtcaggcatttgtgtcctacagactgtgcaggtatatattaaggcagctttggcagcagccttttggtcatgtccttgtttcttcttttgtccagcctgctttttggcatttttctgctg

SEQ ID NO: 1406 - DNA, 284 bp, Rattus norvegicus
  Genbank Accession No. AI179971
gcttcctactcaggctttattcaaagacccaaaggtttaggtgcaagggagggaaaaagggcccggtcaaaaggcaagcccggcaggaggcggtttaacgggacttggagggcaacacagtgctcacagaggcaaggaatttgtccaaaaaggcgtgcctggcgggtgtgaaatctccagggggggggcaaacccagggcaccaacaggcattggctcaggaacttgaaatttaccggatccccaccccgcttgggggcatgcaagacgatcaaaagggaccgg

SEQ ID NO: 1407 - DNA, 546 bp, Rattus norvegicus
  Genbank Accession No. AI179984
aaggaaaagctcttttattgcagaggctacattgaagctatcggccaccttcctggaatgtgtaatcagtcctccctccctctggggttttctgtagcgcactgggacattaagtgctgctggggtccaggattctgcctatgaagaggagggcccccgtgtccgtgtccctcagaacaaagatgaacggtcggttaaggtgatagtcgagcgggaaggtgaggcggacaggctggaggtctgggttagagctggtccctgccccctcctcattccactcaaaagctgccctgtgttccacttgggtgagcttcacaggtttgccggtaatcttgctgaagtcaggggactcaaacaaggactgtagcttcatgtcctgcaaagagttggtaacgtcgccttcatagctcagcttcagcttggggacagtcagcacagcttggatagtcttcagttctcggccaatgtcatgaacgaactcagaggtgaggctctcctctatcatggtcaagttctgggtcaccgtcaggggcaggaagaagatcc

SEQ ID NO: 1408 - DNA, 667 bp, Rattus norvegicus
  Genbank Accession No. AI179988
gaagagaaaatctctaataatttattgaccttcagtttcacatcgtgaaaaaaaataacagttttacaaaacctcaaaaatgtagtggaagcaaacaacatacgaacacgaccgtcttctaacttctacagggtttggtatgtgaaccacatattcaatagccaagagagggatattatgcggctctaatcactcttattcagacaggtgtcaagcctgagaaaagaggctccaccattatgccagaagtggaaggctgccctttgttatccgtttccagggcaaccggctcacaaaataagaagaacctcccctgtcttatgccagggtttttgtgtgtactgtgctgtgaattgtatttgcttcaaagtgtgggacatttcacagggcgagaatggtcaagtagcaggcccgaatgcctagatcaattgaatgagcggggagtctagaaagttcccctgccggctgggggcccacccttgctgggcagctccctctggctcacacagtaattaacagaggattcaaggccgggccacaactttgaaacagctgcagagaattctccctgctctcagcagcagtgacgtgaagatcttgagacagatttgcattgtaaactgtggagctgagacagctacgagacaactgatcataccaccagggt

SEQ ID NO: 1409 - DNA, 551 bp, Rattus norvegicus
  Genbank Accession No. AI180081
tgtgttttttttttttttttttaattattatttttttttattgaaaaagatgtccttactgcacaagtgactacaggctacaggcaaggatgggagacataggcttcaacacaagtcattgcacttagaaccgtcgttactaaccgaaacaccatctgcttgttaacaatgtacccttaacagcagggagaaacttcttcatagtctctgcttcagacaagatttacatctttctccaaggccagaggccagtcatgaccacaagtctcatttcttgctgaccagacccattcctctggcaccttgtacccctcttccccagcaatatgctcggccttgattccagaggcagctggaaggaagcagctatgggcccattaagttcagtttgcccatatccagaagccctaggaaagtcctgtctgagtcttgactcctgacccttgcaatggctggagtcggtactggtgtacacccccactcccacgatgtgggtagtgctgtgaactggaaaccgcagataccctggaggcctggtaggcagctgactg

SEQ ID NO: 1410 - DNA, 403 bp, Rattus norvegicus
  Genbank Accession No. AI180087
acatggatttctgagaatttaataatcaatacacttaaagaagtgtttttttttttttacactgttgcgtttctttaaaagttccaggacatactaacatttcttcagaggcatgttcataccaacttgcacatgaaaattaccttccatgtcttctgaaactttgacaatgttcttcaatacattggtcttcccaattgtaacctatagcagtgaggttcctgtaggtctcctgcatcacatctttgtagagactcttctgtgaaggatccagcaaagcccattcttctcgagtgaagttcacatgtacatcatcataggtcaatgcatccatgtcgcaacttcggagcttgcctgaacatgcctcacagaatcctaacacaggacacagaaccctcgtgcc

SEQ ID NO: 1411 - DNA, 368 bp, Rattus norvegicus
  Genbank Accession No. AI180239
gacttagcagaggctctttattaggtgggacagttgaatgaagccagtgggggaggggatctgtgatagccgctgtaggaactggcaaggcctggagtccacctgacatggcaggaggcactggacctgcaggtagcacgcagcctctgggccggctgggaactgccacagccaggacagataggggctccagcatcactagagcagagccgggagaggccctcagaacccaaattctctgcaaacctgggtagacacccattagacactgagggttaaagagatctgactgagaagagagggacagtccctgtagtgtttcacagcactgctataaaacccaaggatgccacaggctgcctcgtgcc

SEQ ID NO: 1412 - DNA, 567 bp, Rattus norvegicus
  Genbank Accession No. AI180252
aatggtcttcaaagcctttattgggaaggtagatagcatctacagttgactgaggggcgcagggcaggggatgtaacagtccagaggggagaggagttcagaggagagcctgtcagggtgcaaggaggatcctctcctcccaaaaggcactggtgggcgatcaccctcgatcaagacgtggggcctatacacagagggttgtcagcatacaggcgaccttgaagctcaatacagccagccaaaggtgaacagcatctctcttgaggccatacctgctcagggctcctccatctatgaaggaaaggccccagagggcaggtagagcttaggaagaacagcccagccttctatcttagtgttttgtgcaattaaaactatcaataaaaacctaaataaatataacttaaacactttttaaagagcactaacgtctagcctggggaaagcagttgaagcatccttcagcgtgtgcaaagcagagctgacctccaaggcacctggtggcccaagagcatgagggccccatggaccctgcacataggcacatgtagcctgtcccatgtccca

SEQ ID NO: 1413 - DNA, 523 bp, Rattus norvegicus
  Genbank Accession No. AI180281
aaagggcatatgccactttattacaggttacttaaaaatcaagtcagaggaagctacatagggggtttgtactttaagcattaacattagacacaaaaactaaactggccattaaaagggggcacagtgaatgataagatctttcagttggcttcacctaagttctccatcacccaggagccgtaggccccggtagcctgccacctttcactcactgaggacagtccccctctaaacataatggctttatttgttgaaaataactatcagttgtactaatcccttttaataaagaaaacacagaaggttatcaggcaggaatgatggactgcaggtgcaatgctggcggcaagagcaagtggagtgcagcatgactccacagctccctggcaaaggccaggccgagggaaagcagcggaagcccagccacagctgcttggatctgtgctcaggggtcagcatgtgcacactcagactctcttctcatgcactttcctactgcctaaaaaggcctcacagtccc

SEQ ID NO: 1414 - DNA, 553 bp, Rattus norvegicus
  Genbank Accession No. AI180334
aaaacaagtaaacagtttattaagagttaagtgaggcatggaatgtgatacaaggagacactccgatgggcagatcaccacacacacacaaactaaatttcacttcaaaaaaaaaaatcacaaggcaaaagaaaaagcaatttcatcattataaagtaaggtatttcatgcaaagcactaaaccacacccccaaactcccagctcccaataaacattgccatgccagcgtattgaccacagtggaaacacgtaagcaatggggttaggaggtaacacagctcataaccagaccatgattttacatgaaaaacaattccagatccatacacagagtaacataggccaaccttagaagtacgtaaatataaaccccatcaattaatttcattatcttttaactataaaacccagaagcttacagaacctgaaaattttatataaaatttggcatactccttttatattcaagaaatggttttaggatgtttgtagttagcagagagctgtataaaagcatttccaggttaggatttgacctcttaacccttgacc

SEQ ID NO: 1415 - DNA, 588 bp, Rattus norvegicus
  Genbank Accession No. AI180353
ccttccttcttttcttttccttcttttgagactgaagcttggtctagtgtccagagtgaaaatcttgtggcaatcctcctgcctgagtgcggggattacaggcatgagccatcatgcctggcccagagtcgtctttactgcacagagagctgattatttaggagtccactgaagtgttcgaacttctgttctgtctcctcactgaaggctccacctacgtgacaattgtacatccagatgcggtagccatcatagcggctcctgcacttcatgatgttgttagagaaatctgattctggcacctcatagttggggttaatgacaacctgaaacaggtagtctccagggggcacatcggtgatgtctatccactggcagtcaatgtcatgacgatacatgtcccagcagcccatggtgatgccttgttctccgaagttggcacactcgtaactcttctgaatgtctccctcacactcagtgtcctccaagcagaagctggccttgtggccctcagccaccttggtgccgttgacctcgtgccgaattcttggcctcgagggccaaattccctatagtgagtcggattaa

SEQ ID NO: 1416 - DNA, 530 bp, Rattus norvegicus
  Genbank Accession No. AI180414
aaactctgatgtccccttttctttacagaatatttacaaacagggacaggtatcagccaccaaatgggcctgaaagcgggggcagtgcttagatgcgcctcagcgcagggaagacgtcctgaggaaggtcactagtatgacccagctgctctgaggggccaggcagtcccaagcaggtccaggctggaactcaggcaaggtcagtagtgggtgaacccagctgcttagaggccaggagcaggcgggtggcggcactctctgactccgccagcagcctctggttgttgtgtctgaggctccgaacctgttcctccagggctgtcctgtccgccttctccctctgcaggtcctactggagcttcctcaggatggactctaggtgagagaccttttctgacaggctcccaggttctggctcagaattacactttgaagtttccttggggtctccactctctaagatgggctgtccctaccgggacagtgactccagaattgtgttgcaagtggaggcgatctctgagatggac

SEQ ID NO: 1417 - DNA, 905 bp, Rattus norvegicus
  Genbank Accession No. AI227612
  misc_feature (1)..(905): n = a or c or g or t
cgggaatcgtaccccttgnnnnnatttgaactcttttaaccctcactaaagggaataagcttgcggccgcttccatttttttttttttttttttttttttagatgtaaaatactttatttgtaaatggtgatcttctaaatctgtgtccacaaattccaaaacccataacactctgtatacttcaaaaaattcaatttttgccaacattagatactattttacagaacagaaaacaacaaaactcggcaggacaaatactggtaggatgtcagagtattgtacaagagaagaaaaatattcaagaaacaaatttcatacagctatttatcaagagaaaaatatatacaattgatttattctgtaagataaaaatacatcatgccatatacattacaagctgagagctgagccactgatgtgtacccgaagctcacagtccactcgaattgtgcacacaaactccattttatacttagcctgtgaagtgtcagtaccagaattttaagtacaaaataaaaagctaacctggttcaaatgctgattaagtttctacaagcaaacacaaaacagtgtgttttttattaaagaaatgtaaacaaacaagttcatacaaacacattttaaaattacatcttcgaaaaaccccattgccagattcctgcagcttgaacgtaatcacatttaactctctccatctttctttttttaattttcaaattttttgttaaataaaagcctacgattggttagccctgctcatgacttttgttacatgattctgtgagtggaaacaattttatcaaactcttttgtgaaaaaaatcacctccttggttggttaaacgtatccagttccaattttacccaaaactcctgaaatggttcccattaagggcttgttttta

SEQ ID NO: 1418 - DNA, 483 bp, Rattus norvegicus
  Genbank Accession No. AI227639
actgaagaggcattttattgtccatgttgactgtcttacaactgaaacacttacaaggagaatcacacacatccacaaaaggacagactcagagaggcacaagggggcacctgtcacccatagaaaatcagtccgtagtagcgacactgactccttctgtctggctataaaaacagggtgggttgatataatccggcatgtttctgtgaggttagggctgtatctttaaaaaaaaaagaaaaggaaaacaaaaaaaaaaaaagaagggaaaggggggaaattttatgtacagacgttgttccgtagcatttcccatggccacacatgttagcagggtgcaaagccgcttctccacattcggcgctctccctggctgtccctctgcgtcctcctgcacgtggatctgtggctgatacggcacaagtgtgctaacagctcttggcggttgctgtcagtgctcggaccggtaggttgggaaagtct

SEQ ID NO: 1419 - DNA, 499 bp, Rattus norvegicus
  Genbank Accession No. AI227715
aaaaggcaaattactgtatttttatggcaggaagaagaaaaagtgttcaaacggtttctgacgaagtcaggtatttaaatggtgaatgacgatgtgttagtggagatgaaatgaaccaataaatgattgattgtcatttatgcaggaaaataatgctccttttcaatataactaaacagagactaatttataagtgctttattgaaaaatacacatattttcatataaaattacagtagcggtacgaagaggtttctacgtactttgcacagcactctggtggccagtgccaggctgtaggttgtcagctgggtctttggagcggtatgaagtcacctagtaactttgtttacagtgatccaatttaaattgaattttctccttaggattattaatccaacttaaaaaattacttgataataatgattaataaagatatgtgtagataatcaatagctattaaatcttctaatttgtgtcaatggtaccatgtactaat

SEQ ID NO: 1420 - DNA, 548 bp, Rattus norvegicus
  Genbank Accession No. AI227724
cacctcctgacaagacaaggtactttatctatggatatatacacattttttttttttcttcgcaggaaacggcactgtctgagagatcttcgacctcacacctttctcagccttaattttaaaacctgacctgacaggacacaaagttgtgtaactaacatacaaaatacagcatcactgggagctgctggcaaaaaatggatgtggaaccccgagaaagaacagactgcaggtttaatctctatagaaagctacatgaaaactgagtacagcctaggcagccgacggtccaggtcctcacatattccccatggggatacatgcctgctgtctgagcctctagaatcctagcagttaaatgtccaactcatccctcccaagggatatttatcctgaatgatgtgacgatccaaggcctaaccagggctcttctccctggctgaccctaacccttcttgcaagggtggctgtgagccaaacttcttccccaggcagggtctctttccttcctcatgaacacatgcatcatctaggagtgaggatgggac

SEQ ID NO: 1421 - DNA, 481 bp, Rattus norvegicus
  Genbank Accession No. AI227751
caaaagaaagataccaagaagcagaagaatgaagcagttaaaatcagcaaagctgcaaagtaggaaaggagctaaaagggagacagatctgattgggtgacaaaatcattttagtgcaaaccccaggatccaaggctaaaagcctaagtcacaagttcaactccagcagcttgctgacccatcagcaacagggctcagccctttctgctgaatcctagctttgcacattctggacagatcatgcacatacatgttatattccagggttacatgagattgcatgcaattcacacataacatcattggaaggcactgtattgtgtagcagaaaccgctacgttctggcaagtcttcctagggtggatcacaagtggtcctccacgtgaaatcattagaaactttggtgccaagctctggcgctacctgatcctactaagccacccatcttgccttctcgccctctcttctgtttccccctctt

SEQ ID NO: 1422 - DNA, 397 bp, Rattus norvegicus
  Genbank Accession No. AI227763
ttaatatctgaatcttccattttattgttattttatatctgatttggattctgtttcactcttcttagggccgggttaaacggcagggccgggttaaacgacagatgaaacagcccgcagcttctcatttgacagtaactcgatgcaattcactttgtggaacgaagccacaaagtgaaaagcatcgaattgccgagaaaagtgttatcacatccctacccaacattgggccctccatgcacttgtgggaaggtagcccaaggtacaactatttagcttcccgatttgcttcaaggctctatagctctagattttggtggtagcaagtttattgggtggagggattgaggggagagaaggcagatcctgaggttcaacacatgaactgcgttgagaa

SEQ ID NO: 1423 - DNA, 613 bp, Rattus norvegicus
  Genbank Accession No. AI227887
aaacaaggaaacaaaactagcactcatcgctttttagacaatacataattattcaaaattaactattaccggaagggcaagggggccatactaatgggccttgtctcacatgagtgcatgtgggtaggtgcaggtcgtctgtcattattgcagaaacgaattttaatttttaatctttagtttgatttaaacattgcttttagtatgatgacaacaccagctgtgcagaaagggctctggagatgcgttcatagcagcacacacctgcggctcttcttcggttctggaggctccaaggcagccaatattgcttcatcaaacacattctttaggcctttctgaaaaggggtagaaagaagaaatgggcaatctgactttcagtatctcaacagaactggagttcatgtttaaaacagtcaaaccccaaagacagtgagcaaacaaagaaacattaatgaccctgaaaccatcctaataaacttgcttcactcagttgtcttgccagggcacaggagagattcagcaatgctggcacagatgagcagatattcgttaagtggtcctctgagatactttttgcaaaccaatatatgtcacaagaagcaaacaacct

SEQ ID NO: 1424 - DNA, 263 bp, Rattus norvegicus
  Genbank Accession No. AI227961
agggcaggccaaaccctaatttatttcaggggctgcaacagcttacccatcaaaaaaataaacttttcccagggcgacagaagtttttacagcgaggctaagggctcaaccgccaggcgggaaacattaaggatgcctggggggccctgcccgggtaataaattaggaagcggcaccctggggggggctagggccaaactttacttttgggcaggcatgaggtccttaatgggctgaccctgctcaagccgttgttccattta

SEQ ID NO: 1425 - DNA, 510 bp, Rattus norvegicus
  Genbank Accession No. AI228147
ggccgctagagtttttttttttttttttttttttttctaaaataaagtcttttatttttatcaaatgagatagcagctaacagtttaagaaaggctgggtatatgtgcaatttagacagtatttggctaaggtaaaaagttagcattttagtcctttgtaaagtgctgagaagttgttcctggtgaatatctgcattaggtttaaaaaaaatttttttttaaccatccagtgagacgctgatgtataaatacaggcggagaaagggagtctatgggctactcatgccccttgacatccgcggctgcttctcaagtgtcccacatgaccctgtgcattctttgggaaggggggtggcactgggacagcaggcagtgggggtagcggctgactgatcagcaccacgaaccactcagaaggagtgtccaactgcgatggcttcctgacagcaggtgcccagaagacccaagactcgactagcaccatccctgcacgactgggccagcacctgt

SEQ ID NO: 1426 - DNA, 513 bp, Rattus norvegicus
  Genbank Accession No. AI228284
ggctgccatcggtggcatttattttggaggtaattagcactaccgacatctcccttcggttttttaaaaataaacatcttacaagcatcttacaggccagagagtaaccaagaatctggttcacacacttacaatatccgggggaagcttggaggtggcacagagcggactctttggccatctggtgagccaccgagaccatcagagctgttgtgctaagtagatggcatcatcgtgtgcacgaaaaattcttctgcccatcaaaagggacggtactgtaataagaagcatctagaacattctggacccaggagccagccaggtcagcacaaggctgccgagcgtaacacaatctcatgatgagctcagacaggaagccaaatacagtgtgacccgtgtcgggccagcggcttccatccaccccaggtgctgtacacatacccgtggaatacaagggcaggacagggcagaacttgaggacagacaagccacccgcagccataactacacact

SEQ ID NO: 1427 - DNA, 461 bp, Rattus norvegicus
  Genbank Accession No. AI228291
acagagctttaaaaatatatatttattgagtgtctagcacaataaaagccacggtaccaggcaggagcaagctggagataggaggtgaccagggcacacagctcctgccctccatgagtgagcatccccagtgagggataaaaaggaagtatccaatactgagtcaaatgcatacgatgttattggttgagcgacagcactaggaccaactgactaaaccagaactgaaggaccgggaccgggctcagggggtaaccagcagactcccacattactccgagaactagcctaggatctaccaagaaaggactgggagcagggttccgtggtggcacttagcttatacaaggccctgggttccgtccacaacaccacaaggaaaacaaacaagcaagctacttgttggatttgaattcactgttaatgttgtcttttcacacaaatgaattatagatagattg

SEQ ID NO: 1428 - DNA, 505 bp, Rattus norvegicus
  Genbank Accession No. AI228299
cctttcaccaacctcacagagggcttctatttgtttatttaaaaacaaattttaaaaagtaaaatgaaaccaggtgagattaagatacattaaccaaactgcaacgtagaaaaagggacttgctggaaacatgacggagaccactggagatttcacagacacacagaagagctcacattgtcaacagaattaagctgctacgaattctccccagaacatcaaggtttcattttgctcagcctgagatctcgctcaatttcaaactgcctgtggtccacgcgctccagaaaagctttccgttcgatgtacccctctttccctcggttatggatggccagctcttcaccaatcccttcttcctccttgaagctctcccagtccaatttggatttctcaagggtgctcattttctgtttcttggctccaattttccctaaaaggctgctcatcccacttgttctttttatccctgacccagcagggggtggtcttgtcacttcagccg

SEQ ID NO: 1429 - DNA, 462 bp, Rattus norvegicus
  Genbank Accession No. AI228301
ccagatggacccgttttatttccaaacaagactgcaagcataaataaacttccccagtaccatactgggttttcattctataaaatgtatttaattcctaaaactcttcataaaatctgcctttccccttgcagcggaaaattggcaaaagtcaaaggttgaaaggtcatgcacaaaacattccattcggcatcattctgtaagtctgtgagtctgtgagtccttgcaaatggacaccaagaggattcctgcttcactgtactctgcagtacctcaagattttccttcagtattccacagtgtgacctttccataacacagggaagcgaggccaagctgtcgtagactgaaaagatctgctgttagcctgctgtggagcgtaacatatctctaagaataaagccctaaagagaaaggaaactcaagtttgccatcaaatgcagtgggtggctcctttgcccc

SEQ ID NO: 1430 - DNA, 432 bp, Rattus norvegicus
  Genbank Accession No. AI228335
atcagttctgctgtttatagatttcacgggaaggccgaatacattttaagggaatgaggaaaccgttcagtgtctagtaacatgaaacagtatcacattattccataggaaacgtgtatatttatgtagaacaggtcagtcctgagaaacggcgtcagctcagttcgtgtcccatccatcctcctctgagatcgctcttgctgcgtccataccagacatcccaggttggttagcagggcatacatctgaagctctcaccagacctccgcacctcatctacggctacatacagcagcctaaagaagcacggctttcaggtgtggtgtaaagactctgaggtaatagggaacgagttaatttgttcttggctgtagttggctcccaaagagtgcctgtgtttttcaaatgatgtcaactagaaaaagacaatgt

SEQ ID NO: 1431 - DNA, 450 bp, Rattus norvegicus
  Genbank Accession No. AI228438
aaaattaataaaaatattttattgaatttcaggaacttggtactttttaaaaattccaaatctttgcacacagatcagcactctgcttactctggaactgcagatgcttggacttcacgattgtcacttctctccttgtatcacacagcatagaaaacccaagtcctgatgctccccaaccccttctgaactactacagctactctgaccagcccctcagcagaggacagggaagtggggtggggtgtgtatggagaccagctgctgtctgaatacattctgcagtgtgggggaatagctataccaagttatgccacacacattctggaatgcaccgtacccaggacacaggtgagtttccctttgagtactgtgtggttcaagccaacactgctgaggttatctagtccctgagggagctcagaagtttggtaaaggtcaaagagagac

SEQ ID NO: 1432 - DNA, 162 bp, Rattus norvegicus
  Genbank Accession No. AI228462
ggtaccagtggaatgtaaacaaattttttgtaattatttattttttacaaaagatgtgttatcaaatatacatgcagaggtctgaattctagtgtctatcgttatagttccttaacagtgtggtacaatttgttaagtcggttaaaaactggagcctttggc

SEQ ID NO: 1433 - DNA, 574 bp, Rattus norvegicus
  Genbank Accession No. AI228548
gacagttcgtgagagagaagctttattaaaactagtggcagatctggactgctactgttgcgcctttggtgcatgttgagcctgggcaaggatgggtacatagggagatacaggtgggatgaggagcaaagagggagggcgctgcctactgagactgtgctcaactgttctcccagaagaagttgttacaagccactgtgagagcagccaccagcacaacaaactcctggaagtccacttccccatctccattctcatccagttccttcatgatcttgtccacagcatctgcatccttctggacatccaggaagctggagagttcagtttgtagcaggtctttcagctccttcttgctcagcttatatttgtccccttccttgcccgagtgggcatggaacacattgatgagggtctccatggcggtctccagctcagagcccatttcagcagcacacggttggcctcggcctgacgtcggagcaggttcttgacagaagggcgcgctgcaaatgttgccccggagcagtgtggggagacctgtctttactgccgaccctcctccccttgtgcc

SEQ ID NO: 1434 - DNA, 611 bp, Rattus norvegicus
  Genbank Accession No. AI228596
caaaaataaacaatttaactttattaagtcatgacttcagcccttacatggatttgttttttaaaaaaatatcagttcagactattattgaaagtgactatgcacaataaataggaatggcctgcgtgtgctgcagacatgggacacaaaaggttggatgcaatcagcaaagagtgcaaagcacctgggaggaagtttcaaatgtctagaaaagtagctcagagctctggaccactcaccaaataaaacaaaaagcaaaaacaaacaaaacaaaaaccccactcagtacatctggcaaacaacttcccaacaacactgaactatctcctgcgacccataagaacaatttaaaatacccaaagtgctaagacctcattagcagtactttaaatctgagttttaatgttaaatatgattactcgaataccctaaactgtatgacatgcctaataacaataagttacaaatattcaacctaataacttagacatgatatggttaatataacagacattgtatctcagctaacctttcatgtaaggtgagaattaaaagacttgttcatctgtgcactcaaatgaggaatgtggtatcctagcaacagtgatgac

SEQ ID NO: 1435 - DNA, 552 bp, Rattus norvegicus
  Genbank Accession No. AI228672
ccaggttttctccttttttaatcaatgatcatctttgtccagctttggaaatctggacaaagagaaggctaagaggaggcctggtccagtgtctaaaggtctctgagtgagtctgtcagcacatggaccccgaacgggcctgtccatcagctgggcacagcagttttcctgagtatgagccagtcccaccctcagggcagcatcctggtccagagaggaataaaggccccaggttgggcctattcccaaggccctcgggacagtcaataaataggttctgagccaggcctgggaggacggggtgtaaagagtggatcagctacccagggatcccaaagagggcctgggaaccctcctgctcttcttcaacaaggaagtaaataaatagaccttaaactcaggaataggggtgttggagcaggggatccttccccttagagttagtaattaaatcccatgttaaaaacaaaccagccctaacccctaccggcatctacaaaaatcctacaggatagggcaatgggcttgcctgtctgggggtacacagttccc

SEQ ID NO: 1436 - DNA, 418 bp, Rattus norvegicus
  Genbank Accession No. AI228760
gagacagtctcattagtccaggctggctcagaactcagggtgtagcagaggatgaccttgaatgtaggctcctttgccaccacctccagagtgccgggattgcaggcctgggccatcatgtccagttttatgcaatgcagaagacagaaccagggcttggtgcatgctaagcaaaccttctaccaattgagctacagccccagacatgagtgtttttacataatgttatacatttgaatctccttttgaatttgctgtgcatttcctttcagagatggctcgagctccttgaggctgcttatatagaaactgcagggtagagaagagatgagaccatatttccttgaggcccttcatctcccagggaggtaggtctagagaggagatagctggaagtgtgtctttcactgaggcgggc

SEQ ID NO: 1437 - DNA, 390 bp, Rattus norvegicus
  Genbank Accession No. AI228830
ataacagtcccactctgacaataaggagtgaactcattattgtcagagtgggactgttataaaaaaacaaaacaaaacaaaactgagagtttgtaggcggccctggccttcaccaccagcgtaacacggccaccgctttcttaacttctccactaacctatttcaactaaagaagacacgcagaacactagcaaaccaggaagaaaaagctttcactttaaatgctacaaccagcctttaaatcttaaaacaaataacaaaacctacaaatcgcgtacgttcaaattacttccaccatccatcagctacgggcacttcagcaaaacagccccaagaaatattccccaaacgaagaccccagatggaacactgcagatcaaagtccaccta

SEQ ID NO: 1438 - DNA, 565 bp, Rattus norvegicus
  Genbank Accession No. AI228963
gattttggaataatttaatatataacctcaagacataactctattctaagaccattattttaaaggaacggatccttacgagaccaagataacccacagagcatgaggttggttcagcctttccttttcttcttctttcaacaaatgtgcaccacgatgtttcaatggcaaggccgatgccgtgaacatgaaagctgcgatttgcaagtaccaaccacaccagaacctgggaggccaaccagacagtgggttgggtgccattctaattaaatgatcaggtgacatcacaacacgctggggtgtagcctcgcaactgtccattaagtttcttttttcttgatgatcagaggtcccacgttgtctccagtctcctcattgtgctttatgtgagccccatcgcagaacgggaactttttagacctccagcaccggcaatacacggccttatcccccagatcctccatgtcgaaggcgtgcacaaccttcgggttgtctttctggatctgaaggttcaccatagctttggtgcgactctctttagcgtagaacttcttgtaagccaggt

SEQ ID NO: 1439 - DNA, 469 bp, Rattus norvegicus
  Genbank Accession No. AI229196
gtggtaggaatttgtatttttcgcctttgttgagaatacatgagattggtaaatctgtcacatgcctttggtggaaggacaactcttactactatacataaactgtgagactgggttaggaaagacacggtggtaatgacagacacaatggaaaccccacatcacctcatggcaaacaaagaggatgtgggaagcttggcttcaactgactgcagatcccaaggtaagttgcatatttgctcatgcacatgggtgggagggacagaagactgcagagacacagaagggggtccagggtgaagtgagaaagaaagtagaaggactaacagccccagaagaacaaagccaactacacctggtaagccttggagggacagaaacccaggaaataatcccccgctggggctgggtgggccaacagggtaaattggctccaggcttggagcacaccaaggacagtgtgggttct

SEQ ID NO: 1440 - DNA, 505 bp, Rattus norvegicus
  Genbank Accession No. AI229304
agatatatttgaactgtaagctctttgagctgtacacgtgcacaaatgattcagttggtggaaaccttccccttcccctacatttaaaacgttgcaaacttaaaaagagcgctaaagaggtttgcataatgagcatcatggaaggaagtgttgaggcgactttctcggtgctgggaggtcccatggcttccctattctttctggggaaagctccccttctcccctctccgtgctcaacctagtgcgagaatcccttgctctgcagcaggttaacatcgacatatggcaatacagtttactaagactaatcacctgggccatctgtaacactgagttcttaatgcctacccaaggtagtcacatcaacttttactaaactggaaatctctgctatcattgtttggaagcacaaattatttccaaggctttaatctcatttagactgttcatttttctctctttctcagaacctgcatcctgaaagttaacgcggattagaaagtca

SEQ ID NO: 1441 - DNA, 232 bp, Rattus norvegicus
  Genbank Accession No. AI229354
atgaaagaaagtgtaaacattttatttggcagttgtttcgggacccgtgaataaataaatggaaaagtccatatgaatatttcctcttggagtaacagataccattaaacgcttatttacactgcaaagaacagttacgtaatgaaactttggcttataaaagggaacttcccacaccactggacaggacaggtaaggatggtgattctagccgtattggctttagcagtct

SEQ ID NO: 1442 - DNA, 555 bp, Rattus norvegicus
  Genbank Accession No. AI229502
caaaatatattaaaaaaacaaaacaaacaccaaatagactaagaggttatcttacaccacctgcttctcaagtctttatggagctgcacttctaagtcaatgggtgagttcctctctgtgctgtcagccaaaggagccagcctctgctgtcaaactcggagtcccagcagctgatgacatgggagtcggatctagtattgctagaggagcttgcttacaatggcagctggcatgtccgttagacctctttttcagaaccatttgtctcacatacttggggactgctgtgcagggacacccggtgtggcctgacgaggcaacgtgtacatggctcccaaaaactggtcggcaatccttcctgcttctcgaagcccactcagcagagcaccatggaccgtagctgggtagttgcggattgtatgttctccagcaaagaagagtcttggactgcggatgttttccactcaggaagaggcggcacaaactgaacagctggtggctgctgcttcagcactcccaaaggaagggttcagagcactgcgttacactttataa

SEQ ID NO: 1443 - DNA, 542 bp, Rattus norvegicus
  Genbank Accession No. AI229702
caaggttttatagcagctttattcacaacttcctcctcaactgtaacgaatgtcctccaacttggggttgaataagcagtaagacatccacacaatagcatatgaaacagaaatcaaaactattgatacatccagtgatacggatttaaaatctctaatttctagcacattattctcaaaagttacatactattaaattccacttacaactcttttcaaaagacagtccataaagtgaaagcacacgtcagtgaatgtcagggagagaacaagatttgactatgaaataccaggaatggtggaggggagactaatagaactcttctgtactctgttcatgattactcgtctgtatccatttatcggagcttatacaaccgcatctaatgtgaatgtaaggtttagaaggaaaaagctaaaagcttaatgccataaaatacgctcctgtgtgacttacaacatcatactacggaacaggaaagagctctgtgcctgctaggctcttaggatggggacaggactatactataggagacacagta

SEQ ID NO: 1444 - DNA, 487 bp, Rattus norvegicus
  Genbank Accession No. AI229707
ttccttttttttccaattcccatttatttttggctctcggggcaatgtcatcttttcaatatgaaaaaaaaaaaaaaaagccaagtttaacacaaaatagaaaggtagggaatgaccaagccaaggaacaggagggaaatggggcagagatgttacctcccctctggggagtgtgtgaggcacccaggtggaaatggtaattagagtgtttctggacatttagagaacaaggccttgctgccctgcccccacaaatccccatgcaacgtcccttggagaaccaacacagggaagacacctccaatggcagatttggctcaggacagctaggatataaatggtgataatactgttaatacctctcctgaggccgatagatgaagcagggaaaaaagaaagccccatcgactgaaagcctcagcgattcccgtgtctaaatggccctgactggaaaatcccaccccctaagtagcatctcctttaccca

SEQ ID NO: 1445 - DNA, 465 bp, Rattus norvegicus
  Genbank Accession No. AI229753
cagacatccaggagtacatgaccatgtctcctacttcccaagtaagttctttattatctaaccagtcaccaggtttactgcagcctagcaccaggccaggcacactaagcataattacaaagggcaagaggctcccagccaatgggaggtgtacaacttaaacatttctcaggaattcatctgacgttaaaaatcacatctggactcagtcaccagtattgcaatgaacattcaagatattttaaagaaaaacatcacagctcacatttacaatggcatggaattttttttcctagcttaactttgttaccaatgaacaagatttatttgaagttcagtttgcattcccccttctgtagcaggggttaatttttttctgaaaggagttttaaaacattaagcagtaaaggggcttaagtacaaatgtggcccagagctatgtggccagaagggcttagggctgaa

SEQ ID NO: 1446 - DNA, 451 bp, Rattus norvegicus
  Genbank Accession No. AI229785
cccttggaggatagttttattgacaagtcaagggaagggctggtgtgaactttatcatgcccctccctggggaagtcgcactggtagcaaggtaggaggccaggatcagctcagagggccttggcgatggacagactgttgtagtgggcttcctggccctcaagcaggcttcggtaggtggcgatctcctgctccagcctcgacttgatgtccatgagctgctgatactcctggttctggcgctctgtgtcagcacgcacgttactcagctggacttcaatactgctgatcacaccctggatgtgtgacagctgggctccgtaacgggcctctatctctgccacagtgccttccagggcagctttcatgctgagctgagactgcaattcaatctcaaggtcctggaccttacgtcggagttccgtgacctcagtcttgtttatctggatct

SEQ ID NO: 1447 - DNA, 493 bp, Rattus norvegicus
  Genbank Accession No. AI229843
aaaggtgagtcaagatacacagctttaatacatattagaaatatccaatgtgccaccaatacgattcccctaaaacacagcaagtgccagcgcttggggccacactcatctgtctttgtatcactagacatctgaatgaccaaccatccatttttcccacatcctgccattcattaaggtattttcagccagattttttagcaatatgctttttttctttctttcaaatacaacaagccacacaggagttctactatgaatgtccaacaacaacaggctgtatggggccaagcctttctgaaaaacatgcgatctctaaaagattctctgtcttccctttatgagtcagcagtgctccacgtcacaaaaatcgctgctggtcacggtcttctctcacaagctcatatgttctcttcatccaacattttgttgatgccgtcacaaagtttctgtaagtgaggtttaaattttccaaagggattatacaaggcag

SEQ ID NO: 1448 - DNA, 518 bp, Rattus norvegicus
  Genbank Accession No. AI229854
cattacagaaaaatatttttaatgtagaaaagatgaacattttgtagcataatgaaatataaaccattgctatacacagtaatagacttcctgttataagaacagctactcctcccccagattctcagaagctgggcacacagcaccacagaaaggaacgagtccatgaaacacacgaagaacggtgttatcatcagacctgggcagcttaggtcagaggctgcttcgcctcttggggactgagctggccagtgttgtccaatgttcctcagtccaactgggtatctttcttgtcctgaaccaccccgtactcttctaagtgttgtcatgtgtgacagtccttcctctgtcttagaatttcctttcccctagcacggctgtgttttatctgcttaatggatggcaacaaatggctctgaatgaagtcaccatgatttaggaagttggaaccacaaattcttcatgtggtcaaacttttaagtcctatcatggcacattcaccagttaaaagttgggtt

SEQ ID NO: 1449 - DNA, 468 bp, Rattus norvegicus
  Genbank Accession No. AI230116
ggcaggccctcttacacggtgccagccagctatggggacggagcaccattgtccctgtggggctcagtgtggtgccacctctcgggccgagtgacttgatttgaccagcatgcactcagattagctgcttgacaaaggtgtccccttttcgatgaccatcgtgactgtcccggtgtcggaggcaggggtggcacatgttttgaagctaatgggcatcccttgtggtcaggcgtggcgaacttgaacatttgaatgggaaagaaagcacttcgcacagtggcatttgaacaaggtggcaatcggctggagcgacaagcctgtcatcttggaacttgtcttagaaggctccccttgctgctgcagtatctcctaccagaagtttctttttttctttttaaacccttactcctgctgcatactcacccatgactctgttccagcattgaacagacagagtgagaaacccta

SEQ ID NO: 1450 - DNA, 440 bp, Rattus norvegicus
  Genbank Accession No. AI230130
ctaggaaaaatcttttattacaaaagtttttacaagtaggcatggaactgactcccagcctgtaggctctggtgcctgcctttctaaaggcccagacagaaagttcccagggccctgaagatcagaacaaaagtcccactccgaatggacctcaccctgagtcacaggctgagacctgacatcctaggaagagagaggaggattaattgagaactcagggctgcccacgtaggctttctgtgaatgtagatagggaacgttggtttccaggctgcttcagggtcagagatgccctctggaagggagggatagtagggagttgggagaggctcccagttcacccctagagggcgcctggagacttggcagaacgcacctggcgcaggagcaggaccagcgccgccaagatcaggactgtgaagagcagcaggagagcgacc

SEQ ID NO: 1451 - DNA, 495 bp, Rattus norvegicus
  Genbank Accession No. AI230142
gagtatccatgatttatttgtcaattatacatcaatgaagccaaagacagagaaaaacagagaaagagggaaagaaatgtgtagagggacaacatcaaccaatcctattatcaaataagactttggaaacctgggaataggtagagaagtttattgctcccacatatgcacagagagtctcctctgtagtccctggtacatggaaaattctcattatataagaaaatgacaaatgattaagtaaatttacacatgtagcagtattataatatgtataaccactggctgcgtacctaaaattctgtggacctctctttcacatgaaaaaactttccaagcatctgcgtagtggtggataacaatgcaatcccacagtcaaggagaatgtgtggttcataagtatatttttttcacctgacaaaccaacttctgtttatcactgcaagagctatcactccagccccatccagttttctcatgatgatttattataac

SEQ ID NO: 1452 - DNA, 349 bp, Rattus norvegicus
  Genbank Accession No. AI230156
  misc_feature (1)..(349): n = a or c or g or t
gctttgttattccattttattttgggggggggtgtcggncagaagacatttaggacctcgttttctccaccatgtgggtcctgggatcaggcttagtctattaagcgtggcggcaggcaacgtggcctttcccctgcccgatcccccacacttttgttgtggggtggggtcttgagatgtaggcagtctaacccaacactgaacagaagttaagtgcctcagcccctgactgctgggatgacagcccttctgtggccaagcctgacgagaaagttgcttttgagtgacggggataacaagtcagaaaatgacagggcataaccacaccgagattaaatacatgtgtaat

SEQ ID NO: 1453 - DNA, 418 bp, Rattus norvegicus
  Genbank Accession No. AI230284
atgcaaaaatttatttgaccaaaatgtagaaaaagtgataccattacgtatgatacaatcgcaagaatctaaagaacagagtagattttatcagttgcacagtttgctaaaagttcatctccctggtagtgtgatgcttaataaataggagtgaagggagtgtgtacatggaacagtattaaagctcgatcggaaggcacatgggcagcagtgatcaccccagcattctcacctgggaagctgaagtaaataaatctgttctccacggcggagtgtggaacagactcagtaagatcgggccaatctacttgtgctttatgacttcccatagacgggttttaatttttgctctgggtggaaaatttctacatttttcttgcaacaacccctagccgctccaacatcagaaccttgtgcc

SEQ ID NO: 1454 - DNA, 551 bp, Rattus norvegicus
  Genbank Accession No. AI230373
gtcaatagaaatgctttatttaaaaaatagcgacttaaatataaacatctctaaatataaacacttcataagaggctccgaccagtggtgcagccggggtgtccacaggctgccctgattcaccaggattttaaggccacatgtgcatctggaaggctgcagtctaggacccatgctgagacaagtctctgggaccgtttcttcacatgagggtttagcgatcaccttccagccttgggttcgaggtctcattaggcacattagcatctgtctgactttgaaatattgtccttgaagtatggcagctggaggtgagaaagaaaattcttatttccaaactctaaggcaagcttcttcggccaccggtcctacctacttcaaaataagccacgtgggttgtcttgagcacgtgtggaggtgactagaccgcagcagagcgctgcggtggaagggggtggggcaagcgtctggcttccacccagcagaatactttcaatggctggccggagtgccaagcccgctagactagggaaatcttgtcagtcaataag

SEQ ID NO: 1455 - DNA, 675 bp, Rattus norvegicus
  Genbank Accession No. AI230381
cttgtagccaacatattcaaaatttattcaatttttatcacaagtcatgtggttcaaaacacttcaattttattcaattaaaatgaataaagtaagtcaacttttcttaaaacaaaacttttaaagaatattctaccattttacttaaggagctcagtaaatataaatattaaacttcaatataaaactttatatataaacaccttaacttttttttaagttgtactttgcatctcttggtaatcactgagctcatgaaattcaaagccatacaaatccttacattaacagtcataagcttgaaactcttaaaagagacgaccttgatcaaagctttggaatccagtaaaaattagaaaacgagtgggcttcagaataccctgagcgtacaccagcacttcaccaggaaacatagtcgatcttctgtccagaaagtggggctgacagtcaaaaagaaaacagaaggggaattaaggagcaagtaaaattctggctttattacacaagcacgaaaacaaattcctttggagaaaaaaattgaaaaagtcttcggaggacttccagaccggtgaggtagagtccgagagggagaaaatgcacgtgtccctcctggttctggagacgtctccatccgggttgggaagcaaagagacttctgtcacgggtccggccgtc

SEQ ID NO: 1456 - DNA, 436 bp, Rattus norvegicus
  Genbank Accession No. AI230430
gccacaacaaagcaatgactcatttattgatggagggtctgcaggggagagcggggtggggtgcatagggaggggctctctcaccccaggcaataggcctctctttcctctccagcacttctctggtaggaactaactaaggcacaagggcaggaacacacagggacctatgggagccagagtgaaggtgctgggtcagcagtggggagctgggagatcagaggtaaggcaaagtgagagggcttggaggctgggtaaaaggctaagtcaagatctagagaaatgtctgagtgtgtgtgcgtgtgtgtgtgtgtgtctgttgggggctctcatggaaactgcctcggttggagagacacaggggtctaggagttaagggtgaaacatatgaagcaacctgcgctttggccttggccgtcatggtgaacctcgtgcc

SEQ ID NO: 1457 - DNA, 536 bp, Rattus norvegicus
  Genbank Accession No. AI230440
gtccatttatttagaaaaaaattaacatgagcaaatgagatacctcagtgttacaacagagtatagaaatgtctagcaataatcaaataatttgatctttaaatacaaaataaccacatgaacacctaatatacaggtttcatctgaatacatatttattagataaatattagaggtcacatcatctaactacatacagctttgcaagactagaaatcacaattagttttttttttctgaccagtcaaaagtatgaaatgattgccatgtacatacgctgtacaaagacgatgggttccatggacatcacttcaggctgcacgtgtgggtgtggatgtgtatgcgtgtgaatcacctgtgatcatgatatcaaaaacttatacaaagcatatgaatttggttacaattttcttctgaaacccccgtttctcttcattgtttccatagcaccccaaaaatacacaggtggcagggctaggacacggaaggtaaatagtacgtgtaggtagaaataaagacaaaggggaacgaaaatg

SEQ ID NO: 1458 - DNA, 553 bp, Rattus norvegicus
  Genbank Accession No. AI230460
aaagggacaacatttattccttttccaaatgttacagtaaatccaggtggaagaatggttttagcagttagaaaaaaaaagtacaaatctggggtttggccattaaaagttatttacaacaatgggagggggggaaagacaacaaggagttgtttcacattacagacctccctcccgcctgaagcctaatacttgcttatcaagtcagagacacggtgatttcacaagctggaggtttgaacttgagtaagacatttataaaaacccagacaggggcaatgccctccccagcccaggtgccacagggcacagcacaagagactaagaattcaacaagggaaaggctggacgctcggggtttgggagtgtaagccccacttctggctcaggggcttgagaagcaggataaacaaaacgaacttggaaaagaattggaaacccagcagttgccttcagcggggatggggcttgggaaggagagaggcaggagcatttcacatcactaacctaacttgggaaccgtaagggaccatcttcaactggcctaatagta

SEQ ID NO: 1459 - DNA, 472 bp, Rattus norvegicus
  Genbank Accession No. AI230479
aataattccaaattttattttcttaaactgatatgacacagtgaaacacaaaagggggagactcacaaaattcatcttaaaattgacaggcctgagcactggttcagtgagcaggtttggaggacgaaagccaggaacaggaggcaggttcccagcagtctgcactgctggctaggttctccagtctctgtatgcataaagtgctccagtgacttacaaagctgggtgggtagtctcaaagggagaagttcctagagagatcaggagggcagaagaccatacccttttttcttggacgagcaatggggcaagtgaactgtgagaaaaagcttgctttggcttggagtcagcaacagtctcagggccttgcctgtctacagggctgccttgggctctgcaggtggcaggtgcccacacacatcagctaccaccttttggcgccgtacctgcttgccaggggagcccgctagga

SEQ ID NO: 1460 - DNA, 612 bp, Rattus norvegicus
  Genbank Accession No. AI230578
accatttgaaatacatctttaattttgtccaaatcaatatgtaatctacaaaatactttgttacatgattatcaaggtcagtctgttctgtgtttgtaacaataggtcaggaagtcatagtctgagtaaaacattgtaacagccattgttaaggaaacatggtaatagtcattgttaaggaaaactgtctaactgaagttgtaggaaataggctaaatcataaatatagttcctgcatgaaaggcaactgcatttccctgatacacagaccagaccgaaaggggaactggaaagtgtgattttcgtatcattggtaattgataaatagccactcccacagatatggaaagtgttctgatgctcagtcctacataactgatcatgtaactttctcttattagcacagttaatgtggtcctgtgctgcccagacaacgtgaccagggcagtgaaggcagaaagacaggttaaaaactggtagtatccaaagtggtcacacaagtaaattaaaatgtttaaaagtagtgtttcttcttgaattccctctccagctaatttaaaagaggggattttgaagatcactgctggctcctggggagagattttacttttt

SEQ ID NO: 1461 - DNA, 707 bp, Rattus norvegicus
  Genbank Accession No. AI230591
gaactgaaaaaatattggcaatgttttattagtatgagtgtgcctcagagttcacaccacagtgttgatcctacatgagttcaatgttgcgctatacacagccaatgctggacaactgtgatgggctacctcctgctgttgaacctctccgacatcatcctctcacatcgggaggcagaagattcccaaggtaatggcagagtgcttgcttcactcttaggctattctgatgttacaatcaagccacgactcttactctggctgatccctctcaggtgtcagagagctgttctttcccaaatcctcaggtatgggcaaatcatgagtcgtttttcctctacacattaagcttccacagcaattcctcctgaattcttctgtagtcaagtcactaaattgatttaggcccatgtagaagctggtcttgccctgcttatagtctgcattgtgcgcctcaattgtcttcttactctcctcccacactgctcttctgtgtcgttcttcatccgggctgtaggtttttccaaatttcttcttccattcctcccactcggtatccaaacttggatcaggagatggagcagctgaggccattcccaagcagaagacgggcagggagtcagcactaattgggacctcaaaaccttgcttgtctctgctcccacttgaagtgctgcaacttctgttcacagatggaaaccagaaat

SEQ ID NO: 1462 - DNA, 441 bp, Rattus norvegicus
  Genbank Accession No. AI230691
cctcttccggggacggtgcttagaggcactcaggatggtccagcgtttgacataccgtcgtaggctttcctacaatacagcctctaacaaaactaggctgtctcgaacccctggcaacaggatcgtttacctttacaccaagaaggtcgggaaagcacctaaatccgcatgtggcgtgtgcccaggcagactgcgaggggtccgtgctgtgagacccaaagtcctcatgagattgtccaagacaaagaagcacgtcagcagggcctatggtggctccatgtgcgccaagtgtgtccgggacaggatcaagcgggctttccttatcgaggagcagaaaatcgttgtgaaagtgttgaaggcacaagcacagagtcagaaagcaaaataaatgggcagcttttttaagtaataaaaatcaagacttcgtctacgcctcgtgcc

SEQ ID NO: 1463 - DNA, 585 bp, Rattus norvegicus
  Genbank Accession No. AI230716
atgcaaaaatttatttgaccaaaatgtagaaaaagtgataccattacgtatgatacaatcgcaagaatctaaagaacagagtagattttatcaattgcacagtttgctaaaagttcatctccctggtagtgtgatgcttaataaataggagtgaggggcagggttcagataagctataagcaggtgactctccgtcagcactgtaaactcgaggtggccccacactgctggggaatgtggaatgtttcagggagatgttaactgaaaaagcaaaactacaatgccaaaaaatatgtgcagcctctagagcgctccacgtccagttcagtcaggagttctcggactgtattagtgtcattcccaaaggaattcaagtctcagcaaactcaagctcccatttcttgatccctgaacaatggatatgaagttaagccaattgctttctctatcactactttgcggctggagagaccctttgttgcctaacccttggcatcaatgttctgatggctggcaacctgcatattatttgagacagagtctcgctgtgtatcgctggtacctggctttgctagcagtcttgat

SEQ ID NO: 1464 - DNA, 669 bp, Rattus norvegicus
  Genbank Accession No. AI230743
ttgtcatcacttttcttcatgatccagatatttgaaaatgcaaagaaaacgaacttttcatgatatgtcagggactggcactaaaaaaaattcagactgcaaatgagttatacaaatgaaatatcaaatggagatccagttatcaaaatgaaagcactcaacatattaaaagttcacaattatttgtacagagcacataaaaaagtcagcttgctatccaaccgctgtgctttttaaagagctactgcagaatttgaagaaaataggcattgttagttaacttataaagagaccaaagagcctgaaacaagtagtaaaaagaaatttttgcctttattagaatggcattaggccttaaatatgccaattttggtaatcacattattgttttaataagaaacgactctacagaattgcaatactggtccaacagtcttgtctttcttttaaagcaagaaacagaatgtaagtaaccagaaagcagggcaggcatcagctaacccaggagactagcttcttagatccaagcgtttgcagagagaaccgttgggctggggaggggtggagcagctcgagataactggaacccagagtgcacgccaagtcccatgaggctgcttgttgaaatcatcttttccttggtcacactggttccctccaatactatag

SEQ ID NO: 1465 - DNA, 632 bp, Rattus norvegicus
  Genbank Accession No. AI230747
aagtcctttcaagaatccagttggagactaggggttttcatctccaccccactgatctccccaggggccctggcttgtctgtggaaccagaagagacagtgcaagatgaccacagagttcaacaaaagctcaggtgatttctacaagctggtttaaccattgcagccgcaggcccggtcctcccatcttccccagatctgtgtccgctgctccacaccaaaggtgaatgaattcactcctccctctgacctcctgtgggaaagctaaaggaagtgagcaggagcccacatgtctggggtaggtaggtggctgcagagaggctgtctgtcctgactgctgttactttacagggtagggccagtgtcatcatttcctgcatgggagaacagctgtgagtccatggaggtccagccagtgacagaacaaggccaggcggcagagccaagtgccactttaaagagaagctacatctccatcctagagctttggctctaagctctgggaaaagcaacttaccaagatgagctgtgctcctgtctgggtcaaaatcagttgcagaaggcaaccagtgcgatctctcgttctgggaggaaaatacttaggacacagcagccaggcgcactggtaagtgt

SEQ ID NO: 1466 - DNA, 639 bp, Rattus norvegicus
  Genbank Accession No. AI230753
ggtatgaatctcatttatttaaaacagtatttctcaccattctcaaattgaagactgcaaaaaatagaagcagcgcgttatccttggccttgggagcaggtcgctgccttccccctctgcagccctaagccagtccatcccaccgcaggcagagcacgcactttacaaaacagtcctgaagcttaatcaaataaaactattgtacacgacatttacattagaaaagagctgacgtaggaaaactgggtgtgtggttccctttaggtgaagaccgctccacagttggggcaccttcgcttcctcagcgcgaagcagcagaggaacccgaaaggaaacaggacgatggccaagaagatgcccaggcaggtgaagcagtattccaggacaccaaccctgcagaccgggcagcctccgaccacgacgatggagttggcaggataccgggtgaccgctcgactgtggatgttatagacccgggggtggctggtggggatccctgtgacgaggtaagggtagggcggcggcgggggcgcggtggggatggccccgtagccgtgcgggccgcacgcgtagtcgccctggcctgcctccaggttgtaggcgggcgggcgctcctgcaacaagggcttgtggtccatc

SEQ ID NO: 1467 - DNA, 641 bp, Rattus norvegicus
  Genbank Accession No. AI230758
ctctgaagcaggtaaaatttattaaggcattatctaagggacagtggattctcagctctcactttctcatctgaaacgactgcaacactccagttctccatcctgtcacagttgctggattcttggaccaggtatcagggtctgtcagaaaagctcttgctattctgggccatgaatgcaggaaagaaactggagtggaatgtcactatgcctgatttacttcaagacaaggtcttacgtagtctaggctatcattgaatttgctatgtggcagtcaggctttgaactgaccctcctgcttctacaccacagggctggcccaggatgacaggcttgtgctatcactattcatcatcctcattttttcaggaaaacaattttttccagaacattctagattctagaaaaaatatttttgctttaaaaagactgatgggaaaaggttaaacacgtctcattcagactcagagtaggggaagacctgctgtgcaacaggactgttgggaaaagcagtcaagtcagataggtgttggccctggtccttctccctacttctcttcaggggctttctcagtgattccaggagcaaagtcctcaggtcgtcgaggccaggaaaccttccctaacaagtccctcgtgcc

SEQ ID NO: 1468 - DNA, 555 bp, Rattus norvegicus
  Genbank Accession No. AI230798
  misc_feature (1)..(555): n = a or c or g or t
agaagtctgcacataacatttatgttcaggatggcagtagcactccaatacagattacgctagagaacttggaacttcagctgcggctgcgtgtctgggctcttccttatctggacacggatcttgacagtgaatctcttgatgacagataggcagctaacttgtcccggaattcatgaagatagttatattgcttgatggtctgtatcgccccagatcccctgacatctcgaaggctgtctatggcttgctgtggtgaaattgagtcagacaagtataggaggagacaagcagctacaagacaagatcttccaagtcctccataacagtgtatcagggtttttcggttgtttttaaggcaggtggccagctcctccatgatttcccagcagctgccaatgtcgggagtccctccatctgggatcggatgatgatgggtgacaattccatattgttggtagaggtccagaaagtttgggactctatattntgacagttcccctctggtgcagaaaacaaatacgtcttggatcccagagctctttagttcctctg

SEQ ID NO: 1469 - DNA, 475 bp, Rattus norvegicus
  Genbank Accession No. AI230826
aatttacttgttattttattgagtatacagtggaagagggaaaatgggctgtcccatatttagagtaccacctgtgggtgaagatgaagggcactcttcctctgctgtgatgatctgtgccttgagaaggaaggtattcagcccagacgggctgttgtgtagtcccaatgctgtatgaaaaagactttgattctggcctctcttcagactccccagagcagtttggtaacccttcatgaatagaaagggaaactatgtctagcaagctgtgtcaggtggcctccctgatttctccatcatgattagttgctggttctagaatcccattcattctcaaaacctcttcatagagcaaatagctctgcagacttctgggaagtggcaactgatggatgaaaatgtcagaatgaaggtgctctgcttttagactggagcgaatttccaaacgacaaaggtgggttagacttggaacaga

SEQ ID NO: 1470 - DNA, 461 bp, Rattus norvegicus
  Genbank Accession No. AI230830
gaagcatgtcaggaagtgctctgctctttcttcgacttctccctccccagttggctgctttaaggtgcctatgctttctttccctttggtgtgctgacacttaataaacgcctgctttatggaagcattctgactcataagcagctccctttaaaacttaacaataattccttagcgcgggtgtcaggaaaagcttgacagtggcgccctgtggctcagggagactccttggccgcaggcttcacccttcctgctgatctgggtgtgagccccccatcacggtgcaaactgggtggtggtctgcgttccaatgggaggcactatcttttctccttggagaagtgaccctgcagtgtctctgtgggtggaagtgtcccaactttgcttggtgatgacgtggccgtgggtggggttgagtctagaggtgtctggtctttttgtgagtgggccaagcgatggct

SEQ ID NO: 1471 - DNA, 438 bp, Rattus norvegicus
  Genbank Accession No. AI230884
acatttacaaacattaaatttattataactagaatgaatgtaatggttctcagatttggccaccttatagctccgattaaggaggggattttttttttaaacagaaaaatgcattataacttggtcagattacctgcacattaagaaacaacatctaaggaggaaaacaagaaaagcaacccttcagtttcacataattaaagaacaggagaaagcacacaagcaacatcatagctaaatttaccaaaccaaagccagggcgattttctcttctgattatgtgtcataaaaaggtccgctgtcttatatacacatgtatataatgttacattccagcactgtaaaaagtcccctttgccccctccccccaaacttttcagtctagtcgccgaacttggaaggaggcgctcgctcctgctgccggtgcatttcgttttc

SEQ ID NO: 1472 - DNA, 539 bp, Rattus norvegicus
  Genbank Accession No. AI230915
gtcaagatttgggcaaccagaagtataagaaaattattttcctcagtagttaagctattttttcctcttcctttcttgtttgaacctcttgggttttttatatatatatatatattttatgttttcttagaaatatttaggtaaggtttatcttgaatcttaattgccttaattttaaggacgtcaaaggctccagaggcatgctttcagtgtcttgtttttaaaaaaaaatatatatatatatatatcaagaaagaattgaggtattgtgccagttttcactggcatagaagatggagactgagtttttagggtgggaaaaaaaagggaaaaaaactgtacagtttaagggaaaatgttctttcttcattggaagaaaatttgttgataaacaaaaccaaggcaaccgcgagaatcgggaaacgctgggacacttctcatgaactttgacacaatccctctaaaaggctaaaagacattttacggtaaagttattcatgttggtttgaaaaacaactgcattagagatgatgtgtgtt

SEQ ID NO: 1473 - DNA, 481 bp, Rattus norvegicus
  Genbank Accession No. AI230939
ctcatactgaatatttcaaatattttatttgatcaaagtaaaatacactttccactgctataaactacagttgttcacacacccacatttttttacgatgtgtcaacaattttgtattctacataaaacatttggtttaaacaaaaaaagaaaaaacccttaaatgctatcttctctcctgtcttctaagctcttcaggcgttttaattgctgtaaggtttgacttcccagatatctagacggtatgagggatggtgggtaatcacatgaactttaaccataacgagggtatcaatgacaaacctgactttggctgactttgttgagaacaacttgggaccaggagcagagatattccaggaggtggcagtgaagctacattcctatttatcaggagcaaacatgaaaggttccatacgtcataaactaggggagataaatgacttcaaacacagccagcaatgaaaagcttgctcatgag

SEQ ID NO: 1474 - DNA, 463 bp, Rattus norvegicus
  Genbank Accession No. AI230951
cttgaaaaacacatttacttctgtaaactgttggaatgccagaggcggtcctcacagcccagcccggtgcagcattcttccccagagtagtaagagcgaggaggaaggaaaagaaccgtcttcacctgctcctgaggagccaagcccgcctcagctttctttaaaagcaaacgaagccatctttggaatttgcagactaagattccaaccgtagctgccttccaggtgccctgaggcctgtgccagcctccctgtctgcaggggacctttccatcctttgtcatccttgaggccctgaggttgaccctgaaactctcaccacagccggactcagacctctcatgcttcagaagggcttcaccaaaagggtagtttagaccacgtgggcggagccactgccaggcaagatttaaggcaaatttgtcacttcatattcggtccacgccagacctaaatctgttat

SEQ ID NO: 1475 - DNA, 618 bp, Rattus norvegicus
  Genbank Accession No. AI231011
atagactaggaaatataatttatttcataaaaattaattttgttacaagaggaatgctaaaggttatttacaagttgtttacagaatgaacgggtggggctgggactatccccagtggatcagaacccacagacacacagccatgttcacagcctgacatccaagctcccacacacccgacctctgagggcgggaggaaggtgctgactcagatgcctgggagaacacatgaacttgtaaagaagataaagaaagacatccatgttttgatattggaactaaaatggtaagggctttggccagagtaaagaactgctcagtcgtatagaaaaggcattcagctgtcacatgtgtttatatgaaaagtaaaagaagcccgcagtatccagggttggtactgtacactgtggtttgggtgtcactggaggtcttaaggcgcgtatcttgggacagaacaatggagagtggacagcagaattaagtacacatctggcagaagccacctgagaccattcaccggtcctctctggtaatgctgcaacgctgttgtttctcacggctatagggacactggcatttggcttgttgtccactttaaacagcaaacaccccaaaagc

SEQ ID NO: 1476 - DNA, 501 bp, Rattus norvegicus
  Genbank Accession No. AI231038
ggtttctgctagcctttatttgtgaaagtttacacaaaaatctcccaacaggtgagcctatataaaccccacatgcctcttcccattaacaaacagaagatggctctgatgggggtagggtggggggtcatgacaatggtacggaacaaggtttattgaaactgtcttattctcaaattattttgaatatgctgaaaatgaaaggaagcaggtaataacctgtttataaagctgatgtgcatttgtgcaagcctactgccaaaggcaaataaatgctcttcaagcacaatgtccaagttggttgtttttggcatgaattaaaacaaacgaaaggacttgaaataatttcagttctacaaagcttatgtttacagatgttcttgtttacaagagcttggaaacaaaaccatgggcaaaatggtctatttttctcctctctgaaacattgacattttccaggacagaaaacagaaaattagtagagtggttgtcattgctcct

SEQ ID NO: 1477 - DNA, 573 bp, Rattus norvegicus
  Genbank Accession No. AI231044
  misc_feature (1)..(573): n = a or c or g or t
accacccttacttattggctattgagcctttaagggacctcagggcaggttggggattacttgctgtttaaaatcttgtagtccctcttggcagggggagagagtgggcatgggtccccgttgccagttaaatccacgaatcctctcttaatgctctctttccacccctccgtgcactccattttgggactgggttagtacttgtctctacaacctaacgggactgaatgaaaccagaggccagagaaggcaggtcttgggctcccccataaatgtcacttctcagtggttctagggttgggtgttctttggacagacacagcacatagctgagatctcggtggcccacgggttgtatagaggagatggctgatggagccagtaagaggtggcttgctccgggttgatggagactgggttgtaatgggcttatggcctggattgggcaggagggtctggagagtatagctacccnctggcttcatttcatcatttaaagtagaaagactggccttgaacttgtggcagtcctgctgcttttacccccacccccaatgttaggattacaggtgt

SEQ ID NO: 1478 - DNA, 525 bp, Rattus norvegicus
  Genbank Accession No. AI231083
cgggacaatgagtgccctttatggaagcggatttattggtgttttgagagagaacatgggaaaagctgcgacacgtcgatgtgatgctgagtcccgttttaagtggcttctgggaacagtcacagactccaggagagcagagcgacggaatacagacgcagaggttacctaggatccccctcagggagtacgcttggcagagccgtgactccctttgtgtctttgcagatgtcaagcgaacagaccaccaacctgtgtatggaacaaatgtacgcatggtggcctgtgtgcagggaagggattttggtcagaccatgacaaaaaaggctatgaggaattaaactcaacaattctttgtgtctcagaacattttactggcaacactgactgtatcaaacagacattcctgggaatggtggattctcttcctatccccagagaagcatatcaggaaacagacacagaacagaggggggtactgtcttaccacgggatcagcacatcctcatgggggtaaatgcctgc

SEQ ID NO: 1479 - DNA, 512 bp, Rattus norvegicus
  Genbank Accession No. AI231093
ccttctcaatcagcctttattgcaggaacacctagttgatgatacggggaccccggggaacaaaggcacttgccttaagtacaaaacagacagcatggctaaggacttgtcctcgggggattggtggagtaaagacatcttattaacatgcttatcaactatgacctagtaaagatgtcagaagaaagctaaaggtggtagtaaatacaagcgaccactagatgtcagtgctatagataaatgctccaaacatctccctcttttttgttttattaaaagatgagtccattaggtggaggtagtggtctgagagagatcagacatgcctcacagagtgcccagcttggccatgacgagccactcctgcagttaggactgcaccccaatggctagagatgactgaaatgtacaacacaccgttctgggctattggtgtgctaataataggggagagacagagcataggggcatgggaccagcccgaatgtacaaacagggcagggcctagggcc

SEQ ID NO: 1480 - DNA, 523 bp, Rattus norvegicus
  Genbank Accession No. AI231140
atggtggaaaaaaagtatatatttagaattaaccatctggactcactttagatgatcccaatcttgttggcaacatctagagcatcataatcaggagccaagcgaacatatgccttcttctctccgtcaggccgtatcagagtattgactttggccacatctatatcatagagtttttttcacggcctgtttgatctggtgcttgttggccttaacatccacaatgaacacaagcgtgttgttgtcctctattttcttcatagctgactcggtggtcagtgggaatttgatgatagcatagtggtcaagcttgtttctcctgggtgcactctttcgaggatattttggctgcctccggagccgcagggtcttgggccgtcgaaagcgaagaaggaagctcctgcccctcccaaagccgaagccaaagcgaaggccttgaaagctaagaaggcagtgctgaaaggtgtccacagtcacaaaaagaagaagatccgaacgtcacccactttccggccctcgtgcc

SEQ ID NO: 1481 - DNA, 577 bp, Rattus norvegicus
  Genbank Accession No. AI231217
gtaaaaagttggtttatttgtcatgttttcactgtatctcagttaagccattttggtgtccacagtgacagtcctcttggaagccaggtcatccctactcacccactaacagtgaccatcaaccacaagccaccaggcccggctgacagctacagcagcaagtgagactgtggactcctctaggcctgatgctcctcagcacagcccagagctggggactctgcacccgcttgccagaagctgtggagtccctacggtaggtgggaagccctgctgctctgtggcagtggcagaggaggggcagtgggaagaccctgtggactgggagggcaccaggctcctctgctcaggactgggtctagacaaggccacgtgtgatatggtgtgagtcctgggctatgtgcaagggccctgatgctgacctgtgtcggggcaagtggctaattgtcccttgattgccatttgctggcaagcatagcagcaagagtccctagaagccctgggtcatggaggcatttgctacttccactgaggtgtggcggacccacgtgtcttgctgctggcaggccctcgtgcc

SEQ ID NO: 1482 - DNA, 659 bp, Rattus norvegicus
  Genbank Accession No. AI231292
tgttttttttttttttttttttttttttcattttttaaattttttaattgagcaagagcaaggtatgacaggtactgcaaggagaagagaaccaggggacagctgttctgacgtgcagaacctgcctgcagcagcttctttactgtctcctggtgggaacaccccggagatgccctccagagctggagcacccttctcagggataaaacactacagggtaggggaacaagtaagggaccattggcatggtcctatgagactcagctcttaggcatttttgcagctggattttgtcagggtgtgtgtgcctttccagggcacgctgtagatctggaaggagcagagtgccttcctcatcagatggggctggtcgtggaaaggacagttagtcaaatttgtctgggacttggtacatgtagttcggcccatctccacatccaaataatagtttattccagccacaagctgcttacgagctctcaccacctgtatggcgcggctgtggtacgcatcgttgctgcccttgttgtactcgcttacggcgaagtccaacgctcgctgcacgccctcctcgctggcatctgcctcctgcggagctcccaacaatcgcgggggtggcctgtaagttccggcccaggccacggccaggacggccagca

SEQ ID NO: 1483 - DNA, 525 bp, Rattus norvegicus
  Genbank Accession No. AI231310
ataaaaaatttctttttaaaaaccaactccctcattacaaggacctgtccatttcattactcccagtctcctaaggcacagaatttagtcagaaagccaacatcatcgcctgctgcagctgaatacacggcaggggagtggcacttggaacagtctctggacaccatagtcactgaggaaaaggtctacgtctgagcatttagttatgaggccagttctgcaggactttttgaacaaagtaatttctcaaaccggctgaattcaccagtggtgaggagggggatttgatataaagagtttctttatataagaactatgcatgtggaaaagtagacggagggcaaaccctaggacgggcctgagccctagttagctaccaatgcttggcactccataaagcgcagtggcggaggaagaacagtacacaggcatttgcacgccacctgcagcctacccggtccgccagctcctgagatgggtgagatttactactggacgcgtttttttattccattttaaaatcaa

SEQ ID NO: 1484 - DNA, 454 bp, Rattus norvegicus
  Genbank Accession No. AI231421
gaaattcaaagaaatctttttaatttttgaccattggtaaaactttaccagaaaacaggatgtactttaaaaacttgaatcaatgaaaacatgaatgaaatatgaaattaagactcattctggtggcccagtaagaaaagacagaagcccattatcaagacgaaagaaccggtggacccgagtctctgagaacagcgagtacactgagttccaggacggcctccctccacacccgggagtaactgcgtactgagttagcaacccaaaattcatgttcgcctcccaactgcctcaccggacaaatttagagtcatgattctttttgacatttacagtttagacatataagctcatgttaaatgacaactggtctgtcaaaagtacaggagaagaaaaagcaactgtttaattaaaacctttctagatttttgtttttgattattgatcaagttgc

SEQ ID NO: 1485 - DNA, 549 bp, Rattus norvegicus
  Genbank Accession No. AI231472
ggtaaggttgaatgcacttttggtttttggtcacgttcagttggtcaaagataaaaactaagtttgagagatgaatgcaaaggaaaaaaatgttttccaaagtccatgtaaaattgtctcccaatttttggcttttggggaaattgagtttgggttgttggtctgtttccagggttgggggaaagtgggctgggtgggagggaaccagattgggatggagggagtttacacgaagcaggcagggccaatgtccattccgaattcctggtctggggcaccaatgtccaagggagccacatcgatgatgggcaggcgggaggtcttggtggttttgtattcgatgactgtcttgccccaagttccggtgtgactcgtgcagccatccacaagcgtgctgtaggtgaatcgactgttgccttcgcccctgagctcgatctcgttggagccctggaggagcagggacttcttgaggttgccagtctgttggtccatgtaggctacgctgttcttgcagtgataggtgatgttctgggaggcctcggtggacat

SEQ ID NO: 1486 - DNA, 590 bp, Rattus norvegicus
  Genbank Accession No. AI231532
agagtatgaactagttctttattttgattcagaatgtatagctatatacaagatgggcaggcagcctaagagttctagaagttaactgtattgatcccatctgtagcactgtcatataatacaaaacttggatattcttcttagaaaacttaatatttcttcaattacggttgctttggtttgaagtgaccaaaacaaaaagtactttgagatttgacaattgcaaaaaatctaagtaaaggcaattagattccatcggggtcttctgaagtgttagaagtaccaccttccgcttttcggtatttctccagtttagcaatcagttctttggcaggattgaaaaccccatgggtctgttgctcacaaacatagcaccgtggagtggttcggaaatgctgcaatgcacaggtctcgcagaaataatgtttacacttagtaacaaccggattctggaaggtttggcgacagatgaaacatttgaatggtatttcctcatcatcgctttctacttcatagttttcatcttcatacacaccataacggccctcatcgagcttccgttctatctgccccttgtgccgaattcttgg

SEQ ID NO: 1487 - DNA, 542 bp, Rattus norvegicus
  Genbank Accession No. AI231547
cactcaaaattcttcagtttttacaaaactaacagggtggagtagggaagggagcagggaggcagccgcaggggtgggtaggcggagaggcaggctatgcttctgtcttcacctgagcctggttgcctgccacattgttcggctcacccttcatctcagcatcagtgggatggtctcctgcagccacttctgtcttggccttatgttcctcctcagccagcctctcaaacatgttggcatagagcttcttttcccgggcaagctgcctgcgggtccgctgctggcacacagccagctgggtcttggcggctttgttgctgggatagagctgcaggaccttttggaagtcagctcgtgccaggtcaaagtcattcacggccaggtgtgcctctccccggcgaaacaggcccttctcattgttgctgtccagctccaaggccttgttacagctttcgatggcagctgagaaggcctgcagtttcaggtgacacatggccagattgagatgtgaggccagtcggagcgcatggaccttttgcatt

SEQ ID NO: 1488 - DNA, 561 bp, Rattus norvegicus
  Genbank Accession No. AI231566
  misc_feature (1)..(561): n = a or c or g or t
caaggataaaataagtctttatttatattcttatagtaaagggggagccttaacttgcagggagattcttgggcagtatgtacaacatacttttatttccacggaatggaatcaacaccgactgagactacaaagtatacactaaaaatcagcaaatgctggcaacagagtaggaaaaagacaaagaaatgaagcctaaagacgaaaaacccttcactgggatctgctgaccacagtcagagccagggccggatcacacagtggcgacaattccaggacaggaggaaggaaggagggctgggctgtgggtttagtaccaggtaagtcgctcttggtgtttacatataaaaaagttggctctgtttcttagaaatacacacagaagtgaagatttgatcattactttatgaatctgtcgctttacaatatcgacatcatcaaaaataggggcatttcattcagattcaaatttcagtagcaggaaataaatatcaaaacatcatcactggcccttaatacaaaacctntaccccacctacaacttcctcccagcccacccac

SEQ ID NO: 1489 - DNA, 553 bp, Rattus norvegicus
  Genbank Accession No. AI231615
ctaaacagtctttacttctgcttccggctgtacaatgcatacagtatcatagaactggccactaggattcaaacccactagaacactttccatgttaagtggcaacagcagcatctcacagaaatctgtacatacatatatacacagtccacattcaaccatttcacatgtttttcagtacacacagttgcagcatcattattagtcacgtgtctaagttgttgctcgataaaaacccaagcccctgcctagacagaactgcagcagttgagccgatagaattacaatgtatcatgtatcgtatatatgtcggttgcagagagatgtacaagcccctaaaaaacagagtccacaaatacttttgtttttttttttttcaatgctaccacagcatcatgttgggcgatatcaaaacctttaccaaccgaatcaggtgattttttttttaatttcaaaaaaaaaatcttctgcttaccagaaatattcttgatgaaaaaaaattacaaaaatgaatgttctctttaaaataattcacactttttaagattccaat

SEQ ID NO: 1490 - DNA, 411 bp, Rattus norvegicus
  Genbank Accession No. AI231724
aatatgaagtatcactatgtagccctaattggcctgggattcactgtgtagactaggctgttcttgaactcacaaaacgctaagatgaaatgacaaaggctattagcaaaagggaggctgggggtgaggtgggaatagaaggtgtgtcttccccaagcttcccaggtcaggagtgtcaaaacagcagtgtcttcctcagctacatatgacaggtttatctcggcaatgggggaaggggtagaggactggggtgtgcatattgacaggacaatccataggagctcaaggtttcaaggattctaattcgaaccggtgaattttgagaggaagagactggatttacatgtcggacagtcaaaggctgaaagtgccccccacgaggaattcatgctaaaacaactggatggatgt

SEQ ID NO: 1491 - DNA, 635 bp, Rattus norvegicus
  Genbank Accession No. AI231778
ccctttgtaacgaaaggctttattgctacctttaaacaccccgtgtatagcacatacaaatccccgtacagagagtcgttcaagcagtaatactgaaaaacatgaacatacacaaaaagattaaaaaattagacatttagattactagaaattttccaagaaaaatttaaaatgtgaagtgctttttagaaactacactacacacaccagtgtaaatttggtttttattaacaatcaacttgaaacattgcatttaaatgtgcaccagttacgcgccttcatcgctcactccccacagacaagtgcctttgacctccctacgctttgggctttccttgagctgcattatttcaaaccagatttgaacacggagtatttcaaatatgcatgtgcatttaaccacacccacaagatcttaaccctgcccacacagccttaactctcctgtcacttagacatgacccaaggccttaaactatcctatcctcaactgcctgagcctgcacatctgtgtccacttggacacacccacaggtttagaaactaagcctacatgactgaagagtgtaccgaaaccagaaaggagagtcagagaaacctagactaagaagagaatgcttacatttccaggaaat

SEQ ID NO: 1492 - DNA, 710 bp, Rattus norvegicus
  Genbank Accession No. AI231787
gaacaaaacttttatttacatactgtatctagaagcagatacataaatttttatacaattgatttccaaaaaaatgtgcaagaaattactataattcacttacaaaccaaaacacatattaaattggtggactttggatagttcattctgtggtgttctcagtacaaacagtatacacctgatttgaaacatacaaagtgtaaactacagcaatctagattgcaggttttaatttcatggcacattaactatgagacttccttaccccaccatgacaatatactgttaggaaactctaagatcccatctcatccttgctggttggagaacttgcatcacctttcaaaaacaaattcattatttgccttgttacatcatgcctgatcaataaaaaggatatgataaaaactttacaggactaaaacagtattaaaagaaagcaatttttattatcaatgtaccaataacgttagaattttagttatttgtggaactggttattgttcctcattattcaacaaaactgtctattgctggtagtgttatttcattttctaatgaacacttcatattcaatgaaagacattcagatataaatcaaaatgttattttgattcattttaagtttctttcacatacaatatgaaatgtgcattagagttggcatttctgaaagcagttagagatgcttagcactaggaaagaaactg

SEQ ID NO: 1493 - DNA, 664 bp, Rattus norvegicus
  Genbank Accession No. AI231792
ccccctccccgaaatgtaacaacattaaagccattccaacgtagatctatttctacggctccttgcatatctcattgtagctgaagttagatgtttcagtaacgaaatgaaggttatctcatcaaaatggtggcacatctcaaagacgggtttcttgttcctgtaactctctgcctatccctcaaaacctaaaaccccctacggtccagagctaacaggaagacagcccacagccaaggctaaatcaccgtacccatgcacagaaagggctcccaaacaagcagaggggttagacttctggaacgggcaacttgtttatttatacgggtaagaatagggaagagaagcccccttggttagcgctttgcctccaccccaagttactgcataccaagcggctatgaataaagacaaccagctgactgcaagtcccgcagtgcatgcatcttaaaaagtctctacaacgcggaccctagggagccaccgggttgccagccgagtctgctgtgctgctggggtttggaggcgtggcggctttggcttctagctgttggctttcagtttgtggatcttcgttttcaggacctttcttatccttgtcggctgccacggggcccatgatttcctgcagtggctgctcgggctcaaggttgctgggctggaa

SEQ ID NO: 1494 - DNA, 651 bp, Rattus norvegicus
  Genbank Accession No. AI231798
ggccatttcgggagtttatttccagacggaggaatcggcgaggggccgcctgaaaatcacaatctgtcatctgccccattattcattggcagatgtgtcaaggctttagggtctccccaccaaaggggagattctgacacagtcaaagacacttgtccatcaaatgactcacaggacctctctgccaatcctggcagttagactggggtgcccttggctctccctttagtctcctgttttgcagggtagtcccaggggcgcattcgagtcctctccaggttcaggagcggctcctcgacgctggtatccccgtttttctgtcgctcagcgaggatcatggcccgcagcagaggtgggtaggggacaaggttcaatctgtcctctgctttcccagtgaacgcagtgaaagcctcctcctcgtgcttgggtaccaaccgccaatcgtggtacatgacttgctcgatttcccgagccgtttcctcactcttccctttgaaagtcaggataccccaggccctcccgtggtccaagttctgcgccgtgtagtcaggcctcacacgcgtgaggcgccagtagcatggctcgtcgtgctgccacagccaggacttgcgggtaaccagacgacccaggccaaacaaggggaagcgggcg

SEQ ID NO: 1495 - DNA, 703 bp, Rattus norvegicus
  Genbank Accession No. AI231799
ccaaagtcagcgctttattctctgttctgtcttaggtgttctagtttgcaagcatgaaggaatcaactatagtgctcccccttaacgtccttcattaaaaaaataaaacaaaacaaaacaccgcttagctggtctcccgctttccctaaagaggatgggatagaaggtagcctaaaggaggctggaggactggagtcgcttggtgttaaccatcatgtctcctgccagctcctctcactgagcagccagaggccgcaggcagctataaatagcccagcagctctccccttacagcgagggaatgaacttggcaacaacaaagagtcataaggggtgaggcaggcaaagactgggagcctgtttgctgctcaccccttggggatactgtgagattcagcagacaaaggagctctccctgccttctcctccagccgggaacacgcagcctggaagggccaggaagaacttacttcacccgagttcacctgagtgccctcgtcagcaaaatgagagccagagagcagggataagtgtcgaacccaggacccctgttgaggggttccaggatgggcggtgcccccagctcccagacagtaaacggcactgaggagggacagacatccttccatgtcactcagttcacaggacagtctctcgaatgacaccaatgaggctgtgtggccgctcagcctcagctcgctgc

SEQ ID NO: 1496 - DNA, 712 bp, Rattus norvegicus
  Genbank Accession No. AI231801
gaacacatgcccggagaaatgtttattgtactagaatgactcaaaacatttggctcttcaactccagtgaggatttcaaacatttacctattaagaaaccgtaaacactctcaagacaaaatttgaatataaacttttttctagaaaatatatgcacataggtatttcttagaccatgtgtagcccactcttctcttggtaatcttcataaaagcgcctcagtgactccgggattctgggtgtcacaatgctcaaggcttgagtgaaatgcctcttcataatgcagtcagctttaatgttttcttccagagctaggagagcggcctccttgcagactgctatgatctctgctcctgagtaggtgtcagtttggaggaccagttcatccaggtcaacctcgttactgattggcattgagtggaactgcaagttcagtatttcccttcttgttgctgcatccggtaagggcacataaatgatcctgtcaattcttccaggcctcatcagagccttgtctattctatctgggcgattagtagctgccaaaaatgtcacattttttagctgttcaattccatccatttccgttaacagctgagccaaaacacgatctgcaacattcccggcacctgaagaactgcccctttcaacagccaaggcatcaagttcatcaaaaaagataatggaaggtgccactgctcttgctttacgg

SEQ ID NO: 1497 - DNA, 624 bp, Rattus norvegicus
  Genbank Accession No. AI231810
gggggattgtccagcttgtacaaactggatgtagaagcataaacatagtacatttctaccatcttcaacaaaaatagaaccaatatgtacaattattgtattaaaaatacaaaagggatacagactccaccaatgtctttctaaaagacatacaggtacaagtggtatcaaaagtatgaggaaatcaccagttaattttacattctgcacttgacatcacagagcgaactgagattagcagtcctatgttctacaattacttaatgtttagataacatctgtgcaatttgtggtagagctagagttttgtctttctatatgcacatgaggtccatagcctatagagtaaaactggcaataatgcatattacatgtaaaattacaaatgcggaagtgacaatgtgatacataagtagacgaacgccatgacatagaagagaattattaaataaagcactgacattgtttgacacagtgaaaaaacactgcaattcgacctttaaaatttgaagctatttacgtttatctactgatcaatatgatcagctgaatttaatggaaaaaaatccaagatcagcagcccctcacatctgagtactactcggattggcagccttcactttt

SEQ ID NO: 1498 - DNA, 657 bp, Rattus norvegicus
  Genbank Accession No. AI231812
cttgcggccgcacaactttttttttggggggttttttttttatgattacattggattacattgacttatttgtgcaggagggaactacacacacgagggtcagaggacaacctgcagagttctcaccttgtagtgtggtcagggtgtctggcttagtggcaagggcctttaccaactgagccatcccaccagcacagctatgattatattttaataacaaacagtaaaagccaaattgcagccagttgttaaaattcttctttacaaagatttttttaatggtccatcaaaatcagttgggagcttacatctgagtgaatgaccctgcagcagcctttcccaccaaatgcttgtaacaagtctaaactccaggagacactaagcaggcctctctcctgtctgtggttgggattgccaagtgcttaacactagagctctcacttgtgggtaagagaaaaggcattctggtccatcagttcccctactcgctcctggagaacattaaccagttccgcaatgacaaagacatgtgtgtcatcaatgtcttgaatgatgaacttcttccccaaggcattggactcatccaagtacagcaaaaactgcttcatggcgggatcgcattctataagcactcctttcaagacgttgaccatcttt

SEQ ID NO: 1499 - DNA, 589 bp, Rattus norvegicus
  Genbank Accession No. AI231822
ggccgcacaacttttttttttttttttgtttttttttttcgggaccaatacatttattcgaggagatgtgtctatcttaccacgaggggaggactaaatggcggcctatgtgacctgtgcgtaactgcacgggtgagtgaaccttcatgcccagtgtcaccggcacagacaagaggatgaggggggacattctgaggagtcacacaggaggaggcgccgcccttgtgtcaggaaagtagtgttgagaacaagggcagaacgcagcagcgccagcccccggcccaggcccaggcttgacggtgccctatttacaaagcaggaggggtgcttccggctgactggcaggatgagctgggctgaaggtgcagggatgccttggagtgacctttgcctctgcagccttcctctgcccgtgtacaagatggagactcaaggacctctgggcaggaaggggatgccaccaacactgttctcccaggctcccccaggtgacccacctccaccagcccacatgtggacagacacatgaaaaatatggacacgaagccaggctgtgctggagtcaccctcaggcgtctgagatgatggg

SEQ ID NO: 1500 - DNA, 588 bp, Rattus norvegicus
  Genbank Accession No. AI231827
ccacctgatcaaagcatggggtatttaacagtattatacataatatttttacatagaaaactttacatagcatttcatattatataattctgctttattctttcaaaaatgtttacatccattgggcaaggaatgcttttcattaaattactgatattaaatgcacttaatcattgtgtatagatgaaatcaaagaagctggtaaccaactctgagacggttttaaagagcaaaaacatacactttgcacataaagaaatgtttgatgcaaatatgcaagataaaattttttaaaaatcagaacactgagaagatccacacattcaaagagtgtggttttctgagagtgagggtttgcagaggaatcgttcggggctgctccccaaaccacacagctgcagtggcacagctccaggtacaggtgagccccgctctatctgcctcaccacgagccagacagttcagagggatccagtgcctactgcacccagcatccatgagcatccacaaacacctgagtggggcggccatacctacatgtgtcagcacgttcttttaataactagaaagaccaccaaatgtacagcc

SEQ ID NO: 1501 - DNA, 637 bp, Rattus norvegicus
  Genbank Accession No. AI231846
gtcacaaaacatcattttattaattgattaattttttttttacaaaaataaacaatttcatgaacaagaagtacaaaagcttctggatatgcacactccaggagggggagagcctggtttcggctgcttggtggctttcactgaaagcaaatgaggcagaaaggccccgaccctacccccaccccaggtcctggctcaaatgcaatctgctcctccactctagtcttggctcatatggatgtgtgcactgctgcccatgacctggggctggctgaggagcaacccgtagggagaggccagagagccttcccacggctggctccctcacatcttggagcattcccccggcgatccatttggagctgagctgagagaacactctgtgactgactgtccccgtgcagctcctgcccactgtggcttatgcagcagcagcagcagcagtgtctggctacattctcaaactgtgaatgcagtaatggggctgcccatgggactatcccagttaagaccagcctgagccctgctcacagctccagagaggcaatcagatcccaaccagtgacgcttaggctgggagcaacagtcttagaccgaaagctggcaaactcacattttaacacttttgcatattgca

SEQ ID NO: 1502 - DNA, 481 bp, Rattus norvegicus
  Genbank Accession No. AI231992
ggctccttctataatggggggggggggggggggggggggggggatactaatgtacgggaggagagctacaggtggtgctaggcggctgaatacggtatgccgttaaaaggatgaaaagatggaaaaaatgagataggagcgcaaataaatacaaagaacatacgaggcggtgggcgatagagagggacgatacaggaggacccagcgaacccagagcgataaggggatatgagaaatgctaggggtggaagctagaaagagagagagagagagagttgggggatacaaataaaaagcttatgaagcatatacaagatgatgagaggcgacagatattataataagttaaaggtaacaacaaatagatgcagagaacgcgcaaaacctgactggatggaaatgacgtacatggcatgtgcggtaagggagcggagatacatagcgaaagtggcagcatagaggggcaataaaaaaggtggcc

SEQ ID NO: 1503 - DNA, 604 bp, Rattus norvegicus
  Genbank Accession No. AI232014
ccagaggagcttattgtgctgatttattatacaatgcagttaaaaaaaaatatctttgaggttggcctctccggttcaaagtgcagaactagaaacactgggtgttgacaggatggccgcccacttgtgcgagcgagcactggaagcagggtttggagaacatcaacccatttgctcctcaggggaagccaccttctgagctcccgaggcatgcactgttaactggcattcagttattcagcgtgacaaactttgtaatggcatcgtaggaccaagatagaagaattcctatttgccagacacacacaatgactagaaaaggagaaatacccaaactgagtgtcactccgctgaaggaaaggggaaaggcactgtgtccctctaggaacacatggctacggcatactccacatgctccagattcaccccattaaacacatgacaggaacttaacttctaccacgcacaggtcacgggtggcttgaaactccctctgccctctgttcccacccaagtacagacaggtattaagatagctcttggctttatttacaagttcatcctcatgtttccatggggggtgagaaactgtcaaccaacagtt

SEQ ID NO: 1504 - DNA, 650 bp, Rattus norvegicus
  Genbank Accession No. AI232021
gaaaacaagctttatttaaataaggatttaaatacattacataacattaaaactggaagggaaaagaaaaccaaaagaccagtttgttccttcacatggcactgggcagtggcttgtattgtgttgaagcctttatagctagccataagaccaacagcaccagcttggtatttgttcccttgtcgtaagtttaactgataccaggctggccttacccttcatgtttcaacatcccttggctaggagagatctgcctaaaaaagactactgccctggtggtgagctaatgtccatgacttctctggaaaggtagccctttctggattctgcctacctggtcagacaccaggggttctttttacagccagagagactcaactctaatgatatagctggggcagttacccatactctcagtcacctgggctgttcaaatggtgacactcttctagggctggggactgtgtcaagggagtcccaaggaacttctggtcagacatagcctccagtgatttgggggttcttggcttggctgaaatcctgttatttattgctttgttccagggtggactgtcagggcttactgcttaacctgtttaaaatgagggactttaagactacacagcatggctcttttcagtttattgcat

SEQ ID NO: 1505 - DNA, 597 bp, Rattus norvegicus
  Genbank Accession No. AI232128
caaaatggaaaatgattttattggtcactacccataagtcaagtaaacacaaggataattagagagtggggaattcgggggccataaatccgcggcgccttctccaccggcgtcggaagctttatggcttgttgagttttattttgagagaaacgaatacatagttttggtggaagcgggactacccaccaagcgccgcgcgggcagacagacgcgcgcagcgaattcgcccgggactctggccacaattaaggatctctttgtcctagaaagaggggccttccccccgccgggaccttctctccatcgtgggatccgtgctctacccgactcggaaagtcacattcttcctcacccaaactacgacggagatagacacttggtgtgcgtgggggtcccgaagtttttaaacgagagattcattccactcgcagcttccaaacgtccacccggcgctgtacgcttggaaaccttttgttctaacttaaggggtgggaaggatggaacaaaagaaaaacaacccaccttactttgcaatcttccgcaaagagacttgggagtacttttcattccacaggggtttttaccccaccagcc

SEQ ID NO: 1506 - DNA, 566 bp, Rattus norvegicus
  Genbank Accession No. AI232184
gcttcattagatcacaggataggtacataggttttgaaagtgacaaaacttacttatactgacaatataaattagcagaaaatacttggcatattataaagtagcatttttctatttctattggaaatttcagtaactagtggacatttttttcatgatattcatttacatatgttttaatgaattcatatgtacatattagtactcactgaaccctttctactcagtgtgaaatgactaaacttgtagaattatagattttttttaaggtcctggtaataacaattagagtgaagggaagaattttgccaaaaccaatgatgcatggacccattaaactttataagatttttttaatatagtatgatcctggactacactgatttaacacatatttcagagtctttgaaaaatgcctctctcctgggcagaaatcctgagtgtgttccaaagactatttgcaccaaaatcgtgtaggtaaacaggcaatggttctcaacataggattagtaaaataaaccttcagagttttttcaaaccaaactgacttaagtctgagctggggt

SEQ ID NO: 1507 - DNA, 667 bp, Rattus norvegicus
  Genbank Accession No. AI232268
ccagtgacagatttatataatttcaatgtaaacttttgctgcagcatggagaccggtcatatctcattggtagatgtacccaaagccctcaaccagggcggtgacagctacacttgcttgaaagaaaattagtccttgccagccgcagcaggatcagatcggtatttctccttgccactgtggacagccacaccagtatgacaagttgacagttcccagtgtcttcaagagcctctctaggctactgccagtggcttctggtctcagagctcattgtgccgagcccttgagaccctgctggacaggtcctgcagatgcttcttcaccttgtagcccagctcctttgtcttctcctccagcaggacgtacttctccttgttgcggctgatgtgctcggggtcaccgatgctctccacgtgcttcagcttctggtgggaaatctccagctgcttctggtagtggttgtgcttttcgattttggcctcgaagtgcttaagctcctccctgaacgactccagttccttctcggtgaagttggcagactgagccaggtcccacagatctatcactcggggctcttcaaactcagtggcggggccgtagccctggtggctgaccttcctcaagcggtctaggccctggttgatactacgcaatctgtccttta

SEQ ID NO: 1508 - DNA, 625 bp, Rattus norvegicus
  Genbank Accession No. AI232270
ccactggggaaaagagtttattgtatggctgcagggatctactacagaatccccctggctgcagttagctgtgcttactctggacatatctccgaagacttggagcctaaatggttttcttcttttagagctttagtacccgatccatcagacctaggactgcacaacgtgagtccttgaaccaggctctggaaaaggtgcccagaccacccaatggggacacacagtgaggccagcccccagtgaaattcctgctgctacctggggcccttggtgagactctggcttccggctggtagaagccaaggttggacgcatagttgcaaagctcctccttcaggcacaaagtgtctatgcttctaatagaacagcagctcccgtgtcctggctgaccggagcacacaggctgagcgtgccacagcgacgacggaggccaagcgtggtgctggtggtgttactttcccgtgagttccagcaccttcttcaccatggccccaatcccgtcgtggatgtggtggagttcggtctcacacatgaaggccggggtggtgaccaccttgtttttctggtcgacgtgagcttcggtcacacccttcacacagtgcttggcacccagggctttgac

SEQ ID NO: 1509 - DNA, 576 bp, Rattus norvegicus
  Genbank Accession No. AI232295
gagaaagatttagctttatttacaaaatataaggatatttgttatctctgaacaaagaataaagtgtattcccaaaattctaagaagtttctgatgacccatgattcatgatggctgccattaattaaacagagtccactggaaacaaatactgtcttagaaaatttctagttttcattcatggaatgttgggtctgggtcttcttcttgctttggctgcttgctggtctcagcggttgtcatattcctgagtcctgctgcacaactgggcgtaggttacaacctgggtctctttgggtctccaggatgtagtatccttccgaagtctggagggtttcacctgggcgtacacaattccatgggggtctttatcaggtgggttccaactgtccagctctccattgtcctcagattgtgtgtttttcacagaagcatcatcttcagtgtgtgtaggagactggttcttggtttctgataccatgaggacaaggggatcacttgatttccaccacaaatgtggttcatttctaaaagagccatagcatctgaatgttccattgtggttgggagtaacag

SEQ ID NO: 1510 - DNA, 575 bp, Rattus norvegicus
  Genbank Accession No. AI232313
ctcagtgcacccacgtttattcccatcagcatcactcacttccagagaacagcaagggggccaccacgcctgacaacttaggttcagtccctggtatccgcacggtggacagagaaccagtttccacacagtctaacctccagacttgtgctatggtatgtttgtcccaccccccacacaaacaactgtgtaattaaaaaaaaagctagagacgatcatacttgtccagtttagtgggctgccaaggctccaggtgagatgaaaagctctcaggaacagtcacacttggcccacgccacatctggctgctaccatgcctgggtgctggaaggctatctgcctggtccacacccaggacgaagcaagcaccggctgacagcccccttctgtgagccagctacaggaaacccagggacagccccgagaaagcagaccgcattctcaggttcttggctgacaataagctttcagtctagagatgctaattaaaaatgacttgctggcgctagcatttaaaacttccatttaataaaagatttttcattctggatgaggaatttagaatccatataaac

SEQ ID NO: 1511 - DNA, 590 bp, Rattus norvegicus
  Genbank Accession No. AI232321
agatttggcttttgttttattttgttttgttatgtttgaggtaaggtctctatagtcctggctggcctccaactcggagatcttcctatctctgcattccaagttctaggattagaggagtgtgcccccatgcatagctgatttggcttcattttgatacttatttcaatattatctacatgattaacaggtaatcaaattttcctccagacccaaccaagagtaatgttccattcagttgtttcagtctggacaaaaaatttgttaccaaattcaattcaattacacacagtagaaatttgcctctcccaagagtgataaaaatatttcttttttaaaacaaaacagagccttgaagaatgaaactaccacacagacctcctatgcaagacacaaccaagtcgggggagcatttatcaaagcagataaatgccatcctgataacagactagaccggagttgtaagtgccatttgtcattaacccgtcttccattaacccgaagcctttggtttatttcttgtagcaaaccactcgtcacttttgtctgctgccattgcatcatccaacaatttgcttccttttggatcc

SEQ ID NO: 1512 - DNA, 558 bp, Rattus norvegicus
  Genbank Accession No. AI232326
cagtgtaaatatattggctttatttgtgtccattcggacgcctcacagacaacatccaggtaaaaagaccattaaataaaacgccttcagcgattgcaatgcaaaaataaatatcaatcctcggctgcagcggcagccgcgcagcgccccaagtcccctcggtcagctcaacaattataaaagtgttcagtgagagtgtcggcgtgagtgtgaaccggtatgcgctgggggtggggtatgcacagtggagcggtgtgcagaatcggagttgcgagccaaaggcctttgcagcggcgaccccgggcgagccgactcagcgcgggccgccttccgcgcacgctcaccgcagagttcgtactgggaaagagttaaaaaataaacatttacaagggcaaagaaagcggcttcccctccctggcgtccccggacgcgctccggggtcccggctgatccgcagccgggctacagtcccagagagtgaggggagctgatcccgggtagtcgtggccgcctggggcgcgggtcccctccggatgcttccgctgatgctcggcgctt

SEQ ID NO: 1513 - DNA, 562 bp, Rattus norvegicus
  Genbank Accession No. AI232332
ccaaaagctttgagctttattttacacagaaaataaaacacaggtactattcggttgtactgtaaacctgagttacattttaaacaagcctatttatcaaaaagttacctaaaatattttttgttgatatgaatagctgtaacggcatctgtcctgaccctatgaagtgtagattttaaaagttaacaaccatattaccaagtgataggccaaataaaatgcttgtgtacaagattacatatatataaagtgttgtatatacaacacgcacattctcaatgaggaaacttttcacccccaagggaatgaacattggctattttttatgtgcaaaataagacatagatacagtacataaaatagacaaagtatatcggtgagggtgcaggggaaacctgttctctctggtatttaagttacataggaattctggaaatgtagctcagttttacaacatttgtggactgtgactacacccagtatggcccacaaggcaagtatccttaagagtgccaatagttgaacaaagctaacccccacttcaaaataaaattctttacaa

SEQ ID NO: 1514 - DNA, 577 bp, Rattus norvegicus
  Genbank Accession No. AI232361
ggaatccattaaaagtgtttatttttacacagcaaggagaaagggaagtacatagtcagcctttggcacctttccagtctgtcgcccccatgtccttcccaatacaaagcactggcaagaggggctgcaggacagagtcacaaagtgagtcacaggtgggtaggtggggttccagagcccatctcagacccctcgtcctggagaatcaaagctcaggggcatagggctccccggtgggcgagggcacccgcaactcagcgtcgtgtctcacgactgtgaagagtcctgccacggccagcagagtcgtcaccatgacggccgagcagatgctgaacatattcctggtgcccgtcttccgatcgctgtcatggaggaccaggagccccagacaggccagtaaatgcaggggcactcggaaccaattgagaacaccggcctgctccgtctcggggatcactttcctccgcaggaagctcatgctgggaaagtagagcccgcaggccaactcgataagtaaaaaagcgataaaggattccacggggttttcttggcctgggctggtagagaacctcgtgcc

SEQ ID NO: 1515 - DNA, 489 bp, Rattus norvegicus
  Genbank Accession No. AI232402
taatcacacgaggaagatttattgtgagcgagatgaaacgagagctcaggccagcatgctggggtcgagactcatacaccacacagggagtagaggagttcgaccccgacctgaattttcacagagcttataaaggaaaaaaccacaaaccagggggatcaagagggagggaggaggggaattccaaaaccataaactgcccatacatttaggtcatatgctagtcatgtgtaacactaggcaacacacccaggactttgtgacattgtgattaggggtagtgacattttacagggccattggaccattgtggccggaggctatgggtcattgtggctgatccaggaaactattcatgcaagaatgttccaggaaccattgtacagcaagggaggggtgaaaagttcatgttcttacagaccctacttcttctttttgggtagctaggcggcttattattaattcttaatccttcattccccacttctt

SEQ ID NO: 1516 - DNA, 506 bp, Rattus norvegicus
  Genbank Accession No. AI232408
cccagtgaagtcatctttattgcatattgctatttaaaaaaatgtacagtctcatagcacacacgacacctttttttcccttggttctgtaacaacagtcttgcatctaaagactaaatgggtccaactactaagctagtaagatacgagacattgattaagtttagaaattataatgcttttctttttttggcattatttaaaaaaatctttaaaatacatactcaagagagaaaagtgactacttacaccagcaccagtctaaaaagtccatttttttttttttttgtaacaatggcacatgaagttacctgcacagtctttaggaaaataaaccggaagctgggaagggcaaaggtggcctaccaggagggctacatggaagtgaggaggattctaagaaaggcaaggggacatgcgacacagacttgctctctggtgtgagtctctttccacagttccaaaactgagctggaccaaacttttcctgctatcaatagaaaaga

SEQ ID NO: 1517 - DNA, 547 bp, Rattus norvegicus
  Genbank Accession No. AI232494
caaacatatttattatttttacagactctaaatgtactaatgatcctgcaatgcacactggtgtctgtgatgccaggttcagcatgaccatccaaaaggcacctgtctaggggaggcagctttctgaggggatccagaggagcagtggccaatggcaaatacctctgtgagcacactgtctgccctgtgctggggaagagcccccactatgtgtcgcctttggaccttggttgtgagcccctaagaatatttctcaggggattttgatcgacaggatcacactctgtggctcaagcaggcttgtaattctctacatagacaagcctgcctctgaactctcaatcctgctctccagtcttctgcgtactgagaatacaggtatacgtcactatgccccactcctagagaacagttctaaggtcaagacatgatcaagatgcccgtgacaccatggcagagtcatgccaagtttctgtggtttgaaaccttggatgtgagtctcattattcaaacacacagctgcaatgcaaaaggcaccagaaggcca

SEQ ID NO: 1518 - DNA, 648 bp, Rattus norvegicus
  Genbank Accession No. AI232694
cagagtacatgaagtaatttattgatattggttaagatccattatatacaggtagaaaccatcaaaattgtacaaagaaccattaagaatatagataccattttatagacaaaacaactggaaaatattttaaacagacaatatataattatgaaaaaaggagaacacaaattgttctaccagacagatttcaggcttttttaaaagtctgctgttgcagaacttaagttgaaaaaaaaatctgtttaatgtagtcacggggttttaaaaacattaggtgtaagataaaaatgaaggcttttcctctcacagtaaaagagaaaggagccaagataattttaccatgaatctatacagtttgaaaaataatttatatatcaagcacaaagaaaattgaggctgcaaatggttctgtaaactatgtatttatgaaatgcaaattgtgtcagctttagaaattagaagttggacagcaaatagtgttccctttacagtacactacccctccacgggctaccactgagcaccaaagctgacggtctgggtgctgtccaggcaagctatcctgaaagtaatcgagaaattaaaactagcctactatcatcagaaaattaggcaccaagtcggagactgtctcctcaaggatgc

SEQ ID NO: 1519 - DNA, 442 bp, Rattus norvegicus
  Genbank Accession No. AI232731
ccacagccacataaatgtttattcagagtatgagtcctagtctgggacacttttttgccctttgctcgggaggtaaacctaagcagagttccccctccaccccttttaagtcaacctcctgtccccaaccctttccagcacccaggagtcttttttgcttttccaggaccagtttttgcaccaggaggcattacacccctcccctcccacagggcagccgtttccaccaatgacagagtaacactctaatttaagtcagggcctggagttcaccaagagggggttctgaccttggaataaacccagcagcccgttgtctggggctggctccttaatgatcttctgaatctccttgaactgggggtgggcagcatccctaacaagctgcaaaatgagtgattcgctggtggacaggaaagctccactttgtctaatacggccc

SEQ ID NO: 1520 - DNA, 382 bp, Rattus norvegicus
  Genbank Accession No. AI232741
cagctgagtgtttaaaatttattgacgtgatttcccataaggatgacggcccagaagcactcagctgtgtcacctccaaacaggcatgtagcctgggagagtcccgttgctcatccacgctgcccctgggactcaagttacaggaaccgaatcccagctccaaactggacgccttcacaaatcctgtcgcctcgctgcacacccataggaatgcagtagttcagctccagccgagcaatgttgccaagccggaggacgatgcctgcaccataggaccagcggatgcattcagccagcttccggatgtgggctctggggccctcaccgttattgaggttgcacaggttgccagcattgaggaaaaagtgagttctgaaaagct

SEQ ID NO: 1521 - DNA, 450 bp, Rattus norvegicus
  Genbank Accession No. AI232948
ctgtattggcaatttatttaaaaaaaaaacaacactccagccaccacattttcttctctgtccatcatttcccttttagaggaagttacaaaagcatcagggggctttgccattgttataacccaaaccacgtacaagatcaggactgactcccgaagctggcagagtaaagtcaacgtaagaacgattgggttacagcaatacaggatcacgacgttgatttacagtgcatcggtggtgagttcaccagaggggattctgagccaaagactaaagtaaaagcaccctgcccgcttgcaggccaggagacccagtgcaagcgccacagcaacaggacaccaccacgcagtgaggcttttctggccctgacgacggggagggcgctctgcccgcccggcgaggacccggggccctcacttggagtcttggtccttctcatctatcagggca

SEQ ID NO: 1522 - DNA, 528 bp, Rattus norvegicus
  Genbank Accession No. AI232982
ctcattcagatcatttattgagaataagagtcaggccatctcatctctgtgacactgcaacaggagtcacacacatgctaaggaagagtccagagaattgagaccttcaacagtacagagccacaggcacaaaaatcaaaatacaaatgacccattcccccccaagtttggcaggaaaacaaatacagtcagaggcctgggatggaagggcacttacttttcaataaggcatttacaaagcagataaaccccattccccaaatacacgctaatgggcattccaggcagtagaaagcaggcaagaatggaacgcaggagaaagcagagggaggctttgtgttcagaggcaccagtggagggaaacaacccactggagatgctctactgtaagccccaggcccactctgcccacctcgaacatcacagtgacttttcttttacccaccacaaactggaagcagtctataagccaatgaaacaacggaaagacaccccaaaggcaccatgctccccgaggcatgagcctga

SEQ ID NO: 1523 - DNA, 529 bp, Rattus norvegicus
  Genbank Accession No. AI233024
ataaaccaaagatctttattcattcggtagaatactggttacaattaagtagagccatacattcccaaataaataccctcaaacagtacgggtaaaaggaagactacagagctgggtatttatgtgcatttgaaaggcagtagaacaatactgctgctcacccactctgcttatgagctctgctctgtctcacagcagctccgcaccaggacttccagtggtgctctacacggagggagtgacctaacactggatttctcttaaaaaagcaggtttctgttctgatttttctccacttgtgatggaagccagggcccactgagcgacacctccaaactcctcaggtttttataactttcctctcagattcacacaacccaacactcaccccaaatgccgacatgacttttgaactgaagttcactgtcacccatagggagacttttctacggcctttataatcatgtcctttggtttctcagaacatggtcacactttggactcatgtcagtgatgtctttgttcaagg

SEQ ID NO: 1524 - DNA, 549 bp, Rattus norvegicus
  Genbank Accession No. AI233147
  misc_feature (1)..(549): n = a or c or g or t
ggcagtttccaagtaattttattcagaattttgtgtttgtttcctgaatcaataaatactatacaaaacaatgtaaaaatggctaccattttctctcccctgctcccctcacctggggacaagtccctggacaacctcattcagggggttctccctgtagatttggtccagcaaatgaggccagccatgttttagccccttgactcacttttggagatttggctggggtaggaaagcctttaggaatgaggtgattaggttagggaaatgcattattgtttgggggggaaggagacagcgccctgggcanaaccctaccccaaagaaaagggtgtctaaaatgttcacggttccttctttttgcctcaaaaagtgacatttattcaaagagagagagagagaaaaaaaaaacaaaacaaaaaaacaaaaacaagatgtccatcccttggctcccttccctcccccctccagctgttcctgagccctgcccccaggactgaaccctgggctagggccaggtagcaggacagcccctcaaatgaggtcaac

SEQ ID NO: 1525 - DNA, 539 bp, Rattus norvegicus
  Genbank Accession No. AI233182
cttagaaagttactttattagaattttaaacagtttaggcaatgaaaccgttctaacagcaaatgcacttcctgcttacaatgaaatctatttcaattctgataatgacatgacaggtccatccaagtttcttccaacagaaaagcccacagctcaaaagttacggggggaaacatgactaagccaaaggacttcacatgtttaccacagaagtgatacacattaaaataccacataatactttctaagagaatcaagccacttgtgaaaccattagcaagcatggagactgaaacaactgcttaggcacaggactaactcaggcaccataaaaccctctgtcttctcacttaacaaataagattccctagagacaattatttgggtgcctgcttgtaaaaataaggtacttaatgacggaacggtttcttgatcatgatcatacttgggtaatctcaaggaatgaagatgaggattattagacatgattacattaacatgaaattctttatctatacactctgatttccatgtcctga

SEQ ID NO: 1526 - DNA, 602 bp, Rattus norvegicus
  Genbank Accession No. AI233191
ccgctgtgaattcacatttaatgtaaggaaggcccgccacaaagataagtcacccagtccacaccacaccgagtgcctggtggccctgaggaacagtcccaggcgtaccttgcaccagctctgcagacacacccgctgtaggagaatggttttttctgctggtccctgaacacagtcgtgaacatatcattgccctcagcctggagggcatattccaagtaacactggccaccttggtcataaagcccattcctggcacgagggacagggatcacaaactcatccactgtcttttcttggatctcagtgacggaggacaggtctaacctcagcctatctcatctccctgcacagccattcgtagactgagggcggacgaaggtggggactgagtggcttcccccctggtggggagaacacttggttccagtgtgtgcacatggctttggcttggaaactgtctttaatgatagcatcttttaagcgttagacattgagaatgcatttagcccacgatggggcaaacttggctgggagccacactggccacttacaaactaaacctggttattttgcatttctaaatgggcgggaaaaatgag

SEQ ID NO: 1527 - DNA, 537 bp, Rattus norvegicus
  Genbank Accession No. AI233220
ggtatataaactatttattaacagcaaaggcccaaagactcatttcttcttggacacacccacagtacggcccctgcggccagtggtcttggtgtgctgaccccggacacgaaggccccaaaagtggcgcagccctctatgggctcggattttcttcagccgctccaggtcctcacgcagcttgttgtctagaccgttggccagaacctggctatacttcccatccttcacgtccttctgtctgttcaagaaccagtcagggatcttgtattgtcgtgggttctgcatgatggtgatcacacgctccacctcgtcctccgtgagctccccagccctcttggtgaggtcaatgtctgctttcctcaacaccacatgagcgtatctccgccccacacccttaatggcagtgatagcgaaggctattttccgccgcccatcgatgttggtgttgagtactcgcaggatgtgctgaaacttctcggggatcactagggacatggcggcggcacaagcggcggcgtgtaggcccctcgtgcc

SEQ ID NO: 1528 - DNA, 470 bp, Rattus norvegicus
  Genbank Accession No. AI233311
gaacaactcttttcttatttattcaaagagactcttggagggtcctgcataacccttgtcattactccaaccctacccatattggggtacatccaaagttgaccatcatgtggccaaagctgtggttgtgggagctcattgtgccccagcccctggtttgtttcttcattgccccaaagtgacagtacagatggtctccagttcaggtgagcctccaggtctgcatccagcaggaggatggcctatcctcagagtttagccggcaggacctctcgccgcaccccgtctgcccgagggcaggatcccctcgtcctggtttcgggtcttgtgtgacttctgcatccaagcacgccactggtcgtacaggcggaagctaaggttcgagcagtacgcgtgcttcttgagccagccgaggaactgcttgagctcgcgccgcaccgggcccgagctatgctcgccgccccgcggtt

SEQ ID NO: 1529 - DNA, 514 bp, Rattus norvegicus
  Genbank Accession No. AI233316
gacatcacaacctgaagatatgtttattacaacccccatcccagcgcatgaggtcaacctgcagacactgaacatggaagtcaagggagtgggcacaagagttcctccttccaattcaccttcagaaatcttgcaggttaatagcatcttgctgagtcagagtaagatttgaacccaagaaaagctgcccctggagcagaaagaacccgtttccaaggatccagtagcagatcactgtgaattatggtcatttcttcttctgcacgtggccgcagtcatacttgccccctcacaactttgagtttaaccccaggcaggtcctgggtgcgaccaccctccacgaggaccacgtggtgctcctgcagggtgtggccctcgccggggatgaagcagacagcctctttgccggtgctgaggcgtactcggcagcacttccggttggcggagttgggcttcttcggcttcctgataaatgtgcgcaacaccacacccttcagctggggccggccctccg

SEQ ID NO: 1530 - DNA, 435 bp, Rattus norvegicus
  Genbank Accession No. AI233374
ataatacaaaggcatttattggatttgcttacatgatagggactaagtggtgtcacagcgccagagagctctgttcaagtcaccagcctgttgtttggagcatgtgggaaggcttgattggagctttccagtgcaggcactggataggcgttcctgcaggctgttccttccatccgggctcccatgttgccttcggtcaggtggtcgttacccatccactactcctgcatcactcctctgcgagtgccgctgcgtacccagagctgaggtccactagtccggttgacagacagctaagattctgttgttttccacagggtctatgtaactcaaacggctcggaaattccctgtacaccaggctggcctggaactcagagctccgacggccctgcctcctgagcactgggattaaaggcatgcaccaccacgcccc

SEQ ID NO: 1531 - DNA, 475 bp, Rattus norvegicus
  Genbank Accession No. AI233468
gatattctaaagcctttatttagcatcataacacttgttaactccaagacaattaacataacttactggaagctccctaaggccctttagggcaagtacgtcagtcgggttaggttactatgagatcaccccaattaatggggaaaagctactgtacagcaggtctccagtaccttgcaaactcagaatgcacaaggccttctcttacctataatacatgagtgcagcttaatttctctgtggcatttgccactggaagttgaggctaaaggtttgtcattagatagtgatattgattaaaatctattttagggcatttttgtgattttatgtttgaactgaaaaagtctaatgactgatcacaaatgtgaacgtaaatcacaaatgtgaacgtaaatccagagtgctaagagaagtaaatacctgctctggtttagaattttcggatcaggaattctgcccccacccttgtgcc

SEQ ID NO: 1532 - DNA, 603 bp, Rattus norvegicus
  Genbank Accession No. AI233714
actggaaacaactgttttataaatatgtggctgtatttttcttcacatccagcaaatgtattgaataggattcagatatattcttcccagactcacagagttccaagattttctaacacaaatttacatcagtaccaaaatgggcaagaaaatgaaggcacaggctcactctgtatcaataaaggaagtcaaacacagttgtgaggcactaatgacataagcatagaaggtcaatcaaaaataagcaagtagtcagagtcttcagggactttcctccctcttacatttggcaaaattcagtcttgatatttttaatacctcagagagaaaaaaataaataaataggagatggtgcattaaaaggtcaagttacctgtaattagtctttagaaataaaagagatgaaactgaaacacagacttctacagtcttagattacccttcctttgtaaggatcttgtgtgtctgtgtagaaatgccagctataactgaagatctaagatatttgctgacatggtccctcagtccttctaaaagattgtttcacaaaaacaactatcttggtttccactgtaagtcaaatttgattatgtaaaagtgatc

SEQ ID NO: 1533 - DNA, 574 bp, Rattus norvegicus
  Genbank Accession No. AI233743
agaagacaagtacgtacaaaacagtcgtgtggctgatcatcactttcaaaaattcgactatgttttttcaatagaagagttacctccagtttagcacatttttaggcatttggaatcttaaagtatgatttcaagtctgtgtttataatgactgagtaggaagtcagacaggaaaaagaaacatatatcatagataattaacgattatcattaaacagaagcccacattacttcagcttggattacttggggctaatcaacagaggctcacaaggctagctccttgtttacaacctgagcagtcattctattcagcgaaaggtaagattgtactaacacccatgagaacctgagcattttgggtcaagagataacattaaaaaaatactcaacagaagctaaagaaaacacaacttgtcaggaacaaacccttcagtcctgtacagcaaatggcctgaaaatgaaaatgtactgcgtaggcttccaaggttatgaggaaaatattgcagatttttcaatgataactccaaatacttgtccatgattgtggcttcaagaaagttttccagttgct

SEQ ID NO: 1534 - DNA, 611 bp, Rattus norvegicus
  Genbank Accession No. AI233763
aaagagaaaatagtttatttgaagagaagtcatcaggaaccagggtcttcactgtggagatctgcagatgcagtcctatggggtctgtgctcagcctctgtgagtgactgagagtcactccgtgacgagattccgttttagttatgcatgaacgctggaggaaaaccagtgagtccagacaggtgatggggtgtaccgacggctggaaagatgactgacaaacagcaggacggcctgcaccaggagctccggctccatctcctgacccggaagtaaactctcccctctgctcaaaggctctgtccccagtctgacccactggcaggggcgggcagctctgaggccccaccccttacccctgctctcttttgccaccgagcccctgctggacgccctcaccttcaccctctgcttcccactcgtcctcagcctcctgggcgtggcattcccactctgtgctgctgtcctcatcctgatcctccttacccaaaaggaagcttctgggggaagcatcctggtgctggcgggatcgggccttctttctctttcggagcatatgatcgggatcaggcgcctgctcctgccctgatggtggcgccaggctcacacac

SEQ ID NO: 1535 - DNA, 610 bp, Rattus norvegicus
  Genbank Accession No. AI233829
aatagaaaactttattttcaccgataatgttgccgtaacataatttcatagcagacctgtgcaaaagatcccacatcacaaatgtcaccaagagatttcacaacttcccggcaggacgtgtagctctgggcccccagtgttgacacccaacattttacccctttatgtagtagtacagagagtcgagacatcatgacacaagaacaagccgcatgaaggcagtgtgagctctgaggtcagacactcgccgtctctgaacggtcactatagtaaccacgtcttcgcctccatgtgctcagtgtaggtctttgctgttcttatctcttcagcgtggtaatgtggaggactggagagtgtcaactcatcatgagcccacgcaggactatggctactacggatggggtgaactcaacatactaagtccaagtttggcaaccatcagcaaactggctcccgcgatcaaacctgcaggcataaatttcccagagttgtagaatctcatccccataatgccagccaaagtcccagacgtagctaggaaaacccacacgttcctggggtcctgagacagctggtaggcacccaggcctgccaggcccccaaagaagaa

SEQ ID NO: 1536 - DNA, 511 bp, Rattus norvegicus
  Genbank Accession No. AI233870
gagaaacttaagtcttgggtacatcaaaaccaatttctgggagaggggaaaaaaaaacagaactcataatagaaaaaaaagttaccatcatctgggccacaacagaacccagagaatatattcttataattgaaaaattctaggtgcttcataattgaccttttgatacaaaatgacctgttgaatttgtaacttggttcttgaaagaggtccacagacaaactaggaagtcttcagacctcagctgaatgccgtgaggggttatttggcttttgactcttctggtttaagaggtagcagcagcaacagtgcccaccttctgggcagcttctttcttggcatgatgagcctgcaggactgccacagcttcatccaccttggaacggagggactcgggggactccagcatgtggagcagctcagagttgtcgatttctagcagcatccctgtaatttttccagccaggtttgaatgcattgtttggataagtgggaacaaacgctcccccag

SEQ ID NO: 1537 - DNA, 502 bp, Rattus norvegicus
  Genbank Accession No. AI233965
cataatatcttaaacgttttattccctaccattgacatttcgtctttcgtcttctttcagttttctacagtttccaacgtatatctgtatttaatactgctttattctgctagacattaactgactgctttcctaaatctaaggattatatagttttagtataaatatatatcacatattttcgtaaaattttgacaaaaccaaataagcatgccttgttttaagtccatgctctttctactgtttataaaatctgatttaatgatcaaaattcttggttgccactcttcagtcacacagtcctccttctgcactgccactcaactctttacataataatgagcaacagaaaaccaaggacattatggtaatcttagttctttcttttgacactatacgatgggaacttaaaaaaaccaaattcatccaaaactcaatacattcaaatgagctgagttctgccactatcaaaggccatagagttcattcttaactatgctgc

SEQ ID NO: 1538 - DNA, 616 bp, Rattus norvegicus
  Genbank Accession No. AI234095
ccctgcaatatttattaaggagtttacacatacacaggagaaaggcaaccaggcgctgtggttcccacacatgacatctctgaagcaaagttttcttgtttgaattttcaagtggagtgaacaacggccgagagaaagctgtccaggccctctgcctcttacacctggagaaggtgggcatcagcactcagacacgagggcacagagactggcagatgggaaagggaaaagagaagggacctaccaatgagacggcaagttttaaactgtaggacaacctggcaacagtttaggctgctgataaattaactcctctctgctgtaaacctagaactataaaaacaaaaacacacccagagcagatggggaggtggcatgtgggatccacacatcaacacgcacacaagcagttgagctctgcgtttcctctgaggggctgctcttctagccacagggccagatctggctcaaggtaggcagagggcggggaggggagatgtgtgtgtgtctgtgggggacattcgtggagtctctggtgctaataaaggctgacgactgaagcagctccagatcctgcagcactcagagtgagtggactgatatttctgcccatctt

SEQ ID NO: 1539 - DNA, 564 bp, Rattus norvegicus
  Genbank Accession No. AI234105
  misc_feature (1)..(564): n = a or c or g or t
gaaacttgcaaaacgaaaacaaaaacatcaatttcaagtcaggtttaaaatgtcttccctatcccctgctccaacaaaacccagccaagccagcaggacaggttacattaatacagggagatgaagtgaatggcgaaggacgagttagataaaggtgctgtagagatcacagagccaggggcatcactgactggcagtctcctccagagcccttggagggtagccaatctcagcagcattcatctggcttcatagagagaagcagggaggaagtgaagcctcctcaacccccacccccaacctcagttccgtttcctccttgtgtcctttgacccagattttggtcttactgaggcccagtgttccaacaatagaaggaggtaggggcaaaggactggaggtctagagcgtgggtatcttcccaagattcagtcctctgtgccacgggagacctttccagagaggtgagataccagatgtagctaatgagtgcctgggctatcacacgagagacccggcctgactctgtgcaggtaccattacgggcacggnacccatgcgggt

SEQ ID NO: 1540 - DNA, 424 bp, Rattus norvegicus
  Genbank Accession No. AI234222
aaacaaatcctattcagtagctggaaaagtcaattttctgtggaatgacaggaattacatagaagcaagcaattttattctcctcaaatgtagcaataattttaatctgtacatacataaaacaaacagtgcaattataaaaccttgaaggtgacatgcatactttaaggtgcaatggggatgggggaggacattagcatctccaactttccttactgctgttcttttctaggtccttacgcacaagcccggagtcaggaaactccatctggaatgctgaattaaaggtggacttcctgaagtctgcatgtttattatcacaaacaaaatggaaacgacctcttagagcagtttggtaggaactagagtaacatggctgggcttttaagctggaaatggatgagatcagggatgcactttctgg

SEQ ID NO: 1541 - DNA, 431 bp, Rattus norvegicus
  Genbank Accession No. AI234251
ctttagttttgcttttaatgaagaaaagatcacgacatggaagagggccaataaataaagtaatagtagactaactaattaattaaacaaacaaacaaaccagctgtaaaagaacatcaccaaagcaaggattgcaggcccatcacccgtgagtatggagtagagttcattcctggtggaaacccttcacgggcctcccagcttcgatcagcaggcagcaggtaggggtgctgctgggggcacgtcctgatttttctgtgtctgtgtcattttcgatcaactgtgtcatggggcttcctgtttcagctcccagttattcagggagaagctgatagacggtctgccttcccagccactgtgctgtgaagatcccaagatatgctcagcttgcctggaaagtcactttgaaacttagaaagcagccactgtaa

SEQ ID NO: 1542 - DNA, 474 bp, Rattus norvegicus
  Genbank Accession No. AI234283
aatccaaggacaaaggtttccaaattcaatgtctggagctgtctttgttagtcagagcttaagggtgcaggtttctcaggataaaagcatgatgtaggtaacagagaagagatggattgaacttcaagcatgatgtgggttgtctcttgttgctaaaatcaagcaggattagctcagcagcttggtagatagacctcagtacaggctacagaaaagcttcaagaattcagatatacagatgaacccaatgaaaaaaacaaccctttctcagtattctaaagcattatataaatctttaaaattcctatcactcacattttaagaaataaatttatactttggtaaggcactcctggaatacagtttagaaacagttacattttgagctagggtaagccatccctttgtgggagggatggtgagtgccctgcccactcagtctctcaggtctccatgaccgtgggggttcacctt

SEQ ID NO: 1543 - DNA, 395 bp, Rattus norvegicus
  Genbank Accession No. AI234326
ccagccctcactagctctttattctcttattctcaagcaggaagtgtgctctcatgctcgttccagttattcaaaagggaggaataatactttgaagttggcatctttaaaacaagccagattgatctgctttatttttaaaataggagctatggttaaaaaaaagaaaaaagaaaaaaagccccaagtgcaaagaaaatatgtctggtagcggaaatgctctgcggaggttcatagcagaaaagggaataacaactctctcttcttgtcctgggtatctatctccagtgatggaggattcaggcatccagagaggcatctgggaaggagatgccaaggctgtccaacaatgtctgacagacatttttaccagtgtgtatacaacctgtgatatc

SEQ ID NO: 1544 - DNA, 501 bp, Rattus norvegicus
  Genbank Accession No. AI234496
gaaggaagtgatcagactttggtttattgtaaaacttagcaaagtgtttcatataatccctgacccctcactctgaaaacaaaagcagaaacaattattgcttattttccccctctactttgtctgtgctactgtaagagaagggagaaagattattacaataaataaaaatagagatgtaacagagaaaaataaatcagtctagatgagaagtattaggagcaacagaaatttcattaagcagtttaaaaataagcttctttaaaaaggttgccttattaaaataaatcacaccaaaaatatagcagcagagaagaaggatacatacaagttaattgcacatcagtcccatgcaaaaacgtggatcattagccaaagcagtagtactcagaatccagcttgggatgcttgtgcagagcttgagagtcctctatgatagagctgtcactgaactgatccaagtctgaaggggtctgatggcctggtacatcatctgccaaa

SEQ ID NO: 1545 - DNA, 481 bp, Rattus norvegicus
  Genbank Accession No. AI234664
acaatgtaaaaggaagaattttattgtggggctctcaaacctcagcgactcaaaagcaaaaaggaaggaaaacaacattctctaaaaagccattggtggttaacgagagtgaccagtactgtcagggcagcaagcagagtcagacatgaagctgttgtgtgtacaatgaacaagctgccttgtgtttgggaaaaccagggtaaaccataagcatatacagcgcatactttagcaacaatgatcttctaaaacagtggccttaggaaatctgctctggcaagagctggcagcggctcccgtggagaggaagtgaaaaggctgggcaaacaaacaagggctgctggcacgttcaaagcgcaagggatagttcatagagcaaagcacagtcctaagtaaatgggtttcaggcaatttcagtgttaagataacatcattaagagtagaacagattgtgctcaaaccctgctgtttataattaaca

SEQ ID NO: 1546 - DNA, 349 bp, Rattus norvegicus
  Genbank Accession No. AI234748
cacataatcacttccctaatatacatacaacagaacacatttgtaatatttaacctgtcaaaccttgcctgggacaaacaagattctcagcatcgtttattattttacatatggataaatacagttctcaataattgccatgaatcaggactgttgaaaaagaaactgagtacattccgtctggggttatgtgtacttgtttatcttaacacggtcttctaactgttgatttacaagtgagtgtataactcatctctgggaggtcctgaaaagaccctgagcagcttacgtggttatttctagagctcttgaaatctgcagagttgacatgagacctaccaccaccagc

SEQ ID NO: 1547 - DNA, 660 bp, Rattus norvegicus
  Genbank Accession No. AI234822
ccattttaaaattattttattttaaattaaaaaaaataataaggacctcacacaatagaaatgtagagattttgttcatgtcacgttgacactggaactattaaagtgcaagttttgtgttttgttttccttttgggtaattacacacacacacacatgtaaacaagttgcctggctatgattgaaccctcacctctagccaaagtttccagtttgctgaggacagaggtggctgacagcagtcatggcaacaccaatcacagacgagataatgccctgttagtcctggccccacagcaagccggacagttacttgaagtctcagaggccgaagcccttcacacactctcaaagtctctgagaaaaacgccaactaaccctctgctgggtcctggcatcccagaatcggaggcgaaagtcccagtcttagctagttctttcctctcacagcagatgactgtcccttactgtcttggcagcatctccctggtgcacagggctgggtctcagggagggagggaggaggccagctggcgctcttggggcacggagtgcacaggttagcctgcgaaaccgatttgacttttgaacaaaaaaggtcctcaagttgtgtggctgactgaccctgggggctcctaactgatgacacagggctccttg

SEQ ID NO: 1548 - DNA, 694 bp, Rattus norvegicus
  Genbank Accession No. AI234852
aaagggatgcaaaatgaaccatgtttatttcccgcaataatttctgtaaattattacaaagacaaaaaaaagctaaactacagcatataacttctcaatatttaaccagaatacttgtaataaatatgcatcctgacacaagaagaaaggctacacttcgtcaggcatcctacaaaatgtctcaagtttacacactgcagcatttccgtgtggaggcacaaggggaggtggcttggtcatttcttaggttccgtgcgtggcaaatcctttcacatttctttgggggcattttgagaaatgcttaaccgtgatcgggcaacttatgaaaagtattgccactttagtcctgctggtattgaccatcacctaagacagatgaacacacccaagtcagccaagtggcctcagagccgaggcagccctgcagtcgatgggccctgtcagagtggactctacttttagtaacacaccagaagttctttatttcatcatcggggccataaagagaagctgcaagtaggtcaaacctttgtaacctgaaaggaaagtcaacaggcctaattcccccaggctttgctatgcaccatgctggcatgttgaggctcttactttcaacatggagaagctgactggaactgacagtcctttcaggaacgactcatgggcgagagtttggggcgtttacaaattcaac

SEQ ID NO: 1549 - DNA, 507 bp, Rattus norvegicus
  Genbank Accession No. AI234915
cggtggggtgctgtgcgtcggcggatcaggcggtcatgtggagcctccgcggcctgcgcctggcggctggacattgttttaggttatgtgaaagaaatgtttcctcgccactaaggttaaccaggaacactgacttgaagaggatcaatggattctgcaccaagccacaagaaagtcccaaagctccaacccagtcttacagacacagggtgccgcttcacaagcccacagacttcgagaagaagatcctgctgtggtcaggccgcttcaagaaggaggaagagatcccagagacaatctcgtttgagatgcttgacgctgcaaagaacaagatccgggtgaaggtcagctatttaatgattgccctaacagtggcaggatgcgtctatatggttattgagggcaagaaggctgcaaaaagacatgagtctttaacaagcttgaacctagaaaggaaagcccgtctgagagaggaggcagctatgaaggccaaagcggactagacgt

SEQ ID NO: 1550 - DNA, 559 bp, Rattus norvegicus
  Genbank Accession No. AI235032
  misc_feature (1)..(559): n = a or c or g or t
gagacatccaatgaaacaggtgttagacagtcttagaagtaaaagcatgcttcagttccaccaccatccagagtgactggttagtcaatgcagtctacttaggtttcagtttaatatatactttaaaggaaataacttaagaaacgtgtgagagagaagtgtnggngnntnnncnttttannnancccccaatttgtgggatttcaagcatttgaacatgtcggttgcatcccagagtataaaaacctttgcacttctcatttagactaagacaaacacttgtgaaaattggcgcaaaatgagttgtacactaacaaaaaagtttcaacttcttcactcttaattatctattccgtacaaaaaagaaaaaagaaaaggaaaaaaaaaaaaaaaagaaagaaagaaagaaaaaagcgtgagcgagttatttgtgggacttgttggttttgaaggaaacctgtaaaattttgtcccccaggcggtagccgttcagacttgctatggccattgcagcttcttcatagtttgtcatggtcacaaaaccaaaccctttgcactt

SEQ ID NO: 1551 - DNA, 572 bp, Rattus norvegicus
  Genbank Accession No. AI235210
aaaacgttaacactttattattattattattatcgtagaaggaattcaccaaaggcttcaaattatgctatggcatctttaattataaaaataagcaaataaaataacttgcatctgtcattaccatgatatgtttcataacttttatatgcacatggagcttaaaaatgtaatttaacaataaataatgacatataccagatatgctcactgtttattccagtactcagccaaaaacctaaatatcatttaaattataaatacataatgcaaatataacggcacaaaaatgttctaaagtgcaaccaaatcacgagagagatcatgcaaactggtctaggtcagcccccaaatcactctgcagcaaacatgagaaaaagcgttggaagttcaaggaggaggtggagaagggcaggcagggtgaggaaaaaaaaagaagcaaaaaactagcaacgttgtgagaactgcttctttccatatgtgtagatatatgtattgttgatacatataccaatatcactgtggggagaaaggagggtataacacagcttgaagaggtcacagcaacaaat

SEQ ID NO: 1552 - DNA, 624 bp, Rattus norvegicus
  Genbank Accession No. AI235222
aagataaatgtacagttcatttagagaaaaataattatctacaggtcagcaggactggatgtgtttcaacatgtgcctttacaacagcgacggtactaagacagtggtctggtgtgtgcgtgggcctcctgaggcatcacatgctcttaagccatatttctcatatcaaatgtaatgtttaaaagaggcaagagagttctgggaaagccagccattttgttcaaacacattcttttctctccaagtgtacacataaattgagaaggaacctggtgttctggcagattctagaacactcgagatcagttttgaagccacagtaccatcattctatgaacaagccatgttccatgtctcttgtgatgtgttctccacttggctgccttggaaactgaaaattagtgtatggtatcttgctttcttctaatacgctttgctagggagtgacgccatatttccaaattcctttagggaatctatctttttcttaaagctattcctatttctactcggatggccaagtaaaaggagtctaccaagtctagcatcctgaagtcatggctacacttgatcttagccaaaaggccgagaagcaattgaagtcatggcttaactgagttacac

SEQ ID NO: 1553 - DNA, 486 bp, Rattus norvegicus
  Genbank Accession No. AI235224
caccatttaagagaaagaaagatggaggaaaggtaaacagtgttcaggcttcagcttttgccaggggaaggcttcgggtcatcgagaccccaaggtattgccaggtgcacaaatctggattccgtggcaggcaggcaaagtgatcgctctggtagcccttctcagagcccatgaggatctgatctgtccacagaggctctccatggctggggtgtaggcgaaccggaaacctgtggcatttcccacagcgtcgaatcctttgagcatcttagtcatcttgatctcataacgctggtataaggtggtctcgatgatttctggggaacccatgaatttagcccttataaccaggtccgagttgcagaaagctgtctgtgggtgggttggggcacagctacaggctttactggaagctatcaatgatagcaacaagaggatgccagaggccagagatgcaaagggcgccatcgtggtatctctagcgtg

SEQ ID NO: 1554 - DNA, 442 bp, Rattus norvegicus
  Genbank Accession No. AI235277
gacagtggtggtgagagatttgattgagatgccttatggagtagtcgcattctgaataaagcaccacactgtgtcagtccgttcccacactgctgctaacacagctggtttgcttagggagtgcccaacttagccagatcaagggaaccccaagagagcaggggcaaatcctgcctctggtgccaagcctcagggcaggcaatcctggagaacactgccagccttgggaagcttgggagacctctaggctgttttcccttcttttcaaatcccacaatttcctgacggggagaagctgtaattagcccagaccaggcaacagatctcagctagaggtacagctgcagggaaaaccccatggaatcttgggaaccagtgtttttccaattacaaggaccgaggaataaactttttctgtgggttctattgaaaccctcgtgcc

SEQ ID NO: 1555 - DNA, 619 bp, Rattus norvegicus
  Genbank Accession No. AI235282
cttgcgggcgctcactttatttttatttttttttttttttttttttttttttttccttttctttttttttccttttttacaattttatttataacaatatctgtgttatttagttgtaaaggaattcagcaaaaattattaaaacgttcacgtccccaaaatggggctgcccacttgcccttccttggtgtgccccaattcttcctggccctcaggggaggggagactgggggacagttaccaaagaatgtgttcagccctaggagccacagagggggcactggagaggcaaagacctgtctggaagggatactgagcatggccatcccagacgtgcccctaaaagtgggagctggggcttggggtgacttccctcaactaaaaaatactcctacctcagctagagccagatattccagacaggttcagagagaactccacctccccagaactaaccccaggaaaggaaagctgggacactggagccctgttgagtgtcttgtacaggctagaggctgtgccgccagattcccggggtaagggaacgtatgtggactccttcatacctttgagccacagagccctccctgccccctcaaggcagcatggggggagggga

SEQ ID NO: 1556 - DNA, 439 bp, Rattus norvegicus
  Genbank Accession No. AI235284
caagggcagaactggtttattctgatccccggccccgccccaccctccggcccgaccctgccctctacaggcgacccgcgtggattctgggacctggggggcggggccggggtccaggcgatgtcatctgggtcgcaggtcagtcagcctagacgggggcggagccgccttcccgaaagcacaggcgccgcttctgataggctacaaagctggacacagcccccgcaagcgccgccaggactgcagcgaccacacctgggattaggccctggggctggccttccgactccgccccatcagtaccgcggtcccccgctccgcctcctcgtcccccatgtccagccacatcctccaggtctcggtcagagattcctcctgagtctctgggtggcccaggtggtttcggatcaggcttgggccggtttcctggcctccgggg

SEQ ID NO: 1557 - DNA, 481 bp, Rattus norvegicus
  Genbank Accession No. AI235313
  misc_feature (1)..(481): n = a or c or g or t
aaaaaggaaatgtttattgttgtgttacaaggtgattataaactcctctaaaaaaagcaaagatggatttaaaatatcaatatacatattcatctaaaaagcaaaagagaaaaaaaaaaaccgaaaccctgcaaaatgcggggtcgccgtaattaaacatacacagagcttgtatactgcaagacaggtcacacaccaaggatccttcaaacacaaacgctcctccccttcttggttggtttcaggttacttcctgcatagccttgggctacatggaggtcaaaggcctgcccatacaccctggctaaggctcttcacattagcagtgtctttggccctcagtttcctgtggtacaatttgaggggagggtgtatcaattcctagttcccgaaggcttcaaaggaggaaggaaggaaggaaggaaggaaggaaggaaggaangaangaanggaggaagggtannatggggctggggtgagc

SEQ ID NO: 1558 - DNA, 475 bp, Rattus norvegicus
  Genbank Accession No. AI235377
  misc_feature (1)..(475): n = a or c or g or t
aangagaaacatctgagttgtacatatcacaaatacttccaagtttctttaccaatccctggtggccaaacagctcaaccagacctgaagtgtctctttaaacatgaaaagtcttaaaaaattaaattataaaaacatccctatcaagtctgtagtttggcatttactgtacattagtcaaaagctcaggccaaaaatctttttttttttaaatccaagtttacattatacatacagattcagcgttgttaaaaaatatgcacaaataacaacatccatgcaataaaaatttctttagagattttttttttaaagcaatgtaaaaagagctgacctgggtaccaagtgggagattttggtttataacctgggacgtatagactactagctgattggnggaaatctcattccaagtatttaaaatgtatctgaatcaaccaatcagctcagtgcacaggagtttctgaaccattac

SEQ ID NO: 1559 - DNA, 530 bp, Rattus norvegicus
  Genbank Accession No. AI235611
tctcatgttgtatacaaaccaaacttgaggattacatgcaagcacagtttctgaataagatcaaaagggcacagtggggatcaaataaacggttcagagagatgaactatttttagcagaaaaaaactcttcttaggcaagccacacccagagcatctcattaccaggacaaccttggccgagtccactcttgaccatcacttgagcaagattagggtagtaaccctaaaactgaggaatgttcagcatgactgacaaacacacgtggtctgcctagccacgcttgaaattgaacttgtttgatgtgctggttactttgttacacctcacgagtagaaaatggtggcagggtacaatgagatgaagcctgcccctaccaggctcagcaactgtcagctaacatgacaggcaaagccaaagaaagggggctcatgagaactttggatctgtgtaaaataggagaccagatggctaatctcagtaagagacgctgatggtcccacataaagaaatgactgacttcccaggga

SEQ ID NO: 1560 - DNA, 442 bp, Rattus norvegicus
  Genbank Accession No. AI235738
aggcctttgtgggggaagtaacgggtcctagctaagtcagagaaagcagggaaacaaactggcatctgcacaccgtcttcaagtaaacagagtccctgacgcacccggagagtgtacttttaaggcaagaggaaaaaacaacccactgtgacagcttataaaacgcacgggctttggccctagagtctgttaaggcacaaaacctggtaggcagctgttgtcggtggcctgcacctcagaactggatttgtaaagaacagtaggaacatttaaataaaacaacaggccatgttgataggacctgaagtcacaggataaggtcgaaggggaaagtccaaagacgccggtctcttgtctgtgaaagatctgttgcagttgcttcatcaatgatcagtatccggtttttcttcagaattgccctcgcaaggcacactaactgtct

SEQ ID NO: 1561 - DNA, 528 bp, Rattus norvegicus
  Genbank Accession No. AI235874
acaacaatggagacactgtattgcgaaacgagacaaacgttaccagttccagtgaaaattacagagtagggtaggaagccgggacattgcaaagggcttagtttaaaaatacacgtctacgggacagatggcagcggttggagtagaaggaatttcggattccctcatccacactttcttcgttcttccttggtgatcacggaccatcgggtctctgtaagttcatattttcacagggaggaagtcggaagtagttggagcggcggagtcgccttggaggcaggcctgccatctgccggcaaagctcatctttcatggcctcgtgttctttacagacaagccgggaacagatctcattattgatgatgtacatgcgacgtaaactggtgaagcaggcctggtgcacacactgtctgacgggccgatggacagagtacagtcttgtacaagcaaacttctcatcccggcactctgcagtagtatttttgtcaccagctgaagccaggtcatccgtggaaggtgtgatat

SEQ ID NO: 1562 - DNA, 188 bp, Rattus norvegicus
  Genbank Accession No. AI235877
aaaccccccccccttcccaggtccaaaaatggtagaaaaaccccacaaaagtaggccgggccttatttattaggccagcccaaagccttcaaagcactcctggatggcccatagtagcatgtggcggagcttttcaaagctctcataggccggcaggtcccgttgattaaaacatgtgtgaacttaag

SEQ ID NO: 1563 - DNA, 507 bp, Rattus norvegicus
  Genbank Accession No. AI235915
  misc_feature (1)..(507): n = a or c or g or t
aatatatagctactgatgcctcaggtccagccaccaggagcatctcacccgacgggtaaatctctagtcacgacccttttagaaagacatgtaaatatatactcagatttatacactttgtgttttcttcatagctatgtacagagcccccaagtctagggctcagcccaagggcacatccctgctcccgacctctgactcactgtcttctggtaccaggtatttggtcagcaaagcaaattagtattggaattaagaagctactggtaccgtccatctggagcagaggttgccccaccttcggttaaggcctaaacagaaacctcactgcttcaggagccccaaggcccctgccaccagaacacaaagggctgatgggtcaacaagaacacccaggaagctcttgcttgcacgcctatgccacttgcttccactctggagacctcccagcagttgccaggcagcagggtgggtcttggtccaacacttgggaaggangaagtggcc

SEQ ID NO: 1564 - DNA, 670 bp, Rattus norvegicus
  Genbank Accession No. AI235948
aacagtttttttattattttctgcacatttgtacagctgtaaactcaaggaatcatccaatagttgtatacatctggagaaccattaataagcaccttcagtggtttccacagcttaagatttaccatgtaaaacattttagaagggatctagtaaaatgaataaaagttataaaagttgtatatcatgaggaacgtgacaaaaaaagcaaaaaaaaaaaacccaaaaaacaaaaattcgaggctactttatgaggttgcatgaaagagtcacatgttccctaaatcttgtgatttaaattccaattatgtaagtaaagactcccttccaatttaggttcccagtccaatgtaagcagggtgaggtggaggtaggagatagggttggagggctgactattggcaaatatgttataggctccattgctcttccatagaaatccttctagacctttgctgaagccaaccacggcaggtacttggttttcatccttcttcgagaatgttgtaaagaactgtagaccatcatcaggataaaggaaaatagcataggagctggaatttgaggaggccagaacagcctggaacgtgtttctcttgccttcctcaacaaggctcccactgggccctccttagggagccatggattcccaagtgacaaccaccacact

SEQ ID NO: 1565 - DNA, 673 bp, Rattus norvegicus
  Genbank Accession No. AI235950
cactgtcaccatttattaaagttttataaaaactcaggccacatgggagaaaaaaggtacatcccacaatatgaacaacactgtctagtgacttctcccccttgctctgtggcactatggtaaagcagctcctcacttcctacctgtcagacagcatggacatgttcctaaactggggcaggttgccttttctcctgagaaatcttagcagggtaaaagttacttgccagccagtctctctgtgtgagaaagttccttctaaatttcatcaactgagtagtaaggtttcttgaccaggcccagagacagctacagccctgctttttatctggtgtgcaacggccatgggcatgtgaggctttcagaatgtgcttgaccctttcctatgtatccatctcacttcatatctgctatctttcctgtgtccagacagcatgcagcccagtttaggaagacttgggtgggaagaggggttagaggcaaggaaacaatccttgtctcaagtctggtgcacttcatggaacatgagctcacgggggatggctgtttctgggccaaacttggttgctgcccggcgctcaaaggcagcaacgttctgctttacaacctcatcaaaaaacatggtcgccagcttggagtggagcagaaaacgaaattcaaaggaaatcgagaa

SEQ ID NO: 1566 - DNA, 586 bp, Rattus norvegicus
  Genbank Accession No. AI236045
cattattcctaattttaatttgctgctcagggccttcttaggtaagggcatcacagcatttcacagtgacaacacaatgcctctcagcatagtcactcacacacattcagaacagcatttgatgccagcactctaatcaataaacagttaatgaaatgtggtgattttgctcatgaggcaatgaaagaaatactacaagggtctgactgctttttatatcctgagttttcatacataagacttaatttttattaaaacaaaaattcatattttaaaggtttgtcaaaaaaagttgcttatctatatgaaactgagttaaattaagaattttaactatcacaaaataagttcaacacattaggataacatcaacaacaaatgttgaactgattcaggtgctacaaatgatatcctaaagaaggatgtgtctggtccccacggacaaaggctacgttcccaaagggaaataaaggccccaaggcagcccatgctcaggacatctccccagttggccctgctcaagtcaggaacatggcttatgccatgcacacaaacttatcctagccaacctggcggctgcctccta

SEQ ID NO: 1567 - DNA, 292 bp, Rattus norvegicus
  Genbank Accession No. AI236089
caagattatgtttatttgggggttagcagtggttaaaatagagcaagagggaggtcttttttgtatggataagaggactgtgttcctgtggcctggacgctgaccgcagcgatggaattagatctcttgagcatttcttccaaggacagacttgggtagtaagccaggtagaaggcaagcgctcccacaaaactgtcaccagcacccgtggtgtccacagccttgactgcttctgtgggaatgtgctttggaacaggttctgcctgtgacagtgtcactgctgcgggccatt

SEQ ID NO: 1568 - DNA, 612 bp, Rattus norvegicus
  Genbank Accession No. AI236146
atttaaatcagttttatttaagaatttccaagagtgacaactcttataaaaagcatccaagcacaggacacagaactgcagcaaacagcattcttatgaatagctaacagacatgagaacttccacccttctttgagacacctgagctcactggtgaactctgcttccaagttctcctgcaaagcacaccacaagctcagtccatgttcgcagcccatcagcttcagttcacgttcccacacttccagatcagtaacagaggagaacacacaccatacagcattcacagcagttgacagaggggagggaagtacaagtatttcacttaacacattcagctactgtgggtttcctaagaacaaaactcaaagtcttccaacagacgtggatgtcctctgatgcagaaacactcgtacgttagttatctgctatcattgctctctgcacactctcgcaccaaagccacaggattgagggacacatctctccaagttaaaaaatatccattttccaccaccaagtctttgcacgcgctctctccttttctcgctcatactagcctttcatgcctcggcaccaccatcaatcccacacaaggtttcaaaagttcaa

SEQ ID NO: 1569 - DNA, 447 bp, Rattus norvegicus
  Genbank Accession No. AI236152
gaaaaggaaacatacaaaaatcatgtacaaaaaaaattaaccaaacatgtacagaaaattcattccagtatatctacagcagtgcatgtacagtattttacaggctgggccgtccctccccgctcccagactcctccctcttctgagacttcccccctccctgactccccatcttcctccccagcgctttgccctggggactaaggctggggtggcttccgccaatatctcccaccccccaaatgaatgccagtggtcacacgtgctctctctaaacctatgcaatgggatggatggggactgggggagtggtcccggccagagcacaggattcacagtctggacccctcctggacacccccagatgaaggtgaggcaggcattgctcaccgtccgccggcggctcagggaagatggctgggcactgggttgaaaaggctttcacat

SEQ ID NO: 1570 - DNA, 379 bp, Rattus norvegicus
  Genbank Accession No. AI236175
caacttataagaggtttattggtttggtggagcattgatcagggtctcagagtctatagtagattcgccttggaagatgccaaaaacaaaactcagatcaggggagaattccaagggtgtgtgggctgtgaggcgggacagcctcggggccaagggaaaagcaagacgggagacaccaggagaagagaaagaacacgatgaattgggccagaaaacacactgtgccaggtcaccccgcacaccacatcttccctgtagagggccacgcaccttcttttccaggatgtgactcacaaggaccctgggtgtctggaggagccacctgaccgcaggcctttaatgattaagatggtgcccaccacgatgcccacgaggccca

SEQ ID NO: 1571 - DNA, 388 bp, Rattus norvegicus
  Genbank Accession No. AI236212
caggtcaacagtttaatccaaactccatacatttaacacacatacacatctaaaagatttatgacatgcaaaatgattagaacacccttacaatcctatgaagaaggtacaatacagacaaattgtatctttacattaagcaaccaaaccttaacaattgccttttaatgtttaagatcactagcattgaaggagaacgtctgcagaaatcacagatgaaaaaaaaaaatacctgctacagtactgatctttccccctcattattcaagtaaaaacctcacatcatccagttacaaaatcttattattggtaacatgtatacaggtataaaagtacactgtaagtttttttaattgtacccagtcaggcctgaaagtttcatggacat

SEQ ID NO: 1572 - DNA, 446 bp, Rattus norvegicus
  Genbank Accession No. AI236229
aaaaattatatttaatacaagtgaatagatgagaagatccgaaacattataaagcgagatacacaacacataaatagtttgcacaggagagccacgcctccattgcataccactgtctggtacgggaatacttaaatccagtgacaatggagagtccataaaaatgctaacctgttgtcccttgtatgaagttcttcaagtataaaagtccaatacagtgtaaaatagtattcaatttagtttaagagtaaaaattgcaagtatcacactttcagaaggaaaaaatataaagccgtcttttaaaactacatacactacacaaggaaagtgggaacatctgttcccggcagatgagatctgcagggggaaaacattcgaggaagcacagaaccggcgacgtagcttgtttaaaaaaaaaataaaagaaagaaagaaagaaagaaaag

SEQ ID NO: 1573 - DNA, 398 bp, Rattus norvegicus
  Genbank Accession No. AI236294
ggggggaggcagtcctttaatggggtggggcacaagatagcagaacttccatccaagagccacaggaactgaagccagcgtgacgcggcaggcttttcggtaacaatagttgagatggcacaggtgaagggttgggcaaacaattcagctctggtgagctctgccacgccccactgacagcatctggtacagactaactcaggcgtggaaaacgagccaaagtccagaggcaggagcccacaaggggaacctgaagaagggaggacagctcatcctgatcctcgatcgaagttttagggggcaccaaaacttcctggattcctgagaacacagtagcttccaactaacacctggtcagcaaccgtctgcctgaagacttccaccttgagcctcgtgcc

SEQ ID NO: 1574 - DNA, 522 bp, Rattus norvegicus
  Genbank Accession No. AI236307
aatacaaaacatcctaacagaataacttttaatataattaagtttacaaataaattttgttactatcgaataaataacattcacttgactcttaattggattattctctattagaacacagttattttcttcagtttattttaaactgccttatgatttcaaagaaacatcagcttttgcttactaaataattttttcagttggaaagtttcctgtgccaaaatacttgcaaattaatgcatttttctaagccttctacttagtcccttaatgacatcaactttttttaaaatatgcaactccaagatctttcatatacacaacaggagttggtttcaaatgacaggaaccatggaagacaggaaccatcagtgcacttagaaaactgatcaagcttcaactgtacttttaaagattctatcttctccaagctgtggaaatgttagagctcttcagtttccttcagcagaccccttgatccccagttagagacagatgcaggcaagttagtagtcctctttc

SEQ ID NO: 1575 - DNA, 575 bp, Rattus norvegicus
  Genbank Accession No. AI236332
aaaaaagaatcaaaacagaaactctaagtaccagtgtgtacattgtacacatttaaatgactcacaagaatgaagttttgtttttcatatataaagatgataccaccttgttcttcatcaaaagatgttcaagaattctgcctccaaaccacatacatgactgccattttaaacagaccgaatttcaaacatgcaacaacgccactggtaataaagctttggaatggatgctcactctattatttcactacaaacgagatagaaagccggcgagttggaaattttattctaaagcacaatggaggtggtcattgtctataccggcacacctcactcctctgctgccatttttagcaagtattctttgtcaatcttgaatagtctccatccctcttcactggacagatccgaagcacctcttcttttgtagaagttgatagatggttcattccactctgctaccaagaagtgcatactgctgcagcgacacttcatagcaacctggcttagattcttcaaaatttctgatcctataccaaagcctcggtaatcactcatcacaaagaagtcttcaa

SEQ ID NO: 1576 - DNA, 315 bp, Rattus norvegicus
  Genbank Accession No. AI236405
gagttatatgcaaacatttattgaattatttaactatgcaagatttctttccgtcaaggaaatcacaaaaccatggcatttaaaaacctggggtctaactcttcaagaggaagctaatttacttttaccatgcttgtggattcttgtagattcagtggacttccttttaacttttgctggcactatggagagcatccatgatggtttatattgcctctgcaatctgcttcatcacatttttaatcactggctggtaatcactctcctgactctgggttgctatgaactctttcattacaaaattattttgctcca

SEQ ID NO: 1577 - DNA, 321 bp, Rattus norvegicus
  Genbank Accession No. AI236473
atgctacgttcaaaagtatttttttttgagaatacaaaaagtaatccttggaaatgagaatatataacagaaaagagcacaataacttaagtgttaaacatctgtatgaaataacttgcaaagtttgacaactatgcacacatagaacatgcgggtgtttaaaaaacagaacaaacaaaaacaccacccgattctgtagaaccagcatcatttcaccagcgggagagcaccaagcaaggcaccattggaaagacaacacacttggaaagtctctataaataaagcaaatgctaatctggtcgaaaaatcggtgtctttggt

SEQ ID NO: 1578 - DNA, 509 bp, Rattus norvegicus
  Genbank Accession No. AI236481
gataccaattttttaataattacattgctagattattacatatagtcatgaggactctggggtagattgtctaatagtatctgatcagtgtgccaatgtggagttgtttttgctctgtaggaacaaacatgatggctaggtataaaactctaggcggagcacttgccctgaatattcaaagaggccctagagcgaacctcttccttctaaagaataaatatattagagaggagccatatgggagcaaatagaacctgaagtctgatctccatccataaccacactgagcctgttatctcccttctgcatgaaagtgaaaataaaaatattcatctggcagcatttggaggagtctcctaactgagctttcaaagcaacattaaagtgggaccctataaatgtatcttttattctcctgatttggcatctctaaggctcactgtctcagtctgctaacctagggctaggcctggaagtttgtagcctttatatactcttatctaagctta

SEQ ID NO: 1579 - DNA, 453 bp, Rattus norvegicus
  Genbank Accession No. AI236520
atcttgttttattattgatgtaagcatgtgtgccaaagtaatgaaggcaagtttacaatgtcaggattttcttagttcttacgcttatcatcgaccttgacgctaaacagcatttcaaacgactaactttcaaatgaatgtgtgcgaagcaggcctcggctaatgatgggtgctgttaatctgcattgagacatttcactgaaatcttcaaaagacaaggatagaagatttatgaaaaagcttcatagcctgtctcctggtcataagcctgagagagagaagaccaacagatcgttttataaaccaaacgggtttatatgtagttttcacagatgtggctgcagacctcttaataatgcatgagccatcctggctgtggttgtattaactatgcttaaagccctatctggtttcaaaggtggaagaagatacacattggcatggtagctggca

SEQ ID NO: 1580 - DNA, 526 bp, Rattus norvegicus
  Genbank Accession No. AI236590
tttttttattttttcacaaaatagaatactttttattataaatttcacatacagaagtacaaaccacaaataggagcctctcgattgacatcctcagaaaacctaaaatacaggtacaggagacactttcccaagggtgctttcaaatgctcaacatcaatcattgaaatgccccacgagctcgtgcaaagaggcctccattcctcctccagacactgaggggagacccattttctttatgactcaggaccctggggtgtgtgccctgagagggaccatgacattgtctctgtgttaaagaacttgagaggaatttgcaaaccgcactgctggggagaaaacaactgatcctgcagctgggttgtggggtgaagccaaactgcttctcctttttttttttaaatcttcagtttgctaaaggcccaaatgctatcacattaggggcctttctagactttgctttcaatgattggagaaaagagaggagaaattaacaatgccatcatcttttgtgggggtgggggag

SEQ ID NO: 1581 - DNA, 625 bp, Rattus norvegicus
  Genbank Accession No. AI236601
agaaatgacaccacagggtggactttattttaaagctcacaaggtgttcacaatgatcacatgatccacacgtctcccgtgtcacacctccacgggacagtgcatgtatggtgatagttacagccctgcttcgcatgctgctacggttcactagctgttgtattcttggtaataataaagcaaatcactctactggacagacttaatttggaaagcccttatgcagatcagactcagtctcatatgaacaaccccggccacacatgcggaaatgaagagcaaatgcagaagaacacagaaaaccccttggcaagaacagctgctgcagactgagcccagcgctgtcagtgcagttcacgtcctcagaagacaaacgacctccctcctcagcatatgagcagcaatactgtacagagctcagtggggtcccaactccacaggagcctgtcaccaaagtcactctcatttagggtcagagactacagactcaagctttttcttttttccctcataatacacaaaatgtctagacagtctttaaaaaaaaaaaaaaaggaagaaagaaaatataaatagactcagtctgtcatacagaatcacatacaatggcaaacacatttcatga

SEQ ID NO: 1582 - DNA, 550 bp, Rattus norvegicus
  Genbank Accession No. AI236613
aaaattgtttattttaaaacatgaaactcaagctgaatagagaccacagaaattacatggacaagaactttagttatttgccaagaaaaataaagttccccaaagaaaataaaaatcaaaccccaaacccagtttaaaaatgaaagcacagcaacagtaacacacagccatggccctacggaggctggaggggaacttggggctggctcgattcagatgacattgtccactgggggcagatgcaggcagagggaagtaactgggaggcaaatgtctcaaaatcatatacaggaggaagtgtgcagaacaccgctcttgtgattaaaaacaaagaaagagaccctggtcacctgtggcccaggagctaaccatccaccttctgggcccggcagagctgggacctggtagggcagacattggagctagggtcaggaattgcatagtgatatagggtgggagggcgggcactgggaaaagggcttgaaggatgctccaggccaggatctcccactgctcacataaactcgtttgctggggtggcagccttcag

SEQ ID NO: 1583 - DNA, 509 bp, Rattus norvegicus
  Genbank Accession No. AI236669
aactctcaaaacaaaaggatttccagtttaaaaaacaatgcactgaccacataattcctttttcatttatacagttatacaaatatcctaaatacacatttgtgttcaaggatggcaaataagattaactgtacagtacagaaggaaagaaaatatcttaagcatatttagaagcaatagaaatgtctatacaaaacaagcaaaatggaataaattttttaattttatttttaaagtattgcaacaggcccacaggtttgtaacaaaaatgtctttgcacagttcctcacaatgccccattagtagctaaagcaagacagcgtctttagaaaagaatgtttcaaaaatgctacacatggtactatttgcacagtttgatcaaagtaacaaatctacctttcagtcaagcaaagcctagaggagatataccaacaacgtgaagatcattgtataaaagtcattgcacattaatttactcagttgtttgaaaagtaaaaaagtgtttttac

SEQ ID NO: 1584 - DNA, 420 bp, Rattus norvegicus
  Genbank Accession No. AI236761
gctgtctagcatgatctgcatggcctgtaatctttgaaccactttcgtacctcatgtttttatccagcactcttattgtactgtgtactagtctgtgaacaatgtcaaataaaaaagagcgaacaggtcgtatggtggagctgagctagtgtacaatgcaccagttgtacagaaacaaaaatgaagtgagccatcttttgttcatttaaaatggtgttttgaatttcatatgcagaaaacgttttgttacattgcagattttaatgtatttaataaatgcaacatgcagattaagtgcagtgtatactgagtatttaaattaaaatgtacatttcataaatacagtttcaagagaaagcatcattttgtgtatactaacacattaagtgtatgtcagaaattgatgtacaaatatatatt

SEQ ID NO: 1585 - DNA, 469 bp, Rattus norvegicus
  Genbank Accession No. AI237002
taaatacacgtgtttttttgttgggtcacagggcataggtggtgctgtacagagctggtataggcgtggggtggtgttacagtggcactggattcagcttatgtcattcagggcctgtgtcagctgctgcacgggctcccggaagttggtgctcgggtttttgctacacagcatgaagccgatctggccactgggataggtgggaatggtacagtaggcatagctcaccacagggaagagagacttgcagaaatgcctcatctccttgatgaggtccaggtgcagccactggcactcgccctggcaacagaggatgccatcttctttgagggctgtcttcatgagctggtaataggactccttgaagaggctctcagcagggcccatggggtctgaggagtcggtgatgatgacatcaaaggcatcttggttctgcttcatgaactcaaagccatcgcccacgtggaga

SEQ ID NO: 1586 - DNA, 521 bp, Rattus norvegicus
  Genbank Accession No. AI237075
  misc_feature (1)..(521): n = a or c or g or t
gagataaagcataaagtaggttaacaaagtagaaaaaaaagaatatgcaagatgaaagctaacacaggaggagtggggacaaaggctgagtaggtaggactcaagctggccaccaaggcactgtggcatacatatcaagaaacactgtcacgtccaacaggactccagatgttccccacttctcttgtgctcttatcagttggtgctgctgatactccactcagggctccaaccaatgtgtgcaggatgggattcttagattctgcgcattagttggtagggaactgaattcactcaccagtaaggaactaagtcagtcaattctgctaaggccaatgctttaaatgcagttttttttttaagtgcatttaataatcgggtcggtatgaaaacctagattaatcaaatgacctttgtcnccactagaaaaattgttatgggtattggcatttatttattcatcatatacttattagggcagctaanaaagtctaatgcctctgtcatgtattaccacagaa

SEQ ID NO: 1587 - DNA, 560 bp, Rattus norvegicus
  Genbank Accession No. AI237212
ccctcagaataggtttattgaccacaacaaagttctatatacaagtgacctagaccatgacaaatgctaaatcccaggatataggagtttgaagcaggaagaccataaatttgaagtcagcctgggctacacagttctaggccatgagggatatgatcctggactacagtggctgtcaccaaagagcagagtgacaaaagcccagacaaggccaccacactcctaactgacgtcttggtaactgactgtcatattaataagaagtccacattggacattaagtgaatggcccgatttctggaactttaatagttttacaagttaactgagacaggcatgactgaatcccggtgggagaccactggagagctggcatcagatgtcaagaggccattttgtgcacagccactgtgatgccatcgtgtttctggatcataacattcccgttatctgactctaaacacactacagggatgtcggtggggtcagaggtcagcttagctgcctgctgggcgagaacaggtatcactccagcatgctcatccgacagggtaccacgg

SEQ ID NO: 1588 - DNA, 340 bp, Rattus norvegicus
  Genbank Accession No. AI237331
aagaacagaacttccatctatttaggttgggacctagagggctcaggaaagaaattcatccaaatttgccaaaacaatggctggaggagagtcagggaaaagccacttccttgactcaacctcagagtcttcaaacagcacactgaaaccagctgggccaggtttaaaatttaatgcttgttcaggcctgggtccctcattcctgccgctgtcggctaagttcgagggaaagccactgctccagagacaccggctggtgaacgagtgcttagccaaagagctcccgcacatccatgcctttgagcagaaaactcttaccccagagcagtggacccgaccc

SEQ ID NO: 1589 - DNA, 472 bp, Rattus norvegicus
  Genbank Accession No. AI237535
aaggcaaggtctctgtcattagggctgggagagatggtacagatcaagccaaacagtgaaaaataaggcaaactgtagcttcgggttttgagcctggcaccaggaaggcctcttcttgaggaagagggggcaggcagtggcaaatcagcagacgagatgcaaatggagtaacaatcacagttagtggggtaacgagatcaggcggtaaacccttaaagcaacacccaaggtccacgtctttgcatgtgcagggcacaactccagcagcagtttctgggtttgggggtttgttacttttccgactttccccaccccctaaaagacacgaagacgagctcatgaagagatcaaggaagggacgtcttctggctgcgctgggcaagggttgggtgacttccgggagcacttgtctaccttccctgtggctggccgagtcctacaaacgtttgtaggtgcccaggagcgctttgca

SEQ ID NO: 1590 - DNA, 615 bp, Rattus norvegicus
  Genbank Accession No. AI237581
cccgccacgatccgcctgccaagtccaaggtcgggcgcgtgataatgcctcctgcagtggaccctgcggaattgttcgtgttgaccgagcgctaccgacagtaccgggagacggtgcgcgctctcaggcgagagttcacattggaggtgcgagggaaattgcacgaggcccgagccggggttctggctgagcgcaaggcgcaagaggccatcagagagcaccaggagctgatggcctggaaccgggaggagaaccggagactgcaggaactacggatagctaggttgcagctcgaagcacaggcccaggagctgcggcaggctgaggtccaggcccagagggcccaggaggagcaggcttgggtgcaactgaaagaacaagaagttctcaaactgcaggaggaggccaaaaacttcatcactcgggagaacctggaggcacggatagaagaggccttggactctccgaagagttataactgggcggtcaccaaagaagggcaggtggtcaggaactgagaacagaggcctctcaggcccaaataaggacagtgcttgcctagggactggatattggggtagaaattggtgcatcccaggagggtggcacagcctt

SEQ ID NO: 1591 - DNA, 530 bp, Rattus norvegicus
  Genbank Accession No. AI237586
cgcagcacatgtattttattgaatccactatgaacagccatgtgagtttaacatttgcatatgtgtggggtaaacaggcaggactaaaactagagtttggggcaaactggaaggccccaaaatctgttatctaccgtgaggtgctgcaagatggctatgttcttttagtggcgtaaagaatgatcgtgaggatagccatgaggatggtaaagatcacggagctgatgttcaggcacttggcagtggaggcgtaggtcttggccccagtcacatcacccaccattttcctgtccctagacttcacagagtaggaatacgctatgaagcccaggcagcaaaagttcatgaagagcgtattgaacagggaccagaccacgtggtcaggcgtggagatctcagcaggcatgttgattgtggtggttgtcgcaaaatttgaggtgtggggtcctcccaggataaccaccttttgctgttccttgggcatctcttggcttttgaggatacaggcttggtcctaggagccctacaat

SEQ ID NO: 1592 - DNA, 622 bp, Rattus norvegicus
  Genbank Accession No. AI237594
gttaactttgctctggattatgtggcttttgttcaattatgagaacagatttaacggatggtggatttttggctagcttaatggatgatataggaaagtggaaagtagaaaacaccaggaaacatacattcagagctagatatgtttgttcaagaaacctaaactgtctaatccattaaacacaatctcctcaaaaagcaatgaagactctactaactgatacacagggtttcctcattcaaataaaatagacagaccaactaacctagcagctagctgaaatacaaagaagaaatcccaattagaacacccaggttcatgataaaatacatgcatttaaatgtggtccttctggttggaagttggcacaagacactaaattcttcccgaaaatagaaagcacaaatgaagattggggaggagtctcactttatgatcttgctctcaaattgtttagcacttctccacttgcgaatacacttgagacagtaggtgtggttgcagttggagaggatcccaaaacgacgctcgctggggttggctttctcatagaccacctccatgcagatcccacacaccatgtccttgctgcgctgaacagcaaaagagagctccatgtcct

SEQ ID NO: 1593 - DNA, 604 bp, Rattus norvegicus
  Genbank Accession No. AI237636
ggccgcgagatttttttttttttttttttacatcaagagtaactttatttaaagggaactcacacgagacaatgtatttaatataaacttaagtatttagtaagttatgcacatactgtgctgtcctccagaagacaactgctcacaatttccacccagctgctaacttaccttacatcacctctaagaaaatcagcctagagagccctcttgaagatggctttctaatatgaaatgaaaagggcaaggcacgtaaaaggcagcccaacatcagtgaggccctgggcctattctggaaaagctaacaaagcgctgtctaaagtgaacactcgtaaatatcccgcaggtgatttacagggttaatggtctcagacaaatcaatcttctacagaagatgaggtgactaggccagtacaaaaaccattcctgaatatatgcatgagagaaattgtgtgtcaatgcacaagatggccatgtgcatacaaattacagagacatgaaggtcacttctgtgatttttattttagatgttctttaagagtgaacggcatttgttgaaatcgaggcacaacaggaaaaaataaacatttgagtacaaaccctc

SEQ ID NO: 1594 - DNA, 620 bp, Rattus norvegicus
  Genbank Accession No. AI237645
aagtcaggtaaggaatcttcacattgttaaacaccagctgtatacatctataagggcatgtcagcaaagatggctgagtataggttagcaagtcccaaagatattcaaaagctaacacagtaaaggtcatgcgaattctagcagtgaatcatgataaaggcgcgctctattcttatgttcaagatatacattttacccgataataaccttatgagtaacagaagctgttattcagacacacattttacccaagactaaaccttagcaactcactgcattgattagcaaaggttattttagagactgatatggcaaaacgcacgccctttattcatggctgaaaatcccactatgcatggtgatacttgtgaagactgaaaataatctggtggatgtaacttgggtgagtggtgccaagaaccctgagagcctagtgatgttctcaggtggcagctttgagctgccccatgacaaaactgactagatgcggaatgctgggtaactagtctttgttaatttgatcttgctcattatttacataatttatagccaccatagtgatgggcaggtacataaagatccttttgcaagctttgtttcccaacacccgttattctcta

SEQ ID NO: 1595 - DNA, 589 bp, Rattus norvegicus
  Genbank Accession No. AI237646
aaaaatataaaatttattcatagtcactttcacacagggttactctcgagctagcatcctcaagagctcacagcagtaatagatcgctatcaaatatagctcatgctattggacttggagaacgctcgtttcccctttaaaaatgttaaggctcagtttccaaaaggtagttattaccatttagttttctgctgccaaggctggggagtttggggctaaacggcttacagtgaggttgcgggtagggcggcaggaggcaagctccacatagctcactctcgcatcgtgcagagagtgccgttctttttcttaaaggttccttcccttggaaaaagtcattttgttacaaagacaaacaaaacaagcaaaagtaacaatcataaggcaaaagaaatctttagcacacaaacaaggaaagctaacagtgctttttccattgcgtctggatgaaatgtgttgtgggaacaaacgccgctcctcgcggttcttaaatgaatctgaccaatcagcaccacttcccgcggttcttaaatgaatctgaccaatcagcaccacttcccgcggttcttaaatgaacctgaccaatcag

SEQ ID NO: 1596 - DNA, 565 bp, Rattus norvegicus
  Genbank Accession No. AI237648
tgagtacactgtcactgtcttcagacacactagaagagggcatcagatgattgtgagccaccacgtggttgctgggacttgaactcaagacctctggaagagccttcagtgctcttaaccactgagccatctctccagccccaaacgctttctttttatatccagaagaacgatatacagttagattctggaaggcagaaactacaaaatggcagttccaaaagagcctcaaaacagtgacctgattttaccggtgagacatctaggtccctaaattttgccttcgttttgattaatgaactacattgcccaaggatctacattggaaatcgcctgcgtgacagccaccataaaggtccctgactacacccaggtatggacggctacgtttcccacacagtaaaaccgtgatgcaatgcgtgatggccgcgcggatccgcaacacaggccttaaaaagggtgcgggactcgggtcggtccacacgactggaggatccctgttttcttgctcctccccgccttatttccgacgccgcagagccccaagcaacctactgtttgaagg

SEQ ID NO: 1597 - DNA, 597 bp, Rattus norvegicus
  Genbank Accession No. AI237698
gagattcctcttttttccttttttattcaacaacacttctcatttttttcaagacatacatttggctcctgccatttctgtttttcattcggtcctaacatgattagggatgtaacatgactgcataatacaaacaaggaacagatgttctgttaaaaaagactgctgtgaactattcttaagactttaaaaggtcttcatgactttacagacatcttcacacaccttttggtcctcacaacaaccctgtgaggtaggaattaacatgatcattagcagagcataaaataggaaaatgagatatacccaggcatacaattagtaatctgctactatcttagtgttgtggaccttagggtttgtgttaaagcacaaagcatgaagtcctgtaaaatatgctctgtttattcccagagaggtaacaacatgggatattgaatctttattattactgcattttattatcattctcttgttatgaattttcttctttattataacttatacaaaatatctccatttctactgcaatatttatttcccagtatatatacttaaaatataaaaggtaagcaaatacaaatagctttctagaaa

SEQ ID NO: 1598 - DNA, 452 bp, Rattus norvegicus
  Genbank Accession No. AI237724
aatgatccagccatttaataggaactcacgaaggcaaaagttccagggctgcccacctcacccctccactaaatccagatctacattggccagaggccatctgtgcagccagggagaccagacccagctggaaggtgcttcaagagggaagggtatggttaaaagaaaatggggacagggtccccaaagcaaagtctttacaaaagggggttctcctccccacaaaaaagtgtcacataagctcaaaataaaatataaagtaaaaatgctgcattagaaaagtttgcaatgttaagcctttacaataggagactggccctcaagtgtcaaacatccagtataagtccatggaagtgcagcctatacctaaaatctatgtaagtgttgcattgaaaaagtaaaaaattcaagatggcctgtatgtagtgctttggggcccatgtggaggcaaa

SEQ ID NO: 1599 - DNA, 333 bp, Rattus norvegicus
  Genbank Accession No. AI638949
ttcagtattcacaggcctttaatgcacaacttcctggtcatactccatccctgccccaagctggcagggaaggatgaaaacccatgtaggccacaggatacactcaaggagggactggagtcaaactgaaccctgggcagggaggtcctggccccaggaaataagggagttgctggcttgggcaagctcagtgatggacacccggccccgctgtcggatgaaactggccacagcagccagttcctctggggttatgtaaatgaacttgccccggtcgtcaatcacacctgttagagtcccctccgtcagcaggtcctggatgcggtttatggc

SEQ ID NO: 1600 - DNA, 523 bp, Rattus norvegicus
  Genbank Accession No. AI638955
ttaaccacagttttaaaaaaaagcaaaaataagaacaaaaaaccccaaaacaaaaaacaaaacaaaaaaaccccaaaacaaccccccctccaaacaaaaacaaaaattcaaaaacaaaaacaaaaccaaaaaaagcacaatctttggaacaaaagaattaaaggcagaaatttaaaggaaaaatacatattcaaagaacacagtgaggtataaaaagtattctctcttttttgtttgttttcctcttcatcttgctatagagtcctctactagtaaatattgcaatagccaggcctcatgaactgggggctgtcccatttgcaggggtctcacgtcacttcagtagggggcaaatcggctgtagccacctcggtacaaactcgccacagcgccaactccatagctggcggcaggggcgagggcatggtaggggtcagctgtgtacaccctgccgtaaccgtcgctgtaagcggctgcagcggctgcagcagctgtggctgcggttgcagtaacaggctgtgca

SEQ ID NO: 1601 - DNA, 333 bp, Rattus norvegicus
  Genbank Accession No. AI639001
ttcaaggatcataatgtattgagttgagaattcacaaaaaggtaacatcatacaatcagccatttcttgggctgagtaaaaatgattgtcacccactgtgcgtcacaaaaaattcttttaatgaataaataatttgatgaaatcaaaaatatttacaatataaacaaatggaaaagctttggatctgtgactgaccaggttacatttcggatggaggcctccccagcttttctcttagaacccatataaatccgctagaaacaacaactcatacaatgtgtctctgttcattacatctttatctgttagtctttgaaagctatataatcttat

SEQ ID NO: 1602 - DNA, 402 bp, Rattus norvegicus
  Genbank Accession No. AI639008
ttatattgctgaccttcatttttatttaaatatattcatcttgagaggaaactacacaggaaatattttatataaatgtaaacatgcatgtctacatcagaattaagcaaaataaattttgagtcacaagattttaaatatcattaaaggacaccaggaattgaagacggaagtgacaggaaacaagaacacagatcctaacccttgagttggtcttccaagctactgggtaaggcctgagtttcaaaaagtttatgttccttgccaagtggaaatatccagtttggctgttcttaatacatatctacaaaacaaacaattctcttttaaaataattaataaatatgacacacacacatacacacgcacacacacatacacatacacacatacacacaaact

SEQ ID NO: 1603 - DNA, 498 bp, Rattus norvegicus
  Genbank Accession No. AI639012
ttcttttacaaaaaaaaatataataacttagtttgcattttacaacatttccaatgggtcagggcatccttgaatgggacctaaggggtcagagcagcatgtacctcccttcccagttcaagcaccaggcggggctcatgccaccagtctgcaatctctatcgggatttgatagagcaactgagccatggctcatctgaaggacagcagtacggtgtcaccctgcaagtcactccatatttatttcacaagggtttatgcccctttcttctgctttcctgtacatcttttgaaagtcactaaagcgtggggcacatccaagttgtgcctccccaaagtgcacatgtccagtgaagaggaattctccatgccctggtcgtactccacactgcaacagtgttgtgacatggcccagccagtggccactgtcctcaggagctggctggaaaaccctgctcttctgcctgtggagcctgctcacccgtaggtgaatgactga

SEQ ID NO: 1604 - DNA, 358 bp, Rattus norvegicus
  Genbank Accession No. AI639017
ttgtttattaccaaacccaacatttattgagagcacagaaaatcagttggcagaggcccaacttcaatgagcgaactgaggccaggctcagtggggtaggccagccctgaagtcactcactcccagtgagaaaccagctctgggagaggggctgtaaaccttccaggccttactggggtcctccgatgggggaatgtctgaggggcagtgccccggcctggattttaacagtcctcaggtgttgatggggggcagggagctgaggtcagggagcagctccgggtgggggtccagacgggccaggcggctctgctccagggcgatggcctcagctgaatgcttgcacttctcagagcca

SEQ ID NO: 1605 - DNA, 240 bp, Rattus norvegicus
  Genbank Accession No. AI639023
ttaaatgaaaaggaatcatttattgggctggggagtgggaaggcaagtggggaggggcatgacacaaagtctttgttggggggagggttgacatgcggcagcttctgcgtgggtggttcatgcaccctgggtgggcgtgggggaggcttgggggaggagcctgccgactccttactccctgcctgcgggtgggccaggaagacccgccattagcaccagagttgcagacctcccctcccc

SEQ ID NO: 1606 - DNA, 594 bp, Rattus norvegicus
  Genbank Accession No. AI639035
ttacatggacagtttaagttttatttttggaagttacacatactttaaaagaacaatagttttttcttgttttccaatggatgttattactccttagaacactagatgaagacttcacttatgattgaaaccaaagctttctgaggccaaatcaatgtagtgtcttcagcaggagacgctcaggatctgagggctgcgtttctcattctgtagaagcacatttaaaactaccacaaaaccttaaaacatcgaaactcctgagctaattaaaattaatgcactggtctcacttcatttttatttatttgaaaaaaatgtatgtatgttaaaatagttttgatacaaatgagttatactgcttattgttggtggggaaaggttaaaacattaagtttcttctttctatggtcttagactagaatgcttttggatttttggcaactattgtattctaagaatacattctctttccccaccaaaacaaaactcaatttttattaataattatagaattatacttgctttgaaaaaaaatacttttcttaaaatactttctttttaaagtcataaaaatggattttaatttatttgctg

SEQ ID NO: 1607 - DNA, 278 bp, Rattus norvegicus
  Genbank Accession No. AI639058
ttgcaagctttctgagcttctgcattcagaccacacagaacatgtaaatatttatacacagaccggagaactagcacacgccttacagcctgtgtgtcccctgccttcctctctcttctctcttaagaagtgcggagtgtttttttttcttttttgcggatttgcctagaggtgccccaggcccccgctcctagagagggtgacctttctgtttctccttctccttgttctccagaggggcaatgtgagggtgatggagccgggtcccttctggtgcc

SEQ ID NO: 1608 - DNA, 401 bp, Rattus norvegicus
  Genbank Accession No. AI639060
ttaaaaaacagagtccactttaatactgaggtgctataaagtctcaaggtgtccatgcccactgcatgtgtgtggggacatgggctcccacgtacaggttcccgataggccagagccactgcgtccagcctaaaaatctcaggccctgctgtcctgggtctgcgatcgcacacagggcccgcatcttgctaggatgtgttaagcagtctgttttgaacatcctccagaacttgatgaaccagtccctcacgggacttcgtgccatctaaatagaccacttccactcggtcccgctccatctcccgtttatacttctggtacatgggccatacgtgaccatcaaagaggccaggaggatcagggaccatgtaagtacggcttcttctcctccgcttgcattc

SEQ ID NO: 1609 - DNA, 498 bp, Rattus norvegicus
  Genbank Accession No. AI639076
ttcggagctggggaccgaacccagggccttgcacatgctaggcaagcgctctaccactgagctaaatccccaacccctcttggtctcatatttatggaagaaaaattcatattttatgagcagctaaaacatacctgcttatatgcacttatatattataatatgtgagatttatatatatacatataattaattatatatcatttacctgcatatatgtatgcttgcgagatttttatatatattacatataatacattttatatatgatgtatatccatacataataaaatatatgatttgtatatatttatatacaaatatataaattatataaaatatataatatagttatattaaattttatgttaatataattaatataatataaaattaagtgtaaatacattacatataaatataaaaattacatataaatatataaatattaatagatattttctatattttcctcctctatttaagtttctgaggttt

SEQ ID NO: 1610 - DNA, 416 bp, Rattus norvegicus
  Genbank Accession No. AI639093
ttgaagtttaaaattttttattttaaaaatagattcataaagtgcaagaaatgttttctttcccgtgctttatatccatcttcgacaagctgagcacaggctgttagcgaagacaaaactattttctttctgaggtctggaagcaagccacgttcctgcaagccgtgcaaggacgagccgggactcagggcgtgtagtcgcgcagctccccggatacgggctgcacgaggcttggagaagaacccaacgtgctcaggccaagtccagctttttctgagtcgtcgccagcttgtcctgcagcctccgcttcctccagtccaggtaacgcctccgcaaccgattcgcttgccagccaaggaccactccagaggcgaaagccactagcacggacacttgcagcgtcctctctcgtgccg

SEQ ID NO: 1611 - DNA, 494 bp, Rattus norvegicus
  Genbank Accession No. AI639103
  misc_feature (1)..(494): n = a or c or g or t
ttcttttaggagcaaaacagactggctggctttaatgcttcaagttttccatttccttccacagggcttgttgaaaaataaccccnnnnttaatacaaacatttatagactgcataacacattgcaattaaacatttctgtaaaatagagtttatttattagtataaccttactgtataatatagtattaggcaagaattgaaagaacgtaatgagagaacagggttggatgatgtcaatgttgtcaaatttgtggattttacttttcactatctctctgtttggacttctacaccaactttaaaattccaaatgtgagacataaatgcttgtgtggaagtatgccatcatcatcatcattcaagcactgattggtgttattttaatgtggctcagtcacttattgagatagaaggtggcccactctgcagatattggagatcattagcatgagcatgcgggtgtgaacaggagtgttgctctctctaatgggg

SEQ ID NO: 1612 - DNA, 460 bp, Rattus norvegicus
  Genbank Accession No. AI639107
ttacaacagaggatatagggcagaaaagagttagtcagagttggagatcagggggaattctgggaggatctagggccccatggacttctgccttctgcagcattatgagagcagacctgcccctcctgctgtgagcccaccagtgacagtggcttctgccccaaggccagtaggaagagtcgctcctgatgactgtgataggcccagtgacaggcagatgaccgtgataggcctggtgacactcggatgacaatgataggcccagtgacactcggataacagcgataggcccagtgacactcagatgtagttttgaaacctcttttcatttgtgaacttggtcatcaataattatgtcaccaagtttgtgactttgacacttggtactgagctgttacatgggggtattctgagggtttttatattccctctgacgattgttacttgaagaacagttgat

SEQ ID NO: 1613 - DNA, 457 bp, Rattus norvegicus
  Genbank Accession No. AI639120
ttgccaagtgaaatgtgtttattggccagttaatcattgtggttaaacatttgcctaagactacaaggcggcaaagacttagatcctaaggaaggaaagaatcatgttcacttttaggttcagaaaggcagaacagagcacctgaggccagctgtgacatcagaaaagccggagagagggtgccctcaggcacacgtccaaggtggtgagcctgagcttcaccatggtgtgcctgggcctttccctagaaaggcttcagtacagtagctgggacatggacatcccactgaggctctgcatccctgggcagcgtctagggtactgtctcatgccccaggacagtgccatatcatgatctggcatggcctgtgtgggtggacaggcctgggaggtgacactgcagagtgaagggctccagttctggctgttgtgctaggttggcagtctcactgggcga

SEQ ID NO: 1614 - DNA, 476 bp, Rattus norvegicus
  Genbank Accession No. AI639128
ttaaaccagtgaaatatacaaatcacacaagacagaaatatgtacattaaaagtacagaataaaggccataggggatatacaaaatatctgaatgaagcgtagaatatcttacattaaatagatttttttaaagctaggattgttaaactccactctgctcataaacatgaatcagtaaaaaaatgaacataatctgatttaacaaataagagagagagaaagagaaagagagagagagagagagagagagagagagagagagaatgaacttcatggcttttgtagaataaaaaccaaaaagtgacattttaaactaaattagtgctttttttttatttcaagatcttttgcttgcaatttactgtagctgagggggaattaatattttggggcaataagttaagagccacaggactgaggtgaccagaaggctaccaagcccatgaacggatacatacatcttttcaaaccttgg

SEQ ID NO: 1615 - DNA, 559 bp, Rattus norvegicus
  Genbank Accession No. AI639136
ttaagaccctagaaaaggaaaattcaagttttgggggggtggttattactgagacaaaagattcacatttggagagtggcagattccttctagcctgagtgtattgctgaggttaagtcctggattctgggccttggggttcaaacctcagctctgcacacatttgtgtgtatgaatgtataggcactcctgacattctctgtgcctcagggccctctatctgtgaagaaagaatgtcaagttcctccctctcagagacaccgaggagaactgaatgaggccccgagagagtctagcacacaagatgtgctccactctaccaagcaggtactgaagatgagaattcagggctcagaaagatctcgtgtgctcaaatcctttgtgctcaaacatctcactgtggaggtaacagtattcatgggaaggagaccactatggtactgacatgattgccagtcagtcattgaacctttatcaggacaccagcactagggaaggacttctccagggactcctagatcctggattgaaatgtcggttatcccagccccggatgggt

SEQ ID NO: 1616 - DNA, 383 bp, Rattus norvegicus
  Genbank Accession No. AI639139
ttgattttttaaaaagcctttttatttgaatattcatttcattaactgtacataatcaatattccttaagagggaaggagcccttttccctggtgacatgggtcaaactgcatgtacggatccaaggcggcaaacagctctcgagcacaggatcttctcaagtaccaagcattttcccggtcctatgctaagaccatctaagaacaaggacagactgtacttagaagctgaagtgttccctgaagagatcacgacaccactcggcatggtgaacctaatgttcaggcacatgcccctgcctcagtgttctctaaattcaagcaccctcctcctgtcagccacgaccggagctggggtgacctgtgactcatggctgggatctt

SEQ ID NO: 1617 - DNA, 411 bp, Rattus norvegicus
  Genbank Accession No. AI639151
ttaataatgaaagatgcatatttatttctacaaaagcaatgtatgatacagaacataaaggaacaattaaagatttacctattaaaatatacagattctgactgaaaagtaatagggtatttaaaaaagatgacaaaggatgttaatctttttttattattatcatttttacatattttggaacctcacataattttgataaataactcttacaaaattatgcaaaaagtacaagaatgtctggtaaacaaacagtctgtattttccaaaaagaatttttacaacatgcaattcttaaggcagcatcctctttacaaggtaatccttttactcatcaaatcttctgctgcaaagaataggctaagcaagcctggcttcttccattaacgccttttgtctttcctgtctgat

SEQ ID NO: 1618 - DNA, 330 bp, Rattus norvegicus
  Genbank Accession No. AI639152
ttgctggttgcactcaggcatgagtgaaactatcccacgtttaatgtcagcaagaagaggacacagctggaacagggtggtgagggtgactggattttgaaatcaatcatttgttacgggatttaccacttttcccacgaagagggggcaattggtgtattcatctttaatgacaaataagaagggcctgttgaaatggattgaaaagttttgaggcgagtccctcttactccaactggtgttccttgtaggtactgtcacatcatcttcaaaggtcagtacagtcttgtgcacagccttgccgagcttcaggggagcatcctgtgtgac

SEQ ID NO: 1619 - DNA, 595 bp, Rattus norvegicus
  Genbank Accession No. AI639162
ttgcacaaattattttcaattttatttaaatgaaataatgttctaatattatgaaaaactgtcatagaaatgacacaacttttattggaatagaaatttaaagacaaagttatagtatctattttatcctccattaattaaatgcaaaagctatgcatgtcaaattgctacacacatgttggcattatacaatgtactcagtatacttctttattataaataactgaaaacaatatcttatttttcaaacccacataacaaaactgcaaataccacactttttttcctcctcgtttcactttattttttgtaatatggatggaaaaacagtttaccttacccaagattagttttaaaacatctgtgggcgcaaaaacagcaacaaccacagtcacaaaaatactaattttctttcacctaaatgaaaaggaagattttacagggctcagcttaagagagttgtgacggagttactaacagtagaaaaactttgtaacgcctggacaaaacactcataaggcaaaatggtcttttttgcagatataagtataagaaagatgtgatggtaaacagtacaaacctttttctaaaacca

SEQ ID NO: 1620 - DNA, 393 bp, Rattus norvegicus
  Genbank Accession No. AI639167
ttgatgctgggaattgaacacagggttgtaacgctctatgacagctacagcaagcacgtctcatcctcagctgttcaacttaactgcaaggccagtatgttcctgtcgtctcaaagctgcacctggggaagcatgagcgatggcctcagcctgcagcaagtggtggtcatgcctgtgcacaacaagctggagcggagattggtggggcttgcacacccctttcatccgcattgctttaaatactggacacagcctttgcacagtggcccctgtggccacctatgaacactgcaagtgtagtaaccggatgtgtgtgggcaaacaccttctaaaccacaccagtgtacccgatagccagagcctaggatcacagtatagagaggtgactcaggg

SEQ ID NO: 1621 - DNA, 287 bp, Rattus norvegicus
  Genbank Accession No. AI639185
ttggtctccatggacagcatttattaggcgccattctcagtgtgaagacagatgggcaggggctgctgaggggggccagggcagccacagcctggggacttaggggctgcccgggtgggtgtggggatgtcacccacacatattgcatattctgtggcagtgtgcccaggcataaggcattggggaagcagagaggctgcctgcagtgggagggggtgagacaggaagtgacagtggccttctagttccctaggcaagaccctacaagagaccagcagtcccccatg

SEQ ID NO: 1622 - DNA, 357 bp, Rattus norvegicus
  Genbank Accession No. AI639197
ttaattttaataatttatttttttaataaaaacgaaaatgatataaaacccaccccccctacttcaaaggaatggaagggcgggaagaaggacccaaaaaaaaacactttcgaaaaaaacacctcgcaggagatgggcctcaaaaagtcttacggacccccccccaaaaaaaaagtcaccccaagggggggggggttcttttgaacaaaaaaaacatgtggactcaggtttttaccaaaaaaaaccccccatctattgaaattaccaaggaagagcttaatttggtcggtagaacccacccccacagaccttggcccctggggggttctgcacaaaaaaaaaacccttgaggaaggg

SEQ ID NO: 1623 - DNA, 334 bp, Rattus norvegicus
  Genbank Accession No. AI639203
  misc_feature (1)..(334): n = a or c or g or t
ttattggnccaatgagaattttttattgtggctactaacggtatgggtgagggggtacttgtaaggaacagggataactaaaggatagcagtatcagcagaatatatgtgagacttccttggaggataactaaaggatagcagtatcagcaggatatatgtgagacttccttggagacagctccaccaacctggaccagcaggccagagcatagcctgctgatgacctttggtgacaaggtcctgagagagagagtatcaggaaatcaaaagatcaggagataggaaggtttgggctctggaggtcttccataagctgttctatgccaagcaag

SEQ ID NO: 1624 - DNA, 428 bp, Rattus norvegicus
  Genbank Accession No. AI639204
ttccttccttgaccaagttgtcattgagtagagcgttgttcaacttccatgtacatgtgggctttctttcgttaatgtcattattgaagaccagtcttagtgcatggtgatctgataggatgcatgagattatttctatcttcctgtatctgttgagacctattttgtgaccgattatatggtcaattttagagaaggtaccatgaggtgctgagaagaagttatatacttttgttttaggacagaatattccataaatatctgttaaatccatttggttcataaattctgagagtttctctatgtctctgattaatttctctttccatgatctgtccattgatgagagtggggtgttgaaatctcctactcttattgtttgaggtgcaatgtgtgctttgagctttatgaaggtttcttttatgaat

SEQ ID NO: 1625 - DNA, 208 bp, Rattus norvegicus
  Genbank Accession No. AI639214
ttgtttaaaaacccccccggcctttatttaaaggaaggccgggggaaaccacccccaaatgccagaatttcaaccaggcggccgggcccccgaaagggcagtttttattggcccaaaccccaaaggcaaaagccggtgggtggaacttcaagggggggggcttccacttgaaacccgttaatggtgcccttttgggcgggccttattt

SEQ ID NO: 1626 - DNA, 559 bp, Rattus norvegicus
  Genbank Accession No. AI639246
  misc_feature (1)..(559): n = a or c or g or t
ttctttctctctttctttctcttaaccttttaacatagttgttttgccagcaatgggtcctgtaattcaagtgaaaatggaaattcatgtttttgttcgttcctttgtgtgtatgcagggttggatggattctggggattggactagaagccttgtttgtacacgccaggcaagtgctttaccactgagccagcagctcctggcctctctcgtttttaggtttcttataaaagcgtgtttatctctagagaacatcggcaacaatgaagagaaaagaaagtgtgtctatgtcctaagaagtgattcagatcaattaactgagaggcttcccgaccccgcctgtattttatagtctctgccaacaaggctgctatctgggccccagctcccatcttgtgctctgtttattttggcttcccagagattaggtctcagtcaccaagctttctatgaccttctgttgttttcccttgcttattttacatgtgcctggttccaaagagcctggccaggaggtgtgtttccctgtgggaaggttttggactatggngctggccat

SEQ ID NO: 1627 - DNA, 334 bp, Rattus norvegicus
  Genbank Accession No. AI639248
ttccacggggaggaggagccattttactggcccacaattttatttgctgggcattaattttaatgtcttcacaaaggcctttgacacaaatttacaaaaaataatttattaataaactatagctgatcattttgcgttttccaatgtttaaggcccctccttttaagtatttttgggttccactgggccttttttgtcgacctcccatgattaatcctgaacatccgttttttttgccaaagatgtatcaccctgtaactaatacccactttttttggacgggtcttgtttaaatatatttctaagccacaggggccaccttaaccagataatt

SEQ ID NO: 1628 - DNA, 487 bp, Rattus norvegicus
  Genbank Accession No. AI639255
ttgattgattgattgatttatttatttatttatttatttatttatttatttatttatttatgagacttggtctcactgtgtccatctggctgtcctggagctcgctctgtcgaccaggctggcctccgagagctaggactaaaggtgggtgccagcttcccacttgcttgccgtctgtattccatctttagtattcgttaaggtcgtgagttgtatgaaaaaatatataatttaattctcaaaccatagctttgtttttctttttcctaaaatacactgtaaaaagaatcaaaagcatatattttgtagcacacagaggacgaatgttctggagcgaaggcagagtattacccttgtataaaaatcacctataaaaaaaaataaaaaaaaataaatcaccttatcccagagaagagaaaggagacagtgagagcaagcgtataggaaaccagcaaaacgttctgggagaactgcttccgctctgggg

SEQ ID NO: 1629 - DNA, 327 bp, Rattus norvegicus
  Genbank Accession No. AI639268
ttctcaaggaaagcctttattccccttcagtgactcctttgacaacaaggtcaacccttttctgggacactgagcttttccttcactccacaggccacaacagcgaaaaataactcagggaaaaaggtgcggataaacacggcagccttggggacagggttggccatgaacaccttttgctttttcctccgcactgtgcgcataacttcctcagccacctccaccgggtgcacgccataggtcagctttctgcaaaagaatttacaaatggatgacccccagtttctttgctcaggataagcctggtaggaacggatgaaagttggg

SEQ ID NO: 1630 - DNA, 480 bp, Rattus norvegicus
  Genbank Accession No. AI639308
ttaaagggttctttattcataaacttgatgcaagtttacaaaatttactgtacattgccaaataaatctgcaatgaaaaataaaatccaaaaaaaaaaaaaaacccaccccaaagcttgccgaatgtgcagctgtcagtctgctacctagtaggaaattagaattcaatattttattcaagattttgccttaggcataaggagcttcataacgggttgaaaaattctgccttgtcacttgtcatccgagtcactggtaatcatttatttaaggtaaccaagtgaccgagaataccagatttttttattgcccttttaaccaacagaatcaagagaaactaaacccacccataaaatgcacaagtgccacgtttcctagttggggtttacaaagtttaaaaaaaaaatcccaaatcaaatttataggaaataccattgaactttgaattggtttgtgcaggaaacagggcttctgggtttc

SEQ ID NO: 1631 - DNA, 404 bp, Rattus norvegicus
  Genbank Accession No. AI639350
ttaaacacaaaaccaaaaagtgtttacttggaaataagcggacaaatttccactagaatactgacacggtcctcccctcagcaggaggctgggagtctactaaattgcacaaagtccctgattagcttctttctctttggcataagtcagcgagcgccaagagccagctcccgacaagcctgagctgtgaagtatggagcccttaggaagggtcagcttagcaggacacccaggtgacggtctgagtgggaagcagtctgctccagctaagccctgtgtccaccagcacattgagcaacacttgtttctttgataaggctccaaatgataaggctcctgtcacctggcagagccatacctggggctaggtgacctctgtctggaggaggaaagtggccatgatg

SEQ ID NO: 1632 - DNA, 491 bp, Rattus norvegicus
  Genbank Accession No. AI639352
ttagcaacatttgacaggcggtataattcaggtgccaatgagacccatgctttacacaagagggagctctcgttcattgtttctccaagggaaatgttttgggaacgtttcaaccaataaggcgcggaggacttagaacaaaaccctaaaccccggggaaaaaaatgtcaagggggctcttttttaagtttttcccaaccccttgcccaaataaactgtttttgcgcttttttaaaaagaaacttttctaagcacaaggggatttggttcttttttacaatttcccaaaaattggcaatttttcgccaagaaaaacaaattccctttgtctttgaaagacaattttagaggacgggtggaaccccaaaacaagtttccaatttttataaaaaagtggggacccaatttcttttttttcccaaaacttttttaatttttttgaaccccccatttttttggttaagggggggaaaaagccccccccaaaataa

SEQ ID NO: 1633 - DNA, 528 bp, Rattus norvegicus
  Genbank Accession No. AI639381
ttggcaaaggtaactgaagtttctggcttctgtgacgtggtttggttgttactcagctctcactatttaggtggtcttagtcccaaggtggtcactgtgctgaagtggcagagatggccagcccccgtctcgctgcgacatcagaccgtcgctgtggaaggctcagggctgctccatccaacccctcgatcacttacttcctcctacccaagtacccatctcttaccctcacccagtaaggcccattagcatgtttccccttcctctggcgaatttgcataattattcactgcctttttcctagaaccaaatcacggtaatgattttcctcaagtaagcgtcccacaactctcttgattctatcgtacacactaagtttgccctcgaattattgcgtcatgttaaacacatacagacaaagggaaggacacactcttcagtagagaatcagaggggtcggggctgagtgtagacaaggcagtatagagctcagccacccaagcccctaccagagcatgaagatagttg

SEQ ID NO: 1634 - DNA, 468 bp, Rattus norvegicus
  Genbank Accession No. AI639387
  misc_feature (1)..(468): n = a or c or g or t
ttgataaaaccatgtttattactctgctctgtgttccacacaggtttacaagacaaccgagtgtgaatgacaaacattttgttcttcgaaactctgcagtgggactgtgaacaccagccccaccgcaccctgacaatcacacagtgagggtgaaatatcagcaggggtgacagagcaggtctcggccagcagtccccatctgcagcaaaatggtcacgggctaaagcatcctagacaaacctatcagcacccatggtgcacttagaattgaacatagccacatctggtgaatcttctcacttcttccttctctttgntgaatacagtttttcttcaagagggactgggactatgccgtcacactcttttacttcctgggtcaagaggtgtttcacaatatttggtctaaccacatcagtgtctcgtgccaagtgttccagcatgctttccacaagcattgttggggca

SEQ ID NO: 1635 - DNA, 429 bp, Rattus norvegicus
  Genbank Accession No. AI639402
ttggagcagaattacccacctataatatccaagaagcagaaagaagcatacaagtggctaaggcaagatatgcctgttagagacatgatcccagtggctttctttctccagtcataccacactgttagtagcccatacatgaaactgtgctggcatgatccagtcacctctcaataatgacaacagatacctttaccacctaggcctgttggagggatagtttatctctacaccacaacacactgttactataggggtattcatatagccaacacatagattattgccccttcttcagagaactgagtcaacctcttctttggtgcccttctccagggtctatctgctcactcacatcacaacaaatacaagtttaaaaacaaaacaaaacaaaacaaaacaaaacaaaacaaagagtatatgagtgac

SEQ ID NO: 1636 - DNA, 522 bp, Rattus norvegicus
  Genbank Accession No. AI639410
ttcaaaaagtggatgaaactttattattgtcttcaatgtacagtacaatcattagtcaaatatcaagtacttgaaatagcataatagaatcacatatttaaatgcaaagcaaagagataatgtgtaattttataagcaaattatcaaataaaaagacaacattggctgactgttgacttttcaaatatactccactcaacacccaagaaaatgttttatactataaaattcttctatatattttgaggaattttctaatataacaaaatttatatgaaaaatgaaatttaaaaattgttagaaaacactaaatatgagcccaatgtagaaatctgaagatagactgttcctttggcagaaaataaatagctacaaacatcttaaaataagtacagttcaataggatcatggaaaaaatatatctttacatttcgtattaatactgaaatcagatcaatacagatttactatcatttttaggctatcaataactctgcaacacaaatttatgaatggaaaaaa

SEQ ID NO: 1637 - DNA, 454 bp, Rattus norvegicus
  Genbank Accession No. AI639425
ttgagttctttagactttaccaaatgtattttccatttgttagtttttaaagtagcttcaactgatgttgcacacaccatagctctgtacacttatgcagttagcctgtctcagaaagcgaataaaccgcaggtaacatctcccccagaactcctcgggaaacataattaggctgtacaaacacatcacaaattcaacagcacacggtgcacccgaaaccttttctatgaacctcaaaagttctttggacgtaatcactgaacattggtgtcgagcaaagatcagatttcgagcctccaattttgtgctgtgttgtgtcagcgacaagagcgccatccaagtcctttaagcaacgaagacatgcgcagaaccagttcagaaatcgtcaaatttgacgacaaaacagaaggatggctgcctactcccttcctcagcacgaaccctgttacgttct

SEQ ID NO: 1638 - DNA, 336 bp, Rattus norvegicus
  Genbank Accession No. AI639452
  misc_feature (1)..(336): n = a or c or g or t
ttgtttttgttgggtatggcagttccaacacttgggagacaaaggcagacatactctgcaaatcccaggctactctgtcttcaaagcaagtaccaggtcagctagggctatacactaagaccttacttaaagtaaaataaaacttanaaaaaaaaaaaaaaaaaaggaactggaaaggtaggtcagcagttaagagcactgactgctcttccagaggtcctgagttcaattcccagcaaccacatgggggctcacaaccacctgtaatggatctgatgccctcttctggtgttgaccacaccctagaagccatgtctggatttgaggaacaaacac

SEQ ID NO: 1639 - DNA, 457 bp, Rattus norvegicus
  Genbank Accession No. AI639466
ttggttttttaactttttattagcttttaaggagctggggaccaaacccagggccttgaccttcctaagtaagcgctctaccactgagctaaatccccagccggaaaccaaatttgatttcctgatcccacaaggttggtcccacccatctagaactctgattcataagatctgatcgcgtttaagggcactaagcacagtactgttaaaaagatttgtgagcaaaacactcatacacccatatacataaagtttttaaaaattaaacctgctttaaagataattgcagtaatagccaatcctgtattttcttactaaacaaaaataactgctactgttagggaccacataaaataactattatctattttctaaatcaaagagtctaaaaggaggcatggggtgctatgcaatatgtaaattaacatgaatacttggccatctacatcattgactt

SEQ ID NO: 1640 - DNA, 502 bp, Rattus norvegicus
  Genbank Accession No. AI639474
ttcacgtgttacatgattctttatgaaatgtccaggagagacagaaagactgacgattaactagagagaagagaaaatgggggtacaaacagttactgggtttcttttaggaatgagaaaaaacaaattggaattacatagaaatggttgtagatttgaccaaaaccagtgacttgcatatttaaaaagagtaaatattttatggtatgtaaactgcacacagacacacaaaaaaggtgaacaaactaatttcttctctattgtctcaggttacctactgagtcacaaaaatatagaaataagtgcaaagacgcctgacaagtataaccacactgcaacaagttcagtaaaagcaggccctcggcctccagacctgggtcaaatccagggcctcacacgtgccagtaggaaggactcttccactgagctatagccccaacgcctttctccctcttttgggcagggtcgtatgtggtccagactggccttaagccaagtttga

SEQ ID NO: 1641 - DNA, 401 bp, Rattus norvegicus
  Genbank Accession No. AI639488
ttagactaagacaatgctccggctttaatgtatgaaaataatacccatgttgtctaatttgggggtcatacattagaagtgtaaaggtctgcgtctgcccgccgtctagttgaagtacgtgagcacaatcatttggatcggctgtctgcacacggggcagggcttattcctcttctttagcttctttgcacacgtgaaacatgacatcaggtgtccggttttgccgtgaacaatgcaaccatttttaggccgcccctggcaaatcacacatggctcgatggcgttcagagagaagctggattccatactttcctctttgtcttgtgtgtcctccttcaactctttgccactttcttggctgctgtaaacaatgctactggaagtcgacggctgggaatagt

SEQ ID NO: 1642 - DNA, 486 bp, Rattus norvegicus
  Genbank Accession No. AI639501
  misc_feature (1)..(486): n = a or c or g or t
ttccacatagataactttaggttaactacaaaaatcatgaaatgaagaacagatcatgggactgcacactcaagcatcactggagtgacacacaggtttccccagatgactgctaagagggaaaaaaggaaccaggatacaacaaactcatatttaagtagtaaacatgtcagatattttaaaataataaatacagaatagcaggagagaaactaaaatcataaaacagcatggagtatattttattttctttaagacagatgaaatttctaggcacagttttaggcattaaggaggacacagaggcataggttagtgtgtgctgctctgtacaaaaatacagtctgaataaattacattgctagccatacaattagacaatcacttatcagtcaattcactgcatgtttaataatatacaggtacatgcgaatccatatatatcatttatatttcaaacacataagnctctctatatttggtttt

SEQ ID NO: 1643 - DNA, 543 bp, Rattus norvegicus
  Genbank Accession No. AI639504
ttagagagcatcagccgttctatttcttgcatgatcattggcatgaaggaaaagtccaaaacaggggctttgcattctggggattgcgggccaagtgttataagctcctcatagcactttgcctgggttcatgagacctcggggatccagtgtgtctttgagttgcctcatggtctccacacccacaggacccacttcctcttgaagcagctgcctcttgcccagaccgatgccatgttctccagtacatgtcccatggagtgccagggcacgcctgcccagattttctgcaaaggccttgaccctcctctgctcctccacatcatctgggttgaccaacaggatgcagtgaaagttgccgtcacccacatgcccaacaatgactcctgtgagttttgaggccttaagctcctccttggtctctaccaagatctctggcaaccgggagatgggcacacacacgtccgtggaataggccttacttcctggacgcagggccaaagctgcataccaagcattgtgccgtgcagcccaaagttcatt

SEQ ID NO: 1644 - DNA, 410 bp, Rattus norvegicus
  Genbank Accession No. AI639510
ttattacattaaagatttaataattttatttaagttacaataatcacaaacatctcaattgctttaaaaagaagtctaattacttaaatagtttatacccactacttcaggccccacatccctccatgtcagtgctgccatggaagaataattctgaacagatctaatacatacatcactgtgacttcaacacaatcataaaagccatctctaaaagcgacagcacctagtctctaatgaaattgacaacaggttcattgtatggacagctactcaatggctcatcaaaggagacaagttctgtcaacattgttaatactggagtgcaaattcacgcagaaaacttccccatgaaacgtattcttcaaaaaaaaaaattcttagctaacttatacttgtaaggatttttt

SEQ ID NO: 1645 - DNA, 465 bp, Rattus norvegicus
  Genbank Accession No. AI639523
ttattaatctactttattattgtacttttaacagtataattaacagcttatagttagtaataataatggttctgaaaatacaaaagcataactctagttaaatttcatttttaaaaatactgatcctataatcagaaatgcagcacaatactaaaggtgtgcagaatacacacacacacacacacacacacacacacacacacacacacaccaccaccaccaccaccaccaccaccaccagcagcagcagcagcagcagcagcaccaggagcaatatttttctttcacacttgtttgtgcctctttttttcccatcacttgttgccacactatgatcatctatggtacataagaatctgcccatcagttgccaaagaatgaattggtgaagccaacatagtcgtagccagcaggttggctccgaccccgcgggtccatatattgctgcatatgtatggtacagaa

SEQ ID NO: 1646 - DNA, 2002 bp, Rattus norvegicus
  Genbank Accession No. AJ000347
taggggacgccaggctgactgttgatcatggcttccagccacaatgtgttgatgcggctggtagcctccgcatactctatcgctcagaaggcaggaaccatcgtcaggtgtgtcatcgctgaaggagacctgggcatcgtgcagaagacctcagccactgacctgcagaccaaagcagaccgcatggtacagatgagcatatgctcttccctgtcccggaaattcccgaagctgacgatcatcggggaagaggacctgcctcctggagaagtggatcaagaactgattgaagacgggcagtcggaggagatcctgaagcagccgtgcccatcgcagtacagtgcaatcaaggaggaagaccttgtggtttgggttgaccccgtagatggtaccaaggaatacactgaaggtcttcttgacaatgtaacagtgctcattgggattgcttatgaaggaaaggccatcgcaggcatcatcaaccagccatattacaactaccaggcaggaccggacgccgtgctgggcaggaccatctggggagtcctgggtttgggtgcctttgggtttcagctgaaagaagcccctgctgggaagcacatcatcaccaccaccagatcccatagcaacaagctggtcacagactgcattgcagccatgaaccctgacaacgtgctgcgagtgggaggagcaggaaacaagattatccagctgattgaaggcaaagcctctgcttatgtatttgcaagtcctggatgtaagaaatgggatacttgtgccccagaagttatcttacatgctgtaggagggaagttgacagacatccacgggaatcccctgcagtacgacaaggaggtgaaacacatgaactctgctggagttctggctgcactgcggaattatgagtactatgcaagccgcgtaccagagtctgtcaaaagtgcactcattccctgaaggggtctcacttacttacccaggggcctcggttcaaagtaacatatcttagaactgattaactgattgaacaattagaactccacttgcattcatcattgatcaatgatttattagtaggtagggatagaagatggaattaaagaattgtcttaggtatataacacaattgtcatttctcctgcctaaaaaaaaaaaaattagccaagtggtagcacttatgacagtcatggccattccagtggctgagctaggagggttgcttgagcccagggccccgagactagcctccttcacatagcaagacatagcccaaaaacaaagaagaaaaacaaaaaaggaatttacacttgatcttagccaaaaggccgagaagcgatcaaaaaaggaatttagttttaccaattagctaactagacctgttttgttgttgatgttgttgttgtttggttttttgagacagggtttctctgtgcagtcctggctgtactgaaatttacttagtagacaaagctggccttgagctcagtgattcccctgcttctgcctcctgagggcagggattaagggcttgccccaccatacctggcagaaatgttactgtttttaagtgaagaaatgaaaaagggttagttctgaatgacagtccaggtcatttgtggaatcaacattcctgctggtaaccagatttcttcagggcacagttactccagaatttcagtttgttttcttttcatggtaatgttttaaatttctgattccaaatgagaatgcatataatattatttatgttgatagatttatggggaaagtttgtccaagatacttagtcctatctctttatgttatatatcagatttttttcaaaagtatttgaaaattataaatactgtgaggattaatttattctcttgccattaaaagctatcatcagaaaaaaaaaaaaaaaaaattcctgcggccgcgaattcttccctttagagcacactggcggccgctctagaactagtggatcccccgggctgcaggaattcgatatcaagcttat

SEQ ID NO: 1647 - DNA, 1214 bp, Rattus norvegicus
  Genbank Accession No. AJ001290
aagtattaaaaagctggacacttctgtcattcggacatttttactcacaagttcccagaatgagggctgcgctggagacagcagacattgccatagtggccctgtattttgtcctggtcgtgtgcattggtttctttgccatgtggaaatctaatagaagcactgtgagtggatacttcctggccgggcgctctatgacctgggtggccattggtgcctctctgtttgtgagcaatattgggagtgaacacttcattgggctggtagggactggagctgcaagtggatttgcagtgggcgcatgggagttcaatgccttgctgctcttgcaacttctgggatgggttttcatccctatttacatccgctcaggggtgtacaccatgcctgaatatttgtccaagaggttcggtggccataggattcaggtctattttgcggccttgtccctgctcctctatatcttcaccaagctctcggtggatctgtactcaggggccctctttatccaggagtccttgggttggaacctttatgtgtctgtcatcctgctcattggcatgactgctctgctgaccgtcactggaggccttgttgcagtgatctacacagacactctccaggctctgctcatgatcattggggcactgacacttatggttattagcatgatgaaggttggagggtttgaggaagttaagagaaggtacatgttggcctcacccaatgttgcttccattttgttgacacacaacctttccaacacaaattcttgtatggtgcatcctaagcaagatgccctaaagatgttgagagatccaacagatgaagacgtcccatggcctggattcattcttgggcagaccccagcctcggtatggtactggtgtgctgaccaggtcatcgtgcagagggttctagcagccaaaaacattgctcatgccaaaggttctactctgatggctggcttcttgaagctcctaccaatgtttatcatagtcgtacccggaatgatttccaggatactgtttgttgatgatatagcttgcatcaacccagaacactgcatgcaagtgtgtggaagcagagctgggtgctccaatattgcttacccacgcctggtgatggagttggttcccgtgggccttcggggcctgatgatggcagtgatgattgcagctctgatgagcgacttggcctccatcttcaacagt

SEQ ID NO: 1648 - DNA, 3166 bp, Rattus norvegicus
  Genbank Accession No. AJ001929
tagaattcagcggccgctaaattctaggtggccacggaatcctgcggcgtggagctccggggaaaactcagtcaaccatggacctgcgtcagtttcttatgtgcctgtccctgtgcacggcctttgctttgagcaagcctacagaaaagaaggaccgagtacaccatgaacctcagctcagcgacaaagttcacaacgatgctcagaatttcgactatgaccatgatgccttcttgggagcagaagaggcaaagagttttggtcagctgacaccagaagagagcaaggaaaagcttggaatgattgtagataaaatagacaccgataaagatgggtttgtgaccgagggcgagctgaagagccggatcaagcacgcccagaagaaatacatatatgacaatgttgaaaaccagtggcaggagtttgatatgaatcaagacggcttaatctcctgggatgagtacagaaacgtgacttatggcacttacctggatgatccagaccctgatgatggatttaattataaaccgattatggttagagatgagcggaggttcaaaatggccgaccaagatggagaccttattgccacaaaggaggagtttaccgcttttctgcaccctgaggaatatgactacatgaaagacatagtcctgcaggaaaccatggaggatatagaccagaatgctgatggttttattgatctagaagagtatattggtgacatgtacagtcatgatgggaatgctgatgaaccccagtgggttaagacagagcgggagcagttcgttgagtttcgagataagaaccgggatggaaagatggacaaggaagagaccaaagactggatcctcccttcagactatgaccatgcagaggccgaagccaggcatctcgtctatgagtccgaccaagacaaggatggcaagctcaccaaggaggagattgtcgacaagtatgatttatttgtgggcagccaggccacagatttcggggaggccttagtacgacacgatgagttctaagctgcaaacagaggagccttcatttcttcaaaagtaatttatttttacaggtctggtttcacataaaattgtttgcgctactgagactgttattacaaactttttaagacgtgaaaaggcatatcgagatagtgaaatcacccgcccccattcctcctccctctgaggggctggaaggaacccatgcttctgaggaacaactctgattagtacacttgtgtctgtaggtttacactttgtataatgtataacatggtgtgtttatttttgtattgttctctagttgggagtataatatgaaggatggagatcctcaacccacacttgtaggcatacattagccatttacactttctcaatcccttaccacattttttttttaataattctcacttaactaattttttaaagcctaagatcaataagaaatgttcaggagagaaaaagcagaaggaaagcatgtacttcgtgatttacgttcagagagagaatgcttcatcttgcttgttgagaagtctcatttcatgagtagctgttcagttgtcacaggcccagccacggagcctgccattgtctgggcaaggacagagtcctccgctgtaagacagcgtcacgcagctccacttcactcttcccctcaggactagctgtttgctaattttgtcaagcacagctgtggtaggaagaattagggcccagtgtcttgaaaaatcaaccaagtagtgtgtatgatgtcttcacagggctatttctagctctttctagagctgtttctaaccagaaacagctggaaaacaaaaagaacaaagtgtatgcagggcatgcatctcattcttagtgaaatcactacaaggacccatcccagcccctttctaagtcttaaccttgggttttactgcagtttaaattgattcttttcccatcatgacattgaaagttgccctttaacaggaaaaatggtcaccgaatgagaattgggactcaagaataacgaatttggggcgcccttacgttgaaagcatttgaacctccctgataccgaaggggattcccctccccgcctttttctcttgtaaacaggaagtaaatagcattattagttaaagcttggttgcagtgttcttatcttgtgggctggtttctaaaacctcatgctgctgatttgaccagggcatcctcatacctcagatgcaaaccactcttctaccgggcctctgtttaccggagctttgcctcaaggatagaaggctgtacagaggggctctttggtttgaggaccactgctcacccttcctgtcattaacctgtcacaccccattttatcatctccctttctctctgacacacaaaggtggggtacgtgggagggtcgtggattattcttattaaaaaacaaaatcatctgttgccaaccccatttacccatctttggtctcttactgatgggcctcttaagaattattgtattccaagtctttaaccctcatgttactaatgtaaatatacatctgggcagtctttattacttcctgtatctctgagtaatacatcaagctggtgctgggtgatggtcatatctgaacctagacctccccgtgggtcttccacaatcctgttgatgtgggctgcttggtgtggtaaaaagcccagtcgtggtgtaacttaaccttggcgattgcatcaagcttcttgatagcagatacactctaaggttttagccccagtagaggtgaaatgaacatccctcactgccttccccagatcctcaactctccattgttaaggagaccagagataattaatgccaccaaccctggcttagaaagggtacgtcatacactgtgtagcaagagggcattacagagcctaacgctggcgtgaaaatcatgtacttagccagcaagtgagtctgcgagggtggcgtagtctggacagggtgttcagcatcgggaactgtgctctcaggtccataagctccacatagtgttggggtttgggtttgggtttctggttgaatttgagtatttgttctttttttatagagtgtaaaccaagttttatattctgtaatgcaaacaggtacctgtcgttttttgaataaaactgtttacatccaaaaaaaaaaaaaaaaaaaaaaaaaa

SEQ ID NO: 1649 - DNA, 730 bp, Rattus norvegicus
  Genbank Accession No. AJ011116
gagagatccacctcactgtagctgtgctggcatacagaacccaggatgggctgggccctctgcactatggggtctgttccacatggatgagccaactcaaggcaggagacccggtgccctgcttcatcaggggggctccctccttccggctgccacctgatcctaacttgccttgcatcctggtgggcccagggactggtattgcacccttccggggattctggcaagaccgattacacgacattgagatcaaaggactgcagcctgcccccatgactttggtgtttggctgccgatgctcccaactggaccatctctaccgggacgaggtactggacgcccagcagcgtggagtgtttggacaagtcctcaccgccttttccagggatcctggcagccctaagacctatgtgcaagaccttctgaggacagagctggccgcggaggttcaccgcgtgttgtgcctcgagcaaggacacatgtttgtctgcggtgatgtcactatggcaaccagcgtcctgcaaaccgtgcagcgaattctggcaacagagggcagcatggagctggatgaagccggtgacgtcatcggcgtgctgcgggatcagcaacgctaccacgaggacattttcggactcacattgcgcacccaggaggtgacgagccgcatccgcacccagagtttttctttgcaggagcgacagttgcggggcgcagtgccctggtcctttga

SEQ ID NO: 1650 - DNA, 1563 bp, Rattus norvegicus
  Genbank Accession No. AJ011607
gtcaagatgcagttctcaggaaggacccggaagaagctgagattggcaggtgaccagagaaacgcttgttaccctcacagccttcagttctatctgcagccacctactgaaaacatatcattgacagagtttgaaagcttggcttttgatagagtaaaattgcttaaagcaattgagaatcttggtgtgagctatgtgaaaggaaccgaacagtaccagagtaaactggaggctgagattcgaaagctcaagttttcgtacagggagaacctggaggatgagtacgagcctcggaggagggaccacatctcccacttcatcctgcgcctcgcttactgccagtcggaagatcttagacggtggtttattcaacaggagatggatctgcttcggttccgattcagtattttacccaaggataaagtccagagtttcttgaaggatactcacttgcattttgaggctatcagtgatgaggagaagacccttcgggaacaggatatcatggcgtcctctcccagcctaagtggggtcaggtgggaatcggagtcagtgtataaggtcccctttgctgacgctctggacctgttcagaggaaggaaagtctacttggaagacggctttgcttatgtgccacttaaggacattgtggccattatcctgaacgagtttagagccacgctgtctaaggccttggcactaacagccaggtccctgcctgctgtgcagtccgatgaacgacttcagcctctgctcagccacctcagtcattcttacaccggccaagattatagtacccagaagagcaccgggaagatttccttagatcagattgattcgctttcaacaaaatccttcccaccttgcatgcgtcagctgcacaaggcgctgagggaaaaccaccatcttcgtcatggaggccggatgcagtatggcctgttcctcaagggcattgggctaacgttggagcaagcattgcagttctggaagcaagagtttatcaaaggaaagatggacccagacaagtttgataaaggttactcttacaatatccgacatagctttggaaaggaaggcaagaggacagactatacgccattcagttgcatgaagattatcctgaccaacccaccaagccagggggatttccatgggtgcccattccgtcacagtgatgcagagctgctgaagcagaagatgcagacctacaagatccctgcctcggggatcagccagattttggatttggtaaaggggaatcattaccaggtggcctgtcagaagtacttcgagatgacgcacaatgtggacgattgtggcttttctttgaatcatccaaatcagttcttttttgagagccagcgaatcctaactggtggcaaagatatcaagaaggaagcaagccacccagaaacgcctcagcacaaacccagcacccagaagaccaaggatgccacgtctgctctggcctctctagattcctccctggaaatggatctggaggggctagaagactactttagtaaatgacgtggcccctggagcaactggagcaaatacatt

SEQ ID NO: 1651 - DNA, 327 bp, Rattus norvegicus
  Genbank Accession No. C06598
  misc_feature (1)..(327): n = a or c or g or t
gggctgcaggtttgacagcagcctaccacagaaccagccctttgttttctcccttggcactggccaggtcatcaagggctgggaccaggggctactggggatgtgtgaaggggaaaagcggaagctagtgatcccgtctgagctggggtatgganagcggggagcccccccaaanataccaggtggagcaaccctggtgtttgaggtggaactgctcaanattganagacgttcanaactgtancaggctgcaaaggggtaggaggcccctatcagggaccanactgtttaaaaacaaacaaaaaaacctttaaaaccccaaaaaaa

SEQ ID NO: 1652 - DNA, 1083 bp, Rattus norvegicus
  Genbank Accession No. D00729
acacaactctcaatcatccagtgaactgggctgactgtggcaggacctgggcggtgaggaaacccttggggacaccgatgtggcttgagcctgctcctcttcttggcgctggcctctcccgtcgcgttctgctgcaggccggatcccgcctcgccgcaggggggcctggacgagcccgtcgcttctctaacaaggcggtgttggtggagaaggagggcgaggcaggaatcgcagtgatgaagttcaagaaccctccagtgaattcctcagcttggagtttccgacagagttttcgtcatcagcctgagaagctggaaaatgaaaagagcatccgaggtgtcatcctcacttcggagcgcccgggaacctccccgccgccccacgacatgaagaagaaggacgaccagcccactatgctgagtactggaaggctcgtgccaggagctgtggctgaggctctacttgtccaacctgacttgatatctgccatcaatggcgcctttccagctggaggctgcctcatggctctcacctgtgactacaggataatggcggacaactccaagtataccataggattgaatgagagcctgctgggcattgttgcccccttctggttaaaagacaactacgtgaacacatcgggcaccgagcagccgagcgtgcccttcaactggggacgttttcccactaacatgacagcagctgctctactgacgcttcacagaagcctcaatgaggtggtacctgaggatcaggtacacagcaaggctcgctcagtgatggccaagtggtttaccattccggaccattctcggttgctgacgaagagcatgatgcgcaaggccacggcggacaacctgatcaagcagcgagaggctgacatccagaacttcaccagtttcacctccagagactccatccagaagtccctgcacgtgtacttggaaaagctcaagcaaaagaagggctgacctaagggtgccacacggtgtttagttacacgtgccttctagggacccatggtcccaaggattatcaataaggtatttttcaatttaaaaaaaaaaaaaaaggaattcc

SEQ ID NO: 1653 - DNA, 2266 bp, Rattus norvegicus
  Genbank Accession No. D10655
cctacaatgcaggcaggcaccatagcccgctgggaaaaaaaagaaggggaaaaaatcagtgagggtgatctaattgcagaggttgaaactgataaagccactgttggatttgagagcttggaggagtgctatatggcaaagatccttgttcctgaggggaccagagatgttccgataggatgtatcatttgtatcacagttgaaaagcctcaggatattgaggcctttaaaaattatacattggattcagcaacagctgccacacaggcagccccagccccagctgcagctccagctgctgccccagctgcaccttctgcaagtgctccaggtagctcctatcccgttcacatgcagattgttcttcctgccctctccccaaccatgaccatgggcaccgtccagaggtgggaaaagaaagtgggagagaagctgagtgaaggagacttgctggcagagatagagaccgacaaggccaccataggctttgaagtacaagaagaaggttatctggcaaaaatcctggtccctgaaggcacaagggatgttcctctgggaaccccgctatgtatcatagtagaaaaacaggaagatatagcagcatttgcagactacaggccaacagaagtgaccagcttaaagccacaggcaccaccacctgtcccacccccagtggcagctgttcctcccatcccccagcctttagcacctaccccctcagccgctcctgctggaccaaagggaagggtgttcgttagccctcttgcaaagaaattggcagcagagaaagggattgacctcacccaagttaaagggacgggaccagaaggcagaatcatcaagaaggacattgactcttttgtgcctactaaggctgctcctgccgctgcagcagctgctcccccgggtccaagagtggcaccaactcctgcaggtgtcttcatagacatccccatcagcaacattcgtcgagtgattgcgcagaggctcatgcagtcgaagcagactatacctcattattacctttctgttgatgtaaatatgggagaggtgctgttggtgcggaaggaacttaataagatgcttgaaggtaaaggaaaaatctccgtcaatgacttcatcataaaagcttcagctttggcctgcctgaaagttcctgaagcaaactcatcttggatggacacagttatacgacaaaatcatgtggttgatgtcagcgttgctgtcagtacccctgcaggacttatcacccctattgtgtttaatgcacacataaaaggactggaaaccattgctagtgatgttgtttctttagcctccaaagcaagagagggtaaacttcagcctcacgagttccagggtgggacatttacaatctccaacttagggatgttcggaattaagaatttctctgcgattattaacccacctcaggcatgtattttggcaattggtgcttccgaggataaactgatccctgcagataatgagaaaggctttgacgtggctagtgtgatgtctgtcacactcagctgtgatcatcgagttgtggatggagcagttggagcccagtggcttgctgaattcaaaaagtaccttgaaaagcctgtaactatgttgttataatttccctgcgaacttctattcttcctctgctgacattatatttatatgttattaaacaggtggttcttttaaagtttcactagttaattttattattgagtcagtccagataaattatttgtaacagacataaatgaatcttttgtaaatgccagttacacccaaatgttttacccctttaataattacacatcggtttaaagctgtgtactcctagtgaaggggacatgtgggcctaactctttggtagaaggagccttcctgggagtgatagatggcaggattgtggcttcctgcagacaagtcactaaaagtacctggatgagatacttggagttagattaatgatcacttatttaagtgtgagggaacagtcgtgaaaattacgtcttatggaggagtttgaatttacgttggaatctaacagttaaagtctcctgtcacatgaccttagtttatcactcagtaagtgaaacttttaagagtcagcattttcttagacctcttcaaaccaactattatttttatatgaatctctaaataaaatagctttccccacaagataaagatataaaccagcttcttggtataaatgaaattttatgtatttatttataaacaatttcaatgtataacttga

SEQ ID NO: 1654 - DNA, 1196 bp, Rattus norvegicus
  Genbank Accession No. D12770
ggtgcggtgcctggccgggcgtaggcaagagcaaaagagcggctccttgcagactgtgcgcgcccgcgtttcagcatgggggatcaggctttgagcttccttaaggacttcctggcaggtggcatcgccgccgccgtctccaagaccgcggtcgccccgatcgagagggtcaaactgctgctgcaggtccagcatgccagcaaacagatcagtgcagagaaacagtacaaaggcatcattgattgtgtcgtgagaatccccaaggagcagggctttctctccttctggaggggtaacctggccaacgtgatccggtacttccccacccaagctctcaacttcgccttcaaggacaagtacaagcagatcttcctgggaggtgtggatcgtcataagcagttctggcgctacttcgctggtaacctggcctctggtggggcagctggggctacctccctctgcttcgtctacccactggactttgctaggaccaggctggctgccgacgtgggcaagggatcttcccagcgtgagttcaatgggctgggtgactgtctcaccaagatcttcaagtctgatggcctgaagggtctctaccagggtttcagtgtctctgtgcagggcatcatcatctacagagctgcctacttcggagtctatgacactgccaaggggatgctgccagaccccaagaatgtgcacattattgtgagctggatgattgcccagagtgtgacagccgtggcggggctggtgtcctatccatttgacactgtccgtcgtaggatgatgatgcagtctggccggaaaggggctgatattatgtacacggggacagttgactgctggaggaagattgcaaaagatgaaggacgcaaagctttcttcaaaggtgcttggtccaacgtactgagaggcatggggggtgcttttgtattggtattgtatgatgagatcaaaaaatatgtgtaatgctcaagttcacaggttcacagatccattgtgtggtttaacagactattcttaaggaaataaaaaaagacagatcatggataaaaccagaccataaggaatacctcagaaaaatgcttcattgagtattcatttaaccacaaaagtattttgtatttattttacatttagattcccacagcaaacagaagatagcttatcatacttgttcaattaattaactg

SEQ ID NO: 1655 - DNA, 1215 bp, Rattus norvegicus
  Genbank Accession No. D12771
gaattccggcagtcctgtcctgcagtcgcctgcctcttcttttttgctttcaacatgacagatgccgctgtgtccttcgccaaggacttcttggctggtggagtggccgcggccatctccaagacggcggtagcacccatcgagcgggtcaagctgctgctgcaggtgcagcacgccagcaagcaaatcacggcagataagcaatacaagggcatcatagactgcgtggttcgtatccccaaggaacagggagtcctgtccttctggcgtggcaacctggccaatgtcatcagatacttccccacccaggctctcaactttgccttcaaagataaatacaagcagatctttttgggtggtgtggacaagaggacccagttttggcggtactttgcagggaacctggcatcaggtggtgctgctggggccacatccttgtgctttgtgtaccctcttgattttgcccgtacccgtctagcagctgatgtgggcaaagctggagctgaaagggaattcaaaggccttggtgactgcctggttaagatctacaaatctgatgggattaagggcctgtaccaaggctttaatgtgtcagtgcagggcattatcatctaccgtgctgcctacttcggtatctatgacactgcaaagggaatgctcccggatcccaagaatactcacatcttcatcagctggatgattgcacagtctgtcactgctgttgctggcctaacttcttatccttttgacacggttcgccgtcgtatgatgatgcagtctggacgcaaaggaactgatatcatgtatacaggcacgcttgactgctggcggaagatcgctcgagacgaaggaggcaaggcctttttcaagggtgcatggtccaacgttctcagaggcatgggtggtgcctttgtgcttgtcttgtatgatgaaatcaagaagtacacataattatgtcctaggtgttctccccgagaacaggcatgttgtataatagaccatattcttgaacattctggacagattctctgggcttgtctgttttatcaatggcaactatttaccagttgaaaagtggaagcaataatattcatctgaccagttttctcttaaagccatttccataatgacaataatgatgggactcaattatattttttatttcagtcactcctgataataaaaaattgaagaaataaaaatatcccggaattc

SEQ ID NO: 1656 - DNA, 2842 bp, Rattus norvegicus
  Genbank Accession No. D13623
tcgcggaaggtgacgtggacacggaagtggtcgtcgtcgcggcggcaccggtgggagcggggccctgcacttggagtgcggcgggcaagcggacgggtggcggaggcctctcagcggcggcggcggcgacttaaggcgcaggcgtggtccgttgggtgcgaatccgctgagcccacgagcggcctcttagccctctctcctgcccgtcggaaaccgggagcagggacccgcttagccggcgtcatcatgaccaagaccggtagcaagggcgggaacctccgcgacaagctggacggcaatgagctggacctgagtctcagcgacctgaatgaggtccccgtcaaggagctggctgcacttccaaaggccaccgtgttggatctgtcctgcaataaactgagcactcttccgtcggatttctgtggcctcacgcacctggtaaagctggacctcagcaagaacaagctgcagcagctgcccgcagactttggtcgcctggttaaccttcagcatttggatctcctcaacaacaggctggtcaccctgcctgtcagctttgctcagctcaagaatctgaagtggctggatctgaaggacaatcccttggatcctgtcctggccaaggtggcaggtgattgcttggatgagaagcaatgtaagcagtgtgcaaacaaggtgttacagcacatgaaggccgtgcaggcagatcaggaacgagagcggcagcgccggctggaagtggagcgagaggcagagaagaagcgtgaggccaagcagcaagctaaggaagcaaaggagcgcgagctgaggaagcgggagaaggcggaggagaaggagcgtcggcgaaaggagtatgatgctcagaaagcttccaagcgggagcaagagaagaagcctaagaaggaaacaaatcaggccccaaaatcgaagtctggctctcgccctcgcaagccaccaccccgaaaacacaatcgctcctgggctgtgctgaaggggttgttgctgctgctgctgctatgtgtagcaggagggctggttgtatgccgggtgacagggctgcaacagcagcccctctgcaccagcgtgaacgccatctacgacaatgccgtccagggcctgcgccatcatgagatcctccagtgggtcctccagaccgactcccagcagtgagctcatcctcagcaccgctgcctcccagcctcggagcttggattcctatggaattgggttctgctggacacaacttctttttagcgtcagacctacctgccatcatcaaatggctgctgagtggtacttgagatctcccctttgtaggacttctctgttccttagtcagggttccctggtggaatgaggagaaatggagaggggggaggaagagttacctgcatgcctaaaggaataggcttaggggtggggagagagaaggcataggcttttctagttatgcaaagctgtgtaaggcaaggttcctttctactaaatggtcagctgtcactacatttatacttttgtatgtcacaaaccctttctttcattcctccctgggtaaccaggacggattggagggcagtgtgttactgggactaggggactaggaatacttgggtaaattcagcctaagctgggagggtaaagtaatacatttccttaaagatctcagacagtcaagcattttagcaatgtccaaaatgtctggctatgaacacatgttcactgccattggtccagtgtaacactttgaggcaggaggtgccgtccatgacttacttgcctacagtgttcaagctagtccaaggcacaacccagctttcactccagttttcttcctttcctttatgtcatttggcctcctttataatactcaaggggatgaactcacaccagagttgtcttagctaaagtgaatctttcataatagacggtcttaccacccacaaatagatctcatcagggtcctgggaaactaatcctgtggaattttgcctcagcttaaatggcttccacaaaatggcagcaggctgggctccttgcctcccttttagagcattaaactccctgatggcctggaagcacaggggcagatctctgcagcggcactgtgactgccctactagcacttggtatgatgaaatacctcaaaggcaacctagaaacttgatctcacagaagcaggtgcagagttgcttctggacctgtaacagaagggaaggaatagaacagtgggagccaaagggaaacaaagtcacacggtggcgctgcaagtgatacataagtaaacattagcacaaaccagggcagcagcacccacctccctgctgctaccagaaagcattctccccgcttccctgtctcttcacaacagctgcaggaagggatcggaaacctgtctcggtgcttatttgctaaaactcccaactgcaagctctccctagaggagcaggacctgtcggagttcagacagtgtagccccagtggcccatgtgcttaggtcagccactcaagactgtcctgacacgggaagaaaggcctttgtttttccctcccccagatagttctgccgtgtaggtccacaccttactcagaatcactacacattcctttagtcttcctccaagctccagagccatcggtacaaatgctttattgagacaaaatacatactacatatggtgacatcatgaaaacagaagtcagcctcatagatccctggctggttgaggcagctcagtggctgggcgtagtcaagccaacccgcaggcaagagttcactctgacttcgagatttgatgcttattctttggatttctacaattattaaatccgtgtctgagtggtc

SEQ ID NO: 1657 - DNA, 3751 bp, Rattus norvegicus
  Genbank Accession No. D14014
agaaagagagctacagactccgcgcgctccggaagaccgggtcgtagagctcgagacaactcccgccagcagcaagacacgggagacccaaccaggatgacaaccctccccaggccgcccgctccatggaacaccagctcctgtgctgcgaagtggagaccatccgccgcgcgtaccctgacaccaatctcctcaaccgaccgggtctgcgagccatgcttaagactgaggagacctgcgcgccctccgtttcttacttcaagtgcgtgcagagggagattgtgccatccatgcggaaaatcgtggccacctggatgctagaggtctgcgaggagcagaagtgcgaagaggaggtcttcccgctggccatgaactacctggaccgtttcttgtctctggagcccctgaagaagagccgcctgcagcttctgggggccacctgcatgttcgtggcctctaagatgaaggagaccattcccctgactgccgagaagttgtgcatctacactgacaactctatccgccccgaggagttgctgcaaatggaactgcttctggtgaacaagctcaaatggaacctggccgccatgactccccacgatttcatcgaacacttcctctccaaaatgccagaggcggatgagaacaagcagatcatccgcaaacatgcacagacctttgtggccctctgtgccacagatgtgaagttcatttccaacccaccctccatggtggctgctgggagtgtggtggccgcgatgcagggcctgaacctgggcagccccaacaacttcctctcctgctaccgcacaacgcactttctttccagagtcatcaagtgtgacccggactgcctccgtgcctgccaggaacagattgaagcccttctggagtcaagcctgcgccaggcccagcagaacatcgatcccaaggccaccgaggaggaaggggaagtggaggaagaagctggtctggcttgcacacccaccgacgtccgagatgtggacatctgagggcccaccgggcaggcgggagtcaccaagtagtggcatccgcgaagagaaaggagccagcccgggtgctcctgacgaggtcccccttggggatgtgttgttaccagaaggggaagttttgttctctttgttggttgtttttccttaatctttctcctttctatctgatttaagcaaaagagaaaaaaatacctgaaagctgtcttaaagagagagagagagatagaattcgcatcaccctgagtatagggagacgggggggtgcctacaaaaatagaattctgtaccccagtaatcaactagttttctattaatgtgcttgtctgttctaagaataggattaacacacaggaagtcttgagaaggatttttgattcttttatgtgtttaagaaaaaaaagcttaagaaacattgctttaaaaaaagaaggaaaaaaaatacagcaaaccattgttaaagtagaagggttttaggtagagaaatgtactctgctttggtgaaaaggcacagatttgggaaggtcctcaacctcactcccctgcttgttcagtgcctacagacctgttacctgatgatacctgtgctttatcccaggagtggggcagacctcttaaccttactgatggtcgattcgacctctagcgggctcgtgggtgtggcaacctccagggctcatgttatgggccctctgccccccacaacctgcaggttcacagagcgccagccagcacgcaggggtagggatgaaatagtgacataatatattctatttttggggaaccttcctgttttgggggttcctgtttagagagatgctggtttttggctggtggccctgcagcccactcaacatcaggttgaacccacagcttttcttttgtgtgtggtttgttttgttatgtttttccttctccatgttcccaaaaccattccatttcaaagcacttttggtcagctagctggaggcagtgttgctgggtgtgtgtgtgtgtgtgtgtgtgtgtgtgtgtgtgtgtgtgtgtcggtgggggagggggtctagtggaatggttggggatgtccacacactcaattctgatggctgcacagcaggtgtgtagggctggtagcatgaggtgcttgggaagttgtgttgggtcgagaagagaaagctctgttctcgtaccaccgggatcttcctgcaaagtcggagggatcttttggtgccagctggcgtttggaagtagggaccgtgatggcattacctggacaaggggattcaggacgactcttaagtctttcacacaggaggcttttaaacactaaaatctctaatttatacgtaaggctacagaagagtatttattgggaaggttgcccatgacccgtgtgactcaaagcaatgtgatcttcccttgattcaaacgcacaccttcttccctgctggcgaaggttttaggccattgtctgagagactggtcttttattggccaagtggggtgtcctccaaaaaaaccaaaccacaaagacggagatgtgggtctccttgactttcccaacccaattgcccccattggagagccatccaaacctgaggaaaattaggggaccccaaaagagtcttgagtctggcacattcttgccgccgctcccaagttagcaacagtaggtaatttgcacacctctggctctgtgcctttctgttcaggatgtgttggtgggaggtggagagcgggtggctggagaggggatgtgagagaagaagtatggagggtagggaccacacgggacagaccgcggctcctttcacagcgctgctaccaatgactcccaggatccccggcgttcggaaccagattcacgttgctttgtatctttcatgttgttttcgctgctattggagggtcagttttattttgttgttgttggtttgtttgtttttttttacaatgtcataaactgccatgttcaagttttaatttcctcgtagaagagtgtatttacagatgccctctccgggactttttctatttattgtgattcaattttggattaatgtgattaccgctgtattcccaacaaaaggtgttttccacacacacacacacacacacacacacacacacacacacacacaggttcctgtacacaatacctcatgtatcacctaacaatacataggcctgccaggcgggtggggcggtctgcctccagggaccctgggaccctgctggggatcatcctgtcatgctgggccttcatttgatctgggacatagcatcacagcagtcaggccaactgtgttctgttagttatcaatattgttacttgtagcggcctgttgtgcatgccaccatgctgctggacccggagagatttgttctgagtctctggtgcatcatataatctgttaggttctagtgttctgtcttgttttgtgttactcacagcattgtgctaatgtaaagccagccgcaatgctgtaggccccaggttccctagcaagctgccaaaccaaaagggtcaccaccagcttagctgaggcgtcccaaccaggcaggacccttgagggctgctgtgtccatggtgatggggtgaagttttggccaaagggccaaaggctggtggatccacacagtctgccctgtgacatgaatggctttgaggggctctggctggtggtcaggttggctttgtgtattctggttgacacaccatggcgcttcccagcacagacatgtgaccagcatggtccagg

SEQ ID NO: 1658 - DNA, 4432 bp, Rattus norvegicus
  Genbank Accession No. D25233
ccggaggacgaccccgcgcaggacagtgaccccgaagagctgcccctgatcaggcttgagtttgaaaaaattgaagaacctgaatttattgcattatgtcagaagttaaaggtgcccgatcatgtcagagagagagcttggctaacgtgggagaaagtttcatctgtggatggaatcctggaaggatatattcagaagaagaaggaactctggggcatctgcatcttcattgcagcagttgacctggatgagatgccattcacttttactgagcttcagaaaagcatagaaaccagtgtctataaattctttgacttattaaaagaaattgataccagtaccaaagttgataatgctgtgtcaaggctattgaagaagtacaatgtgttatgtgcactctacagcaaattagaacggacatgtggacttatatatttgacacagcccagcagtgggttatctactgaaataaattctatgttggtgctaaaagtttcttggatcacctttttactagctaaaggagaagtagtacagatggaagatgatctggtgatctcatttcagttaatgttgtgtgtacttgactattttatcaagctctcgcctcctgcgctgctcagagagccgtacaaaacagctgcaacacccattaatggttcacctcggacacccagaagaggtcagaacaggagtgctcggatagcaaaacaactagaaagtgatacaagaactattgaagttctctgtaaggagcacgagtgtaatgtagatgaggtgaaaaatgtttatttcaaaaattttatcccttttataagttcacttggaattgtatcatctaatggacttccagagcttgaaagtctttctaaacgctacgaagaagtttatcttaaaagcaaagatttagatgcaagactatttttggatcatgacaaaacacttcagactgatactatagacagttttgaaacagagagaactccacgaaaaagcaaccctgatgaagaggcaaacatggttactccacacactccagttaggactgttatgaatactattcaacagttaatggtgattttaaattctgcaagtgatcagccatcagaaaatctgatttcctacttcagtaattgcacagtgaatccaaaagaaaatatcctaaaaagagtaaaggatgttggacacatctttaaagagaagtttgctagcgctgtggggcagggatgtattgacattggagcacagcgatataaacttggggttcgattgtattatcgtgtgatggaatcgatgcttaaatcagaagaagaacgtttgtccattcagaattttagcaaactcctaaatgacaacatctttcatatgtctttattggcctgtgctcttgaagttgtaatggctacatatagcaggagtatgttacagaatcttgattctggaacagatttgtccttcccgtggattctgaatgtacttaatttaaaagcctttgatttttacaaagtgattgaaagttttatcaaagtggaagccaacttgacaagagaaatgataaaacatttagaaagatgtgagcatcgaatcatggaatcccttgcatggctttctgattcacctttgtttgatctcataaagcagtccaaggatggggaaggacctgatcaccttgagtctgcttgttctctcagcctccctctccagagtaaccacactgcagcagatatgtatctttctcctataagatctccaaagaaaagaacttctactacacgtgtaaattctgcggcaaatacagagacgcaagcagcctcagccttccatactcagaagccattgaaatctacctccctttccctgttttacaaaaaagtgtaccgtctagcatatctccgactaaatacactgtgtgcgcgccttctgtctgaccacccagagccagaacacatcatctggactctgtttcagcatacattggaaaatgagtatgagctcatgaaagaccgacatttggaccagattatgatgtgttctatgtatggcatctgcaaggtgaaaaacattgaccttaaattcaaaatcatcgtaactgcgtataaggatcttcctcacgctgcccaggagacctttaaacgtgttttgatcagagaagaggagtttgattccattatagtgttctacaactcagttttcatgcagagactaaaaacaaatattttacagtatgcctccaccaggcctcctaccttgtcaccaatacctcacattcctcgaagcccttacaagttctcgagttcacccttgcggattcctggaggtaacatctatatgtcacccctaaagagtccttataaaatttcagaaggtctgccaacacccacaaaaatgactccaagatcaagaatcttggtctcaatcggtgaatcatttgggacatccgagaagttccagaaaataaaccagatggtgtgtaacagtgacagagtgctcaaaagaagtgctgaaggcggcaatccccccaaacccctgaagaagctgcgctttgacatcgaaggatccgatgaagcagacgggagtaaacatctcccagcggagtccaaattccaacagaaactggcagaaatgacttctactcgaacacgaatgcaaaagcagaaactgaatgatagcatggaaatctcaaacaaggaggaaaagtgatgatctcaggaccctaacactgtagaccctcgggacacctgactcgtgtctcatggatgtgactatagttcccaggttctgctcatgttatagatataaaatgtgcaggtacagctgaatatttatgtgggtgatttgtaagccacttcaatgttgtaatcaatggtatagaattgacagtacacaggattgagaatcttgtgcagatcatgccatttaaaatatgaaagcagattgttggcatttccaacaggagcctgctgccctcagaagtgaggctgcctctggagggagtcctagcaactcccttacatctggctgactactttgcctttccttgtggcacatgtgtgatgtttgctcttggttttattaatttatatgtattttttaatttaacgtgaatatccttagaaaatgtgtcttgtcttccaaatgcaagttgattgattgtccacattcaaccaaattatcttgaatcctctactgaaacagattgttacaaactggggaaaagtactaatttgtacacattggacttgttttaatactagaatctaatgtgccatatgtttgtttcacacattttacctttgaaatagaagtaaaaaaagtataaacatatgatactgtcttactactgacacagatttcatacctcagaccctctaagaaccaattcttttattcatccaactcatactttaaactgaagactattgataatactccaggtttgttttttcttttaatctttcagatcactgaatctttaagtacccatgtagtacttgaaaatcaagtctggccacaactgtacttcagaggaccctagtacagtacaacccaagtgcactttctaatgtctctgggtcctgaggaatcaagatacaaattaactatgttctgtaagcagaccgttaactataggagccttcggtttaactatgttctgtaagcagaccgttaactataggagccttcggttttccctcatacaagtgtctaaccacatctcaacagttcactctgctcttctgcatccagggctgatgtgttccctctggaatggtacatgtcttccagggtcttttgaactggcaggtatctatttttttaagccaatctggtctaataacactggcttcttcaaagccacagcatttctaatccagctgtgccgaagcttcagactaaaacagctgcattgaaagaagaggcactcccttcaccccccccccccacctaaaggtgtttacattatcttgtgggattaacttatttagagatgctataatttaaaataggcggtatttaaggtagcgtcagctagcatttaagaaaatcattttttctaaactccatactttttgaaaagaaatctggtcttgttagaaaacaaatttctactttgtcctcaatttagtttcagttttactaggttgatagttatctcgatgacaaaggccgtagacagctccccccatttcttcattgagttttgcatggccatcacacaggttagttgggtttaggtcaagggctgaccatacttctaggtcttttgctagtaagttcaagttagaattagtgacagaatcataggaattttcagagatcctctattaagatttcttaaaactgcagaccctgcttttgtttttgtactggttaaaactatacattcagattgctatgttcctattttctataatagtttgtctattttaca

SEQ ID NO: 1659 - DNA, 1500 bp, Rattus norvegicus
  Genbank Accession No. D28557
taaccgcgccaaccgccaccgaggtgcccggagagaggcggagaggcggcatgagcgaggcgggcgaggccaccaccggcggcaccacgcacccgcaggccgcggccgacgcgcccgccgcggcgcccccggaccccgcgcctaagagcccggcggccagcggcgcgccccaggccccggcgcccgccgcgctgctcgcgggagccccggcgagagccagcccccgggcccgccccggcctcatcagcccccgcgggaagcgaggacgcgagaagaaagttctcgccaccaaagtccttggcactgtcaaatggttcaacgtcagaaatggatatggatttataaaccgaaacgacaccaaagaagatgtgtttgtacaccagactgccatcaagaagaataaccacgtcaagtatctgcgcagtgtgggggatggagaaactgtagagtttgatgtggttgaaggagaaaagggtgctgaagcagcaaatgtgactggcccagatggagttcctgtagaagggagtcgctatgctgctgatcggcgccggtacagacgcggctactatggcaggcgccgaggacctccccgtaatgctggtgagattggagagatgaaggatggagtccccgagggagcgcagctccaggttcatcggaatcccacttaccgcccaaggttccgcaggggacctgctcgcccacgacctgcccctgctattggagaggctgaagataaagaaaatcagcaagcggccaatggtccaaaccagccgtctgcccgccgtggattccgacgcccctacaactacaggcgccgcccccgtcccctcaacgctgtttcacaagatggcaaagagaccaaggcaggtgaagcaccaactgagaaccccgctccagccaccgaacagagcagtgccgagtgaccctggctcccaggcaccttcaccaccagcagggtgaccttaagaattaatgaccattcaaaaacaaggcaaaaagcacacccacgaccttaccaacaccaaagaaacatctaagcaataaaacggaagactaacaagatttggacattagaatgtttactgctattctctacgaaactaacaactgcaaagggaaggagcccgcactgtccatcaagctgcgtcccgggaacctgcacaggcagagagcagcctccccatttcagcaacctagtgctttatatttttttcctggtttttactgttttggtaatatgaattaaaagaagaaatattaataccacatggggattgccccaaccaaagaaatctgaaatatatagtaaatgctctttttcctttgttgttcattttggatgctggtgctaaacttccaagtgtcatgatttaagaagaaattttatgcccttatttattcctaggatgaggggagaacatttttgctttcttacatagctctctctgaaatgtgcagtaacaagttcctcaaaaataaaatttttaccttcaaaga

SEQ ID NO: 1660 - DNA, 1360 bp, Rattus norvegicus
  Genbank Accession No. D28966
ctggagaagacggaaacaaaagacagaaacacacgcacacggggaactgggagttgactggcagatcccagctgccctgaggatggtggccagcggtggacgtcctgatggtcccccttctatcacccccgagagccctctcattgtaggtggcagagagtggcagggtatggcaggttcttgctggaacatcacctacgttcaagactcggtaggacctgccaccagcaccctgatgtttgtggctggtgtggtgggcaacgggctagcactgggcatcctgggtgcccgacggaggtcacacccatcggcgtttgcagtgttggtcactgggctggcagtgacggatctgctgggcacgtgcttcttgagccccgcggtgtttgtggcctatgctcgaaacagctctttgctgggcctggcccacggtgggacgatgctgtgtgacactttcgccttcgctatgactttcttcggcctggcctccacgctcatcctcttcgccatggctgtggagcggtgcctggctctcagtcatccctacctgtacgcccagctggacgggccccgctgtgcccgcttggctttgcctgccatctacgctttctgttgtctcttctgctcactgcccctgctgggcctgggcgagcaccagcagtattgtcccgggagctggtgcttcatccgcatgcgttccccccagcctggtggctgtgccttctccctggcctatgccagtctcatggccctgctggtgacctccatcttcttctgcaacggctccgtcactctcagcctctgtcacatgtaccgccaacagagacggcaccatggctcgtttgtgccgacctctcgggcacgagaggatgaagtttaccacctgattctgctggccctcatgacaggcatcatggccgtatgctccctgcctctcacgatcagaggattcacgcaggccatcgccccagacagcagagagatgggggacctccacgccttccgttttaatgccttcaaccccatcctggacccctgggtcttcatccttttccgaaaggctgtcttccaacgcctcaagttctggttgtgttgtctgtgtgcccgttctgtccatggggatctgcagacgcccctctcccggcccgtgtcggggagaagagacacactggctcccgattctctccaggctaaggaagggaactgggtgcccctgtcaacctggggtacggggcaggtggcaccattgactgctgtgcctctgtctggtggtgatggctgttctgtgggaatgccatccaaaacagaggctgtggttgcctgctccctctgctgatacctaagctggtcctgcttgccatcc

SEQ ID NO: 1661 - DNA, 2996 bp, Rattus norvegicus
  Genbank Accession No. D30734
ccgccttgacgggctacgcaggcggtagggctgcggtaggggccgggcggcaccatggcggcggcagcgcctgctgcggcggctttaaccgaggcgccggccgtcccgggcaccgcagaacccgagacgggagacgaggacagtcgtgaggtccgagtgctgcagagcctgcgcggcaggatctatgaagcaaaaaatttattgccatatcttggacccaacaaaatgcgggattgtttctgcactataaatttggaccaggaagaagtttatcgcacccaggttgttgaaaagtctttaagtccatatttcagtgaagaattttattttgagattccaagaactttccagtatttgtcattttatgtttatgataaaaatgttttacaaagagatcttcgtataggaaaagtagccatcaaaaaagaagacttgtgcagtcatagtggtaaagaaacttggttttcattgcagcctattgactcaaattcagaagttcagggaaaagttcaccttgaattaaaactgaatgaattgataacagaaaatggaactgtgtgccagcagcttgttgtacacatcaaggcatgccacgggttgcctcttatcaatggacaaagctgtgatccttacgcaacagtttccctcgtgggcccttccaggaatgaccaaaagaagacaaaagtaaagaagaaaacaagcaatccacagttcaatgaagtcttctactttgaggtaaccagatccagcagttacaccaggaagtcccagttccaggtggaggaggaagacattgagaagctggaaatcaggattgacttgtggaataatgaaaacctagttcaagatgttttcctgggggagattaaggttcctgtcaatgtgttaagaaatgattcctctcatcaagcctggtacttgctacaaccaagagacaatggaaacaagtcgtctaaacctgatgacctgggatccctcctgttaactctgtgttacacagaagactacgtgctcccatcagagtactatggacccttgaaagctttgctgctaaaatcaccagatgttcagccagtatccgcctcagctgcttatattttgggtgaaatatgtcgagaccagaaggatgccgttttgcccctcgtacgactgttgctgcatcacaataagcttgttccctttatcactgcggtggctgacctggacttgaaggatactcaagatgccaacgcaatatttagaggaaactccctggctacccagtgtctgactgagatgatgaagatagtgggagggcactacctgaaagtcacattgaagcctgttctggatgagatatgtgagtcctcgaaatcctgtgaaatagatcctgttaagttgaaagagggagataatgtggagagtaataaggagaatctgtactactatgtggacaaagtattcagtgcgatcgtaggatcgagtgtgagctgtcccactgtgatgtgtgatattttttattctctgagacagatggctgctaagagatttcctaataaccctcatgttcagtactctgccgtgagcagctttgtgtttcttcgtttctttgctgtagcgattctgtcacctcatgcttttcatttgcgacctcattatccagatacacagacagttaggactttaactctcatctcaaaaaccattcagattattggaaactggggatgtcaatccagaagaaagtcacggttcaaaaagtcagtcatgtgtgaatttctcaaaatgtttcaagaagaaaggtattttacagacgtgaaaaagttcttggatgaaatttcgtctacggaaactaaggagtccagtggtacgagtgagcctgtgcacctgaaagaaggtgagatgtataaaagagctcaaggaagaacccgtattggaaaaaagaacttcaagaaacgatggttctgcttgacaagcaaagagctcacctaccacaaacagcaaggcaaagatgcaatttacactattccagtaaagaacattcttgctgtggaaaaactggaagaaagctctttcaacaagaaaaatatgttccaagtgatccatacggagaaaacgctgtacatccaagcgaataactgtgtggaagctaatgagtggatcgacatgctgtgcagggtgagcaggtgcaaccacaacaggctcagctccttccacccgtcagcatatctcaacggaaactggctctgctgccaggagaccagtgaaggcacaccaggctgcaagccatgcactgcaggcatccctgcagacatccagatagatattgatgaagacagagaaacagaaagaatttactccgtttttaccctcagtttacttaaactgcagaagatggaagaggcttgtgggtctatagctgtatatcaggggccacagaaagaacctggttattctaagttcaccatcgaggattctgtcgcaacctttaagacaattcagcaaataaaaagcaccatagagaaactagatgaacctcatgagaaatacaggaagaaaagatcgagtagtgcaaaatacggaagcaaggaaaatccaattgtgggaaaaatatcatagtgtttgatcaactgacggagaactggaaaatactcttatcatcaagtttttcaattcaccccatttgttccagtgtgtaagagcagacattggctttgaagacacctgctcttgcaatgtatttaatatttaatgattgaaattaactggggatcctgatactgatgtgtttattactaaagaatttgaaaaccaagatttccttcatagccatgcatccaaatccatgtctctgcaacttcctttcaacagaaaggatctttctaaggaacgttcccaagaagctttgtaataagggagcacttgctagcaagaagccatctctacttggagcactcctgtgtcactcactaccatcagtgcctgccctgtgctgccaacattgagcttccagagaa

SEQ ID NO: 1662 - DNA, 900 bp, Rattus norvegicus
  Genbank Accession No. D30804
tggagcggcggcggcttgagctcgcgcgtccgcagtgatgagctacgaccgcgccatcaccgtcttctcgcccgacggccacctcttccaagtggagtacgcgcaggaggcggtcaagaagggctccaccgcggttggtgttcgaggaagggacattgttgttcttggtgtggaaaagaagtcggtggccaagctacaagatgaaagaacggtccggaaaatctgtgctctggacgataatgtctgcatggcctttgcagttgtagcctctgtctcaggtctcactgccgatgcaaggatagtcatcaacagagccagggtagagtgccagagccaccggctgaccgtgggggacccagtgactgtggagtacatcacccgctacattgccagtctgaagcagcgttacacacagagcaatgggcgcaggccatttggtatctctgccctaattgtgggtttcgacttcgatggcacccccagactctatcagactgacccctcaggcacataccatgcttggaaggccaatgccataggccggggtgccaagtcggtgcgtgaatttctggagaagaactacacagatgatgccattgaaacagacgatctgaccatcaaactggtgatcaaggcgctgctggaagtggtccagtcaggtggcaaaaacattgaacttgctgtcatgaggcgggatcagcccctcaagattctaagtcctgaagaaattgagaagtatgttgctgaaatcgagaaggagaaagaagaaaatgaaaagaagaaacaaaagaaagcatcatgagggcagcggtcagagcagctttgagcctccatccgagcaaacgggtgctgtgggccttgtggccatttgtcggagtccaataaactactacgtttttt

SEQ ID NO: 1663 - DNA, 1397 bp, Rattus norvegicus
  Genbank Accession No. D50695
ggcttggtcactatggaggagataggcattttggtggagaaaattcaggatgagatcccagcactgtccgtgtctcggccgcagaccggcctgtcctttctgggacccgaacctgaggacctggaggacctatacagccgctacaagaagctacagcaagagctggagttcctggaggtgcaggaggagtatatcaaggatgagcagaagaacctgaagaaggagttcctccatgcgcaggaggaggtaaagcgaatccagagcattccgttggtcattggtcagtttttggaagctgtggatcagaacacagccattgtgggctctaccacaggctctaactactatgtgcgcatcctgagtaccattgatcgggagctgctcaaacccaatgcctcagtggccctgcacaagcacagcaacgcactggtggatgtgctgcctcccgaggccgacagcagcatcatgatgctcacctcagaccagaagcccgacgtgatgtacgccgatattggaggcatggacatccagaagcaggaggtgcgggaggctgtggaactaccactgacgcacttcgagctctacaagcagattggcatcgatcctccccgaggtgtcctcatgtatggcccacctggctgtggaaagaccatgttagcgaaggctgtggcacatcacacgacagctgcatttatccgtgtggtgggctcagagtttgttcagaagtacctgggtgagggcccccgaatggtccgggatgtgttccgcctggccaaggagaatgcacctgccatcatcttcatagatgaaattgatgccattgccaccaagagattcgatgcccagacaggagctgacagggaggttcagaggatcctgctggagctactgaatcaaatggatggatttgaccaaaacgtcaatgtgaaggtaatcatggccacaaacagagcagacaccttggatccagctctacttcggccaggacgcctggaccgcaaaattgaattcccactccctgatcgtcgccagaagaggttgattttctccaccatcaccagcaagatgaacctttctgaggaggtcgacctagaagactatgtggcccgcccagataagatttcaggagccgatatcaactccatctgtcaggagagtggaatgttggctgtccgtgagaaccgctacattgtcctggccaaggacttcgagaaagcatacaagaccgtgatcaagaaagatgagcaggaacatgagttttacaagtgacccctccccacactccccaggcacctgtcccaaaggctagttttctctttacccaggattggtttcgtcaataaatggacgtgattggaaaaaaagcggccgcgaattctagaactagtggatccccc

SEQ ID NO: 1664 - DNA, 3775 bp, Rattus norvegicus
  Genbank Accession No. D63772
ggtccccagcggcagtggcagctctgacagcggcccgtgcgctgtgtctccaccgtgccctgcatccctcatcccacatccgccgcgctccccgattcctcacaaacgccggtgcccatcatggggaagcccacgagctcgggatgcgactggcgccgcttcctgcggaatcactggctgctgctctccaccgtggccgccgtggtactgggcatcgtggtaggagtcttggttcgaggacacagtgagctctcgaatctggataaattctactttgcgtttcctggagaaattctgatgcggatgctgaagctcgtaattatgccactgattatatccagcatgatcacaggtgtcgctgcactggattccaacgtatctgggaaaattggtctttgtgctgtagtatattatttctccaccaccgtcattgctgtaatcctaggtattgtgttagttgtgagcatcaagcctggtgtcactcagaaagtgaatgaaatcaacaggacaggcaaaacccctgaagtcagcactgtggacgccatgttggatctgatcaggaacatgttccctgagaacctggtccaagcctgttttcagcagtacaaaaccaagcgtgaagaagtgaagcctgccagtgatcctggggggaaccagacagaggtgtctgtcaccacggccatgacaacaatgtctgagaacaagacaaaggaatacaaaatcgtgggcctgtactcagacggcatcaacgtcctgggcctgattatcttctgcctcgtctttggacttgtcattggaaaaatgggagaaaaagggcagattctggtggatttcttcaatgcgttgagtgacgccaccatgaaaatcgttcagatcatcatgtgttacatgccgatcggtattttgttcctaatcgctgggaagatcatagaagttgaagactgggaaatattccgcaagttgggcctttatatggccactgtcctgagtgggcttgcaatccactccctcgtagtgctgccactgatctatttcatagtcgtgcggaagaaccctttccgctttgccttgggcatggcgcaggctctcctgacagctctcatgatctcatctagctcggcaacccttccagttacattccgctgtgcggaagaaaagaaccacgtggacaagaggatcacaagatttgtgctgcccgtcggcgccaccatcaacatggacggcactgcgctctatgaagccgtggcagctgtgttcattgcgcaagtgaacggcatggacctgagcattgggcagatcatcacgatcagcatcacagccaccgctgctagcattggagctgccggtgtgccccaggctggcctggtgaccatggtgatcgtgttgagtgccgtggggctgcctgctgaggacgtcaccctcatcattgccgtcgactggctcctggaccggttcaggaccatggtgaacgttctgggtgatgcgtttgggacgggcatcgtggagaagctgtccaagaaggagctggagcaggtggatgtctcctctgaagtcaacattgtgaacccctttgccttggagcccacaatcctggataatgaagactcagatacgaagaagtcttacgtcaatgggggcttctcggtagacaaatctgacaccatctcgttcactcagacctcgcagttctagatgcctggccttagatgcctgggactgtgaagggcatctccgagggagccatctcttagccaactccagcgttaaggagcgagaaggacacaaagaatcaactgtacatttagtttgataaacagacctccagattattttctatatttggctctatagcctttgttctctgggtttgggaacgtggggtgggatgaaccgaaggaaattaagaaagctgtgttatctggactttctaattctgtaaaacaaagtttagaagtatatgacgtagtaactgttaggattaggtcatgggtctgggagaaaaattgctttctcaagcacagaccaatatttggggtttttaaacaatattattggctacaaatttttactcaggctttctattggcggggcttcctttgccttctcactttttatagattataattcagctcaaaagccccacccagtcaactagtgcccaattttccattttgcctcattccagcactctcaactactagtgccaaattttccattttgacctcatctccagcaactctcaaactacttttgggaaaaaaaaaaaagcaaaaaggatcagcatagtctgcaataacagtttcaagatattgtggggcttaggggaagggaagggttttttattcaatgtactgtattgggacgctggatgtcagtgttcggtatagaactatatgtatatgtgtgtatatttattattttcatgtaattttcaagacagagatcagtaatgaactatcaatgtgaacgagacgttttccttgtacttgaatcagggctctagctccagccttgctgtgcttcagagctcacgaggacgctctcaggcgctctggggtgagaaatcaagttgctgggttactgtggttcaagccctaaagcagaaactctagggtggcccagccatccattgacaacatctaaggtcaagctccctggagggtgggaaacccttgtcgggcatggaataagtacatttacaaagggaccgtagaggcaagatgtgctccgatagcaacagaaggcttcattcttcaagtacacttcaaggcccacttcacaaggctgtcacctttctgcccttggttttctctgaccaccagggccaaaccagcagtggcgagccatcacctaagctgtttcaaaatgggctgcataaattgaataagcttcatcggaaggtgaccaagctattctaatactgtagtctttttattttagcttttgttattttatttttttagttttttgagacagagtttgtctacatagccctggctatcctggaactcactatgtagactagactggcctcaaactcacagagatcctcctgcctctgcctccttagtgctggcctgaaaggcaagtgccaccatgcccagctctatgctgaattcttacagaataaaaaccataaaagccgggccacaagctactgataccagtggttcaggggaaatgcttcagtctgtctctggagaagactgttctgaaaatctcggccttgtggcttagaatcctctgcctgtctttctcctgctaatttctgaagatggactattaaaattctacacttctgtccccatcctgtaaataaaacccaacaaaaactcgttcttaatgtggacggattcagaacagccatgtttctgtagtgcccttaactcatcttaaacccgtgcttttatatttgagaagccagaaatcgtgccaaagataacagaaaggtaaacgagtgttgaccatggccacctgaagctacagcctgaccctcacagtgaccagtgactccgaactttgaagtacaaatatccctattctttataggaagcaaatctaaatctaaatgaggttggatgaatactttatgtaggaatggctggttctgtccccttatcaggtggttcttgtctgtggcactgaattaattggcagagctgtccacgagttcactggggtcatccttgtaaccagctgcttaacacactgtgctgttatctcaagaggacgcgttccatttttctcaataaacatctcccacactttctccctt

SEQ ID NO: 1665 - DNA, 6857 bp, Rattus norvegicus
  Genbank Accession No. D83538
ttccagaatcgatagtggttcggcccacctctgaaggttccagaatcgatagtggttcggcccacctctgaaggttccagaatcgatagtggttcggcccacctctgaaggttccagaatcgatagtggttcggcccacctctgatggttccagcacctcccgaggtttttatttcaacacagtgctttcactggcccgctccctggctgtgcagagacctgcatccctagagaaggttcaaaattcggcccacctctgaaggttccagaatcgataggctctggttccagcacctcccgaggtttttatttcaacacagtgccttcactggcccgctccctggctgtgcagagacctgcatccttagagaaggttcaaaagctgctgtgcatgtgcccagtagattttcatggaatcttccagctagatgaaagacggagagatgcagtgattgctctgggcatttttctcattgagtctgatcttcagcacaaagattgtattgttccttatcttcttcgacttctcaggggtcttccaaaagtctattgggtagaagaaagcacagctcggaaaggcagaggtaacctcccggttgcagaaagcttcagcttctgcctggtgaccttgctgtctgatgtggcttgcagggacccctcgcttagggatgagattttagaggcacttttgcaggttttacatgtccttctggggatgtgccaggccctggagattcaagagaaagaatacctttgcaagtatgcaatcccatgcctgatagggatctcgaaatcttttggacgttacagcaattcagaagaatctctcctctcaaagctttttcccaaagtccctcctcattccctgagaatccccgaagagctagaaggtgtccgaaggcgttcctttaatgacttccgctccatcctgcccagcaacctgctgactgtctgtcaggagggcacactgaagaggaaaaccagcagtgtgtccagcatctctcaggttagcccagaacgtggcatgccccctcccagctcccctggaggatctgcttttcactattttgaagcctcttgcctgcctgatggaaccaccttggagcccgaatactacttctctaccatcagctccagtttttctgtctctcccctgttcaatggtatcacctataaggagttctatattccactggaaatgcttcgagaactcttaaacttggtaaagaagattgttgaggagcctgttctcaagtccttagatgcagctgtagccagagtgatggaggccaatcccagtgctgacctatactacacgaccttcagtgatcccgtctacctgaccatgttcaagatgcttcgagacactctgtactatatgaaagacttacccacctcctttgtgaaagagatccatgattttgtgttggagcagttcaacatgagccaaggggaactccaaaagattctccatgatgcagacaggatccacagtgagatgagcccactcaaactgcgctgccaagcaaatgctgcctgcgtagacctcatggtgtgggctgtgaaggatgagcagggtgcagaaaacctttgcatcaagctgtctgaaaagctgcagtccaagacatccagcaaggtcatcatcgcccatttgcccttgctgatctgctgcctacagggtctgggccgcctatgtgaacggttcccggtggtggtccactcagtgacaccatctttgagagactttctggtgattccatccccagtgctggtgaagctctataagtaccacagtcagtaccacacagttgctggcagtgatataaaaattagtgtcaccaatgagcattctgagtcaactctgaatgtcttgcccggcaagaagaaccagccatccatgtatgagcagctccgggacatcgccattgacaacatctgcaggtgcctgaaggccggcctcaccgtggaccctgtgatcgtggaggccttcctggccagcctctccaaccggctctatatctcccaggagagcgataaggatgctcacttgattcctgaccataccattcgtgccttgggacacattgcagtggctctgagggataccccaaaggtcatggagccaattctgcagcagaaattttgccagcccccctcacccctcgatgtgctcatcatcgaccagctgggctgcctggttatcactggaaatcaatacatttatcaggaagtgtggaatctcttccaacaaatcagtgtgaaggccagttcagttgtatattcagccaccaaagactacaaagaccatggctacaggcactgctccctcgcagtcatcaatgccctggccaacatcgcagccaacattcaggaggagcaccttgtggatgagctgttgatgaacctgctggaactgtttgtgcagctggggctggaggggaagagagccagtgagagggccagcgagaaggggcccgccctgaaggcttccagcagtgcagggaatttgggagtgctcattcctgtaatagccgtgctcacccgacgattgccacccatcaaagaagctaaacctaggctacaaaagcttttccgagacttctggctctactctgtgctaatgggattcgctgtggaaggctcagggctctggccggaagagtggtatgaaggagtctgtgaaatagcaaccaagtcacctctgcttacctttcccagcaaagagcctcttcgatcagtcctccagtacaactcagccatgaaaaatgatacagtgaccccggctgagctgaatgagctccgaagtaccatcatcaacttgctagatcctcctcctgaggtgtctgccctcatcaacaagctggactttgccatgtccacctatctcttgtctgtgtatcggctggaatacatgagggtgctgcgttctacagatccagatcgcttccaggtaatgttctgctacttcgaggataaagctattcagaaagacaaatctgggatgatgcagtgtgtcatcgctgttgctgacaaagtatttgatgccttcctgaacatgatggcagaaaaagccaagaccaaggagaatgaagaggagttggagcggcatgcccagtttctgctggtgaacttcaaccacattcacaagaggatacgcagagtggctgacaagtacctgtctggtctggtggataagtttccacacttgctctggagtgggactgtgctgaagaccatgttggacatcctgcagaccctgtcactatcactaagtgctgatattcacaaggaccaaccttattatgacattcctgacgccccctatcggatcacggttcctgacacgtatgaagcccgggagagcatcgtgaaagactttgctgcacgctgtgggatgatcctgcaggaagccatgaagtgggcacccacggtcactaagtcccacctgcaggaatatctgaacaagcatcagaactgggtgtcaggactgtcccagcacacgggattggccatggccactgagagcatccttcactttgccggctacaacaagcagaacacaactcttggggtaactcagctcactgagcgcccggcctgtgtgaagaaagactactccaacttcatggcatccttgaatttgcgcaaccgctatgccggcgaggtgcacgggatgattcggttctcaggtgccacaggccagatgtccgacctgaacaaaatgatggtccaggatctgattacagctctggaccacagtcatcctcagcactatacccaagccatgttcaaattgacggccatgctcattagcagcaaagattgtgacccacagctccttcatcatctgtgttggggtcccctccggatgttcaacgagcatggcatggagactgcactagcctgctgggagtggctgctggctggcaagaatggagtggaagtgccgttcatgcgggagatggcaggagcctggcacatgacagtggagcagaagttcggcctcttctctgcagaaacaaaggaagcagaccccctggcagcgtcagaagcaagtcagccacgaccctgtccccctgaagtgacacctcactacatctggattgatttcctggtgcagcggtttgagattgccaagtactgtagctctgaccaggtggagatcttctcaagcctgctgcagcgctccatgtccctccacatcggtggagccagggggagcatgaacaggcatgtggcagccattggaccacgtttcaaactgctgaccctggggctgtccctcctacacgctgatgtggttccaaatgcaaccattcgaaacgtgcttcgagagaagatctactcaacagcctttgactatttcagttgtccaccaaagttccctactcaaggagaaaagaggctgcgtgaagatataagcatcatgattaagttttggactgccatgttctcagataagaagtacctgactgccagccaactcgttcccccagataaccaggacacccgaagcaacttggatataactgtgggctctcgacaacaggctacacagggatggatcaacacataccccctctccagtggcatgtcaactatctccaaaaaatcaggcatgtctaagaaaaccaaccgaggttcccagctgcacaagtactacatgaagcgtaggacgctgctgctgtcactgttggccactgagatcgagcgcctcatcacttggtacaacccgctgtcagccccagagctagagctggaccaggcaggtgagaacagtgttgccaactggaggtccaagtatatcagcctgagtgagaagcagtggaaggacaacgtgaaccttgcctggaccatctctccatacctcgctgtgcagctgccagccaggttcaagaatacagaagccattggaaatgaagtgacccgtctcgttcgcctggacccaggagctgttagtgatgtccctgaagctatcaagttccttgtcacctggcacaccatcgatgctgatgctccagagcttagccatgtgttatgctgggcacccacggacccgcccacgggcctctcctacttctccagcatgtaccccccacaccctctcactgcacagtatggggtgaaagtcctgcggtccttccctccggatgccattctgttctacatcccccagattgtgcaggccctcagatatgacaagatgggctatgtgcgcgagtacattctctgggctgcagccaaatcccagcttctggcacaccagtttatttggaatatgaaaactaacatctaccttgatgaagaagggcaccagaaagaccctgacattggtgaccttctggagcagttagtagaagaaatcacagggtctctatcaggcccagccaaagatttctatcaacgggaatttgatttctttaacaagatcaccaacgtgtcagctatcatcaagccctaccctaaaggcgatgaaagaaagaaggcttgtctgtcagccctgtctgaagtgaaggtgcagcctggctgctacctgcccagcaaccctgaagcaattgtgctagacattgactacaagtcagggacaccaatgcagagtgctgcaaaagcgccgtatcttgccaagtttaaggtgaagcgatgcggagtgagtgaacttgaaaaagaaggtctgcagtgccgctcagacacagaggatgagtgccgcaggcaagaggctgatggcaagaagatctgctggcaagcagccatcttcaaagtgggggatgactgccgacaggacatgctagccctgcagatcatcgaccttttcaagaacatcttccagctggttggcctggacctcttcgtttttccctatcgggtagtggctactgcccctgggtgtggggtgattgagtgcattccagactgtacctcccgagaccagctaggccgccagactgacttcggcatgtatgactactttacacgccagtatggggacgagtctaccttggccttccagcaggcacgctacaactttatcagaagcatggcggcctacagcctcctgctgttcctgctgcagatcaaggacaggcacaacggcaacatcatgctggacaagaagggacacatcatccacatagactttggcttcatgtttgaaagctcaccgggtggcaaccttggctgggagccagacatcaagctgacagacgagatggtgatgattatggggggcaagatggaagccacacccttcaagtggttcatggagatgtgcgtccgaggttatctggctgtgcgcccctatatggatgcagtcgtctccctggttacactcatgttggacacaggcctgccctgtttccgtggccagacaatcaaacttttgaaacacaggttcagcccgaacatgacagagcgggaggctgcaaattttatcatgaagatcatccaaaactgtttcctcagcaacaggagccggacctacgacatgatccagtactaccagaatgatatcccctactgaggagactgtacctgaagccttgagtgtcacagagcagcttgtactgtcaccataagcctgggtgtggaggtgacaggcacatggaacttggatgcacaggtgtgagtctttttcacactggacacattccctatttgttcacccatcttactatgttggtacatgaagtattttcctgtgtaaacatgagaaattgacataaaaaataagaaccctaaaatgtgctacttctgtttgttaggtcaccaagactttgtccttagtcaaaggtaccctttgaatccctggtccttccaactcacacctagcttagtcttgctttgatttggtcctgaggatc

SEQ ID NO: 1666 - DNA, 433 bp, Rattus norvegicus
  Genbank Accession No. D84485
  misc_feature (1)..(433): n = a or c or g or t
acaaaaaactgtttattgctgtgacagccaccagaagctgtcaaggagcccattgctgtgaggggccaggcagccagtggatgggctgaacgccagtctcacgagtcaaccaacctgctgctggccccgcccacccagcaataggctgtcacactgattaaaacccaaccaggagataggaaacccccataggttcaccttcctaggtctcatgacctagacgaagaagagtgccccaaatacccctccaaaataagacctgccctggtccctcatatttctgaggatcctggggtgtcatacagccctgcagcaagccagagttgcagccccaaggaagtaccagctcctctctgttccacaggctgtcccaagantccagcccaaggtattcagctgcctctagaatgcagggggggaatcactaggaata

SEQ ID NO: 1667 - DNA, 1911 bp, Rattus norvegicus
  Genbank Accession No. D89730
gatgttgcaaacagttttcctaactatgctgactctggctctggtcaagtcacaggtcacggaggaaaccattacatacacgcaatgcaccgatggatatgaatgggaccctgtaagacagcagtgcaaagatattgatgagtgtgacattgtaccagatgcttgcaaaggtggaatgaaatgtgtcaaccactatggaggatacctctgccttcctaaaacagcccaaattattgtcaataacgaacagcctcagcaagaaacaccagctgccgaagcatcgtcgggtgctgccactgggaccatagctgccaggagcatggctaccagtggtgtgatccctgggggtggcttcatagccagtgctactgcagttgctggtcctgaagttcagacaggccgaaataacttcgtcattcggaggaacccggctgaccctcagcgcatcccttccaacccttcccaccggatccagtgtgcagcaggctatgaacagagtgagcataatgtgtgccaagacattgatgagtgcacctcagggacccacaattgtagattggaccaagtgtgcatcaatttacgtggttccttcacatgccactgtcttcctgggtatcagaagcgaggcgaacagtgtgtggatatagatgagtgctcagtgcccccatactgccaccaaggatgtgtgaacaccccgggttccttttactgtcagtgcaatcccgggtttcagctggcagcaaacaactacacttgtgtggatataaatgaatgtgatgccagcaaccagtgcgctcagcaatgctacaacattcttggctcattcatctgtcagtgcaaccaaggatatgaactgagcagtgacagactcaactgtgaagacatcgatgaatgcagaacctcaagctacctgtgccagtatcaatgtgtcaatgaacctgggaagttctcatgtatgtgtcctcagggttaccaagtggtgcgaagcagaacctgtcaggatataaatgaatgtgagaccaccaatgaatgccgagaagatgaaatgtgctggaattaccatggtggcttccgctgttacccacaaaacccatgtcaagatccctatgttctaacgtcagaaaaccgatgcgtttgcccggtctcaaacaccatgtgccgagacgtgccccagtctatagtctacaaatacatgaacatccgatctgacaggtccgtgccatcagacatcttccagatacaggcaacaacgatttatgcaaacaccattaatacttttcggattaaatctggaaatgaaaatggagagttctacctacgacaaacaagccctgtgagtgcaatgctggtgcttgtgaagtcgttaacaggaccaagagaacacatcgtgggcctggagatgctgacagtcagtagtatagggaccttccgcacaagctctgtgttaagattgacaataatagtggggccgttttcattttaaacttttattcacataaagcctaccacaggcatttaaatcagccaaagaatatcattacattaaagtttattttatttatagctctatctagtacatctatattcaaacagctagactatggtaggaagtgggcatttaatccataagagtcaacatttatctttatcactgtgtgtaaattagacattagtccaacattcttcttgaagagagctaagcatatattatctagtgaaacttggattctttcctacaaaaatggggccaagcaatgatactgttctgtggtgaatagagaaatatacacctccacaaacaatctcatgaggattggccatctaaacatcaagagcaagaagggttttttttttaacttctttgtaagaaaatggaaaaaagtcaataaagatatatttctttagaaaatg

SEQ ID NO: 1668 - DNA, 3657 bp, Rattus norvegicus
  Genbank Accession No. D90109
ccaacacagaactatggaagtccacgaattgttccggtattttcgaatgccagagctgattgacattcggcagtacgtgcgtacccttccaaccaacacactcatgggcttcggggcttttgcagcgctcaccaccttctggtatgccacccggccgaaggccctgaagccaccatgtgatctgtccatgcagtctgtggaagtaacgggtactactgagggtgtccgaagatcagcagtccttgaggacgacaagctcttgctgtactactacgacgatgtcagaacgatgtacgatggcttccagagggggattcaggtgtcaaatgatggcccttgtttaggttctagaaagccaaaccagccatatgagtggatttcttacaaacaggttgcagaaatggctgagtgcataggctcggcgctgatccagaagggtttcaaaccttgctcagagcagttcatcggcatcttttctcagaacagacctgagtgggtgaccatcgagcaggggtgcttcacttactccatggtggttgttccgctctatgacacgcttggaaccgacgccatcacctacatagtgaacaaagctgaactctctgtgatttttgctgacaagccagaaaaagccaaactcttattagaaggtgtagaaaataagttaacaccatgccttaaaatcatagtcatcatggactcctacgacaatgatctggtggaacgcggccagaagtgtggggtggaaatcatcggcctaaaagctctggaggatcttggaagagtgaacagaacgaaacccaagcctccagaacctgaagatcttgcgataatctgtttcacaagtggaactacaggcaaccccaaaggagcaatggtcacccaccaaaacattatgaacgattgctccggttttataaaagcgacggagagtgcattcatcgcttccccagaggatgttctgatatctttcttgcctctcgcccatatgtttgagaccgttgtagagtgtgtaatgctatgtcatggagctaagataggatttttccaaggagacatcaggctgcttatggatgacctcaaggtgcttcagcctaccatcttccctgtggttccgagactgctaaaccggatgtttgacagaatttttggacaagcaaacacgtcagtgaagcgatggctgttggattttgcctccaaaaggaaagaggcggagcttcgcagtggcatcgtcagaaacaacagcctgtgggataaactcatctttcacaagatacagtcgagcctgggcgggaaagtccggctgatgatcacaggagcagccccagtgtctgccacagtgctgacgtttctgagggcggctctcggctgtcagttctatgaaggctacggacagaccgagtgcaccgctggttgctgcctgagcttgcctggagactggacagcaggccatgttggtgcccccatgccttgcaattatatcaagcttgtagatgtggaagatatgaattaccaggctgccaagggcgagggtgaggtgtgtgtgaaaggggcaaatgtgttcaaaggctacttgaaagacccagcaagaacagctgaagccctagataaagatggttggttacacacgggggacattggaaaatggctgccaaatggcaccttgaagattatcgacaggaaaaagcacatatttaaactagcccaaggagagtacatagctccagaaaagatcgaaaatatctacctgcggagcgaagccgtggcccaggtgtttgtccatggagaaagcttgcaggcctttctcatagccattgtagtacctgatgtggagatcctaccttcctgggcacagaagagaggatttcaagggtcctttgaagaactgtgcaggaacaaggatatcaataaagctatcctggaagacatggtgaaacttgggaagaatgctggtttgaagccatttgaacaggtcaaaggcattgctgtgcacccggaattattttctattgacaatggcctcctgactccaacactgaaggcaaaaaggccagagctgcggaactatttcaggtcacagatagatgaactgtactccaccatcaagatttaacatgaggaagaatccttagaggaaatggcgcacctccacaatcctcctcgtaccaatggcctttgagttggtaactctgcctgcagcgagtgtgggaaaggaaatgccatgctggacttgtgcacagggtcttaccatagggatagcagagggcacggaacactgccttacagtcacctgtgttgtagcccatgatcctggggatacacagtttccaaaacgagccttaaacattgtaaaggggaacccataaaagtgctaagttatttaagacttcaaccaataaggtgggtgttaaaacttctgtctcctgtttttctaaccaaggggttaggacttactctttctgatacgtctgctgctggctgcacaccctgcagccgtctgctgctctgaagagtacagtacactggaagaaagctacccctttaagagcaactgtccaggctgaagaaagtcacagtggaccagagatttctcttcttaaccccttccccttgtccctttccctcaccactcacatgcagtacatttatgtgacccttctggtttgtaagggttccaaagggtccctgttgtgcctgctggtaacctcgtgtttccagtacactaaagaacagatcctcctcagaacaatgcgggtacccagtctcagaaaaggaaaaaaaaaaaaaggtggctcctgcgttgagccagcaacttgcaggctcacacagatgtcctcagactccgctccatctctgctccctgcccctcccattcttcccaggggttatgagaaaccctgccttagactctgcagtgaagatggtgttccgaagaatgacctggatgggccatgctcaactgtgattcctcccccgctgtccactcgctcgctcgtcgtggaaccagcccgtatctgcagcggcctctgtgctccaaatgtggttttctagcaaatgctaatgtggtgatcaacttgctttgttttctttccctcccagttaaactcaggcacagcatgtcttcagaagtatctaggcagttggtatacgtgggtacttattaaagtggacagtaataagtaaatgtccttattataaaactacctgatttatgtgaaatgcatttgataagccaaaaatctggggtgtagaaatctgggggaaaaaaaatcatatcctgggatcaacttcccaaggtatattttttaagttaatttgggaaatgaacagcatttcactttgccgcgagtcttggccacatttgacctatttgagctgtttatacatttgaagccactgttgttggctgtgtgacagtgtgtgtatcttgaagcacaactgggtttgcactaaagaatcatcattgtaataacactatttggtagcctaacttcattttcgtattcttaactgcacaggaagtcgataatttgtcacaacggggttttgaatgtttgctttcagtgttggctatttctatgttttataaaccaaaacagaatttccaaaaacaatgaaggaaaccaaaataaatatttctgcatttggagtgagtgg

SEQ ID NO: 1669 - DNA, 1983 bp, Rattus norvegicus
  Genbank Accession No. E12286
ggaccgtcgccatgcgtcgtgtaccgctgctgctcgtgctgggcttgctgttcgtgctgggcttgctgttcgctggccctgtcgccccttcgcgcctcatctcgaagcgcccttcccaacttggtggcttctcctgggataactgtgatgaaggaaaggaccctgcagtgatcaaaagcctcacgctccaacctgaccccattgtcgttcctggagatgtgatcgtcagtgctgagggcaagaccagcattcccctcacttctcctcagaaggtggagctcaccgtggagaaggaagtggctggcttctgggtcaagatcccttgcgtagaacagctaggaagctgtacctatgagaatgtctgtgacctgatagaccaatacatcccccctggagagacctgcccagagccgctgcacacctacgggctgccctgccattgtcccttcaaggaaggcacctactcactgccttcgagcaacttcacagtgcctgatctggagcttccaagctggctaagcacgggcaactaccgcatccagagcatcttgagcagcggtggaaagcgcctggcctgcatcaagattgccgcctctctcaagggcaaataaccaggcagcagccaccatagaatgaaagggcaccaggaaggcatgcttcttcttctgtgttccggggcccagagctgcctgcctctaactccgttctatggttctctaccctttctgcaaatcacgacaacctgacctgagggaggatggaccaggcgggtctcgacatctgttgggctgtacgccatgctccttcgcacccctaccaactttctaagagtttctctcatgtcccaaacagtcaaggaatgggaaccaacatgttatggaatcttaagttcaagctggcccaacatgggcctcctgaagctatgctcaccccacctcttcgttttagccaccaacttaaaaaccaagatgacagtattaatctctcattccaccctaaacctctcatccagcaaagaggtctaggtagccagtcttaggtctgcccccctattaacttccatgattaactacattccctttgcaacttgcctagccaacactggggctgacagatcctgaaagggcaggatggcgtgtgacagaaaccctgggagagttattgttgggcatgccccattaacctcagtaaagcacaggtgcccagggccaagcagatcgagggagccaaagcagtcactcccaggagcgatgcccacttttcttcctttggtatgacgcatacagaatgggatgacattccttatacctgacaagaaacaaaactgaaaccccaacagcacatgtgctccagtgccaggaggccagggtctggaatggcatgtctagtcctggaggtacagtccagtgacctgtaagtgccatgtaaggaatgttaccggatatttgcaacagttttcttccttaggccccaaaccccagacttttctatgaagtcttagattttttaactattagaaacaaattgttttttatatactgttcaggccaaaggggccacgtggacttgtctggggggtggggggggacatagctggctcacaggtggctgctttttttctcacacctgttcgtcttctcagtctcaagttatctgacttcatttctctccccctcaaggtcaagtccttggtaccagacctcagagagggctcagcctgcactggagcaggtctgcatggcctctgagagctgggccctgtgccagcctcagagccccatcaccatcagggtataggggttcacactggagtggatctccccacccccaccccccagcagccaccttgtggaacaggggtcccatgtagagagtggatcccacaccgggttgtaccatgacaacttcctgagcctccgtcagcccggttctggactgcaagactagtctgtcaataaatcttcttaaaaaaaaaaaaaaaaa

SEQ ID NO: 1670 - DNA, 355 bp, Rattus norvegicus
  Genbank Accession No. H31144
  misc_feature (1)..(355): n = a or c or g or t
gacgtaaaatagaaacagactttatttctctggaagaagcagatatccatggctgggacanagctttggcaacanaggcgatgggaacacatcaaatggacacaggggaggaacaggcatcaaacaggacaagtactggtgccgctggggtctccctccacacccggggcctggggccctggtccctgccagagaagatcctggcgcctcttctgtttctnagccacttcaggctgtttacanttacaagatctaagaccagccaagcccgagttcacagtgaagccacaggtcacattctgtccaacactccacattcctacaggggttccctgggaaaagggggcctggtcct

SEQ ID NO: 1671 - DNA, 356 bp, Rattus norvegicus
  Genbank Accession No. H31456
agtctacatacacttttacttattcataaatactgatttacatataataacccacacaattttatcttcaaaaacaccatccaaaacttcaagttaaatatactgcaggattaggttgagtttttatttatttttgaagtttagtttttaaccatgtcttccttcaggtatacgtcatcagaacagcacacaggaaggacactttggggcatgtctagcccaccagcagatccatttctaggcatacaggctactacacttggcatggtcgtgtcacccaacttctctgggactgccctttcctttggaagggacctagctcaactgtgattttttgtggttcagatggtgtcaaa

SEQ ID NO: 1672 - DNA, 482 bp, Rattus norvegicus
  Genbank Accession No. H31625
  misc_feature (1)..(482): n = a or c or g or t
atagtaaaataaatgactttnatttggatactttcaaaataatacacatctatgaaaaattaacgttcaaaccccaaaattatcctgcatattgaaggatgagaaacatttgcnttgctgagccattttttggaagagcctctgaagaaattgaatgttcccagtttacagagcattagcctatatccctttcttctgggaaacaaccctcctaggctgcagtggactttgagtcatgagaggacttggtgtgggtgccgatggttccgcgatgggtcccattgctgggaatggggagccgggttccttggtccacctggctagttattgggaggagtcatgccttctcaggtgtcaatgagcaggctcaccactgagcggattttgcaaggcaaaccatcgcctaggggncaaaagtattgataggggaattnttcaaactcaggggtcttgcggtatctcggaaaaggaacgcaaaggca

SEQ ID NO: 1673 - DNA, 349 bp, Rattus norvegicus
  Genbank Accession No. H31665
  misc_feature (1)..(349): n = a or c or g or t
atgttcagacttattttaataacaatacatacaccatcttggcactgtggatggaatgtaagtncaggttggacagggggattttacagtgcatttaatattctgtgtatccaaatttgtatgtaaatattggaaaaaccagcccgcccaccgttcacctctcaccttcggtactttaatagccatggccttatagacggtggccacgcggcctgcacaggctgtgtgcattaggccctttagccttgttttacacttgcagcacctacttctgctggggttcaactcagtgcacagcacttgcttagcctatgtgaggcccctgcacttaaatgcccagcaccacaaa

SEQ ID NO: 1674 - DNA, 518 bp, Rattus norvegicus
  Genbank Accession No. H31802
  misc_feature (1)..(518): n = a or c or g or t
agattaaatgagtttattctcaccgatagccaaaggagctttagagacaaacagtgtgctgtnccagagggagctaacagaagcgtttataaaggtagatgccaaaggtgcccattaaaattatctacggaattcatagctgggcaggaaaattggttttctccccttacttttttttttttaaggtttatttatttaatgatttaaagtatatgagtacactgcagctgtcttcagacacaccagaagagggcactagatctcattacagatggttgtgagccaccatgtggttgctgagaactgaactcaggacctatggaagagcagtcagtgttcttaaccactgagccatctctccagcttgcccaccccaccccccacccccgttgtttctttttcctgtgtataataatgaaaagatcacttactctagtcacataacaatgatggagtttacaaaatcagagagcagggacaccattatctttctctgatctcaccagcaggccactaag

SEQ ID NO: 1675 - DNA, 377 bp, Rattus norvegicus
  Genbank Accession No. H31842
  misc_feature (1)..(377): n = a or c or g or t
aaaataataaagacatgttttatttcttagtaggtaaaattttcctaaaagtcaagttgatccgaggagccaggaccctcttgcggatggggagactgtggtaccagtgggtgttggtggggtggttcatcatcagcaggcttccatgggccagctgcagcctgaccacctccactgccctccggggcctcttcccccgagagtctttgtgccggaagaggatgtctctgcaggcaccgaagagacggacgcgatggggctccccggggccagttctcgttcatcgtctctgtgctccccaatgtggtcacagccgtctttgtacctgttcacgagcacaaagttgaaggtctgtcctgtcancctgcagacttggt

SEQ ID NO: 1676 - DNA, 363 bp, Rattus norvegicus
  Genbank Accession No. H31982
  misc_feature (1)..(363): n = a or c or g or t
gtttgtnctttttttcagagctggggaccgaacccagggccttgcgcttcctaggcaagcgctctaccattgagttaaatccccaaccccaagactttcttttaaaaagacagtactctacggattgaaggattacaatccttcaatcctgatgaactctccatattactggaaccacacactggagcactactgggagccagtgaagttggtgcctcaggatatggggctgttcccctcagccatgggttatctgtgaatatgacccatcacagtctgaatttatctgggaagaaaaagagctcataagtctgtgtacacacttaacacaccacagcacttagactgcattaggtattaggg

SEQ ID NO: 1677 - DNA, 376 bp, Rattus norvegicus
  Genbank Accession No. H33001
  misc_feature (1)..(376): n = a or c or g or t
atactagggacgtggagatgttaaaacgacaacaaaaaatatatatatataaaancaggaatgaaatctgtgagagaatatttttggttctaaagacgggtgcatccgtttgtnttcgcccgantcccttgccggagaccacgcgggctgtgacattgcacggagagggcagctttgggttcccggccgtcactgaaatcactgaaaccaccggaaggcagctcccgacggaagcatcaccttctggtggggcgggagacaaaaacaaggagagagttcagtcagggtcccggtgggcctggtgcaagatgctccccgtggccggctcaaatgaccggaggnaccgggcattgagaaccgnatggcccatttaccc

SEQ ID NO: 1678 - DNA, 351 bp, Rattus norvegicus
  Genbank Accession No. H33101
  misc_feature (1)..(351): n = a or c or g or t
cggagctggggactgaacccagggccttgtgcttgcnaggcaagcgctctaccactgagctaaatccccaacccctagagcagacactcttaagtggcacagtggtaaccgggctcctagagtgtcagaaccctgacatctttcttttcagagacagagggggccggatggaggggaagcagcctctgctccttaccttactctgcaacactgagaaaccagaaaaaaagacctgggactatattaagactcccaaagtaaaactatatggaagtgtttattttttaaagtctagtaccagagaacaggacagacatgacagttactactcacaaggggcagtgtcccact

SEQ ID NO: 1679 - DNA, 381 bp, Rattus norvegicus
  Genbank Accession No. H33219
  misc_feature (1)..(381): n = a or c or g or t
cttttaaattattttattattgtataagctaaanggaaatttacacactgaaatctcaaaacccttgggcatgcatattaacccgttagaggttcttctacatgtctctcctgcttccataggaattgccccaaacgtttaaaacccacagcttgtttttttgtttttttactgtatatacagcctaaaccatagcaatctaggattatgtcattttacactgtgcaaaatcctcaaaaaatagtggtatgacagagcagaaagatctctacaaatttcattttaagacattcatataattnggtccttctccaaatcacaccaattaaaacaggcacattctctgtcaagcctccagtcacgncctgacagtgatcccgg

SEQ ID NO: 1680 - DNA, 422 bp, Rattus norvegicus
  Genbank Accession No. H33426
  misc_feature (1)..(422): n = a or c or g or t
aaagatttattcatgcagtttatgtatatgagtnctgtcttcatacacatcagaaggaatcagacctcatagatggttgtnagccactatggggttgttgggaattgaacttaggacctctggaagaactactgggtgctatcactcagacccaggtttttgggagagacagtgtcctgtgtagcctataactgattaggaatttgaatctcttctgcctccacctaccacatgctgggatgactgctaagagttgtagcttccagaaaggatgaacattaagacctttgtgcttctgtaacagaagttaaagaaccatgggaacattactttggtttcaacaggatggtgtttgttcaaggctgagagcctcaagtgagcaatttagcagagtctgtatacaaacagatttaccactgggg

SEQ ID NO: 1681 - DNA, 318 bp, Rattus norvegicus
  Genbank Accession No. H33472
  misc_feature (1)..(318): n = a or c or g or t
agggagccatagactcagccatttatttcaagtcttcacagaaagcagtgtactattaagnggaattaacacatcttgatacttctaccatcgnggcatacacagcagataaccattcgctgtcccccacaactatccaaatgcagtcactggtacagcccaggntctgaaacccaatggtaatctgctgaggacactcctctcaagtctgtcctagagccttcctcgcccagcaggtctgaatgcagaagccaggccaggcagtggaatactccttccggttccttttcacacagntcagccctgtccgggctcacg

SEQ ID NO: 1682 - DNA, 283 bp, Rattus norvegicus
  Genbank Accession No. H33528
  misc_feature (1)..(283): n = a or c or g or t
cccaaatctaaaactacctttatttgtggctggctcagcataagtngccttcatcagtgagcagaattataaaactgtacaagaggtaaaaaaataggccgtttaacttagtgaccctcatatcatgagctttgaaaatacacataaaattgtacaatctggcagtttataaaatataaagctaaaaagaatattttagttcccacaaagaggagtgaatcacacaatcagcacatatccattaaacanttaactgtccacagagaagacacatggcacaaga

SEQ ID NO: 1683 - DNA, 360 bp, Rattus norvegicus
  Genbank Accession No. H33656
  misc_feature (1)..(360): n = a or c or g or t
ggagaccaaagggcttgggttttatttgccattccataaatacgggccgcaccttggtccgagtctgtcaggaagctggaggcgtttgcggtcggccttggtggggtgcagttagcgaggagccacgctcgtnaaaaaatggggagagaaagcacgttatgtacacggccagagcgggcacccaggtgccctcctgtgcctcaggaccctgggtctgggatgagcaggagcagggctccatgtgccagatcctatacatagccctcctcctgcaccaggcctgacagactacttcaagagggtggagagaggctggcttggtctgaccagcaggcagttggactaaaggaaggagaggcc

SEQ ID NO: 1684 - DNA, 389 bp, Rattus norvegicus
  Genbank Accession No. H33660
  misc_feature (1)..(389): n = a or c or g or t
aagagcttnctaaaactctttattaatcaaattgttaacttttaatagaacttgagacaaaaatctacagtttaaacagctatcttatggtaataaacattaatcctgtaagtnctgtggagaagcagttactccacatatagagacctaggtcaggaattggaaccaactagattacttagggaaggagttttncgaagttagttttgacatgaccaaattcagtgtgttctgaatacttgtgttatttctctctactatagaagaatttctnccgcttgtttttccatttncttctgattcaagggggaggagagtatgcgggttgaatagatttcgaggttcccccaagatgccaactacgggcataaccacagactccagattcg

SEQ ID NO: 1685 - DNA, 419 bp, Rattus norvegicus
  Genbank Accession No. H34186
  misc_feature (1)..(419): n = a or c or g or t
tggctgtggaccttccaaggtcgtcttctccagaagaacaacaaggaccgcttctnccagctgctctggagaccaaggcccccaacactcctcantcaggntcagataaagcaaattaaaaaggntctgaagaaatactctaagatctttgagcagaaggttcgcttgagccagtccaaagcttcaaaggaactggtggaaagaaggcggaccatgatggaggacttcaggcaataccgaaaaatggcccaggaactctatatgaagcagaagancgagcgtctagagctacggggaggggtggacactgacgagctggacagcaacgtgngatgactggtgaggaagagaccatttganttttttnttcactgaagaggtcattcctctgggaagttcaggagtgacctcagcactgt

SEQ ID NO: 1686 - DNA, 312 bp, Rattus norvegicus
  Genbank Accession No. J00797
gggagagattacctcataccatgtcgcttgcaccaatcaccactctcctgtcgcggcttctctgggcagacggaggggtctggaccaacaggaaaggccttggcccatccccatggtgaccggagctgtatataaggggcgcatccggcccaagtgccggcaggttctcttacatcgaccgcttaagagtcgcgctgtaagaagcaacacctcctcctcgcctccgccatccacccggcagccgcgaagcagcaaccatggtgagcaaaccttcccgagttctcaggagcgggtgggtgtcagcccggctca

SEQ ID NO: 1687 - DNA, 1195 bp, Rattus norvegicus
  Genbank Accession No. J01878
attcttagtatatgactatataagtacacattcagatctttatttccataacctaagtttttatttttttttgttgcagcgcttggcagttttatatacattcatacatacatacatacatacatataatatttgcaataacagaataataaagaattatacaatcaagtatatagttgatgtttgatgtctgtagcaaatatgaccaattctgtaacgactcagatgaaactggaaattatttttcctgtactttctgagtacaagaaggtttacattcatcaacattctgttagtaatgatgcaggaaactacatgaataccaaataaaactgttgaataaacgattcgtatcatgctgtatttaaaacaaatacttcagaaattgccagttttaggctgctggtgtagtgtgttctggatattttaaatgtgtagtcgctgactcacttggcctcctgagatggtttataaatataacaagtgtggaggagagagcgattctagagcacagtttagaaagccttgtgtcaggggcttgttgctcacgcactggttgctttcccatagtcacttccggctagtacagagattaacttccattcaggattccacgaatctactggctgtgttttcagacagtgcccttttcatgataagatcttcttcctccaactcccaccccctacatacgcctctgctttcttcatttcaaatcaaagtattttttcctcttcgacatcgtgaagccgtgctgccttcagagctctgagtcatgggcagagagtggctcccccagcattctgcgttgggtcccacatacttccaaatgtgcacatttgcggggtgaatcaatgctgtggaggaggattccagtaactctggcccttcccactgcctgcacaggctgcccatgatttcctcccaccccatctgtcaagcattgaaagtgaagagaaattctgtccaatatgttgtttgaagggataccaaagggaggaaaaagctcccacccaaaataatgggctttttctttcacataatgtaaacatgtaaaatattgatgggtatcaaatcttcatttaaagatctggtacagggggctggggatttagctcagtggtagagcgcttacctaggaagcgcaaggccctgggttcggtccccagctccgaaaaaaagaaccaaaaaaaaa

SEQ ID NO: 1688 - DNA, 1639 bp, Rattus norvegicus
  Genbank Accession No. J02827
tccgcggccaagatctggaggccgagccgtggcctgcgccaggctgccctcttgctgttggggcgacctggggctcggggcttggctagattccaccccagcaggcagcagcaacagcagttcccatccctggatgacaagccccagttcccaggggcctctgcagagtttgtagacaagcttgagttcatccagcccaatgtcatctccggcatccccatctaccgcgtcatggaccgacagggccagatcatcaaccccagtgaagatccccacctgccccaggaggaggtcctgaagttgtacaggagcatgacgctgctcaacaccatggaccgcattctctatgagtcccagcgacagggccggatctccttctacatgaccaactatggcgaggaggggacacatgtggggagtgccgctgccctggagcgaacggacctggtgtttggccagtaccgggaggcaggtgtgctcatgtaccgggactacccgctggagctgttcatggcccagtgctacggcaacgtgagtgacccaggcaagggacgccagatgcccgttcactacggctgcaaggagcgtcacttcgtcaccatttcctctccactggctacgcagatccctcaggcggtaggggcagcctatgctgccaagcgggccaatgccaatcagatcgtgatctgttactttggcgagggggcagccagtgaaggggatgcccacgccggtttcaattttgctgccaccttggagtgtcctatcatcttcttctgccggaacaatggctatgccatctccacaccaacctctgagcagtaccgtggggatggcatagcggctcggggccctgggtatggcatcatgtcaatccgtgtggacggcaacgatgtgtttgcggtgtacaatgccactaaggaggcccgacggcgggctgtggctgagaaccagcccttcctcattgaggccatgacctacaggatcgggcaccacagcaccagtgacgacagctctgcgtaccgttcggtggatgaggtcaattactgggacaagcaggaccacccgatctcgagactgaggcagtacctgctgaaccagggttggtgggatgaggaacaggagaaggcctggcggaagcagtcacgaaagaaggtgatggaggcctttgaacaggctgagcggaagctaaagcccaacccaagcctcctcttctccgatgtgtaccaggagatgcctgcccagctgcgcaggcagcaggagtccctggctcggcacctgcagacctacggggagcactaccccctggaccactttgacaagtgaggccctaaccaccacaaggtgtcctgctctgagtggagctggggggcggcaggacgctgccccccgctgctaaccagtgctgctgacgtgctgagcagccagtgtggcacgcactgcggctcccccaggctacttcactggggcaccacatttgcagccattgctgcagctccatcactcccttcacctgttacagtgccttttaggggtggggaggaaccagggccagggcagaccctttggcagggtggccctggatttgctcagagaaatagctgattggcagagtaagtaaaccacagctctgcctttg

SEQ ID NO: 1689 - DNA, 1211 bp, Rattus norvegicus
  Genbank Accession No. J04035
tcccctgctgcagctgctaaggctgccaaatatggtgctgctggccttggaggtgtcctaggagccaggccattcccaggcggaggagtggcagcaagacctgggtttggactttctcctatctacccaggtggtggtgctgggggcctgggagttggtggaaaacccccgaagccctatggaggagcccttggagccctgggatatcaaggtgggggctgctttgggaaatcttgtggccggaagagaaagtgatcttctggggacccctgactcgcgacctcatcaacgttggtgctactgcttggtggagaatgtaaaccttctatgaccaccccccctactccatccccccgacccccacctgggaggggacaacaggccagtggccttggaaaacccacaggacaaggaaatcagacagcagcagccacgtacccctaactagaaacccccccacatatcagaggccagggcgggtgtcccatctcttcccacccaggagctcccccacacagtatccatctccaagagaaattggtgctacatgttggtgcttcttctttgtggggggagggaggagggaagggtatcccaggagggactcccccttccctgaagcccctctattaagatggtgcacaccttcgctgggcagtcctgcctccccctgcccaccaggagccattcctggctgcatcccattggtacccaagtaccagaagcctcgacattagatttggtaacacgatccctctctctctttgggtcccctgtccctgactcccattaacaatagctacttcccacacctgggacaccttgaagtccgacgacttctcacactgggaatagctcccttgttcttgtggaatccacctgccaaccacccatccacggactcatccatccttccatccgtcatccatccatccgtccgtccgtccgtcctgactgcctagtgccactgtctggctaggcacacccactatcaacctggttcacctgtcatggcagcctgtacccacccccgccacacaccccgacgctggcctatggtgcaaagggttgtgcgggctggtccttcccacatgcagtactgtaatccccgtccctcctggagccactctattacagagcatgtctcaccaaccccacctctttgtgtttcgctgtgatagatcaataaaatattttattttttgtcctgg

SEQ ID NO: 1690 - DNA, 1053 bp, Rattus norvegicus
  Genbank Accession No. K01701
cctccccttctaggctgtgtcccttttgagctcaggtcattagctgaggcggtgaccttgaccccagcccagaccctgcaaatgaagggcctgcttctaaacagtgtggaacagtttgacccaagagacctggctgtgaccagtcatgcagtcaccctcttagactgggccccaccatggcagtggacaaggcataaaaaggtcggtctgggctggagaaaccatcaccgacggtggatctcggactgaacaccaacgccatggcctgccccagtctcgcttgctgcctgcttggcctactggctctgacctccgcctgctacatccagaactgccccctgggcggcaagagggctgcgctagacctggatatgcgcaaggtgagtctccccgacgccatcccgtcccgttctggcaaggctaaggaccagagatgctctcccaccttcagagagcatcccctcacacttgccagccctacgcggcctcgcatgggaacccggagctccctcttgacgccgtgaaggcacgctgtccctgccccaccacagtcccgatatggattgtgcacagcgcccatccgcgtctttccccccgcagtgtcttccctgcggacccggcggcaaagggcgctgcttcgggccgagcatctgctgcgcggacgagctgggctgcttcgtgggcaccgccgaggcgctgcgctgccaggaggagaactacctgccctcgccctgccagtctggccagaagccttgcggaagcggaggccgctgcgccaccgcgggcatctgctgtagcccgggtgagcaggagggggcctagcaggaccgaccggcagggagccgtcgggtttgctgctcaggccactgacccatttctcttgcagatggctgccgcaccgaccccgcctgcgaccctgagtctgccttctccgagcgctgagccctgctttgtgatgatacctttagggcgcttccttcgttccccatggccactaccagaaaaaaattaaaaaaaaaacataaataaataaataaagcagatttccttttc

SEQ ID NO: 1691 - DNA, 681 bp, Rattus norvegicus
  Genbank Accession No. K02815
tcagcccaacaccctcatctgctttgtagacaacatctttcctcctgtgatcaatatcacatggttgagaaacagcaagccagtcacagaaggcgtttatgagaccagcttcctttccaaccctgaccattccttccacaagatggcttacctcaccttcatcccttccaacgacgacatttatgactgcaaggtggagcactggggcctggacgagccggttctaaaacactgggaacctgaggttccagcccccatgtcagagctgacagagactgtggtctgtgccctggggttgtctgtgggcctcgtgggcatcgtggtgggcaccatcttcatcattcaaggcctgcgatcagatggcccctccagacacccagggcccctttgagtcacaccctgggaaagaaggtgcgtggccctctacaggcaagatgtagtgtgaggggtgacctggcacagtgtgttttctgccccaattcatcgtgttctttctcttctcctggtgtctcccatcttgctcttcccttggcccccaggctgtccacctcatggctctcacgcccttggaattctcccctgacctgagtttcatttttggcatcttccaagtcgaatctactatagattccgagaccctgattgatgctccaccaaaccaataaacctctcataagttgg

SEQ ID NO: 1692 - DNA, 615 bp, Rattus norvegicus
  Genbank Accession No. K02816
tttcttcgagctcttcaggcagtgattctgacagcgaagttgaaaaaaagttaaagaggaaaaagcaagttgttccagagaaacctgtgaagaagcaaaagcctagtgagagttctagagcactggcatcctccaagcagagtagcagcagcagagatgataacatgttccagattggaaagatgagatatgtcagtgttcgggactttaaaggaaaaattctaattgatattagagaatattggatggactcagaaggtgaaatgaaaccaaggagaaaaggtatttctttaaacatggaacaatggagccagctgaaggaacagatctctgacatagatgacgcagtaagaaagctgtaaagtctgagccatatcaagcctgtactgtcgtagctgttttacttcgctgtcttttcacattggcttttgttttctaaaatgttgtttttcacgctgttgtatatttggattgcagaacaatttgtaagacaaatacttttttttaatgtgcattattaaaatgttctaagtgaagctaattgtcgactttattaaagaggattgctttgtgccccttacctagtgtaaaataaagtcagatcattacaatctt

SEQ ID NO: 1693 - DNA, 395 bp, Rattus norvegicus
  Genbank Accession No. L00124
cgggcctgacgcccaagcaggactctgggccaagacccttcttgacaggaggggaaaactgcgaccgcacctcttggccctgagaagtcactgaactcagtgctcagccctcagcttaacgtcactctcctgtgtgtcctgcaggtgattgcaaagaactaagcaaaggcatctctgtgactgtcaccttgggaacgcacggaagggacacagtaataaagtgacttacgaattacaccatgggatgcgtctgtcttattaacccgacaccctaaccagggccctggaagcaacacctgtggcccaacctgcggcagtgacaagctatcatccctgtactcgggagcagtgggatggagactttgaggctagcctgggctacaaagtcagagccc

SEQ ID NO: 1694 - DNA, 2082 bp, Rattus norvegicus
  Genbank Accession No. L08814
gaattccaccagaacgatgatgctgaagtatctctcatggaggtgcgcttctatgtccctcccacgcaggaagatggagtggaccctgtggaggcctttgcccagaatgtcctgtcaaaggcagatgtgatccaggccactggagatgccatctgcatcttccgggagctgcagtgtttgactcctcgtggtcgttacgatatccggatctaccctacctttctacacctgcatggcaaaacctttgactacaagatcccctatactacagttctccgtctcttcctactgccccacaaggatcagagacagatgttctttgtgatcagcctggatccccccatcaagcagggccaaactcgttaccacttcctgatcctcctcttctcaaaggatgaggacatctccttgactctcaacatgaatgaggaagaagtagaaaagcgctttgaggggcgactcaccaagaacatgtcaggatccctttatgagatggttagccgggtcatgaaagcacttgtaaaccgtaaaatcacagtcccaggcaacttccaagggcattcgggggcccagtgtatcacctgctcctataaggccagctcaggactcctgtacccactggagcggggcttcatctatgtgcacaagccccctgtgcacatccgcttcgatgagatctctttcgtcaactttgcccgtgcgaccacaaccactcgttccttcgactctgagattgagaccaagcaaggcactcagtataccttcagcagcattgagcgggaagagtatggaaagctgtttgattttgtcaatgcaaaaaagctcaacatcaagaacagagggctgaaagagggcattaacccaggttatgatgattacgctgactctgatgaagaccagcatgatgcctatttggagaggatgaaggaggagggcaagatccgggaggagaatgccaatgacagcagtgacgactcaggagaagaaactgatgagtccttcaatcctggtgaagaagaagaagatgtggcagaggagtttgatagcaatgcctctgccagctcctccagtaatgagggcgacagcgaccgagaagagaagaagcggaaacagctcaaaagagccaagatggccaaggatcggaagagccgcaagaagtcttcagaggggaagaagggtaaggatccaaatgcccccaagaggcctatgtctgcgtacatgttgtggcttaatgcaagccgagagaagatcaagtcagatcaccctggcatcagcatcacagatctttccaagaaggcaggcgaaatctggaagggaatgtccaaagagaagaaagaggagtgggaccgcaagggggaggatgctaggagggagtatgaggaagccatgaaagagtatgaaggaggacgaggggactcgtctaaaagggacaagtctaagaagaaaaagaaagtaaaagcaaagttggaaaagaaatccactccttcccggggctcatcatccaaggcttcatccaggcagttgagcgacagcttcaagagcaaagagtttgtgtccagtgacgagagctcttcaggcgagaacaagagcaaaaagaagaggaggcggagcgaggactctgatgaagaggaactagccagtactcctccaagctcagaggactctgcctcaggatctgatgagtagaggaagagaattcctgcccttgccctgtcacacctccaggctccctactcatttggtaccagtgtctatggattctgtgccatctgagtaactgctcttggtggcttccacttccctgaggctttgagggaagcacctaacctctgctttgcaaggaaatgctaccatgcaatctggaaagagacttgggtactggctacgcgatcgaaggatccaagtacctcatcctactttgctactttcctgactgtaggggaaaactgcttcctgtcctgttcaagttgctgcagcaggggtcatgcgaagtcaggcctgtagctcctaatagggggctatttctacttttattttgtatgaactgactttggaaaaaaaaaaaaaaaaaaaacggaattc

SEQ ID NO: 1695 - DNA, 214 bp, Rattus norvegicus
  Genbank Accession No. L13025
acctagtgagtgtaaggccagcctggaatcaataagagttggtttcaaagaagcaggaggagaaggaggaacaggaacaggaggaggagcagggggaggagaaaaaggaggaggaggaggaggaggaagaggaggaggaggaggaggaggaggaggaggaggaggaggaggaggaggaggaggaggagaagaagaagaagaagaagaagaagaa

SEQ ID NO: 1696 - DNA, 303 bp, Rattus norvegicus
  Genbank Accession No. L13202
ctggtgaagccaccctactcttacatcgcgctcatcaccatggccatcctgcagagcccgcagaagaagctgaccctgagtggcatctgcgagttcatcagcaaccgcttcccgtactaccgggagaagttccccgcctggcagaacagcatccgccacaacctgtcgctcaacgactgcttcgtcaagatcccccgcgagccgggcaacccgggcaagggtaactactggaccctggacccccagtccgaggacatgttcgacaacggcagcttcctgcggcgccggaagcgcttcaagcgc

SEQ ID NO: 1697 - DNA, 455 bp, Rattus norvegicus
  Genbank Accession No. L17077
gatctccttctcgctagagcctccttcacagcatggctgtcctggtgctgttgctctgcctggtgacatttccaacctgtgtcctgtcccaggtgcagttgaaggaatcaggacctggtctggtgcagccctcacagaccctgtccctcacctgcactgtctctgggttctcactaaccaacaacaatgtgaactgggtgcgacaggctacaggaagaggtctggagtggatgggaggagtctgggctggtggagccacagattacaattcagctctcaaatcccgactgaccatcactagggacacctccaagagccaggttttcttaaaaatgcacagtctgcaatctgaagacacagccacttactactgtgccagagacgggggctatagcagctctaccctctatgctatggatgcctggggtcaaggaacttcagtcactgtctcctca

SEQ ID NO: 1698 - DNA, 1776 bp, Rattus norvegicus
  Genbank Accession No. L18889
atggaagggaagtggttactgtgtttgctactggtccttggaactgcagctattcaggctcatgatggacatgatgatgacatgattgatattgaagatgatcttgatgatgttatcgaagaggtagaagattcaaaatctaaatcagataccagcactcctccatctccaaaggtcacctacaaagctccagttccaacaggggaggtttattttgctgactcctttgacagagggtctctgtcagggtggattttatctaaagccaaaaaagacgacactgatgatgaaattgccaaatatgacggaaagtgggaggtagatgaaatgaaggaaacaaagcttccaggtgataaaggacttgtattgatgtctcgggccaagcatcatgccatctctgctaaactgaacaagcccttcctgtttgataccaagcctctcattgttcagtatgaggttaactttcagaatggaatagaatgcggtggtgcctacgtgaagctgctatccaagacctcagaactcaacctggatcaattccacgacaagactccgtatactattatgtttggtccagataaatgtggagaggactacaaactgcatttcatctttcgccacaaaaaccccaagacaggcgtatatgaagaaaaacatgctaagaggccagatgcagatctgaagacctatttcactgacaagaaaacacatctttacacattaatcttgaatccagacaatagttttgaaatattagttgaccagtctgttgtgaacagtggaaacctgctaaatgacatgacccctccggtaaacccttcacgtgaaattgaggacccagaagaccggaagcctgaagattgggatgaaaggcccaaaatagcagatccagatgctgtcaagccagatgactgggatgaagatgccccttctaagattccagatgaagaggccacaaagcctgaaggctggttagatgatgaacccgagtatattccagaccctgatgcagagaaaccagaagattgggatgaggatatggacggagaatgggaggctcctcagattgccaaccctaagtgtgagtccgcccctgggtgtggtgtctggcagcgacctatgattgacaaccccaattataagggcaaatggaagcctcctatgattgacaatcctaactaccagggaatctggaaaccaaggaaaataccaaatccagatttctttgaagacctggaaccttttaggatgactcctttcagcgctattggtttggagctctggtccatgacatccgacatcttttttgacaactttatcattagtggtgaccgaagagtagttgatgactgggccaatgatgggtggggcctgaagaaagctgctgatggggctgcagagccaggtgtagtggggcagatgctggaggcagctgaagagcgtccatggctttgggtggtctacattctgactgtagcgttgccagtgttccttgtgatcctcttctgctgttctggaaagaaacagtccaatgctatggagtacaagaagacagatgctccccagccagatgtgaaggacgaagaagggaaggaagaagagaagaacaagggagatgaagaggaagaagaggagaagcttgaagagaaacagaagagtgatgctgaagaagatggtggcactggcagtcaagatgaggaagatagcaagcctaaagcagaggaggatgaaattttgaacagatcaccaagaaacagaaagccacgaagagagtga

SEQ ID NO: 1699 - DNA, 773 bp, Rattus norvegicus
  Genbank Accession No. L20869
atcccaggttcacaagacagacaagatgctgcctcgtgtagccctcaccaccatgtcctggatgctgctgtccagcctgatgctcttatctcaggtgcaaggtgaagatgccaaggaagatgtgcccacttcacgtatcagctgccccaagggctcgcgtgcctatggctcctattgctatgccttgtttagtgtatccaaatcttggtttgatgcagatctggcctgccagaagaggccatcaggacaccttgtgtctgtgctcagtggatctgaagcttcctttgtgtcctccttgattaaaagcagtggtaacagtggccaaaacgtgtggattgggctccatgatccaacactgggccaagaacccaacagaggtggatgggagtggagtaatgctgatgtgatgaattacttcaactgggagacgaatccttcttctgtctctggaagtcactgtgggaccctgacacgagcctcaggatttctgaggtggagagagaataattgtatctcagaattgccatatgtctgcaagttcaaggcctagagtacagagatgacaccatgtgttgatatatacctcaccaaatcaagaaccccaatgggaagatcaacaacaacaacaaaaagaatattctcctcacagtcaacatctgacctcctatttttctcctcatctgccccttccttcctctcatttgaggctcttctgtgtgtactgtggcctgagatctcacagcacaataataaaatatataactcacgctcat

SEQ ID NO: 1700 - DNA, 2179 bp, Rattus norvegicus
  Genbank Accession No. L23863
cgctgtagtcattcctgtgtcctcttctctctgggcttctcaccctgctaatcagatctcagggagagtgtcttgaccctcctctgcctttgcagcttcacaggcaggcaggcaggcaggcaggacaggtttggggactctgtttacagctgtttatcccagagtctggtcggcctccacctgatgtggcaattgctggcagtgccacaggcttttcagccaggcttagggtgggttctgggacctgattaggtgagcaggaggagggggcagttagcatggtttcaatgttcagcttgtctttcaaatggcctggattttgtttgtttgtttgtttgttcctttgtccctttgtcctcccctgtcactcaggtctgcagccgaatcttctctcctttccacagcaacagagcactctactcctcccacagacaggacctggcctcacctcccaggcagttggacgccctgggctgtcaggatcctctttagagccccacctggaagcttctcaacatctgccagggcccaagcatctgcctggccccggagggaatgacgaacccactgacctggaggagctggagaagttcgccaagaccttcaagcagaggcgcataaagctaggcttcacacagggggatgtgggattggcgatgggaaagctgtatggtaacgacttcagccagactaccatctcgagatttgaggccctcaacctgagtttcaagaacatgtgtaaactcaagccactgctggagaagtggctgaatgatgcagagtcctccccggcagacccttcagcaagcactcccagctcgtaccccactctcagcgaagtatttggcaggaagaggaagaaacggaccagcatcgagaccaacatccgcctgactttggagaagcgatttcaagataaccctaaacccagctcggaagagatttccatgattgcggagcagttgtccatggagaaggaagtggtaagagtctggttctgcaatcgacgccaaaaggagaagagaatcaactgccctgtggccacacctgtcaagccgcccatctacaactcccggctggtctctccctcagggtctctgggctccctctcagtccctcctgtccacagcaccatgcctggaacagtaacgtcatcctgttcccctgggaacaacagcaggccctcgtctcccggctcaggactccatgccagcagccccacggcatctcaaaataactccaaagcagcaatgaacccctcctccgccgcctttaactcctcagggtcatggtaccgttggaaccatcccgcctacctccactgagaccaaaaacttcctcccgttccacctggccctggttcccaccaggaggaagagcggccacaccttccacgtatggacagacactttgagactcggagcgggagaaatggccgctgctgaagagcaaacccacaatcttgccttctcctggatccagagcttccagagaaccaagatgtgaccaaaggcgcacactcttgccttgggctcttgatcacccgctgggagtttaccgtgctcacccgtgaccgcttcatgctcacatgatggctcacctattggaaaggcattctgccattgttagttttcagctcaccggtgggattctgggacagccttttgctcgttgtgccaaactgcaagaagggtagttatggttttgactctgacctcagccacaatcctgaactgatccaaattctatgagaagactgaaatctcgtgtctctaccaaagccttattttgttaaattagcacagttttcttacagcatatccatttttgcccaactttcttttagaaattacttcccttttctacaacaaaacctgtctatccttaggtcctacaaagtcccttcctctctataaatggctaagctcccctctggccatgttgctccattcacgtgtactcttttgttgcccacatgttcccaagttcaagaacacttgttttttttctgttctctgtgggttttcttgtcctgtcccctctccttgctcctggccacagagaagtacacacactgtggccactttcttgtacatagtcctttcctactctgcactatgaccgttcatctttaatgtgtaatttcccagcgaaatgtttaactcaggtgtgcattttg

SEQ ID NO: 1701 - DNA, 2643 bp, Rattus norvegicus
  Genbank Accession No. L25387
gtgaccaggactcttcgacgtccagcacctcctttccgaagtacctggagcacctctctggggatggcaaagcatggtgtcctgaccagcggcggggagtcccaaggcatgaatgctgctgtccgtgctgtggtgcgcatgggaatgtacacgggggcccaagtgtactttatatacgagggttaccaaggcatggtggatggaggctccaatattgtggaagccaagtgggagtgtgtctccagcattctacaagtgggtgggaccatcatcggcagtgcccgttgccaagccttccgcagccgtgaagggcgtctgaaagccacctgtaacctggtacgcttgggcataaccaacctgtgcgtgatcggtggggacggaagtctcacgggagccaacctcttccggaaggagtggagcggtcttctggaagagctggctaagaatggtgagatcgattcggacacagtgaagaagcacgcctacctcaacgtggtgggcatggtgggctccattgacaatgacttctgtggcacagacatgaccatcggtacagattcagctctgcaccgaattattgaagttgttgatgccatcatgaccactgcccagagccaccagagaaccttcgtcttggaggtgatggggagatactgtggttacttggccttggtgagcgccttggcttgcggtgccgactgggtgttccttccagagtctccgccagaggaaggttgggaggaagaaatgtgcctcaaactctccgagaaccgtgcccgaaagaaaaggctgaatatcatcattgtgtctgaaggagcaatcgacacccaaaataagccaatcacctctgagaaaatcaaggagcttgtggtgacaaatttgggctttgacacccgggtcaccattcttggacatgtccagagaggagggaccccttctgcatttgacaggattttggccagccgtatgggagtggaggctgtccttgccttgctggaagctacccctgagaccccagcctgtgtcgtgtcactgagaggaaatcaagctgtacgcctgcctctgatggagtgcgtgcaaatgacccaggatgtacagaaagcaatggatgaaaggagatttgatgaagccgtaaaactccgaggaaggagttttgagggcaacctgaacacctacaagcgtcttgccattaaggagcctgatgacaagatccccaagagcaattgcaatgtagccatcatcaatgtaggggcacctgccgcgggaatgaatgcagccgtccggtccgctgttcgggttgggattgcagagggccacaagatgttcgcaatctatgacggctttgatggcctcgccaatggccaaatcaaagaaatcggctggggagatgtcggaggttggacaggacaaggagggtccattcttgggacgaaacgcaccctacccggaaagtacttggagaagatcgcagaacagatgcactcgaaaaatatcaatgcccttctgatcattggcggattcgaggcctacctgggactcctagagctggcagctgcccggaacaaacatgaggcattctgtgtccctatggttatggttcctgctactgtctccaacaatgtgccaggttctgatttcagcatcggggcagacacggctctgaacactatcacagacacgtgcgaccgcataaaacagtcagccagtgggaccaagcgccgggtgttcatcattgagaccatgggcggatactgtggctacctggccaacatggggggacttgcagcgggacgcgatgctgcctacatctttgaagaacaatttgatatccgagatttgcagtccaacgtcatgcacttgacggagaaaatgaagaccagcatccagaggggccttgtcctcagaaatgaaaactgcagtgtaaattacaccacggacttcatctaccagctctactcagaggaagggaaaggagtgtttgactgcaggaagaacgtgctaggccacatgcagcaggggggagcaccttctccattcgacagaaactttggaaccaaaatatctgccaaagctatggagtggatctcggccaaactgaagggctcccacggcacagggaaaaaatttgttagtgatgattccatttgtgtcctgggaattcagaagagagacctcctgtttaaaccagtggcagagctaaggaaggctactgactttgagcaccgtatccccaaacaacagtggtggctgaaactgctaccaatctcgaagatcttggcaaagtatgaggcaagctatgacatgtcagacgtaggcaagctggagccggtgcataaccacggagaactatcagccatctgattgaatatgccgtctcctgacctgcacacttacctagggaagcctgtaatgttctccagggaccacccctttttgtaacatagttatttatcagcactctatgcaagaattgttggccgagtattgtcagcagtaataatcagagagcatcacttgctataaccattgacgcaacagaccctaagacatgaaacccagcctcgcgcgattgatcacgtgtcagttttctactgtaccgggtactactgtcttgtgctttaccatgtgtgtatcttgtgggat

SEQ ID NO: 1702 - DNA, 3974 bp, Rattus norvegicus
  Genbank Accession No. L38482
tcgactacccatattccccaccagccaaccggttcctcaccaagatgtggcacccaaacatctatgaggtaagacactagaggcctgcttcaggcacactccaccacacacttctctgcctcccttgcacatgctccacccctcctctaaccctggtcactcttgcagacaggggacgtatgcatctccatccaccatcccccagttgatgacccacagagtgggagctaccctcagagcggtggaaccccacgcagaatgtcaggtgagaattgccatggaactgcaccgtgggcacccgcaaacaccctgtaccctaagatccacccttccctgctccagtcaggggttcccagagtctggggagctgagcttgcacctacggccctacaggaccatcctcctgagtgtgatctccctgctgaatgagcccaacaccttctcgcctgccaacgtggacgcctcggtgatgtacagaaaatggaaggagagcaaggggaaggaccgcgagtacacggacatcatccggtgagtgcttcctactgtgaagagtgatctggggtgtgggtggggtggggacttgttgtatgtttccattttttgcatcccgggctggatgtgtggaggactctggggcccccagagcacggagttgaccacccagggtggccaagatcccctctgccttgttgttgacttaactccatgagcaactgggctctctgggccacaccctcactgtctgacagagagcatcaatcacttgcatttcgtgcttctgaaacttagagcttttttttttttttttgcaaagtgggaagggggctgagcccactgtgagtctgtcctcagttagggaccagggctgcgacctgttgctgtctatgagtggcagtgtccacacctatcatcgcttcttagcaggagctcctggcctgtctggggccaggcagtctcccctacacccctcacgttgggtatgaagttgcacttgaggggttcagtctttgtcgcttagcttctgtgttttctgagacaggctttcatataactccgtatctccttgtggtccctctgatgtcaggatgacaacacacattcctcggaagtgaccccagtgcttgtctacacagtgacccaaacacagggcctgtcctgtccccaagcctgccctctcagagttggtacaggccgcagctcggtaggcagtgctggtctagcatgtgcacacacacagggttagtctctgtcttaggcaaggtggatgtagccagcatggtccttcatggaggtataagttactcaggaaggtctgagcgctgcactacggaggtgtccccttcaccatggtcaggtcagcaacggtcccggtcactggaagtccctgcagactgtcccctttgttttctgttcagactggctgaacagaactttgttcctcctgctcttcctcagctgagaggaaggctggctgccctagctgttctatatagttctggctgtcctggaagaggagaccctgggtctggccctgtcactgcactctccaccctcctggcagcctttaatccacttctggctgcttcctccctggatccctggcccagagcaggagcccaggctatttttaccattctgactccaggagccacttgctctgaccaggaggcctgtaccactcctggaactcaacctgagccagtatctagtcatgtccctgcctgagcacaaggacaggatagctaggagcctgtgagaaggaccttgagatggatctaggctattgggtgtgctgctgtcccacgtgcccctccaccatagccttgtccccattcccctattccttctgggcagctgaaaacagtgtctgctctgcttgactgcactgggacctgtgccccaagactctggcctgacggtggcctggcctctcaggcacctagttaattgctgcctgccctgtgcaaggaagcccttacatgttgcttcacccatggcctgtgggacctggaacctcagttgttccggaactgcccttcatcatggtgccctcaggtcaggctgcaatttgttgttggtgtgaggaggtgcatgttacctagcccacaactagggtagtgccccccacagtctgggattacagctgtttctgtggtgctgggagctggacatgggtccttatgcttacagaaggagcactctggctgcccctgttgtcggttatagccgaggtcagcctgaatctcatagtagttctcctgcctccgcctccaaggactgggtgacagaccgtctcccacagctggctgtggttacatttctgctggagttggtcactgagccactccttgtcgcctggccctctcctcccacctgctccctgcccccattcatctcatcgtcctgggccgtggcctcacccgccctgtctccccaggaagcaggtcctggggaccaaggtggacgcagagcgcgatggcgtgaagtgcccaccacgctggccgagtactgcgtgaagaccaagcgccggcgcccgacgagggctcagacctcttctacgacgactactatgaggacggtgaagtggaggaggccgacagctgctttggggatgaagaggatgactctggcaccgaggagtcctgacccacgtccctgaaataaacttacaaattttacctcagcaggacccgtgtgggcctcaggcgacagactacctcaccgaggttcaatgtgggctcccatcccatgatccttaggtcctcttaccctgtattccccatgggttttcctcggctttggagaagagctgtggtgcagggcagacaccccactcagccttcagaggatgacaagcctgggaggctgggaaccgactgcccaggggagccagagactccagcccaaagagggccagccccacagtctcctctctgcttttggtgtgtgtgaaatccaaataaaatagctttctgagaagctgagagaagcagccaggacgccggtggcactgggtactgagggctacctgggtacccaggcagggctgtgggatgggcaggaagaggtagcgatggtggcctgtttgttggggctcagtagcatacaggagccccaggcccagaagaaacttgctgcctgcaaatcccacccgcctgcatcgggcactgtggttgcgtccaccccaagcctgtgttcaggaggcctgggtcctgaggcctacaggggattggtattcccaacagtccttgtgttctgggcacttcctcagccctggaaactagtgctgcctgaggagtccctctgatacctgagctgcagcctggtgactccacagcaggggcaggctgagtgaattctctgaccacaccatgctgtgcagggcacctgcagtgaccccgtgctgagatagcagatctgctctgccacctgcatgtttacgggtgctgtggaaagaaagtgtcacttcctcttatgcgggcctgttaatgtccaaagttccagtcaacccatgccagtcagaactgatcagagaaggacacatcggaaaaaggtgttcaggcgatcctctgcccatacaatttgctgccagcctgatctacagttgcaaaaccagcgggaaggctcagtgggcaaaggcctgcaccaagcctagcagaggacccacttggctccaggtggtccctgtgggggttgaggtcagttgagacaaatcccccccccccccccggagttcaccccagtgctaaaaggagcagtgtgccaggagagggagcatcgcttggctgtagttgctgcccccagacacagggcaactttgacagcagagttgctttctaaaaccacacagcagggtgtgaaggaggaggagctgacacgtgggtaaggtgggtggtgcttggaaggccacttgtctccaccggaagagaaagtgtggggccccttcccccagggaccaccagtcctgtgccagg

SEQ ID NO: 1703 - DNA, 413 bp, Rattus norvegicus
  Genbank Accession No. L48209
gctgaggagcctgaccggcccggcccggcggcttatggtgccgcgggctcaggtccactcgaagccgccgcgggagcagctcggggtcctggatatcaccattgggctcacttcctgcttcgtgtgttgtcttctacctgcgggctgggtcctgtcacacctggaaagctacaagaagcgggagtgaagggagcgtcttccctcatcctttgactagaccactcttgccagcccaccttgatcatgtttcctgcattcctggctggcttaccctgggatcatgttattcaattccagtcacctcttctgcaatcatgacctctcgatgtctccatggtgacaactgggaccacatatattggttctgcttgatggggtccccctttgtaacaataaagtctatttaaaccttg

SEQ ID NO: 1704 - DNA, 2169 bp, Rattus norvegicus
  Genbank Accession No. M13011
ggatccggaattcggccactggcttgcttgcctactcagtgctggagagagcccttgggttaggcatctattagcagtctcaagtggctagggctggctaagtgtgattctcattggcaggtggggcaggagctcctggtttggcaacccctgtagaagcgatgacagaatacaagcttgtggtggtgggcgctggaggcgtgggaaagagtgccctgaccatccagctgatccagaaccattttgtggacgagtatgatcccactatagaggtgagctctgactacctgccagaggtgggctctggcagtggtcatgggttagagtcccaaacaactaggtcttgaagttggtatgggcctgattcctacctgatcctgatccatcagggtatgagaggtgcaagggtaggcggattctctgtctaagaagaggtaggacccttaagctgtgttcttttgcaggactcctaccggaaacaggtagtcattgatggggagacgtgtttactggacatcttagacacagcaggtcaagaagagtatagtgccatgcgggaccagtacatgcgcacaggggagggcttcctctgtgtatttgccatcaacaacaccaagtcctttgaagacatccatcagtacaggtgaccacctatggctagcccgtggcccatggcatatgtgaggaaggttctgtgtgcacactgaggctttatgtctttttttgaatgtcatggacacgtcaggcctgcagtctgctagctggctcatatacaaccccatccccctccagggagcagatcaagcgggtgaaagattcagatgatgtgccaatggtgctggtgggcaacaagtgtgacctggctgctcgcactgttgagtctcggcaggcccaggaccttgctcgcagctatggcatcccctacattgaaacatcagccaagacccggcaggtgtgagcttgttcccctctccacaagctagtcagggattcaccataccccaccccagccggagcgagctcatcgccctctccctcaacacagggcagccgctctggctctggctccagctctggaccctctgggacccccccgggacccatgtgacccatgtgacccagcggccctcatgctgtaagtcttccgcaggccgcaggctggagggaggcaagggccagggtctgggcttatgccaaagttctgggttgacacatagctccagggcaggatggggtccatggagagagctgccctgagcaggccggagcggtgacccaggggcctagttcttcttgtctccagtgtcctatggagatttgctattttaagcccttaagtgttgttaggttgttaaccttgagacatactgggggtctgggagagtctgagctaagtggctctgatttttcagtggtatttaggagtgaacctacttaaagagagtggcctgtactttttagatggccagagcccagctccctattattttggttttgcagctgaggaagggagcctccagcatggggtgttacctgatccagtcagggagtttcttacccagagagcagagcacccctttcctcctcagagtcctctctgatccagtccctctgtccccagggtgtggaggatgccttctacacactagtacgtgagattcggcagcataaactgcggaaactgaacccgcctgatgagagtggccttggctgcatgagctgcaagtgtgtgctgtcctgacactaggtgaggcagggaccagcaagacatctggggcagtggcctcagctagccagatgaacttcatatccactttgatgtccctgctcccccaattctgccaatccccctgcctgcaggcatcagtcatgtcctttgtgcccgtcccgcaggctcaaggacgaggaggtgccggatgcagggaggaggaggtgctgtcggaaggaaggaaagaggagggaaggaaggaaacgatgctggagccagttcaaggatggtggacagatgtgccaagccttcgcatggacaatttgaacagactgtcatgaactatcccgttgccacgccacccaagtcctccgccccctctcagctcccttgggcgcctatgagggcacatgttgaatcacagtaaattatttgatggacttgacttgtctctgggctgg

SEQ ID NO: 1705 - DNA, 8048 bp, Rattus norvegicus
  Genbank Accession No. M13100
  misc_feature (1)..(8048): n = a or c or g or t
gaattcggcccaggataaacagatatataggtaaatgactggatagatacatggatttgatctctaactcaacttaggcaccatagaaaacaatccttgaattattttaataattttaaatcctagtttactgagaaacacgttgacgaggcagggcttcagcctctctgaagcagcactgcccctctgtggccacacaggaagtcttcactcagcagtttcctgacttaaggcctaggcctgaggaaatgcattgaatatttctctgggggacaatagttctgagaaggaaagagagtttgtctatgttgaggtcagttaaggatggttttctttccttccctcccagccttttctccatgcaacatcatgagtccccatctttctatcctgcctaaaaccacttccttctgggaaatgagaaaatccactcatacaaaatggaaacatcccgaggatcccggcccgcagcagctctctgcccccagaccctgtgagagagagacccaaccgcctggtcaggtgggcactcctgaggctgcagagggaagagaccaccaacactgctcacccctgcccacatccctggcccaagaggaaactgtataaggcctctgggtcctgtgggggagggcccaggagcggcaggacccctgtgcctgagagaccaccaccagaaccagaaggaaacagaccggataaacagttctctgcaccaaatcccgtggagggagagctgaaccttcagagagaaagacaagcctgggaaaccagaagagactgctctctgcacacacatctcggacgccagaggaaaaagccaaagaccatctggaaccctggtgcactgaagctcccggaaatggtgcacaggtcttcctggttgctgccgctgcagagagcccgtggtagcaccccacgagcgaacttgagcctcaggaccacaggtaagaccaacttttctgctgcaagaaagctgcctggtgaactcaagacacaggcccacaggaacagctgaagacctgtagagaggaaaaaccacacgccggaaagcagaacactctgtccccataactgactgaaagagaggaaaacaggtctacagcactcctgacacacaggcttataggacagtctagccactgtcagaaatagcagaacaaagtaacactagagataatctgatggcgaaaggcaagcgcaggaacccaagcaacagaaaccaagactacatggcaccatcggagcccaattctcccatcaaaacaaacatggaatatccaaacacaccagaaaagcaagatctagttccaaaatcatttttgatcatgatgctggaggacttcaagaaagacgtgaagaactccttagagaacaagtagaagcctacagagaggaatcgcaaaaatgcctgaaagaatcgcaaaaatccctgaaagaattccaagaaaacataaataaacaagtagaagcccatagagaggagacacaaaaatccctgaaagaattccaggaaaacataaataaacaagtagaagcccatagagaggagacacaaaaatccctgaaagaattccaggaaaacataaataaacaagtagaagcccatagagaggagacacaaaaatccctgaaaggaattccaggaaaacacaatcaaacagttgaaggaattaaaaatggaaatagaagcaatcaaaaaagaacacatggaaacaaccctggatatagaaaaccaaaagaagagacaaggagctgtagataaaagcttcaccaacagaatacaagagatggaagagagaatctcaggagcagaagattccatagaaatcattgactcaactgtcaaagataatgtaaagcggaaaaagctactggtccaaaacatacaggaaatccaggactcaatgagaagatcaaacctaaggataataggtatagaagagagtgaagactcccagctcaaaggaccagtaaatatcttcaacaaaaccatagaagaaancttccctaacctaaaaaaagagatacccatagacacacaagaagcctacagaactccaaatagattggaccagaaaagaaacacctcccgtcacataattgtcaaaacaccaaacgcacaaaataaagaaagaatattaaaaacagtaagggaaaaaggtcaagtaacatataaagggagacctatcagaatcacaccagacttctcgccagaaactatgaaggccagaagatcctggactgatgttatacagaccctaagagaacacaaatgccagcccaggttactgtatccagcaaaactctcaattaacattgatggagaaaccaagacattccatgacaaaaccaaatttacacaatatctttccacaaatccagcactacaaaggataataaatggtaaagcccaacataaggaggcaagctataccctagaagaagcaagaaactaatcgtcttggcaacaaaacaaagagaatgaaagcacacaaacataacctcacatccaaatatgaatataacgggaagcaataatcactattccttaatatctctcaacatcaatggcctcaactccccaataaaaagtcatagattaacaaactggatacacaacgaggaccctgcattctgctgcctacaggaaacacacctcagagacaaagacagacactacctcagagtgaaaggctggaaaacaaatttccaagcaaatggtcagaagaagcaagctggagtagccattctaatatcaaataaaatcaatttccaactaaaagtcatcaaaaaagataaggaaggacacttcatattcatcaaaggaaaaatccaccaagatgaactctcaatcctaaatatctatgccccaaatacaagggcacctacatacgtaaaagaaaccttactaaagctcaaagcacacattgcacctcacacaataatagtgggagatttcaacacaccactctcatcaatggacagatcatggaaacagaaattaaacagtgatgtcgacagcataagagaagtcatgagccaaatggacttaacggatatttttagaacattctatcctaaagcaaaaggatataccttcttctcagctcctcatggcactttctccaaaattgaccatataattggtcaaaaaacgggcctcaacaggtacagaaagatagaaataatcccatgcgtgctatcggaccaccacggcctaaaactggtcttcaataacaataagggaagaatgcccacatatacctggaaattgaacaatgctctactcaatgataacctggtcaaggaagaaataaagaaagaaattaaaaactttttagaatttaatgaaaatgaaggtacaacatacccaaacttatgggacacaatgaaagctgtgctaagaggaaaactcatagcgctgagtgcctgcaaaaagaaacaggaaagagcatatgtcagcagcttgacagcacacctaaaagctctagaacaaaaangaagcaaatacactgaggaggagtagaaggcaggaaataatcaaactcagagctgaaatcaaccaagtagaaacaaaaaggaccatagaaagaatcaacagaaccaaaagctggttctttgagaaaatcaacaagatagataaacccttagccagactaacgagaggacacagagagtgtgtccaaattaacaaaatcagaaatgaaaagggagacataactacagattcagaggaaattcaaaaaatcatcagatcttactataaaaacctatattcaataaaacttgaaaatcttcaggaaatggacaatttcctagacagataccacgtatcgaagttaaatcaggaacagataaaccagttaaacaaccccataactcctaaggaaatagaagcagtcattaaaggtctcccaaccaaaaagagtccaggtccagacgggtttagtgcagaattctatcaaaccttcatagaagacctcataccaatattatccaaactattccacaaaattgaaacagatggagcactaccgaattccttctacgaagccacaattactcttatacctaaaccacacaaagacacaacaaagaaagagaacttcagaccaatttcccttatgaatatcgatgcaaaaatactcaataaaattctggcaaacgaattcaagagcacatcaaaacaatcatccaccatgatcaagtaggcttcatcccaggcatgcagggatggtttaatatacggaaaaccatcaacgtgatccattatataaacaaactgaaagaacagaaccacatgatcatttcattagatgctgagaaagcatttgacaaaattcaacacccttcatgataagagtcccggaaagaataggaattcaaggcccatacctaaacatagtaaaagccatatacagcaaaccagttgctaacattaaactaaatggagagaaacttgaagcaatcccactaaaatcagggactagacaaggctgcccactctctccctacttattcaatatagttcttgaagttctagccagaccaatcagacaacaaaaggagatcaaggggatacagatcggaaaagaagaagtcaaaatatcactatttgcagatgacatgatagtatatttaagtgatcccaaaagttccaccagagaacgactaaagctgataaacaacttcagcaaagtggctgggtataaaattaactcaaataaatcagttgccttcctctatacaaaagagaaacaagccgagaaagaaattagggaaacgacacccttcataatagacccaaataatataaagtacctcggtgtgactttaaccaagcaagtaaaagatctgtacaataagaacttcaagacactgaggaaagaaattgaagaagacctcagaagatggaaagatctcccatgctcatggattggcaggattaatatagtaaaaatggccattttacccaaagcaatctacagattcaatgcaatccccatcaaaataccaatccaattcttcaaagagttagacagaacaatttgcaaattcatctggaataacaaaaaacccaggatagctaaagctatcctcaacaataaaaggacttcagggggaatcactatccctgaactcaagcagtattacagagcaatagtgataaaaactgcatggtgattggtacagagacagacagatagaccaatggaatagaactgaagacccagaaatgaacccacacacctatggtcacttgatttttgacaaaggagccaaaaccatccaatggaaaaaagatagcattttcagcaaatggtgctggttcaactggagggcaacatgtagaagaatgcagatcgatccatccttatcaccctgtacaaagcttaagtccaagtggatcaaggacctccacatcaaaccagacacactcaaactaatagaagaaaaactagggaagcatctggaacacatgagcactggaaaaaatttcctgaacaaaacaccaatggcttatgctctaagatcaagaatcgacaaatgggatctcataaaactgcaaagcttctgtaaggcaaaggacactgtggttaggacaaaacggcaaccaacagattgggaaaagatctttaccaatcctacaacagatagaggccttatatccaaaatatacaaagaactcaagaagttagaccgcaggaaacaaataaccctattaaaaatggggttcagagctaaacaaaaattcacagctgaggaatgccgaatggctgagaaacacctaaagaaatgttcaacatctttagtcataagggaaatgcaaatcaaaacaaccctgagatttcacctcacagtagtgagaatggctaagatcaaaaactcaggtgacagcagatgctggcgaggatgtggagaaagaggaacactcctccattgttggtgggattgcagactggtaaaaccattctggaaatcagtctggaggttcctcagaaaattggacattgaactgcctgaggatccagctatacctctcttgggcatatacccaaaagatgcctcaacatataaaagagacacgtgctccactatgttcattgccgccatatttataatagccagaaactggaaagaacccagatgcccttcaacagaggaatggatacagaaaatgtggtacatctacacaatggaatattactcagctatcaaaaacaacgagtttatgaaattcgtaggcaaatggttggaactggaaaatatcatcctgagtgagctaacccactcacagaaagacatacatggtatgcactcattgataagtggctattagcccaaatgcttgaattaccctagatccctagaacaaacgaaactcaagacggatgatcaaaatgtgaatgcttcactccttctttaaatgaggaaaaagaatacccttggctgggaagggagaggcaaagattaaaacagagactgaaggaacacccattcagagcctgccccacaggtggcccatacatatacagccacccaattggacaagatggatgaagcaaagaagtgcagactgacaggagccggatgtagatcgctcctgagagacacagccagaatacagcaaatacagaggcgaatgccagcagcaaaccactgaactgagaataggtcccccgttgaaggaatcagagaaagaactggaagagcttgaaggggctcaagaccccaaaagtacaacaatgtcaagcaaccagagcttccagggactaagccactacctaaatactatacatggactgaccctggactctgaccccataggtagcaatgaatatcctagtaagagcaccagtggaaggggaagccctgggtcctgctaagactggacccccagtgaactagactatggggggagggcggcaatggggggagggttgggagggggacacccataaggaaggggaggggggagggggatgtttacccggaaaccgaaagggaataacacttaaattatataagaaatactcaagttaattaaaaataataataataataataaaaagaattactcataaaataaagacaagatgatggataaaattaaaaaaacaaaaaaaacaaaaaaaaaccaaaatggaaacatgaaaatgctcactacttacaatagtgctttatgtaataagcaaatgactgcatttgacacgagttataatttattaaccccttagttagactacttgtacacatggtgattattaatccacaattattctttttcactaaaatccttatattttattctttgagattataatataatcacacaaattccctcttccctgtcatctcttcaaaaccttccatatagtcctccatgctgtcttttgaacgttatggcttcttttttatattcttgttttatattatatatatataatatatattataatatatatcatactatatatattcctcaggactgaccaatccatattggataaccaattggtgtgctcgtctcagggaaagaccatttccccaccatcagcattctcggtttccagtagttcattgtctagaatggagactgtgtgtgctttccccgtccactttagctgctgtgtttcagctcctcttgaggcagttatgttggtgagacctcatctgtgcggcttccaacattcctcagagacacagtgagttacacagtgtcacctgatcctctaactcccaccatctttcctgctgtcttctccagggtttcctgaacctcagcaggagcaggggttgtactgtagacacgcccaccttcactaggatccacagctcctcactttgatttgctgtggttttctgcaatggcttccatgtcctagtaaagtcatggagaccccataaccacgctgtactaaaccagacaatccctagctgcattctaagttcttgtccttatcccatacatgtgcatttagagagtctgcttattttgctcattatagaacgagtcaatcattctctttgagttgtaaaagctt

SEQ ID NO: 1706 - DNA, 3197 bp, Rattus norvegicus
  Genbank Accession No. M13101
gaattcaaggcccatactgaacatggtaaaagccatatacagcaaaccagttgctaacattaaactaaatggagagaaacttgaagcaatcccactaaaatcagggactagacaaggctgcccactctctccctacttattcaatatagttcttgaagttctagccagagcaatcagacaacaaaaggatgtcaaggggatacagatcgctaaagaagaagtcaaaatatcactatttgcagatgatatgatagtatatttaagtgatcccaaaagttccacgagagaactactaaagctgataaacaacttcagcaaagtggctgggtataaaattaactcaaataaatcagttgccttcctctatacaaaagagaaacaagccaagaaagaaattagggaaacgacacccttcataatagacccaaataatataaagtacctcggagtgactttaacaaagcaagtaaaagatctgtacaataagaacttcaagacactgaagaaggaaattgaagaagacctcagaagatggaaagatctcccatgctcatggattggcaggattaatatagtaaaaatggccattttaccaaaagcaatcttcagattcaatgcaatccccatcaaaataccaatccaattcttcaaagagttagacagaacaatttacaaattcatctggaataacaaaaaacccaggatagctaaaggtatcctcaacaatgaaaggacttcagggggaatcactatccctgaactcaagcagtattacagagcaatagtgataaaaactgcatggtattggtacagagacagacagatagaccaatggaatagaattgaagacccagaaatgaacccacacacatatggtcacttgatttttcacaaaggagccaaaaccatccaatggaaaaaagatagcattttcagcaaatggtgctggttcaactggaggtcaacatgtagaagaatgcagatcgatccatgcttatcaccctgtacaaagcttaagtccaagtggatcaaggacctccacatcaaaccagacacacccaaactaatagaagaaaaactagggacgcatctggaacacatgagcactggaaaaaatttcctgaacaaaacaccaatggcttacgctctaagatcaagaattgacaaatgggatctcataaaactgcaaagcttctgtaaggcaaaggacactgtggttaggacaaaacggcaaccaacagattgggaaaagatctttaccaatcctacaacagatagaggccttatatccaaaatatacaaagaactcaagaagttagaccgcagggaaacaaataaccctattaaaaaatggggctcagagctaaacaaagaattcacagctgaggaatgccgaatggcggagaaacacctaaagaaatgttcaacatctttagtcataagggaaatgcaaatcaaaacaaccctgagatttcacctcacaccagtgagaatggctaagatcaaaaactcaggggacaacagatgctggcgaggatgtggagaaagaggaacactcctccattgttggtgggattgcaaactggtacaaccattctggaaatcagtctggaggatcctcagaaaattggacattgaactgcctgaggatccagctatacctctcttgggcatatacccaaaagatgccccaacatataaaaaagacacgtgctccactatgttcattgcagccttatttataatagccagaagctggaaagaacccagatgcccttcaacagaggaatggatacagaaaatgtggtacatctacacaatggaatattactcagctatcaaaaacaacgactttatgaaattcgtaggcaaatggctggaactggaaaatatcatcctgagtgagctaacccaaacacagaaagacatacatggtatgtactcactgatatgtggctattagccaaatgcttgaattaccctaaatgcctagaacaaatgaaactcaagacagatgatcaaaatgtgaatggttcactccttctttaaaaggggaacaagaatacccttggcagggaagagagaggcaaagattaaaacagagactgaaggaacacccattcagagtctgccccacatgtggcccatgcatatacagccatccaattagacaagatggatgaagcaaagaagtgcaggctgacaggagccggatgtagatcgctcctgagagacacagccagaatatagcaaatacagaggcgaataccagcagcaaaccactgaactgagaataggacccccgttgaaggaatcagagaaagaactggaagagcttgaaggggctcgagaccccatatgtacaacaatgccaagcaaccatagcttccagggactaagccactacctaaagactatacatggactgaccctggactctgacctcataggtagcaatgaatatcctagtaagagcaccagtggaagcggaacgcctgggtcctgctaagactgaacccccagtgaactagactgttgcggggagggggacaatggggggagggtggggaggggaacaccgataagaaacaggggggggagggggatgtttgcccggaaactgggaaagggaataacactcgaaatcgtatataagaaatactcaagttaataaaaataaaataaaataaaataaaaaaggagcattcaactcataaataatttttgttctgaaaaatatttttaattgttatcagttatgagacagcttttcagaagattgtgtgtgtgtgtgtgtgtgtgtgtgtgtgtgtactacagcatgttttatatttagttatcaatccttgaagaatgatttagttttaaattaaatttaaatataatactagactctgttagatacgaaaggtaaatttctattttggttccctttactcccatgtctagtgtttctagatggaaaatattgtgatcctgctgtcttatagatttaacttaagaatgtttacattttattttcaactagattggcaattcaaagcctggtcttagaagttattttaaagtatgttcttagtgtaagtcaatttttaagctagttgtagttcatttaatttcctcacaagagttatttttgtgtgtggtatatttctcttttgttaggtgatttttgctgttatacttaccttgaattc

SEQ ID NO: 1707 - DNA, 2383 bp, Rattus norvegicus
  Genbank Accession No. M14050
ctctgtgagacacctgaccgaccgctgagcgactgactggtccacagcgccggcaagatgaagttcactgtggtggcggcggcgctgctgctgctgtgtgcggtgcgggcggaggaggaggacaagaaggaggatgtaggcacggtggttggcatcgacttggggaccacctattcctgcgtcggtgtattcaagaacggccgcgtggagatcatagccaacgatcagggcaaccgcatcacaccgtcgtatgtggccttcactcctgaaggggagcgtctgattggcgatgcggccaagaaccaactcacgtccaacccggagaacaccgtcttcgacgccaagcgcctcatcggacgcacttggaatgacccttccgtgcagcaggacatcaagttcttgccattcaaggtggttgaaaagaaaactaaaccatatattcaagttgatatcggaggtgggcaaaccaagacatttgccccagaagaaatttctgctatggttctcactaaaatgaaggaaactgccgaggcgtatttgggaaagaaggtcacccatgcagttgtgactgtaccagcttacttcaatgatgcacagcggcaagcaaccaaggatgctggcactattgctggactgaatgtcatgaggatcatcaatgagccaacagcagctgctattgcatatggcctggataagagagagggagagaagaacatcctcgtgtttgacctgggtggtggaaccttcgatgtgtctcttctcaccattgacaatggtgtctttgaagtggtggccactaatggagacactcatctgggtggggaagactttgatcagcgggtcatggagcacttcatcaagctgtacaaaaagaagactgggaaagatgtcagaaaggacaacagagctgtgcagaaactccggcgtgaggtagaaaaggccaagagagccctgtcttctcagcatcaagcgaggattgaaattgagtccttcttcgaaggagaagacttctcagagacccttactcgggccaaatttgaagagctgaacatggacctgttccgctctaccatgaaacctgtccagaaagtgttggaagactctgatctgaagaaatctgatattgatgagattgttctggttggcggatctactcgaattccaaagattcagcagttggtgaaagagttcttcaatggcaaggagccgtcccgtggcatcaacccagatgaggctgtagcatatggtgccgctgtccaggctggtgtcctctctggtgatcaagatacaggtgacctggttctgcttgatgtgtgtcctcttacacttggtattgaaactgtgggaggtgtcatgacaaaactgattccgaggaacactgtggtgcccaccaagaagtctcagatcttctccacagcttctgataatcagcccaccgtaacaatcaaggtctacgaaggtgaacgacccctgacaaaagacaatcaccttctgggtacatttgatctgactggaatccctcctgctccccgtggggtaccccagattgaagtcacctttgagatagatgtgaatggtattcttcgagtgacagctgaagacaaagggacaggaaacaaaaacaaaatcaccatcaccaatgaccaaaaccgcctgacccctgaagaaattgaaaggatggtcaatgacgccgagaagtttgctgaggaagacaaaaagctcaaagagcgcattgacacgaggaatgaattggaaagctatgcttactctcttaagaaccagatcggagataaagagaagctgggaggtaagctgtctcctgaagataaagagaccatggagaaagctgtagaggaaaagatcgaatggctggaaagccaccaggatgcagacattgaagactttaaagctaaaaagaaggaactagaagaaattgttcagccaattatcagcaaactctatggaagtggaggccctcccccaactggtgaagaggatacatcagaaaaagatgagttgtaggtgcactgatctgctagagctgtaatattgtaaatactggactcaggaactttcgttgggagaaaattgagagaacttaagtctcgaatgtaattggaatcttcacctcagagtggagttgaaaatgctatagcccaagtggctgtttactgcttttcattagcagttgctcacgtgtcttggggtcagggagaggaggaattggctattttaaaattggggaaaagctgggtcagggtgtgtgttcaccttggatatgttctatttaacggttgggtcatgcacatctggtgtaggaacttttttctaccataagtgacaccaataaatgtttgttatttacactggtctagtttttgtg

SEQ ID NO: 1708 - DNA, 2462 bp, Rattus norvegicus
  Genbank Accession No. M14972
gatggctgcaccatgagcgtctctgcactgagctccacccgcttcacgggcagcatctctggcttcctccaagtggcctccgtgcttggtctgcttctgctgctggtcaaagcagtccagttctacctgcaaaggcaatggctactcaaggctttccagcagttcccatcacctcccttccactggttctttgggcacaagcagtttcaaggtgacaaagaactacagcaaattatgacatgtgtggagaatttcccaagtgcctttcctcgatggttctggggaagcaaagcctacttaattgtctatgaccctgactacatgaaggtgattctcgggcgatcagatccaaaggccaatggcgtctacagattgctagctccttggatcggatatggtttgctcttgctgaatggacaaccgtggttccagcaccggcgaatgctaaccccagccttccactatgacattctgaaaccctatgtaaaaaacatggctgactccattcgactgatgctagacaaatgggaacagctggcaggtcaagactcctctatagaaatctttcaacatatctccttaatgaccctagacactgtcatgaagtgtgccttcagccacaatggcagtgttcaggtggatggaaattacaagagctatatccaggccattgggaacttgaatgacctctttcactcccgtgtgaggaacatctttcatcagaatgataccatctataatttttcttccaatggccacttgttcaaccgtgcttgtcaacttgcccatgatcacacagatggtgtgatcaagctaaggaaggatcagctgcagaatgcgggagagctggaaaaggtcaagaagaaaagacgtttggattttctggacatcctcttacttgccagaatggagaatggggacagcttgtctgacaaggacctacgtgctgaggtggacacatttatgttcgagggtcatgacaccacagccagtggagtctcctggatcttctatgctctggccacacaccctaagcaccaacaaagatgcagagaggaagttcagagtgtcctgggggatgggtcctccattacctgggatcacctggaccagattccctacaccaccatgtgtatcaaggaggccctgaggctttacccacctgttccaggcattgtcagagaactcagcacatctgtcaccttccctgatgggcgctctttacccaagggtatccaagtcacactctccatttatggtctccaccacaacccgaaggtgtggccaaacccagaggtgtttgacccttccaggtttgcaccagactctccccgacacagccactcattcctgcccttctcaggaggagcgaggaactgcattgggaaacaatttgctatgagtgagatgaaggtgattgtggccctgaccctgctccgctttgagctactgccagatcccaccaaggtccccatccccttaccacgacttgtgctgaagtccaaaaatgggatctacctgtatctcaagaagctccactaattccgttgtggagctccgaaatctgaaatgagtttcactggcagaaagctgagttggtggtgtgactagccttcttcagaagagtgcttcagagagtcctctcctcctctcttcagtacagatcacccttctcagcactggaatattcctctgctttaaagccagcacccttcccataccccctcttctaaaagccttcccttttacaaatgttcttatgacatcatcaagaccactgaaaaactccaagataatttcccatctcaatattccttactccatctaacctactaagtcccttttgaattatgaggaataattcaatttgttccatgggctccaaaactcaaggcctgagcattattgtgaaacctttattcagcctaatatcatcttcacaagactgttacctggtacgttcatctaaatctcccctgcatagtctctctacctgactattcctcacacaagtttctttaccttccctcctttctccaataaagtgtccagtgtcctgcacaaaaagctcaaggagaactgattatcaccttctgattcgttcattgatgcattcaaattaaacctccacatagtagagactttttcaactattataaaaaccatcctgagccagacctgcagtcaacagcaagagcaggaagcgcataggaactacacctgcaaccaagctggcacaaagaccaagaattctgaagcagcccaaactcaagatgacatatttttacaagttagagaaaaatcaagatctgagttatcttgacaaactcgggatggaaagtaggagggaggggaaagcaaataaatacttccttattgtgtagcataaaaaaaccgaattcgtaggagggaggggaaagcaaataaatacttccttattgtgtagcataaaaaaaccgaat

SEQ ID NO: 1709 - DNA, 805 bp, Rattus norvegicus
  Genbank Accession No. M15562
gtgattccagaggtgactgtactccccaaaagcccggtgaacctgggagagcccaacatcctcatctgtttcattgacaagttctcccctccagcggtcaatgtcacctggcttcggaacggacagcctgtcaccaaaggcgtgtcagagacagtgtttctcccaagggaggaccacctcttccgcaaattccactatctcaccttcctgccctccgtggaagattactatgactgtgaggtggatcactggggtctggaggagcctctgcggaagcactgggagtttgaagagaaaaccctcctcccagaaactaaagagaatgtcctgtgtgttctcgggttgtttgtgggtctggtaggcatcgtcgtcgggattgtgctcatcatcaagggccttcggaaacgcaacgcagtggaacgccaaggagccctgtgagataccgggaggtgatggcttccgtgagagctcatagaagaaatgtgctgtgacagcatctgaggctaccccttctctcagctcttcacctcagcagagacatcttctgcagtttccaacctcaagcctcgcgccagattctctggtctaatgtctggctggggttctccgtctgcttcctgtatctatattctattttccatcatttatagtaattcctctgtggcacatatcacagagctcttcctccgctgcggaactttctaagaatggaggcatcttctgttcacttacggcttgacatttctccaaactgtgttttctctttctctttttcaataaataataaacaccttgggtcctgaat

SEQ ID NO: 1710 - DNA, 1159 bp, Rattus norvegicus
  Genbank Accession No. M18529
ggccacaccaaaggaagccatagagagcctgatatcagagtattcttggaagaggcaggagaaaatgaaagccaatctctgctcctaccttacatgtttgtgttaggggtgtcagataaactggtctggtatctctgtctgatgcatggaactattgtagctgaagaagaacatagtttcagggaagaaaggcaatagaagggaggctctgaatagcttcaaagggtcagacccaatttactttctaaagtagctagggactagggaataactcaaaacccacaagactgtatacatgtgtcctggcttcattgttcctaatctgtagggttaagtgtgcttttctgtgtgtctgtctataacatgcataatgcactgaaagggagattttccttgttacttcataccatctctgcactaccttcctcaggggctgatgctgcaccaactgtatccatcttcccaccatcctcggaacagttagatactggaggtgcctcagtcgtgtgcttcataaacaacttctatcccagagacatcagtgtcaagtggaagattgatggcagtgaacgacgagatggtatcctggacagtgttactgatcaggacagcaaagacagcacgtacagcatgagcagcaccctcacgttgaacaaggctgactatgaaagtcataacctctatacctgtgaggttgttcataagacatcagcctctcccgtcgtcaagagcttcaacaggaatgagtgttagacccaaaggtcctgaggtgccacctgctccccagatccttccaatcttccctcctaaggtcttggagacttccccacaagcgacctaccactgttgcggtgctccaaacctcctccccacctcatcctccttcctttccttggctttgatcatgctaatatttggggaatattaaataaagtgaatctttgcacttgagatctttgtctttcttactaaatagtggttaacagttatttatcctgttacctggtttctcttctaaagaagttaaatgtttagttgccctgaaatccaccacacttaaacaacaaataaaactctcccccttgccctacttggttgtccactacatggcagtcctctctaaggttcacaagtactattcatggcttatttctctggg

SEQ ID NO: 1711 - DNA, 525 bp, Rattus norvegicus
  Genbank Accession No. M21354
gcaggtcccagaggcccagttggtccacatggacctcctggaaaagatggatcaagtggacatccaggtcccattggaccaccagggcctcgaggtaacagaggtgaaagaggatctgagggctcgcccggtcaccctggacagccaggaccccctggaccccctggtgcccctggtccctgctgtggtggcggtgctgccattgctggagttggaggtgaaaagtctggcggcttttcaccatattacggggatgatccaatggatttcaagatcaacactgaggagatcatgtcttcactcaagtctgttaacggacaaatagagagtcttatcagccctgatggttctagaaaaaaccctgctcgcaattgcagagacctgaaattctgccaccctgaactcaagagcggagaatactgggttgatcctaaccaaggctgcaagatggatgctataaaagtgttctgtaatatggaaaccggagaaacatgcataaatgccagtcccatgactgtcccgcgg

SEQ ID NO: 1712 - DNA, 912 bp, Rattus norvegicus
  Genbank Accession No. M24542
tcccgcggggtggcgggagcgctgcggcccctgctgcaaagcgcggtgcccgccacctcggaaccaccggttctggacgtgaagcgacccttcctgtgccgtgagtcgctgagtggccaggccgcgacccgtcctttggtggccacagtgggcctgaatgttcctgcttctgttcgttattcccacacagacatcaaggtgcccgacttctctgactatcgccgtgctgaagttctagatagcacaaagtcttctaaagagagcagtgaggctagaaaaggcttctcttacttggtaactgcaactactactgtgggtgttgcatacgctgcgaaaaatgcagtctcccagtttgtttccagcatgagtgcttctgcggatgtactggccatgtcgaagatcgagatcaagttgtctgatattccagaggggaagaacatggcttttaaatggagaggcaaacctctgtttgtgcgccatagaaccaagaaggagattgaccaggaagctgcagttgaagtgtcccagttaagggacccacagcatgatttagagcgtgtaaagaagcctgaatgggttattctgatcggtgtctgtactcatcttggttgtgtacccattgcaaacgcaggagattttggtggctactattgcccctgccatgggtcacactatgatgcttctggcaggatcaggaagggccctgcacctctcaacctggaagtacctacctatgagttcaccagtggtgatgtagttgttgtgggttagacacttggactgagggcctaggtttctttcggtcttcatgtcccctcagaagagttgagagtaagccttgtacttctaggttggttgatttaaaatatttaagaattgttaataactattggcaaacattaatgtgaagta

SEQ ID NO: 1713 - DNA, 147 bp, Rattus norvegicus
  Genbank Accession No. M27207
tcaatttccccaaaagccaaaaattgggagacaattttacatggactttggaaaacatttttttcctttgcattcatctctcaaacttagtttttatctttgaccaactgaacgtgaccaaaaaccaaaagtgcattcaaccttacc

SEQ ID NO: 1714 - DNA, 100 bp, Rattus norvegicus
  Genbank Accession No. M32757
tggaattaacttggcctgaacttctccgtctccacagatggcctcgcctcctcccgggtccgcctgtacttcttcgtctctaacgaaggcaaccagaacc

SEQ ID NO: 1715 - DNA, 1994 bp, Rattus norvegicus
  Genbank Accession No. M33648
atctctcccaggggctgtggactgctggctttctgttgataccttagagatgcagcggcttttggctccagcaaggcgggtcctgcaagtgaagagagtcatgcaggaatcttcgctctcacccgctcacctgctccccgcagcccagcagaggttttctacaatccctcctgctcccctggccaaaactgatacatggccaaaagatgtgggcatccttgccctggaggtctactttccagcccaatatgtggaccaaactgacctggagaagttcaacaatgtggaagcagggaagtacacagtgggcttgggccagacccgtatgggcttctgttcggtccaggaggacatcaactccttgtgcctcacagtggtgcagaggctgatggaacgcacaaagctgccatgggatgccgtaggccgcctggaagtgggcacggaaaccatcattgacaagtccaaggctgtcaagacagtgctcatggagctcttccaggattcaggcaacactgacatcgagggcatagataccaccaacgcctgctatggtggcactgcctccctcttcaacgctgccaactggatggagtccagctactgggatggtcgctatgccctggtggtctgtggtgatatcgcagtctacccaagtggtaacccccgccccacaggtggtgccggggctgtggcaatgctgattgggcccaaggccccgctagtcctggaacaagggctgaggggaacccacatggagaacgcctatgacttctacaaaccaaacttggcctcagagtatccactggtggatgggaagctgtctatccagtgctacctgcgggccttggaccgatgctatgcagcttaccgcaggaaaatccagaatcagtggaagcaagctggaaacaaccagcctttcaccctcgatgacgtgcaatatatgatcttccacacacccttttgcaagatggtccagaaatccctagctcggctgatgttcaatgacttcctgtcatctagcagtgacaagcagaacaacttatacaagggtctagaggccttcaagggtctaaagctggaagaaacctacaccaacaaggatgttgacaaggctctgctgaaggcctccctggacatgttcaacaagaaaaccaaggcctccctttacctctccacaaacaatgggaacatgtacacctcgtccctctacgggtgcctggcctcacttctctcccaccactctgcccaagaattggccggctccaggattggagccttctcctacggctcaggcttagcagcaagtttcttctcatttcgagtgtccaaggacgcttccccaggttcccctctggagaagctggtgtctagtgtgtcagatctgcccaaacgtctagactcccggagacgcatgtcccctgaggaattcacagaaataatgaatcagagagagcaattttaccacaaggtgaacttctctccccctggtgacacaagcaacctcttcccaggcacttggtaccttgaacgagtggatgagatgcaccgcagaaaatatgcccggcgtcccgtctaaggagaccaatccatacaaccattccccggggaaagaatgtgagcagagccgttacccaaacggcttccacttaaaattccacccacagcagtgaacggtgaatagacacagcgaccccataggatctgctccgcggtgaagggcctccctctgtggatcctgggtgaccctccctgaagcagtgagcaccacaggttctgctgtggaccagagcccccctgtggagagggagaaagaaaggggagccgctgacctgcagggatacagaccttccccacagcctggcagccgcccgtttgttgcagcttattatcagactgtgggctatcatagttcatgctcgtttcttaaagtttcccgagaatttctaaaattttgtatctaaacttttaatatggcgattaaaaggagagaagga

SEQ ID NO: 1716 - DNA, 451 bp, Rattus norvegicus
  Genbank Accession No. M34331
tcctctttctctcgaaccgggcggcctcatccgcgaacagcgcagcaatggccaagattaaggctcgggacctgcgcggcaagaagaaggaggagctgttgaaacaactggatgatctgaaggtggaactgtcccagcttcgcgtggccaaagtgacaggcggcgccgcgtccaagctctccaagatacgagtcgtacgcaaatccatcgcccgtgtcctcactgtcattaatcagactcaaaaggaaaacctcaggaaattctacaagggaaagaagtacaagcccctggacctgcgacccaagaagacaagagccatgcgccgccggctcaccaagcatgaagagaagctgaagaccaagaagcagcagcggaaggagcggctgtacccactgcgcaagtacgcagtcaaggcctgagacgacgacaataacaataaagtccaaaactg

SEQ ID NO: 1717 - DNA, 562 bp, Rattus norvegicus
  Genbank Accession No. M36151
agagactccccaagggatttcgtgtaccagttcgagggccagtgctactacaccaccgggacgcagcgcatgcggctcgtgaccagacacatctacaaccgggaggagtacgtgcgcttcgacagcgacctgggcgagtaccgcgcgctgaccgagctggggcggccctcagccgagtactggaataagcagtacctcgagcagacgcgggccgagctggacagggtctgcagatacaactacgaggggccgggggctctcacctccctgagacggcttgagcagcccaatgtggccatctccctgtccaggacagaggcccttaaccaccacaacctgctggtctgctcagtgacagatttctacccagcccagatcaaagtgcgctggttccggaatggccaggaggagacgacgggggtcgtgtccacacagcttattaggaatggggactggaccttccagatcctggtcatgctggagatcacgcctcagcggggagatgtgtacacctgccatgttgaccaccccagccttcagagccctgtcacagtggagtggc

SEQ ID NO: 1718 - DNA, 1157 bp, Rattus norvegicus
  Genbank Accession No. M36410
ggcaggctaggttgcgctgtctgcgtgctgaccggggcttcccggggcttcggccgcgccctggccccgcagctggccgggttgctgtcgcccggttcggtgttgcttctaagcgcacgcagtgactcgatgctgcggcaactgaaggaggagctctgtacgcagcagccgggcctgcaagtggtgctggcagccgccgatttgggcaccgagtccggcgtgcaacagttgctgagcgcggtgcgcgagctccctaggcccgagaggctgcagcgcctcctgctcatcaacaatgcaggcactcttggggatgtttccaaaggcttcctgaacatcaatgacctagctgaggtgaacaactactgggccctgaacctaacctccatgctctgcttgaccaccggcaccttgaatgccttctccaatagccctggcctgagcaagactgtagttaacatctcatctctgtgtgccctgcagcctttcaagggctggggactctactgtgcagggaaggctgcccgagacatgttataccaggtcctggctgttgaggaacccagtgtgagggtgctgagctatgccccaggtcccctggacaccaacatgcagcagttggcccgggaaacctccatggacccagagttgaggagcagactgcagaagttgaattctgagggggagctggtggactgtgggacttcagcccagaaactgctgagcttgctgcaaagggacaccttccaatctggagcccacgtggacttctatgacatttaagcccatgtcctgtcacagcgccccccccccccagccctgcctaacacacatacaagccctccaacccagccagcgggagccacgggcactgccagtcctgagaaggcttctgcagaggctcgggagagagctgatgtgtactggagtcctctgtccccaggaagagaacttagggctgggagagcaggagaagcagaaacactgagcagatgaggcagagtctctcgtctgtggtcgttctcaggtgaagagggcggggtctgattcacagagaggaccgagggtattgaatctttgttgtactgccttcatcctggggtattcactggtcctccctcgactctggtcaaatacatggttatggcagatgccctaga

SEQ ID NO: 1719 - DNA, 1877 bp, Rattus norvegicus
  Genbank Accession No. M38566
ggtctctggctctaaactcttggcttctcagacacgatctatggctgtgttgagccgcatgagactgagatgggcgcttctggacactcgtgtgatgggccatggcctctgcccacaaggggccagagccaaggccgcgatccctgcagccctccgggatcacgagagcacggagggtccaggaacaggtcaagaccgaccgcgcctgcggagtctggcggagcttccgggacccggaacgctacgctttttattccagctatttctacgaggctatgtgctgcacttgcacgagctccaggcgctgaacaaggccaagtacggcccaatgtggacaaccacctttgggactcgcaccaatgtgaatctggctagcgccccgctcttggagcaagtgatgagacaggagggcaagtaccccataagagacagcatggagcagtggaaggagcaccgagaccacaaaggcctctcctatgggatcttcatcacacaaggacagcagtggtaccatctgcgtcatagtttgaatcagcggatgctgaagcctgctgaggcagccctctacacagatgccttaaacgaggtcatcagtgactttattgcccggctggaccaggtgcggacagagagtgcatcaggggatcaggtgccagatgtggcacatcttctctaccaccttgccttggaagccatctgctatatcctgtttgagaaaagggttggctgcctggagccctccatccctgaggacaccgccaccttcatcagatctgttggactcatgttcaagaactcagtctatgtcactttccttcccaagtggtctcggcctctgctgcccttttggaagcgatacatgaataactgggataacattttctccttcggggagaagatgattcatcaaaaagtccaggagatagaagcccagctacaggcggctgggccagatggggtccaggtatctggctacctgcacttcctgctgactaaggaattgctcagtcctcaagagactgtcggcacctttcctgagctgatcttggctggggtagacacgacatccaatacactgacctgggccctgtatcacctttcaaagaacccagagatccaggaagccttgcacaaggaagtgactggtgtggtacccttcgggaaggtgccccagaacaaggactttgcccacatgcccctgctaaaagctgtgattaaggagaccctgcgcctctaccctgtggttcccacaaactcccggatcatcacagaaaaggaaactgaaattaatggcttcctcttccctaagaatacacagtttgtgttatgcacctacgtggtgtcccgagatcccagtgtctttcctgagcccgagagcttccagcctcaccgatggctgaggaagagagaggacgataactccgggatccaacacccatttggctctgtgccctttggctatggggttcggtcctgcctgggtcgcaggattgcagaactggagatgcaactcctgctgtcaaggctgatacaaaagtatgaggtggtcctgtctcccgggatgggagaagtgaagtctgtgtcccgcatcgtcctggttcccagcaagaaggtgagcctacgctttctgcagagacagtagtaccaagctgggctcctgtctccatgggacttgtccagaagccctggcacagaagttcttggccagtctcacgtcacatgtcacgatgccagattcaacaggggacctctctgccctttccatagacaccagacgtctggcacaatctctactgagcagcacccatttaagacattagagcacctcatatcacaggacggtgcttgggtacaatttaaaataaaatttaaaattc

SEQ ID NO: 1720 - DNA, 1712 bp, Rattus norvegicus
  Genbank Accession No. M57728
atggcgacggcagtgtgggcggctgcgcggctacttcggggttctgcggcgctgtgcgcgcggcccaagttcggttctcctgcacacagacggttcagcagtggcgccacctaccccaacatccctctctcttctcccttgcccggagtgcccaagcctatttttgctacagttgatggacaggaaaagtttgaaaccaaagtcaccactctggacaatgggcttcgtgtggcatctcaaaataagtttggacagttctgtaccttaggaattcttattaattcaggatcacgatatgaagcgaaatatcttagtggaattgctcattttctggaaaaattggcattttcgtctaccgctcgatttgacagcaaagatgaaattctgcttaccctggaaaaacatggtggtatctgtgactgccagacctcgagagacaccaccatgtatgctgtgtctgctgacagcaaaggcttggacactgtggtgggcctgctggctgatgtggttctgcacccccgcctgacagatgaggaaattgagatgacgaggatggctgttcagtttgaacttgaggacctgaacatgagacctgacccagagccactgctcaccgagatgattcatgaagctgcttttagggagaacacggtgggcctgcaccggttttgtcctgtggagaatatcgggaagattgaccgagaagtgctgcattcctacctgaagaactactacacccccgaccgcatggtgcttgctggagtgggcgtggagcatgagcacctggtcgaatgtgccagaaagtacctcctgggagtgcagcctgcctggggagctccgggagctgtgtggatgttgacagctcagtggcacagtacacgggggggatcatcaaggtggagagagacatgtcaaatgtcagccttgcgcccaccccgattccagagctcacacatatatggtggggctagagagctgctccttctggaggaggatttcatcccctttgctgtgttgaatatgatgatgggaggcgggggctccttctcggccggagggcctggcaaaggcatgttctccaggctctacctcaacgtgctcaatcggcaccactggatgtataatgcaacctcctaccaccacagctatgaagacacaggcctcctgtgcatccatgccagcgcagaccctcgacaggttcgagaaatggtagaaatcatcacaaaggagtttattttgatgggccgaacggtggatttggtggagctggagcgggccaagacacagctgatgtccatgctcatgatgaacttggagtccaggcctgtgatctttgaggatgtggggaggcaggtgttggctacacattcaagaaagctgccccatgagctgtgcacactcattcgcaatgtgaagccggaagatatcaagagggttgcttccaagatgctccgaggcaagcctgctgtggcggctctgggtgatttgactgacctgcccacgtatgaacacatccaggcagcgctgtccagcagagatgggcgcctgcccagaacataccggctgttccggtagagccctccagcggaggctgcagagtgcttctgtgcatgttactgttggtgtggacactgcataagaatagctagctctgtgaacagtgccaacagggaagctctggaaacttgaatgaaagttactgttgccactgc

SEQ ID NO: 1721 - DNA, 3413 bp, Rattus norvegicus
  Genbank Accession No. M58040
catagagttcactgacatcatcaagcagctgagccagaatacatatactcctcgtgaggctggatctcagaaagacgagaatcttgcctattatattgaaaatctgttccatgactttaaattcagcaaagtctggcgagatgaacattatgtgaagattcaagtgaaaaacagtgtttctcaaaacttggtgaccataaattcaggtagtaacattgacccagtggaggctcctgagggttatgtggcatttagtaaagctggagaagttactggtaaactggtccatgctaattttggcactaaaaaggactttgaagaattaaattattctgtgaatggatctttagtgattgttagagcagggaaaattacttttgcagaaaaggttgcaaatgcccaaagctttaatgcaattggtgtcctcatctacatggacaggaatacgttccccgttgttgaggcagaccttcaattctttggacatgctcatctaggaactggggatccatatacacctggctttccttctttcaaccatactcagtttccgccatctcagtcatctggattgccttctatacctgtgcagacgatctcaagagctcctgcagaaaagctattcaaaaacatggaaggaaactgtcctcctagttggaatatagattcctcatgtaagctggaactttcacagaatcaaaatgtgaagctcactgtgaacaatgtactgaaagaaacaagaatacttaacatctttggcgttattaaaggctatgaggaaccagaccgctacattgtagtaggagcccagagagacgcttggggccctggtgttgcgaagtccagtgtgggaacaggtcttctgttgaaacttgcccaagtattctcagatatgatttcaaaagatggatttagacccagcaggagtattatctttgccagctggactgcaggagactatggagctgttggtccgactgagtggctggaggggtacctttcatctttgcatctaaaggctttcacttacattaatctggataaagtcgtcctgggtactagcaacttcaaggtttctgccagccccctattatatacacttatggggaagataatgcaggacgtaaagcatccgattgatggaaaatatctatatcgaaacagtaattggattagcaaaattgaggaactttccttggacaatgctgcattcccttttcttgcatattcaggaatcccagcagtttctttctgtttttgtgaggatgaggactatccttatttgggcactaaactagatacctatgagatattaattcagaaagttcctcagctcaaccaaatggttcgtacagcagcagaggtggccggtcagttcattattaaacttacccatgacattgagttgaccctggactatgagatgtacaacagcaaactactgtcatttatgaaggatctgaaccagttcaaagcagatataaaagatatgggtctaagtctacaatggctgtattctgctcgtggagactacttccgtgctacttctagactaacaactgattttcataatgctgagaaaacaaacagattcgtcatgagggaaatcaatgatcgtattatgaaagtggagtatcacttcctgtcaccctatgtatctccaagagagtctcctttccgacacatcttctggggctctggctctcacaccctctcagctttagtggagaacctgagacttcgtcagaaaaatatcactgctttcaatgaaacgctcttcagaaaccagttggccctggctacgtggactattcagggagttgcaaatgccctctctggtgacatttggaatattgacaatgagttttaaatgtaatgtgcataattaagtgagagagggtagtctgtttctagacttgagctggttgtgctaaattttcattagagctcgaattaatgttaaaaattctacccaatcatctaatgtgtttaggcagcagcttttagtgcagggttggacccacacttcaagttacagtggacaacactttccatgttcatgataccttcttagattatctttagaattttgagtcttttgtaataccttgctctttgcttcatggtcatgaaaatgtcagaaccagttgtaagaacattgctataagtcctgagggcactactagtatcttgaggtgggaggaagagggtgtatgtgaggggcagagtggtcgctgggtgtgattccccatctccatctgaccctcactgggattctccaattgagctgtatgcctgaaggatttagctggcttccattcccctaaagtagacagttacttttcagaagaggtgcaacttgttttcttgccagcaaggttgaactaggtccttctgctggataaaagaaaggaagtttgtctgtttacaggaataaggccttattggtttaacctttgtgttatttaggatgagaccagaagccaaagacttcaagttttctctccactgtcatctacccagtagtctttagttctttgggttgttttgtttttgttttgtttttcttttccaacactttctgaaaaagaacaggtttagactcagtctgtcagcagaacacactgccgagctcggtacccggggatcctctagagtcgacctgcaggcatgcaagctttccctatagtgagtcgtattagagcttggtgcatgcctgcaggtcgactctagaggatccccgggtaccgagctctggccaaagtgctggtcttcagggaagctctgtcgtttttggcactgagatatttattgtttatttatcagtgacagagttcactataaatagtgtttttttaatagaagataattatcggaagcagtgccttccataattatgacagttatactgtcgttttcttttaataaaagcagcatctgctaatgagacccacagatactggaagttttgcacttacggtcagcacttgcgggctttagaaaggagaaagccacaagccaaacaatatccgatgagctagaagaggattgggttaaataagagattcctagttgagttggaaaaaaatgataattctaagtccagtgagttgtggccaagttaaatgtcatttaaaggctatgatagtacatcaacaaaattctatagctcagtttattcaagatgtaactcaaatccaattttgcaaaatttccagtacctttgtcacaaacttaactcacattatcgggagcagtgtcttccataatgtataaagaacaaggtagtttttgcctaccacagtgtctatatcggagacagtgacctccatatgttacactaagggtgtacgtaattatcgggaacagtgtttcccataattttcttcatgcgatgacatcttcaaagcttg

SEQ ID NO: 1722 - DNA, 8275 bp, Rattus norvegicus
  Genbank Accession No. M59786
cgcagaattctaaatctgagagcaaaagctcaaattcactgccaagcgataaggccgtatgagatttttatggccttcaaacgtggccacagacattgtttctgagtttttaaaaagtacaaggaaaaatacaagtgggatagctgttcagttgtgacatcagctgttggtccccaactggagtcacaatgattcgggccttcgctcagccatccacacccccataccagccgctctccagttgcctgtctgaggacacagagaggaagttcaagggcaaggtggtacacgaagctcaactcaactgtttctacatttctcctggaggttccaactatgggagcccacgcccagctcatgccaacatgaatgccaatgcagctgcaggacttgcccccgagcacatccctactccaggggcagcactgtcctggctggcagccatcgatgccgcccggcaggccaagttaatgggcagtgctggcaatgcgaccatctctaccgtcagttccacacagcggaagcggcagcagtatgggaaacccaagaagcaggggggcacaactgccacacggccgccccgggctctgctctgcctgactctgaagaaccccatcaggagggcatgcatcagcattgttgaatggaaaccatttgaaataattattttattgacgatttttgccaattgtgtggccttagcaatctatattccctttccggaagatgactccaacgccaccaactccaacctggaacgggtggagtatctcttcctcatcatttttaccgtggaagcatttttaaaagtgattgcctacggactactcttccaccccaacgcttacctccgcaacggttggaatttactagattttataatcgtggttgtagggctttttagtgcaattttagaacaagcaaccaaagctgacggggccaacgctctgggagggaaaggagcgggattcgatgtgaaggcactgagagctttccgtgtgcttcgtcccctgcggctggtgtctggagtcccaagtctccaggtggtcctgaactccatcatcaaggccatggtgcccctgctgcacattgccctcctcgtgctcttcgtcatcatcatctatgccattatcggcctggagctcttcatggggaagatgcacaagacctgctacaaccaggagggcataatagatgttccagcggaagaggatccctccccttgtgctttggagacaggccatgggcgacagtgtcagaacgggaccgtgtgcaagcccgggtgggatgggcccaagcacggcatcaccaacttcgacaacttcgccttcgccatgctgacggtgttccagtgtatcaccatggagggctggacagacgtgctgtactggatgcaagacgctatgggctatgagttgccctgggtgtattttgtcagtctggtcatctttggatcctttttcgttctaaatctggttctcggtgttttgagcggagagttttccaaagagagggagaaagccaaagctcgaggagacttccagaagcttcgtgagaagcagcagctagaagaagatctcaaaggctacctggactggatcacccaggcggaagacatagaccctgagaatgaggacgagggcatggatgaagacaaaccccgaaacatgagcatgcccacaagtgagactgagtctgtcaacaccgaaaacgtggctggaggtgacatcgagggtgaaaactgtggagcccggcttgcccaccggatctccaaatccaagttcagccgctactggcgccggtggaatagattctgcagaagaaagtgccgtgccgcagttaagtccaacgtcttctactggctggtgatcttcctggtgttcctcaacaccctcaccattgcctccgaacactacaaccagcctcattggctcacagaagtgcaagacacggccaacaaggccctcctggcccttttcacggcagaaatgctcctgaagatgtacagcctgggtctgcaggcctactttgtatccctcttcaaccgctttgactgtttcattgtgtgcgggggcatcctggagaccatcctggtggagacgaagatcatgtcgcccctgggcatctcctgctggagatgtgtgcggctgctcaggattttcaagatcaccaggtactggaactccctgagcaacctcgtggcgtccttgctgaactcactgcgctccatcgcctccctgctgctactcctcttcctcttcatcatcatcttctccctcctggggatgcagctgtttggtggaaagttcaactttgatgagatgcagacccgtaggagcacgtttgataacttcccgcagtctctcctcactgtgtttcagatcctgaccggggaggactggaattcggtgatgtatgatgggatcatggcttatggcggcccctcttttccagggatgttagtctgtatttacttcatcatcctcttcatctctccaaattatatcctactgaatctcttcttggccattgcggtggacaacctggctgatgcggagagcctgacctctgcccaaaaagaggaagaagaagagaaggagagaaagaagctggccaggactgccagcccagaaaagaaacaggaggtgatggagaaaccagcagtagaggagagcaaagaggagaaaattgagctgaagtccattacagcagatggagaatccccgcccactaccaagatcaacatggatgacctccagcccagtgaaaatgaggacaagagtccccactccaacccagacactgcaggtgaagaggatgaggaggagcccgagatgcctgtgggcccacgcccccggcccctgtctgagctgcaccttaaggaaaaggcagtccccatgccggaagccagtgcatttttcatcttcagcccaaacaacaggttccgcctgcagtgccaccgcattgtcaatgacacgatcttcaccaacctcatcctcttcttcattctgctcagtagcatctccctggcggctgaggaccccgtccagcacacctccttcaggaaccacattctgttttattttgacattgtttttaccaccattttcaccattgaaattgctctaaagatgactgcttacggggctttcctgcacaagggctctttctgccgaaattacttcaatatcctggacctgctggtggttagcgtgtccctcatctcctttggcattcagtccagcgcgatcaacgttgtgaagattttaagagtgcttcgtgtcctcaggcccctgaggatcaacagggccaaggggctaaagcacgtcgttcagtgtgtgtttgtggccatccggaccattggaaacattgtaattgtcaccactctgctgcagttcatgttcgcctgcattggggtccagctcttcaagggaaagctctatacctgttcggatagttccaaacagacggaggcagaatcgaagggtaactatataacatacaagaccggagaagttgaccaccccattatccagcctcgaagttgggagaacagcaagttcgactttgacaatgttctggcagccatgatggccctctttaccgtctccaccttcgaggggtggccagagctgctgtaccgctccattgactcccacacagaagacaagggtcccatctacaactatcgtgtggagatctccatcttcttcatcatctacatcatcatcattgccttcttcatgatgaacatcttcgtgggtttcgtcattgtcaccttccaggagcagggggaacaagaatacaagaactgtgagctggacaagaaccagagacaatgtgtggaatatgccctcaaggcccgacccttgccaaggtacatccccaagaaccagcaccagtacaaagtgtggtacgtggtcaactccacctacttcgagtatctgatgttcgtcctcatcctgctcaacaccatctgcctggccatgcagcactacggccagagctgcctcttcaaaatcgccatgaatatactcaacatgcttttcactggcctcttcacggtggagatgatcctgaagctcattgccttcaaacccaagcactatttctgtgatgcatggaatacatttgacgccttgattgttgtgggtagcattgttgatatagcaatcaccgaggtacacccagctgaacatacccaatgctctccctctatgagtgcagaggagaactcccgcatctccatcaccttcttccgcctcttccgggtcatgcgcctggtgaagctgctgagccgaggggaaggcatccggaccctgctgtggaccttcatcaagtccttccaggccctgccctatgtggcccttttgattgtgatgctgttctttatctatgcagtgattgggatgcaggtatttgggaagattgccctgaatgacaccacagagatcaatcggaacaacaacttccagacgttccctcaggctgtgctactgctcttcaggtgcgccactggggaggcctggcaggatatcatgctagcctgtatgccaggcaagaagtgtgctccagagtctgagcccagcaacagcacggaaggggagacaccctgtggcagcagtttcgctgtcttctacttcatcagcttctacatgctctgtgccttcctgatcatcaacctctttgtagctgttatcatggacaactttgactacctgactagggattggtctatccttggtccccatcacctggatgaattcaagagaatctgggccgaatatgaccctgaagccaagggtcggatcaaacacttggatgtggtgaccctcctccgtcgaattcagcccccactgggttttgggaagttgtgtcctcaccgtgtggcctgcaaacgcctggtgtccatgaacatgcctctgaacagtgatgggacggtcatgttcaatgctacactgtttgcccttgtcaggacagccctgaggatcaaaacagaagggaacctagagcaagccaatgaggagctgagagccatcatcaagaaaatctggaagaggaccagcatgaagctgttggaccaggtggtgccccctgcaggtgatgacgaggtcacagtgggcaagttctatgccaccttcctgatccaagagtacttcaggaaattcaagaagcgaaaagagcaggggctggtcggcaagccctcgcagaggaatgcactgtctctgcaggctggcttacgcaccttgcatgacattgggcctgagatccggagagccatctctggggatctgacggctgaggaggagctggacaaggctatgaaggaggcagtgtctgctgcctccgaagacgacatcttcaggagggctggaggcctgtttggcaaccacgtcagctactaccagagtgacagcaggagcaacttccctcagacgtttgccacccaacgcccactgcacatcaacaagacagggaacaaccaagcggacaccgaatcaccgtcccatgagaagctggtggactccactttcacccccagcagctactcatccacgggctccaatgccaacatcaacaatgccaacaacactgccctgggccgcttcccccaccctgctggctactccagcacggtcagcactgtggagggccatgggcctcccttgtcccctgctgtccgggtacaggaggcagcatggaaactcagctctaagaggtgccactcccgagagagccagggggccacggtgagtcaggatatgtttccagatgagacccgcagcagcgtgaggctgagcgaagaagttgagtactgcagtgagcccagcctgctctccacagatatactctcctaccaggacgatgaaaaccgacaactgacctgtctagaggaggacaagagggagatccagccatgtccgaagaggagtttccttcgctctgcctctctaggtcgaagggcctccttccatctggaatgtctaaagcgacaaaaggatcaagggggagacatctctcagaagacagccttgcccttgcatctggttcatcaccaggcattggcagtggcaggcttgagccccctcctgcagagaagccattctccttccacgtttcccaggccacgccccacgccccctgtcactccaggcagccggggcaggcccctacagcccatccctaccctgcggctggagggggcggagtccagtgagaaactcaacagcagcttcccgtccatccactgcagctcctggtcagaggagaccacagcctgtagtgggggcagcagcatggcccggagagcccggcccgtctccctcaccgtgcccagccaggctggagctccaggcagacagttccacggcagtgccagcagcctggtggaagcggtcttgatttcagaaggactgggacagtttgctcaagatcccaagttcatcgaggtcaccacacaggagctggctgacgcctgcgatatgacaatagaggagatggagaacgccgcagacaacatcctcagcgggggcgcccagcagagccccaacggcaccctcttaccttttgtgaactgcagggacccagggcaggacagggctgtggtcccagaggacgagagctgtgtatatgccctggggcgaggccggagcgaggaagcgctcccggacagcaggtcctatgtcagcaacctgtagtccgcaggctggcgagacgcgggtgttttttattcgtttcaatgttcctaatgggttcgtttcagaagtgcctcactgttctcgtgacctggaggtaaccggaacagcgtcttcattcactgctgtcgggataagcctcagagctgggcggtgtaccgaagtcggcttttcagggagaagccaaggccgttggtgcgggggctccagcaccttcccacggcagcaccgcccaaaggaccccaccccccctaagcaaaagggtgttttccccttgcttgtataaacagtcatttgcacatgttctgtctgagcctggccgtctctatggagcagggccccagggatctatggcaggaatgggccagtgtccccagtaggagccggaaggtggctgcaaggttcccagcagtgcagatctggtccctatgtcccttcagggacccttcccctgctggaactgaggagcaggtgcaggagccagtgcagaccacaccacctgccctcagctagccagacctgggggcgcaggctgcttgcctggtgctctgggtttcatagtttgatggttcttgtcagcatgttgcggttttctaggttttgatttctttattactatttgttgtgttttccacggggaggggaggaagaagagcgtttacaactgcgcagcctcacttcaccggttccacatttgcatatttaagttggatttggtttattgtattctttaaatggtgcggtccaacccccaccctcacccctattggagcaagggttcattatcaccaacggggttcattatcaaccaacggggaggttttacctgctctgtgtatgcccaagtaacatgttacaattttccttaagtcaaagcaactttttcccctttcggtttggttgagcatcacgacctgcaggttaacagtcagtttagataaggcggtgtgtgcctgggcgactgagctgggctcctttctgggcatatggattggttcaggagagaagaaatatgggcatctttgcgtcacacgtgtgtccatagtgggtcgtcttgtgtgtctgtgcatccacacggtacgtgagcaccccgccccacccccgctcaaagtctgtagatcccgttcgggtttgacggccggggagttcaaaatctggggcgattcgaaagcaagaacaaaccactgtctctgcttctgcttctgaaacgagaatctggtaactgcattttctgtcccacgagatatgcaaaagcaatgcaataatatccattttaaaatacgattgtgagttgtgtcacagcattaaaattctattttaaaaaaaacatgaaatttaaggggaaaaactccaagaagacattttgactttcgatatattctgtgtaatgttttattgcattgataatgtttctgttgaagaaactgttatacttgaattcaggtcagtttcagtatttttcaaatatttttttaaaactgaattgcaattgtgccttgcaaatataatgacttaagtttgttttaaaattcacttcttgtatattttgctgcatgtaaagtaaatcattttgtatttgg

SEQ ID NO: 1723 - DNA, 1675 bp, Rattus norvegicus
  Genbank Accession No. M60666
cgcgctcggtctcctctggctcctctgcctaagggcccctcgccaccgccaccatggacgccatcaagaagaagatgcagatgctgaagctcgacaaagagaacgccttggatcgagcagagcaggcggaggctgacaagaaggctgcggaagaccggagcaagcagctggaagatgagctggtgtcactgcaaaagaaactcaagggcactgaagatgaactggacaaatactccgaggctctcaaagatgcccaggagaaactggagctggcggagaaaaaggccacagatgctgaagctgacgtagcatctctgaacagacgcatccagctggttgaggaggagttggatcgcgctcaggagcgtctggccacagctctacagaagctggaggaggctgagaaggctgcagatgagagtgagagaggcatgaaagtcattgaaagccgagcccaaaaagatgaagaaaagatggagattcaggagatccagctgaaagaggccaagcacattgctgaagatgctgaccgaaagtatgaagaggtggcccgtaagctggtcatcatcgagagcgatctggagcgtgcggaggagagggctgagctctcggaaggcaaatgtgccgagcttgaagaagagttgaaaacggtgacgaacaacttgaagtcactggaggctcaggctgagaagtactctcagaaagaagacaagtatgaagaggagatcaaggttctctctgacaagctgaaggaggctgagacccgggctgagtttgcagagagatcagtaaccaaattggagaaaagcattgatgacttagaagagaaagtggcacatgccaaagaagaaaaccttagtatgcaccagatgctggaccagactttactggagctaaacaacatgtgaaaccctccttagctgcggccacattctctcgtttccccctgttgttttattttgtctttaaacacatgcttaccatgaaaccccttcaatgctttttttttttatatatatatatacctttaccactgtcactgcaacatctgcagagagccagctagggcagggggtggggaaagacacacagaaagcaggtgtacttgttatttaaatgtgccatttcccaggttgacattgccacacttcacagagtttaggcatgcagtttgcttagccagtgtaggaagcctcacgaaaacaaaaggattaacagcctaagtgccaatggtggggtcatcaggaagactgatgttggagacaatcaggtgcagattggtgctaatttaaacaaaagaacccctggtgtcttttgttcagtctaatacaatttagacttctgtccaacactaatttatttttgtcttgagtagcactgcgagaggatatgggttccatgtgcccgtgttcctcacagccaagggtttgaaagccacgctggtcttgtaagattcccattccttcccagctgacatgcttgtggtcccttccaactcagtggggagagggctcagtgctgttcgccccccccccccccaattctccatgtcagggtaagagatctaggcactacatatgtaattggtaaagaaaaggcattttctcgagagttataactatgtaaacattgtataatgatatgaaataaaatgcacattgtaggacattttcta

SEQ ID NO: 1724 - DNA, 3912 bp, Rattus norvegicus
  Genbank Accession No. M62992
cacagcttgggccttagagcagcaactagagagtgtgacaactgtgcctgtgatatctacatttgaaagatttgtacaaaaaagattacaaggttcaatgtcagtggctagggagatagcttagtcaataaagtgcttaccacacaagcatggagttcctagcagccacatgaaaaagctgaacatagtagccaacaccataatcttgatgcaggagaggcggaataggtgggttcctggggctttctggtcagccagcctgtccagcctaataggtgagttacaggtcccagtaaatgactccatctcaaaagatgatgtagataataactaaaaaggacacgagggctacctgctcacacacaagggtataaacaatgaggaaactcaccagcattgcttcttcactgtggaataagccttttggcagtgtagcctcccccatcactttgagaggtccaagtagaagtcatactgctctgaagggtacattctgatatattcccattcaacatggaatatgtgtctatggtactatgtgggctatccaactttgcatcttggtctcattgtcccacaccagtgtggggggaattgccctgggaagatgatgcaatgttccctgtcatcatcatcgccatataagctttgtatatggatgtacctggatgactctgcctggagcgggcgtaagtcaaaactttgagagtctagtgcttttgcatgggatggactgtggctgctcttggcttatggagtgcttggtctcttttccccttgtccctcccaaccactactggtttccacctagagaaaaccccaagtaacatctgattagctgacctgggtctccacttatccctaagcactgggctctcatacccacccttgtgtcctggttccaactcactagagtgccttcttgtgaactgcctcagacttccaccttggtagtgggacgtgcgcctgcccaggagcactcaactcccattggtttactggagttggtcatgttagcaaaggaaagagcaggggtgctgccagctctgcatccagcccactaccctccacaccactgagcttgcctgtcccaaactgccatctgaccatgtcacttcctctgctctagacatcttcccaaggttgcagacgctgacggatttgccccagagtcgaagtaactgccacctggaaattccacagccatgagtgggtttaactttggaggcaccggggctcctgctggcggctttacatttgggaccgcaaagactgcgaccaccacacccgccactggcttttccttctctgcttctggcaccggcaccggagggtttaattttgggactccctcccagccagctgcgaccaccccttccaccagcctcttctcacttgccacacagacctcaaccacacagaccccaggattcaactttggaacaacacctgcttctgggggaacaggcttctccctggggatcagcaccccaaagctcagcctaagtagcacagccgccacaccagccacagccaacactggcagctttgggcttggcagcagtactcttaccaatgccatctcaggtgccagcacctccagccaggggacagcccccactggctttgtctttggctcttctaccacctctgctccgtccaccggcaccacgggattctcattcaccagtggcagtgcatcccagcctggagcctccggcttcaacattggctctgtgggtagtttggcccagcccacagcactgtctggctctcccttcactccagccactctggcgacaactacggcaggagcaacacagccagctgctgctacacccactgctgccaccaccagtgcagggtctacactgtttgcttcaatagctgctgctcctgcctcatccagtactacagtgctttccctctcagctccagcgacaactgcagccactcctactgctgggactttgggcttcagcctcaaggcccctggagcagctcctggtgcctccaccaccagcaccaccactactactaccaccaccactactactgcctccacctcctcctccaccacgaccactggctttgccttaagcctgaaacccctggtgccagctggccccagcagcgtggcagctactgctctgcctgcctccagcacagcagttgggactacgacgggtccagcaatgacctacgcgcagctggaaagcctgatcaacaagtggagtctggagctggaggaccaggagcggcacttcctgcagcaggccacgcaggtcaatgcctgggaccgcacactgattgagaatggggagaagatcaccagcctgcaccgagaggtggaaaaggtgaagctggatcagaagcgtctggaccaggagctggactttatcctgtcacagcagaaggagctggaagaccttctgagcccgttagaggagtcagtgaaggagcaaagtggcaccatctaccttcagcatgctgatgaggagcgtgagaagacctacaagctggctgagaacatcgatgctcagctcaagcgcatggcccaggacctcaaggacattattgagcacctgaacatggctggtggccctgcagacaccagtgacccactgcagcagatctgcaagatcctcaatgcacacatggactcccttcagtgggtggaccagagctctgccctgctgcagaggagggtggaggaggccagccgtgtgtgtgagagccggcgcaaggaacaggaacgcagcctgcgcattgcctttgactagccatacatgagttgggggtgggggtacctcttttgttgtagggctgctggctttggggtggttgtattgttgagaaaaatgctctttggtttggttccctgttatcagaagtggtttgcgaaggcatgatgtcatggatgtaataacctgtgtgctctggagacaggtgtgaaggtcactgaactctaggccagcatttaaagaacaagggcaaactcatcctttagccactccaatacaactgtgacagtgggatggcatgctccagagattggaatggagacatggcttctgtgcttccctgcttctctaactcccatctaacccatgtcctccagagcctgtgctgcacaaagcagagtcaccaagggagactgagcttaacaccggtttgcactggctacccctctcacccctctcttgtgagcttctgtggcagggactgactgctgatagttctttgagaacagagtggctgcggatttgcttctgaatgtcccagtgtcaaaccttagattcatagatagtgttgaaggctggcagttatgtctggtctattttatttctccacactctactgtagcctctatggtccctgatcaaaacattgcttttctaaataaagaaaacattgtgaaatcagacttgctgtgaatgtgtgtgtagtgggtccaagatttggcaggacactgctggtgtgatactcttcctgtgccaccaggttggaagcgctggactgagtgagccacagagtctagtctctaccttctatggggtgggcaggctgcaggtacaagaagaaagtcctgtctaccagtgtgcataagtaataagtcatccattaccctaatagatacaggtgtcattgtgatgtcatcagcagtaggaaataggggaacactagaagggatttcactggaccagcagtagagccactaagttattttcttgggtcttgttgggctttgaagcacaagagaaagctgggggtggggtgagggtatagaggtaagtagctcggcgggtaagagcactggttagctgctgctctttcaaggacccaggtttattcacagcacccacgtggtagcttacaaccaccctataaccagtccaggttatctggtgt

SEQ ID NO: 1725 - DNA, 7286 bp, Rattus norvegicus
  Genbank Accession No. M64780
tgcttatctcctaccatgaacctggagggctggggagaggacctggtgctcccctagccataactggctaaactttgagatcacagctgcatctgctgctccagagcacccagcatggggggagtagctccgaagaggcctaagggcactccataagaactcccacacacacccaggaattgggctcgagctgtatgtatcatgcctcctctgccactggaacacagacccaggcaggagcctggtgcctccatgctggttcgatacttcatgatcccctgcaacatctgcttgatcctgttggccacttccacattgggctttgcggttctgcttttcctcagcaactacaaacctggaatccacttcacaccagcgcctcctacgcctcctgatgtatgcaggggaatgttatgtggctttggtgctgtgtgtgaacctagtgttgaggatccaggccgtgcctcctgtgtgtgcaagaagaatgcttgccctgctacggtggctcctgtgtgtggctcagatgcctccacctatagcaacgagtgtgagctgcagcgcgcgcagtgcaaccagcaacggcgcatccgcctgcttcgccaagggccatgtgggtcccgggacccctgtgccaacgtgacctgcagtttcggtagtacctgtgtaccttcggctgacggacagactgcctcatgtctgtgtcctacaacctgcttcggggcccctgatggcacagtgtgtggcagtgacggtgttgactaccctagtgaatgccagctgcttagtcatgcctgtgccagccaggagcacatcttcaagaagttcaatggtccttgtgatccctgccagggcagcatgtcagacctgaaccacatttgccgtgtgaacccacgtacacggcacccagaaatgcttctgcggcctgagaactgccctgcccagcacacgcctatctgtggagatgatggggtcacctatgaaaacgactgtgtcatgagccgtataggtgcaacccgtggcctgcttctccagaaagtacgctctggtcaatgccaaactcgagaccagtgcccggagacctgccagtttaactccgtatgcctgtcccgccgtggccgtccccactgttcctgcgatcgtgtcacctgtgatgggtcttacaggcctgtgtgtgcccaagatgggcacacatacaacaatgactgttggcgccaacaggctgagtgtcgacaacagcgggccattcctcccaagcaccagggcccgtgtgaccagaccccgtccccatgccatggagtgcaatgtgcatttggggcagtatgcacagtgaagaacgggaaagccgagtgcgagtgccagcgggtgtgctccggcatctacgatcctgtgtgcggcagtgacggtgtcacttacggcagtgtgtgcgagctggaatccatggcctgtacccttgggcgggaaatccaagtggcccgcagaggaccctgtgacccatgtgggcagtgccgttttggatccctgtgcgaggtggaaactggacgctgtgtgtgcccctctgagtgtgtggagtcagcccagcccgtatgcggttctgatggacacacatacgctagtgaatgtgagctgcatgtccacgcctgtacgcaccagatcagcctatacgtggcctcagctggacactgccagacctgtggagaaaaagtttgtacttttggggctgtgtgctcagctggacagtgtgtatgtccccgttgtgagcaccctccacctggccctgtgtgtggcagtgatggtgtcacctacctcagtgcctgtgagctacgcgaagctgcctgtcagcagcaggtacaaattgaggaggcccatgcagggccatgtgagccggctgagtgtggctcagggggctctggttctggggaggacgacgagtgtgaacaggagctatgccggcagcgtggtggtatctgggacgaggactcagaagatgggccatgtgtctgtgactttagctgccagagtgtccctagaagcccagtgtgtggctcggatggagtcacctatggcaccgagtgtgatctgaagaaggccaggtgcgaatcacagcaagaactgtacgttgctgctcagggagcctgccgtggccctaccttggctccactgctacctgtggccttcccacactgtgcccaaaccccctatggctgctgccaggacaatttcactgctgcccagggtgtgggcttggctggctgtcccagcacctgccattgcaacccccatggctcctacagtggcacttgtgacccagccacagggcagtgctcctgccgaccaggtgtaggaggcctcaggtgtgatcgctgtgaacctggcttctggaacttccgtggcatcgtcaccgatggacatagtggttgcactccctgcagctgcgaccctcggggtgccgtaagggatgactgtgaacagatgactggattgtgttcctgtaggcctggtgtggctggtcccaagtgtggacagtgtccagatggtcaagtcctgggccatctaggctgtgaagcagatcccatgacacctgtgacttgtgtggagatacactgcgagttcggggcctcctgcgtagagaaggctggttttgcccaatgtatctgcccaaccctcacatgtccagaggctaactctaccaaggtctgcggatcagacggtgtgacatatggcaatgaatgccagctgaaggccattgcctgccgccagcgtctggacatctccactcagagtcttggtccctgccaggagagtgttactcctggggcttccccaacatctgcatctatgactaccccaaggcatatcctgagcaagacgctgccatttccccacaacagccttcctctgtctcccggcagtactacccatgattggcccaccccattacccatatcacctcacaccacagtcagcatccccagaagcaccgcgtggcctgtgctgaccgtgccccctacagcagcagcctctgacgtaaccagtctcgcaacatcaatcttcagtgaatccggcagcgccaatgggagtggcgacgaggaactgagtggagatgaggaggccagtgggggcgggtctgggggacttgagcccccggtgggcagcattgtggtgacccatgggccacccatcgagagggcttcctgctacaactcacctttgggctgctgctcagatggcaagacaccctcactggactccgaaggctccaactgtcctgctaccaaggcattccagggcgtgctggagcttgagggggtcgagggacaggaactgttctacacacctgagatggctgaccccaagtcagagttgtttggggagaccgcaaggagcattgaaagcacgctggacgacctgttccggaattcagacgtcaagaaggacttctggagtgtccgcctacgggaactggggcctggcaagttggtccgcgccattgtggacgttcactttgaccctaccacagccttccaggcatcagatgtgggtcaggccttgctccgacagatccaggtatctaggccatgggccctggcagtgaggaggcctctgcaggaacatgtgcgattcttagactttgactggtttcccactttctttacgggagctgcaacaggaactacagctgctatggccacagccagagccaccactgtgagccgactgccggcctcttccgtcaccccacgagtctaccccagtcacaccagccggcctgttggcagaactacagcaccaccaaccactcgccggccaccaaccactgccaccaacatggaccggcctcggaccccaggccatcaacagccctcaaagtcctgtgattcccaaccttgcctccatggaggtacctgccaggaccaggattctggcaagggtttcacctgcagctgtactgcaggcaggggtggctctgtctgtgagaaagtacaacccccctccatgccagcttttaagggccactccttcttggccttccccaccctccgagcctaccacacactgcgcctagcactggaattccgggctttggagacagagggactgctactctacaatggcaatgcacgtggcaaagatttcctggctctggctctgttggatgggcgtgtgcagttcaggtttgacacaggctcagggccagcagtgctaacgagcttagtgccagtggaaccaggacggtggcaccgcctcgagttgtcacggcattggcgtcagggcacactttctgtggatggcgagactcctgttgtaggtgaaagtcccagtggcaccgatggcctcaacttggacacgaacctctatgtgggtggtatcccagaagaacaagttgccatggtgcttgatcggacctctgtgggcgttggcctgaaaggatgcattcgtatgctggatatcaacaatcagcagctggagcttagcgactggcagagggctgcggttcaaagctctggtgtgggagaatgtggagaccatccgtgcttacctaacccctgccatggtggggccctatgccaggcactggaggctggcatgttcctctgtcagtgcccgcctggccgctttggcccaacttgtgcagatgaaaagagcccctgccagccgaacccctgccatggggcagccccctgtcgtgtgctttccagcggtggggccaagtgcgagtgccccctgggacgcagtggtaccttctgtcagacagtcctggagactgctggctcccggcccttcctggctgactttaatggcttctcctacctggaactgaaaggcttgcacaccttcgagagagacctaggggagaagatggcgctggagatggtgttcttggctcgtgggcccagtggcttactcctctacaatgggcagaagacagatggcaagggggactttgtatccctggccctgcataaccggcacctagagttctgctatgaccttggcaagggggctgcagtcatcaggagcaaagagcccatagccctgggaacctgggtcagggtattcctggaacgaaatggccgcaagggtgcccttcaagtgggtgatggtccccgtgtgctaggggaatctccgaaatcccgcaaggttccgcacaccatgctcaacctcaaggagcctctctatattgggggagctcctgacttcagcaagctggccaggggggctgcagtgtcctctggcttcagtggtgtcatccagctggtgtctctaagaggccatcaactgctgactcaggagcatgtgttgcgggcagtagatgtctcaccttttgcagaccacccttgtacccaggccttgggcaacccctgccttaatgggggctcgtgtgtcccgagggaagccacttatgaatgcctgtgtcctgggggcttctctgggctgcactgcgaaaaggggctagttgagaagtcagtgggggacctagaaacactggcctttgatgggcggacctacatcgaatacctcaatgctgtgattgagagtgagaaggcactgcagagcaaccactttgaactgagcttacgcactgaggccactcaggggctggtgctgtggattggcaaggctgcagaacgtgcagattacatggccctggccatcgtggacgggcacctgcaactgagctatgacctaggttcccagccagttgtgctgcgctccactgtgaaggtcaacaccaaccgctggcttcgaatcagggctcacagggagcacagggaaggttcccttcaggtgggcaatgaagcccctgtgactggatcttccccattgggtgccacgcaactggacacagatggagccctgtggcttggaggcctgcagaagcttcctgtggggcaggctctacccaaggcctatggcacaggttttgtgggctgtctgcgggacgtggtagtgggccatcgccagttgcatctgctggaggacgctgtcaccaaaccagagctaagaccctgccccactccctgagctgccaccagagctgccaccttccctactgtaattattttctatttttgtaaacttgttgcatttttatatgatttttttgactgcacgttggccagaaggactgctggcctggcctcctttccgtccggcagctgtgctacagagacaaagtggtgctaagggaactcttaagtagaccgtagcacctagagccctgggctttgaaaggcagccttaggacacactcctctgcctaaggtaccgtgcctcagccccttgcactgtatgttcctacctgtccacttgtattggtcctttgggtctcctggcccattgctaggccctgtttgtgtgttattaatgtgttattggatgagaactgtatccctgagcaggagggtgctgttggggttgagggggcccttcattaaaccaagtaacattgggtcctttgtaggttcccacttaagctgctctcctgtgtgtgctaagggccagcctcaccccaagctagcctggacccctagtgctccctgtgacaatactgtgatataaaaaacctgataattggggcatcatcttacttcccaaaatgtgtttgcctgtccctggaggctgtaaacagaagccaggctccatctaggttgtcctggctggtcctcagttggccttccccacctactcagttaccctgaacatggtcatcctttccccaaaacatcaggccacttaggaatccctaagagggagtgcgtcactacgggatgtggttgacctccattgcttacctgcctaagcagccagctacatctgtctctcaaagatgtccagccagactcctaactatattcttcaaccattgattttgtttgatttctgatgtggaagtgcggtcattcctgttctaacgcacagcaaactttaattggtctaacgtgagggcaacccacagttggtccactgtaacgatggtcatccttgtttgagtgacagttactgccgggtgtccagccaagggcaggtactagaatggcagagatgactatagagccaaaaatgactgaaactgaagcaactgtctgctcctccatcccctatctttaatgtccagcacagtcatctcgggagaaaaaccagacaaatctgggatgggggcagtctgaccttcttcctgcttcggtgatcaaggctagagggaactgcatggtatcttgttactaactccagtatgtgtcaatgtcaaataccatgaaataaagtctgaaaaccttaaaaaaaaa

SEQ ID NO: 1726 - DNA, 4254 bp, Rattus norvegicus
  Genbank Accession No. M81855
gctcccatcttcgaggctcagctcaactcagagctacttcttccaaattctacatcttggcggacttcgcgaaggaaacccggagtgttacgtgaggtcctgatggagtttgaagagggccttaacggaagagcagacaagaacttctcaaagatgggcaaaaagagtaaaaaggagaaggagaagaaacctgctgttggcatattcgggatgtttcgctatgcagattggcttgacaagctgtgcatggctctgggaactctcgctgctatcatccacggaaccctgcttcccctcctgatgctggtgttcggatacatgacagatagttttaccccaagcagagacccgcattctgaccgagcgattactaatcaaagtgaaatcaacagtacacataccgtcagcgacacgagtctggaggaggacatggccatgtatgcctactattacacgggcattggtgccggtgtgctcatcgttgcctacatccaggtttcactttggtgcctggcagctgggagacaaatacacaagattaggcagaagtttttccatgccatcatgaatcaggagataggctggtttgacgtgaatgacgctggggagctcaacacccgtctcacagatgacgtctccaaaattaatgacggaattggtgacaaacttggaatgttctttcagtccataacgacattttcagccggttttataataggatttataagtggttggaagctaacccttgtaattttggccgtcagccctcttattgggttgtcatctgccatgtgggcaaaggtactgacttcatttactaataaggaactccaggcttatgcgaaagctggagcagttgccgaagaagtcttagcagccatcagaactgtgattgcgtttggaggacaaaagaaggaacttgaaaggtacaataaaaatttagaagaagctaaaagagttggcataaagaaagccatcacggccaacatttccataggtattgcctacctgttggtctatgcgtcttatgcactggcattctggtatgggacctccttggtcctctcaaatgaatattctattggacaagtgcttaccgtcttcttctctattttattggggactttcagtattggacatttagccccaaacatagaagcctttgcaaatgcaagaggggcagcctatgaaatcttcaagataattgataatgagccaagcatcgacagcttctcaaccaagggacacaaaccagacagtataatgggaaatttggaatttaaaaatgtttacttcaactacccatcacgaagtgaagttaagatcttgaagggcctcaacctgaaggtgaagagcgggcagacggtagccctggttggcaacagtggctgtgggaaaagcacaactgtccagctgctgcagaggctctacgaccccatagagggcgaggtcagtattgacggacaggacatcaggaccatcaatgtgaggtatctgcgggaaatcattggggtggtgagtcaggaacccgtgctgtttgccaccacgattgccgaaaacattcgctatggccgagaaaacgtcaccatggatgagatagagaaagctgtcaaggaagccaatgcctatgacttcatcatgaaactgccccacaaatttgacaccctggttggtgagagaggggcgcagctgagtgggggacagaaacagaggatcgccattgcccgggccctggtccgcaaccccaagatccttttgttggatgaggccacgtcagccttggacacagaaagcgaagccgtggttcaggccgctctggataaggctagagaaggccggaccaccattgtgatagctcaccgcttgtctacagtgcgcaatgctgacgtcattgctggttttgatggtggtgtcattgtggagcaaggaaatcatgaagagctcatgaaagagaagggcatttacttcaaacttgtcatgacacagactagaggaaatgaaattgaaccaggaaataatgcttatgaatcccaaagtgacactggtgcctctgagttgacttcagaagaatcaaaatctcctttaataaggagatcaattcgcagaagtatccacagaagacaagaccaggagagaagacttagttcgaaagaggatgtggatgaagatgtgcctatggtttccttttggcagatcctaaagctaaatattagtgaatggccctatttagttgtgggtgtactttgtgctgttataaatgggtgcatacaaccagtgtttgccatagtgttttcaaagattgtaggggttttttcaagagacgacgaccatgaaaccaaacaacggaattgtaacttgttttcccttctctttctggtcatgggaatgatttcttttgttacgtacttctttcaaggcttcacatttggcaaagctggagagatcctcaccaagcgactccgatacatggtcttcaaatccatgctgcgacaggatataagctggtttgatgaccataaaaacaccactggctcgctgactaccaggctcgctagtgacgcttctaatgttaaaggggctatgggctccaggcttgctgtagttacccagaatgtagcaaaccttggcacaggaattatcttatccttagtcttagtctatggctggcagcttacacttttacttgtagtaattataccactcattgtcttgggtggaattattgaaatgaaactgttgtctggtcaagccttgaaggacaagaaagagctagagatctctgggaagatcgctacagaagcaattgaaaacttccgcactgttgtctctttgactcgggagcagaagtttgaaactatgtatgcccagagcttgcagataccatacagaaatgctttgaagaaagcacacgtctttgggatcaccttcgccttcacccaggccatgatttatttttcctatgctgcttgtttccggttcggtgcctacttggtggcacgagaactcatgacgtttgaaaatgttatgttggtattttctgctgttgtctttggtgccatggcagcagggaataccagttcattcgctcctgactacgcgaaggccaaagtctcggcatcccacatcattgggatcattgagaaaatccccgagattgacagctacagcacggagggcttgaagcctaattggttagaaggaaatgtgaaatttaatggagtcaagttcaactatcccacccgacccaacatcccagtgcttcagggactgagcttcgaggtgaagaaggggcagacgctccgcctggtgggcagcagtggctgcgggaagagcacggtggtccagctgctcgagcgcttctacaaccccatggctggaacagtgtttctagatggcaaagaaataaagcaactcaatgtccagtgcgtccgcgcactgggcattgtgtcccaggagcccatcctgtttgactgcagcatcgccgagaacatcgcctacggagacaacagccgtgtcgtgtctcatgaggagatcgtgagggccgccagggaggccaacatccaccagttcatcgactcactgcctgagaaatacaacaccagagtgggagacaaagggactcagctgtcgggcgggcagaagcagcgcatcgccatcgcgcgcgccctcgtcagacagcctcacatcttacttctggatgaagcgacatcagctctggatacggagagtgaaaaggtcgtccaggaagcgctggacaaagccagggaaggccgcacctgcgttgtgatcgcgcaccgcctgtccaccatccagaacgcagacttgatcgtggtgattcagaacggccaggtcaaggagcacggcacccaccagcagctgctggcccagaaaggcatctatttctcgatggttcaggctggagcaaagcgctcatgagctgggagtatttgaggtgctaagtatttctaatattggtgttcaaacatggcacgtaaccaaagttaaaaggttaaaagcactgttaaaggtaatttcatcaagacgagaagccttcagagacttcataattaaatgaaccgaaattgaaaaaaaaatcattaaacagggccacattttttaattgtattatgtgattcaagagaacatatagtttttttaaaaagaaatgtgtagttttgtttcagtttttttaatttctaccctattcccttaaatgatcataaaggctgtaaaaagcactatttttttgcggcc

SEQ ID NO: 1727 - DNA, 949 bp, Rattus norvegicus
  Genbank Accession No. M83740
gaattccggttttatagcaaggacattacattttcaggtacctaaagtcaaaattcaacacactgatataaaacttctatttaaaccaatagggttctgttatgatattgatctgttcacagtaacatttacaaaaagaggcagaggcagggggatctctgccccgcccccgcggtggcctgctgcctgccagccgctctccctcgctgacgccacctgcttcccgcactggacatggctggcaaggcacacaggctgagtgctgaggaacgggaccagctgctgccaaacctgcgggccgtggggtggaatgaactggaaggccgagatgccatcttcaaacagttccattttaaagacttcaacagggcttttggcttcatgacaagagtcgccctgcaggctgaaaagctggaccaccatcccgagtggtttaacgtgtacaacaaggtccatatcaccttgagcacccacgaatgtgccggtctttctgaacgggatataaacctggccagcttcatcgaacaagttgccgtgtctatgacatagatctaccctgcctcctatttccttaggggaaaggagaaggagtgactggaggaggaacccagggagggaaccaaggaggctggcccttgctccctgactcttgcggtgaccaccatctccgtcaggaggggtatgagtccctccctgtgcagaacgatgcccatgttcctggtgccagcctcctcactgggctctgccatgtttataatttgaataagctctcccattttctatagagttcctagcctcagttgtgtcccaggctgcctcttgctccttgtctaccggttctagttaattttccaagtagctgtgataaagcatgacagaaagtccaattcagaccctactaaaacaaaccccaatatattatggaaacagtgcttttatgccggaattc

SEQ ID NO: 1728 - DNA, 1219 bp, Rattus norvegicus
  Genbank Accession No. M86341
atgggtgggggcctgattgagaggtatgtggctgccatggtgctgagtgcggctggtgataccctgggctacttcaacgggaagtgggaattccttcgggatggggagaagatacaccggcagttggcccagatgggtgacttggaagccatagatgtggcccagtggagagtcagcgatgacaccatcatgcacctggctacagcagaagccctcatggaagccggcagttccccggatttgcctcagctgtattccctactagctaaacattaccgggactgcatgggagacatggatggccgggcaccaggtggtgcttgcatgcagaatgccatgcagctggaccccgacagggctgacggctggaggattcccttcaacagtcacgagggcggctgtggagccgccatgcgcgccatgtgcatcgggctgaggtttcctcaccccagccagctggacactctgatccaagtgagcatcgagagcggccggatgacccaccaccaccccacaggctacctcggaagcctagcgtcagctctttttaccgcatatgccgtgaacggcaaatcaccacggcagtgggggaaggggctgatggaggtgctgccagaggccaaagcgtatgtcacccagtcaggctactttgtgaaggaaaatctccaacactggtcctacttcgagaaagaatgggaaaagtacctggaacttagaggaattttggatggcaagtccgctcccgtcttcccgcaaccctttggtgtgaaggaaagggatcagttctatatcgaagtgagctactcaggctggggtggcagcagtggacacgatgcccccatgattgcctatgatgccctcctggctgcaggggattcctggaaggagctcgcacacagagcctttttccatggtggagacagtgattccacggccaccattgctggatgctggtggggagttatgcacggtttcaaaggggtaaacccttctaactatgagaagctcgaataccgacagcggctagaagaggccggaagagctttgtattctctggggtcaaaagaagacactatactaggtccctagggaaagggtggtttgttttggcggttttttcccctgtatccccgacactcattctcttcagcttttccagcgtcaagaatcctaattttgtgtttgaagaattctgtgtaaacaagtcccttgggcggct

SEQ ID NO: 1729 - DNA, 2648 bp, Rattus norvegicus
  Genbank Accession No. M91599
catcaataacgaggaccccaagaccctcagcagctcctcgagtgggcactcctacctgcagcaagcaccttactggacacacccccaacgcatggagaagaaactgcacgcggtacctgccgggaacactgtcaaattccgctgtccagctgcagggaaccccatgcccaccatccactggctcaagaacggacaggccttccacggggagaatcgtatcggaggcattcggctgcgtcaccaacactggagcctcgtgatggagagcgtggtgccctcagaccgtggcacgtacacgtgtcttgtggagaactctctgggtagcattcgctacagctatctgctggatgtgctggagcggtccccgcaccggcccatcctgcaggcgggactcccagccaacaccacggctgtggttggcagcaacgtggagctgctgtgcaaggtgtacagtgacgcccagccgcacatccagtggctgaagcacatcgttatcaacggcagcagtctcggcgctgatggtttcccctacgtacaagtcctgaagacaacagacatcaatagctcagaggtggaggtgctgtatctgaggaacgtgtcggctgaggatgcaggggagtacacctgcctggcgggcaactccatcggcctctcctaccagtcagcgtggctcacagtgctacccgcagaggaagaagacctcgcgtggacaacagcaacatcggaggccagatatacagatattatcctatatgtccatggctcactggctttggttttgctcctgctgctggccggggtgtatcaccgacaagcaatccacggccaccactctcgacagcctgtcactgtacagaagctgtcccggttccctttggcccggcagttctccttggagtcgaggtcctctggcaagtcaagtttgtccctggtgcgaggtgtccggctctcctccagtggcccgcccttgctcacgggccttgtgagtctagacctacctctcgatccactttgggagttcccccgggacaggctggtgctcggaaagcccctgggtgagggctgctttgggcaagtggtttgtgcagaagcccttggcatggattcctcccggccagaccaaaccagcatcgtggctgtgaagatgctgaaagacaatgcctccgacaaggatttggcagacctgatctctgagatggagatgatgaagctaatcggaagacacaagaacatcattaacctgctgggtgtctgcactcaggaagggcccctgtatgtgattgtggaatatgcggccaagggaaaccttcgggaattcctccgtgcccggcgtcccccaggccctgatctcagccctgatgggcctcggagcagcgaaggaccgctctccttcccggccctggtctcctgtgcctaccaggtggcccgaggcatgcagtatctggagtctcggaagtgcatccaccgggacctggctgcccgaaacgtgctggtgaccgaggatgacgtgatgaagatcgctgactttggtctggcccgtggtgtccaccacatcgactactataagaaaaccagcaatggccgcctgccagtcaagtggatggctcctgaggcgttgtttgaccgtgtatacacacaccagagtgacgtgtggtccttcgggatcctgctgtgggaaatcttcaccctcgggggctccccataccccggcatcccagtggaggagctgttctcactgctgcgagaggggcacaggatggagcggcccccaaactgcccctcagagctgtatgggctaatgagggagtgttggcacgcagctccttctcagaggccgacttttaagcagctggtggaagctctggacaaggtcctgctggctgtctctgaagagtaccttgacctccgcctgacctttggaccctattcccccaacaatggggatgccagcagcacgtgctcctccagcgactcggttttcagccacgaccctttgcccctcgagccaagccccttcccatttcctgaggcgcagaccacatgagcctgggaacgatgttgcatgggctcgtaggcccgtggccgtgggactccaacctgtttcatcagcatttgacgttggcactgtcatcaggcctctgactcgaggctactgctggcccagatcctctctctggccctgttttggggaggcccattcttggtcttggggttcacagttgaggccttctgttccaaacttatgttcccagctcagagttcaactcctcgtctcaagatcatggtcgtgcccttggactcatcctcaaaggagcgaagcattaaggccttgacacttagcctccaccccaggggctctccgggcctgactgcaaatctttggtcctaaacatttctagctccccaaacaacctagaggcctcgggacttcactgcacccccgcccccgcagcccacaagcctcgccaccctggtccccaactccccactgcttgttctagcatcttgttgaaggagcctcagctctggtgtccttgagagagggaagcctgtggaaaagacagaagaacaaggcattttataaattattattattttttaaaaaaaaaaaaaaaaatctagaattctgcagaaggatcccgcgccat

SEQ ID NO: 1730 - DNA, 3047 bp, Rattus norvegicus
  Genbank Accession No. M95791
  misc_feature (1)..(3047): n = a or c or g or t
gtcgacctgcaggtcaacggatcctcaacctgaggcaaccaacagcgctgtgtcgggagccacactgacccagggctttcttagaggtaaatgtaacttttatttgcttgagttaattgtctggaagcttctagcctccgtctgtctgtctgtataatcttatctcagcctagaatgtcttcagcctctgagacttcctgttgaataagctttcgcccttnctagttctttctgatctctggctgnctggttcaactcagctgtttctgctcaaactcctctccagactgactgatccattctggcttctcccagttttctcctgaattgctgtacttggcttcacactaacacgaactctagcaatctgttctaaactattctggttccttctcattctctgactctgatatctctctctctctctctctctctctctctctctctctctctctctctctctctctctctctctctctctcactgtcccagtaaaactatcttcttaactttgttttttctcagcccagctctctcttaagtagcttccctttcttctttcttcttctgacagttagtcatatcctgtgctgtcaactctttctctgattcaccacattgtctgtcactcaattagacgtcactttcaaatccgggtgcttccttctacaaactaactttaccttcattatttgggattaaaggtgggtgctaagcactgagccacaccacaactagaaacaggtatcattgtctagaacagacttggcaaggccaaaccgatgctggaactgctgcttctgaggagtcaccggtgcaaaccccactcttcctcttgggctgtggttattagtcccaatgctgctatgtcgggggtgtccagggttctctttaccgagactgtctgacttagctctctgctcaccttgaccacttcccccttcaaaccacaagtaagattctgtacttcagagagccctgagagccccaccgccgccgccagcctggtcatcgtcacaccccaaggagccgcagccattgctgccggccccagtcactatcaccgcaaccatgagaaacccagcagccgccctcagcccccccccccccgccctcagcgctgccaacaccaagcctggctccacaggcagcaacgcgggtagtggcggccagggcggcctcacatggtcagcgcccgccggcggggacaagaaggtcatcgcaaggaaggttttgggaacaataaatggttcaacgaaaggaacggtttcatcaacaggaatgacaccaaggaagacgtatttgtacaccagactgccgtaaagaagaagaaccccaggaagaaccttcgcagggtaggagatggagagactggggtttgatgttgttgaaggagaaaagggtgcggaggtagcaagtgttacagaccctggtggagttccagttcaaggcggtaaaggcgcagcagaccgtaaccattatagacgctatccaggcaattaccagcacaattacaagaatagtgagagtggggaaaagaacgaggaaggccaggcccaacaacgccagccctatcgcaggtgagggttcccaccttacaacatacagagaccctatgtgcgcatggaccacagtattccaacacccctgtgcaaggagaagtgatagagggtgctgaccaccagggtacaggagaacaaggtagaccagtgagacagaatatgtatcggggttacagaccatggttccgcaggggccctcaaggtagaccagtaagacagaatatgtatcggggttacataccacggttccgcaggggccctcaaggtagaccagtaagacagaatatgtattggggttacagaccatggttccgcaggggccctcctcgccaaagacagcctagagaggatggcaatgaagaggacaaggaaaatcaaggagatgagacccaaggtcagcagccacctcaacgttggtatcgttgcaacttcaattaccgaggcagacacccagagaaccctaaaccacaagatggcaaagagacaaaggcagccgatccaccagtgagaattcgtctgctcccgggactgagcagagtcgggctgagtaaaagccggcttaccatctccaccatcatccggtttggtcatccaacaagactaaatgaatatgaaattccagcagtaagaaatgaacaaagatcagaactgaagaccttaagagcttgctctgtgcccgttgggcagatccactagagctgtctgcagtatctatgagcatggggtcttcttatttttacctaaagatgtctctttttggtaatgacaaatgtggttttttttttcttttttcttttttcttttttttttttcggagctggggaccgaacccagggccttgcgcttgctagactacagagcggaagagacctccaatactgctcacccctgcccacatcctggcccaataggaaattgtatacggcctctgggaactggaagataggggcactggagctgcaggtcccctgcaccccagacaccgccagaacctgaagggaccagatgaacagttctctgcggggttggggatttagcccagtggtagagcgcttgcctagcaagcgcaaggccctgggttcggtcctcagctcaaaaacaaaacaaaacaaaacaaacaaacaaaaaaaaaaaaccaaaaccagttctctgcacccaaatcccatgggagggagagctaaaccttcagagaggcagacacacctgggaagccagaagagactacactctgcctacatttctgactacagaggaaaacaccaaacgccatctgggaccctggtgcacggggggccctccagaaaaggcggcacaggtcctcctggttgctgccctcatggagagtgcataagcaacaccccacgaacaaacttgagcctcgggaccacaggtaagaccaacttttctgctccaagtgacctgcctggtgaactcaggacacaggctcacaggaacagctgatgacctgtagagaggaaaaactac

SEQ ID NO: 1731 - DNA, 609 bp, Rattus norvegicus
  Genbank Accession No. M96626
gaattcagattgtcattgtccaatttggagggaagcccttcagctgttccccactgtccacagaacagtggctctggtgtctttttgttggtgttggggagctggtctggggacaggtcattgccactatccccaccagccagctcaagtgcctgaaggaagcagggcatgggcctgggaaggatgagatgactgatgaagagttggcggaaggggaagaagaaattgaccatgctgagcgagagctccgcagaggccagatcctctggtttcggggcctcaaccggatccagacacaggtgtgttgggacggaaaaaaaatgttgagaactaccgaagtaggataaggaagtattgccaaacacagatggaggtagtgagtaccttcaagagaagcgggtcatttcagggtgctgtgcgccggcggtcttcggtcctcagccagctccatgacgtaaccaatctttctacccctactcacgtaactctctctgccgccaagcccaccagcgctgctggcagtgagtcttgacttcccttttctctcataaatggcacctgggggaagataaagcctccccgactctgccttctcttttccagtcttgc

SEQ ID NO: 1732 - DNA, 1619 bp, Rattus norvegicus
  Genbank Accession No. NM_012489
actttcaggcctcgtgaggtagagggctggcctgcgcctgcgcctgccatcattttggtttgttaagcaaggcagagcatgagcgagtcggtgggacgcacctccgcgatgcatcggctgcaggtagtgctgggccacctggccggccgacccgagtcgagctccgcgctgcaagccgcgccctgctccgctaccttcccgcaggcttcggcctccgacgtggtggtggtgcacggacggcgcacccccatcggccgcgcgggccgcggcggcttcaaggacaccacccccgacgagcttctgtcggccgtgttgaccgcggttctccaggacgtgaagctaaagcctgagtgtttgggagacatctctgtgggtaacgtacttgagccaggagccggagcagtcatggcgcgcattgcccaatttctgagtggcatcccagagaccgtgcctctgtcagcagtcaacagacagtgttcatcgggactgcaggcagtggccaacattgctggtggcatcagaaatgggtcttacgacattggcatggcctgtggggtggagtccatgtccctgtctaacagagggaaccctgggaatatttcctcccgcctgctggagagtgacaaagccagagactgcctgattcctatggggataacctcggagaatgtggctgagcggtttggcatctcacggcagaagcaagatgccttcgcgctggcctctcagcagaaggcagcaagtgcccagagcaaaggctgcttccgtgctgagatcgtacctgtgacaaccactgtcctcgatgacaagggtgacaggaaaaccatcaccgtgtctcaggatgagggtgtccgccccagcaccaccatggagggcctggccaagctgaagcctgccttcaaggatggaggctctaccacggctggaaactccagtcaggtgagtgatggagcagccgccgtcctgctggcccggaggtccaaggctgaagaactgggcctccccatccttggcgtcctgaggtcctatgcagtggtcggggtccctcctgacatcatgggcatcggacctgcctatgccatccctgcggccttgcagaaagcagggctgactgtgaatgacatagacatctttgagatcaatgaggcctttgcaagtcaggccctctactgtgtggagaagctgggaattcctgcagagaaggtgaaccccctggggggtgcaatagccctgggccaccccctgggctgcaccggagcaaggcaggtggtcacgctgctcaatgagctgaagcgccgaggcacacgggcttatggcgtggtgtccatgtgcattgggactgggatgggagccgctgctgtctttgaataccctgggaactgaggccctgactgcaggcactacccagagagtcctatagtagtgtctggagagggatggtacaggagccatcttcgtgggacactcagcagtggagggatttgtcacagcacttcaattcagaagatgtagtcgatgttggaacaggaggtggaactgccctgtcaagtaccccaagccatgctaaagtgagcatgggacacccaggttgcaaagccatctgtacctctgacggatgc

SEQ ID NO: 1733 - DNA, 1339 bp, Rattus norvegicus
  Genbank Accession No. NM_012498
gcactcttgcgggtcgttgtgcgtaacttgcagcaatcatggctagccatctggaactcaacaacggcaccaagatgcccaccctgggtctgggcacctggaagtctcctcctggccaggtgaccgaggctgtgaaggttgctatcgacatggggtatcgccacattgactgcgcccaggtgtaccagaatgagaaggaggtgggggtggccctccaggagaagctcaaggagcaggtggtgaagcgccaggatctcttcattgtcagcaagctgtggtgcacgttccacgaccagagcatggtgaaaggggcctgccagaagacgctgagcgacctgcagctggactacctggacctctaccttattcactggccaactggcttcaagcctgggcctgactatttccccctggatgcatcgggaaacgtgattcctagtgacaccgattttgtggacacttggacggctatggagcaactagtggatgaaggtttggtaaaagcaatcggagtctccaacttcaaccctcttcagattgagaggatcttgaacaaacctggcttaaagtataagcctgctgttaaccagatcgagtgccacccatacctaactcaggagaagctgattgagtactgccattgcaaaggcatcgtggtgactgcatacagtccccttggttctcctgacaggccctgggccaagcctgaggacccctctctcctggaggatcccaggatcaaggaaattgcagccaagtacaataaaactacagcccaggtgctgatccggttccccatccaaaggaacctggtcgtgatccccaagtctgtgacaccagcacgtattgctgagaactttaaggtctttgactttgagctgagcaatgaggacatggccactctactcagctacaacaggaactggagggtgtgcgccttgatgagctgtgccaaacacaaggattaccccttccacgcagaagtctgaagctgtggtggacgaatcctgctcctccccaagcgacttaacacatgttctttctgcctcatctgcccttgcaagtgtccctctgcactgggtggcaccttgcagaccagatggtgagagtttgttagtttgacgtagaatgtggagggcagtaccagtagctgaggagtttcttcggcctttcttggtcttcttcccacctggaggactttaacacgagtaccttttccaaccaaagagaaagcaagatttatagcccaagtcatgccactaacacttaaatttgagtgcttagaactccagtcctatgggggtcagactttttgcctcaaataaaaactgcttttgtg

SEQ ID NO: 1734 - DNA, 5109 bp, Rattus norvegicus
  Genbank Accession No. NM_012505
tctgccagggtctccagctgccccagacaggcggtgtggtcttgggatcctcctggtgacctttccagcctaggtcccctcagccactctgccccaagatgggacgtggggcagggcgtgagtactcgcctgccgccaccactgcggagaatgggggtggcaagaagaaacagaaagagaaggagctcgatgagctgaagaaggaggttgccatggatgaccacaagctgtccttggatgagctgggccgaaaataccaagtggatctgtccaagggcctcaccaaccagcgagctcaggatattctggctagagacggacccaacgccctcactccaccccctacaactcctgagtgggtcaagttctgccgtcagctttttgggggcttctctatcctgctgtggattggggcgcttctctgcttcttagcctatggtatcctggccgccatggaggacgaaccatccaatgacaatttatatctaggtatcgtgctagcagctgtagttatcgtcactggctgcttctcctactaccaggaagccaaaagctccaagattatggactccttcaagaacatggtgcctcagcaagctctggtcatccgagagggagagaagatgcagatcaatgcagaggaggtggtcgtgggagacctggtggaagtgaagggtggagaccgtgtccccgctgacctccggatcatctcctcccacggttgcaaggtggataactcatccctgacaggggagtcggagccccagacccggtcccctgagttcacccatgagaatcccttggagacccgcaatatctgtttcttctctaccaactgtgtggaaggcactgccaggggcattgtgatcgccacaggtgaccggacggtgatgggccgcatagccactcttgcctctggcctagaggtgggacagacgccgatagccatggagatcgagcatttcatccagctgatcacgggggtggccgtgttcctgggggtctccttctttgttctgtcgctcatcctgggctacagctggctggaggctgtcatcttcctcatcggcatcatcgtagccaacgtccccgaagggctcttggccactgttactgtgtgcctgacgctgacagccaagcgcatggctcgcaagaactgcctggtgaagaacctggaggcggtggagacgctgggctccacgtccaccatctgctcggacaagacaggcaccctcacccagaaccgcatgacggtggctcacatgtggtttgacaaccagatccatgaggctgacaccactgaagatcagtctggggccacttttgacaagcggtccccgacgtggacagccctgtctcggatcgctggtctctgcaatcgtgccgtcttcaaggctgggcaggagaacatctccgtgtctaagcgggacacagctggtgacgcctctgagtcagctctgctcaagtgcatcgagttgtcctgtggctcagtgaggaagatgagggacaggaatcccaaggtggcagaaattcccttcaactctaccaacaaatatcagctttccatccatgagagggaagacagcccccagagccatgtgctggtgatgaaaggtgccccggagcgcatcctggaccgatgctctaccatcctggtacagggcaaggagatccctcttgacaaggagatgcaagatgcctttcaaaacgcctacatggagctgggaggactcggggagcgagtgctgggcttctgtcagctgaacctgccttctggaaagtttcctcggggcttcaaatttgacacggatgagctgaactttcccacagagaagctctgctttgtggggctcatgtctatgattgatccccccagagcagctgtgccagatgctgtgggcaagtgcagaagtgcaggcatcaaggtgatcatggtgactggggatcaccctatcacagccaaggccattgccaaaggtgtgggcatcatatcagagggtaacgagactgtggaagacattgcagccaggctcaacattcctgtgagtcaagtcaatcccagagaagccaaggcatgtgtagtgcacggctcagacctgaaggacatgacttcagagcagctggatgagatcctcagggaccacacggagatcgtgtttgcccggacctcccctcagcagaagctcatcattgtggagggctgtcagaggcagggagccatcgtggcagtgactggtgacggggtgaacgactcccccgcgctgaagaaggctgacattggcattgccatgggcatctctggctctgatgtctctaagcaggcagctgacatgatccttctcgacgacaactttgcctccattgtgacgggcgtggaggaggggcgcctgatctttgacaacctgaagaagtccatcgcgtacaccctgaccagcaacatccctgagatcacccccttcctgctgttcatcattgccaacatcccccttcccctgggcaccgtgaccatcctgtgcatcgacctgggcacagacatggttcctgccatctcattagcatacgaagcggctgagagcgacatcatgaagaggcagccacggaactcccagacggacaagctggtgaacgagaggcttatcagcatggcttacggacagatcggcatgatccaggctctgggcggcttcttcacctactttgtaatactggcagagaacggcttcctgccatcgaggctgcttgggatccgccttgactgggatgatcggactaccaacgacctggaggacagctatggacaagagtggacctatgagcagcggaaggtggtggagttcacatgccacacggccttctttgccagcatcgtggttgtgcagtgggctgacctcatcatttgcaagacccggcgcaactcggtgttccagcagggcatgaagaacaagatcctgatttttgggctgctagaagagacggctctggctgccttcctgtcttactgcccgggtatgggggtggccctccgaatgtacccactcaaggtcacgtggtggttctgtgcctttccctacagtctcctcatcttcatctatgatgaagtccgaaagctcatcctgcggcggtaccctgggggctgggtggagaaggagacgtactactgagctcaccgacaaaaggaagaacaggggagatggggtgctccagaggggctggtgggtgttgtggtgaagggaagggctggggagacacaaggaagcgatggtggcgtgaactcagtgggtaggcttgggtaaataaacttgaggagactgctccaactgctccataggtcccgctgtgaaccctaagacagtgcatgttggggtcgcctcctcagatccttcccgtcccactctcccacattgtctacattttctgaagaaccgggggtcgccctagccctccctgtgtcccagtccttcaccctcacctgcattattccattattcaaacagatcaacacccaaaggttaatcctgtctaaccctggaggaaagcctgtcagaccaccagtacccaccactaccaccaccaccaccaccaccaccaccaccaccaccaccaccaccaccaccccctgttcactcctcttcccattcttgccttcctcaccttcctgcctgagtcttcccttgctcctccccttacaccttgaaaacacaaaattctgcttctgtgagtgcaagagcctagggccagaaaaggaagccagttggagagatggggcctgtctcccagccaagaccagtcaggaaccagaggggagctgggctggcaagtggaggttggggtgcactggctgagaaagaaagaaaggaaggaaggaaggaaggaaggaaggaaggaagaaaggaaggaaggaagtgaccacaggtgtgtcatctccagccttcaggtatatgggacaggctctggatctgtgagagacttaagagactagcacaccagcagaccaaattcccatctcatcagactagcagtaagtgccacccagtgcccctctgacccttgggtagtggtcctctctgtccacaaggctcagatttcacagaaggttcagctatctcaaccacatactcttgggaacaccccccttctttagaataattagttctctggggcctcgtgctgttctgagagccccattagctgccacttctcctcgtgctctctcactgccttctgcttcctacccacctgctgaacccacgttatgtccagtatcgccttgcttgtcctgaaaaaggatctcttggccattggcaggaatcagtgtagaaatgtttccaggacatccctgactttcgggaacatgcagaatcagtgtagctcatgacacagtcagaaactttagacacaagagaaattcttaagagacctatgcacctttgacctctcagattgagacaggaagctggcttcaggttcctatggcatagagttatctttccttactctcttctcaacctaacgtattcgctcttcagacagctgcctgttctctaatcctggcctagaaagcatagcatagatgcacctggatcaatgagggaagcaagagagaatcagcaaggaaactggaaggcttgaggtgggaatatgaaagtcaagacaagcatcaagccaggcccaagggcctcccaaaggctactgtctcatcgtggtggatggagttttgccttaccctaaataccttgaaatttgtcagtcatgcatagccttcagtcggaagtcaaaatgggacaccgtatttatttgggcctgactaatttgagatcactgactttgaacaaaagtttacctttgcacaatcaataaaatcatctgctaggtaattcaagagcataaacgatactgctaggagcagcatagttagtttcaaagtatgctttccgagcactttagcaatctccctttagaatcaggaagtgcataggctaattactatcagtcccgatatatttgttaaaggaacacctacaagatccttactggtgaccttctgtgagacactagtttgaggcactacatgtgtacttgaaaataataaagttgcatttctttatgaat

SEQ ID NO: 1735 - DNA, 1085 bp, Rattus norvegicus
  Genbank Accession No. NM_012513
cgccttggacagagccagcggatttgtccgaggtggtagtacttcatccagttccaccaggtgagaagagtgatgaccatccttttccttactatggttatttcatacttcggttgcatgaaggctgcgcccatgaaagaagcaaacgtccacggacaaggcaacttggcctacccagctgtgcggacccatgggactctggagagcgtgaatgggcccagggcaggttcgagaggtctgacgacgacgtccctggctgacacttttgagcacgtgatcgaagagctgctggatgaggaccagaaggttcggcccaacgaagaaaaccataaggacgcggacttgtacacttcccgggtgatgctcagcagtcaagtgcctttggagcctcctctgctctttctgctggaggaatacaaaaattacctggatgccgcaaacatgtctatgagggttcggcgccactccgaccccgcccgccgtggggagctgagcgtgtgtgacagtattagcgagtgggtcacagcggcagataaaaagactgcagtggacatgtccggtgggacggtcacagtcctggagaaagtcccggtatcaaaaggccaactgaagcaatatttctacgagaccaagtgtaatcccatgggttacacgaaggaaggctgcaggggcatagacaaaaggcactggaactcgcaatgccgaactacccaatcgtatgttcgggcccttactatggatagcaaaaagagaattggctggcggttcataaggatagacacttcctgtgtatgtacactgaccattaaaaggggaagatagtggatttatgttgtatagattatattgagacaaaaattatctatttgtatatatacataacagggtaaattattcagttaagaaaaagataattttatgaactgcatgtataaatgaagtttatacagtacagtggttctacaatctatttattggacatatccatgaccagaaagaaacagtcatttgcgcacaactttaaaagtctgcattacattcctcgataatgttgtggtttgttgccgttgccaagaattgaaaac

SEQ ID NO: 1736 - DNA, 691 bp, Rattus norvegicus
  Genbank Accession No. NM_012518
aaaagagtgtggagccgagacgcgcggcagagctcgagctgctgcagctgctgccgccgccagagtaacctcgatccccgagctccggatacgtgccccgccatggctgaccagctgaccgaagaacagattgcagagttcaaggaagccttctccctctttgacaaggatggagatggcaccattaccaccaaggagctggggactgtgatgagatcgctggggcaaaaccccactgaggcggaactgcaggacatgatcaatgaggtggatgctgatggcaatgggaccattgacttcccagagttcctgaccatgatggccagaaagatgaaggatacagacagcgaggaggagatacgagaggccttccgtgtctttgacaaggatgggaatggctacatcagtgctgctgagctgcgtcacgtcatgacgaacctgggggagaagctgactgatgaggaagtggatgagatgatccgagaggcggacattgatggagacggccaggtcaattatgaagagtttgtacagatgatgactgcgaagtgaaggcccgggcagctggccatgcccgttctcctgatctcttcttgcgctctcctctcttcaacactcccctgcgtacccggttctagcaaacgccaattgattgactgagaatctgataaagcaacaaaagatttgtccc

SEQ ID NO: 1737 - DNA, 5637 bp, Rattus norvegicus
  Genbank Accession No. NM_012519
ttcgggagcgctcgcccggcgggaggaggaggaagaaggatcgcggctcgggctggtctggccacctcgccccgcgcgccccgcccctgcgcgcactccctcgccggcgagctactttcggacaaggaaagtgagggcggccccgggtgacagcgcggcggtgccagtcccgggaagccgcgtctgttcgcgtgtcgcccgtcgcactgtccagaccccgccatggcttcgaccaccacctgcacccggttcaccgacgagtatcagctcttcgaggagctcggaaagggggcattctcagtggtgagaagatgcatgaaaatccctactggacaagagtatgctgccaaaattatcaacaccaaaaagctttctgctagggatcatcagaaactggaaagggaagctagaatctgccgtctcttgaagcaccccaatattgtgagacttcatgacagcatatccgaagagggcttccattacttggtgtttgacttagttactggtggcgaactctttgaagacatagtggcaagagaatattacagtgaggctgatgccagtcattgtatacaacagattctagagagtgtaaatcattgtcacctaaatggcatagttcacagggacctgaagcctgagaatttgcttttagctagcaaatccaaaggagcagctgtgaaactggcagacttcggcttagccatagaagttcaaggcgaccagcaggcgtggtttggttttgctggcacacctgggtatctttctccagaagtcctacgtaaagatccttatggaaaaccagtggacatgtgggcatgtggcgtcatcctctacatcttgctggtgggatacccacccttctgggatgaagatcagcatagactgtatcagcagatcaaggctggagcgtacgattttccatcaccagaatgggacacagtgacacctgaagccaaagacctcatcaacaaaatgctgaccatcaaccctgccaaacgcatcacagcctctgaggccctgaaacacccatggatctgtcaacgttctactgttgcctccatgatgcacaggcaggagactgtagactgcttgaagaaatttaatgctcgacggaaattgaagggtgccatcttgacaactatgctggctacgagaaatttttcagcagccaagagtttgttgaagaaaccggatggggtaaagataaacaacaaagccaacgtggtaaccagccccaaagaaaatattcctaccccggcgctggagccccaaactactgtaatccacaaccctgatggaaacaaggagtcaactgagagctcaaataccaccattgaggatgaagacgtgaaagcacgaaagcaagagatcatcaaagtcactgagcagctgattgaagctatcaacaatggggacttcgaggcttacacgaaaatctgtgatccaggcctcactgcctttgaacccgaagcattgggcaacttagtggaagggatggactttcacagattctactttgaaaatgctttgcccaaaatcaataaaccaatccacactatcatcctgaaccctcacgtacacctggtaggggatgatgcagcctgcatagcatacattcggctcacacagtacatggatggaaatggaatgccaaagacaatgcagtcagaagagactcgagtgtggcaccgccgtgatgggaagtggcagaatattcactttcatcgttcggggtccccaacagtccccatcaagccaccctgtattccaaatgggaaagaaaacttctcaggaggcacctctttgtggcaaaacatctgaaaaccattcacatttgggtcttctaattgtcaacagtgccacgtcttcattctgtcctcaaggcacctggcggggtgatcctgggacatcctctcctcttcatgcatgtttctgagtgcatgaagttgtgaaggttctacgtgtaatgcatatgtgacacgtcatcttaccatgtgacacgccatcttaccatgtattccttcctgtacattgtttacactccagctactggacggatgttccatgcaaacgtcagttactgctggcaaactaaagagggagctccgacaagaaaactccgcaatactccaagttcagctgatccatcaggtttctctgtggatgccaagattcaaaagacttcataaaattactgttcaatgaatgacagtgtgtaagaggaaaggaaatctttcaagaatgctgccattaatctatttgggcttctcattgggattttggggttgattttttttttcattttttaaggcaaatatatatatatatatatatgccttcagttcctggtgtgatcctggtagaaatgaatggatgccttttctctgaaagtgttggtgttggataaatggatggctatgtgagccaagtcctgggtgattgtaggagcaagaatcgtttgctgttctaccatcaaagccatgttgatttgggtcgagctctgtatactggaaaaattcacatcattttctagtttgattgctttcagataggcacagttctggtgaatgcttggcactgatcttggtttttctttcctaaatctgtgttctgttttcattatatactatttgctcctttcctttgtatttgttttcttttcccactcttttctttatctttctctctcccactttctttcttttttatgttttcctttctatagctgatagtgtgtaaaaacagtaacatttgcatatgaagttaaaataaaaatcaaggtcttctagaagctaaaactagcacttccggtctctcacggggctgtggagttgttagaagatttaaataaatacttaaataagagaggaatgaattcagcttaggttaccacttgtgcataggtatccttgctctgttgaaagtgttggaattgttgagacttaagctaacagcagtaagagcctgcttacacagtcctggttctccccaactagatattgaagaccaagtggagcctgaccagggttgcatgcagagcacttgttttggaccttccagactaggaggcatttactgcctcactttcactagctagccacaggaagagtgttctccatcctcctagaggttgaacttgaccttcgtgactagtgcagttctagcttctctcttgagtcacagtagcatcctgatgccaggagttaggcttttgtccagattaaaacaacgaggaaaaggaaatgccccagttttctttccgtttcccatttcttctttgtcgattcggtccctgggagactgtttctccgcgctgaactgctttatggtgcatggaatctccatcagcgtacttccaccctagccactcacactccttagaagctgatttttaaagcagaagcaaggaagcaaaagtaaaacactcccttcccctctttttcctcatttcaccttttggtgttgattgctaatcactttagatatattgttgctagtgaatgtatgatagatgggttgaagcttttctgataattagcacatgatttaaaacaatatatatttaaaacaaatatatacagtacatgtattgagccgtgttaacctgccaatgagatctgtgaaaaacgtaatggcctcacttttccctttgaatttcttttacctttctgtgaagcagctctgcgtggcatacatgtatttaaaaacacaaatagtggtagaatgggtttttttttacacttttaacttagcatgtggtgttgaagtattaccatagatccagtttgtcttctgcactaagatgtgaggaaatcgtgatttgttctctccagcacagtggaattacaccttcatcatcttctattgttttgaaaacactgcagtttaccatgggacactgtatataattcttgccgtaatggtaaatgacgaattgatatatttaagagttaataaatttgtgatttctgctgacagcgtgtccttctttatttctcaaataccctatgtgtggtgccggccacagccgaggacattatgtcctgccctggtctccttcaatagacatcttgcagtctgtgatcatggcaagcaatttgttctctctgcacataacagtgctgtcttttcacaaaaaaaaaaaaaattagctaaaaggaaagtagttagcagctgactatcctaaaagattttagacatgctgcttctgtccatctcttacaggactgctaaaatgtcccactcactcctaatacaaatctgtcagtcatctccagtatctagcagtcaccctagctgctatgaccccagaactacagattgctaaggtgtccatgagttaaagcaccacctactatttcttatatccattcatgtgacttactttcttacctagaacggtcttcctttgttggattaaaccaatctttgactcattcactggggtccaaagtagtgttgcacctcctccagcgaatttcctctgcagcttctaggttttatttgctctgtcatgacttgcatggtagtctgtattctctgttcctgatgctatccacattattttgacaatatatttttgtattatctttactgtagtaggaaagtctgtagagataagaactgcacattcatggttgtacccttaccaccaaaccagaacaagaaagaggctgttaataaactgctttttaaaattttttattagatatatttctttacttacatttcaaatgttattccccttcctagtttcctgtccataagcccccattccctcccttcccctccccatgcaggtattccccctatacatcctccgtatttcccccccattcccctgccctaggggtccaaccttggcaaaaccaagggcttccccttccactggtgccccaacaaggctattctctgctacatatgtggttagagccctgggtcagtccatgtataatcttttggtagtgaataaactggttttgaaccatattgtccaaggcaacctctaggtgagatcacacagtcctgagttgaatgttgggctctgtcatcattattttgatgttctaaataagtcatttcccttgaacttcactttccaagattataaaatgagtataagtatgtaaattaaattataatatcctaaggattagaaaaacaggcataaaatccctggaataccatttttggtattaagtggacatcattgggcatgttggtatatggctatgatctcggcaggctaatgtgaactagatagaagaccccatctcaacaaatgcataaataaactcctgctactcatggagccctactattcttgtatcgttccctgtttaagatcaggagggtgtgcaacctttgctttaccaggggttgctctcttcattgcaaaggatgtattgcattccactgtctcagcaagaagttgggagccagaaggaggtggccgtgtccctgaaaatgcaaaagaagatggagtacattctggggaaattttcaaaaatgtcaagtttgagtagctaaaactttgaatttctatgtaaatcaaagaattctatataatgtgaggataaatgtagaagacacaacctttgagtcatttcattaaataaaatcttactgactttg

SEQ ID NO: 1738 - DNA, 2495 bp, Rattus norvegicus
  Genbank Accession No. NM_012520
attgcctaccccgggtggagaccgtgctcgtccggccctcttgcctcacgttctgcagctctgcagctccgcaatcctacaccatggcggacagccgggacccagccagcgaccagatgaagcagtggaaggagcagcgggcccctcagaaacccgatgtcctgaccaccggaggcgggaacccaataggagataaacttaatatcatgactgcggggccccgagggcccctcctcgttcaagatgtggttttcaccgacgagatggcacactttgacagagagcggattcctgagagagtggtacatgcaaagggagcaggtgcttttggatactttgaggtcacccacgatattaccagatactccaaggcaaaggtgtttgagcatattgggaagaggactcctattgccgtccgattctccacagtcgctggagagtcaggctcagctgacacagttcgtgaccctcgtgggtttgcagtgaaattctacactgaagatggtaactgggacctcgtgggaaacaacacccctattttcttcatcagggatgccatgttgtttccatcctttatccatagccagaagagaaacccacaaactcacctgaaggaccctgacatggtctgggacttctggagtctttgtccagagtctctccatcaggttactttcttgttcagcgaccgagggattccagatggacatcggcacatgaatggctatggctcacacaccttcaagctggttaatgcgaatggagaggcagtgtactgcaagttccattacaagactgaccagggcatcaaaaacttgcctgttgaagaggcaggaagacttgcacaggaagacccggattatggcctccgagatcttttcaatgccatcgccagtggcaattacccatcctggactttttacatccaggtcatgactttcaaggaggcagaaaccttcccatttaatccatttgacctgaccaaggtttggcctcacaaggactaccctcttataccagttggcaaactggtcttaaacagaaatcctgctaattattttgctgaagttgaacagatggcttttgacccaagcaacatgccccctggcattgagcccagcccggacaagatgctccagggccgcctttttgcttacccagacactcaccgccaccgcctgggaccaaactatctgcagatacctgtgaactgtccctaccgtgctcgcgtggccaactaccagcgcgatggccccatgtgcatgcatgacaaccagggtggtgctcccaactactaccccaacagcttcagcgcaccagagcagcagggctcggccctggagcaccatagccagtgctctgcagatgtgaagcgcttcaacagtgctaatgaagacaacgtcactcaggtgcggacattctatacgaaggtgttgaatgaggaggagaggaaacgcctgtgtgagaacattgccaaccacctgaaagatgctcagcttttcattcagaggaaagcggtcaagaatttcactgacgtccaccctgactacggggcccgagtccaggctcttctggaccagtacaactcccagaagcctaagaatgcaattcacacctacgtacaggccggctctcacatagctgccaagggaaaagctaacctgtaaagcacgggtgctcagcctcctcagcctgcactgaggagatccctcatgaagcagggcacaagcctcaccagtaatcatcgctggatggagtctcccctgctgaagcgcagactcacgctgacgtctttaaaacgataatccaagcttctagagtgaatgatagccatgcttttgatgacatttcccgagggggaaattaaagattagggcttagcaatcacttaacagaaacatggatctgcttaggacttctgtttggattattcatttaaaatgattacaagaaaggttttctagccagaaacatgatttgattagatatgatatatgataaaatcttggtgattttactatagtcttatgttacctcacagcctggtatatatacaacacacacacacacacacacacacacacaccaaaacacacatacactatacacacacacacacacacacactaaaacacacatacacaacacacacatacactacacacacagaacacacaacacaaacatacacacataggcacacacacacacacacacacacacacacacacacacacacacacacatgaatgaagggattataaagatggcccacccagaatttttttttatttttctaaggtccttataagaaaaaccatacttggatcatgtcttccaaaaataactttagcactgttgaaacttaatgtttattcctgtgtagttgattggattccttttccccttgaaattatgtttatgctgatacacagtgatttcacatagggtgatttgtatttgcttacatttttacaataaaatgatcttcatgg

SEQ ID NO: 1739 - DNA, 1146 bp, Rattus norvegicus
  Genbank Accession No. NM_012529
atgcccttctccaacagccacaacacgcagaagctgcgcttcccggccgaggatgaattccctgatctgagcagccacaacaaccatatggccaaggtgctgacccccgagctgtacgcggagctccgtgccaagtgcacgccgagcggctttacgttggacgacgccatccagactggcgtagacaatccgggccacccgtacatcatgacagtgggtgcagtggcgggcgacgaggagagttacgacgtattcaaggaccttttcgaccccatcatcgaggaccggcacggcggctaccagcccagtgatgagcacaagactgacctcaacccagacaacctgcagggcggcgatgacctggaccccaactacgtgctgagctcgcgggtgcgcacaggccgaagcatccgcggcttctgcctcccccctcactgcagccgtggggagcgccgcgccatcgagaagctggcagtagaagccctgtccagcctagatggcgacctgtctggcaggtactatgcgctcaagagcatgaccgaggcggacgagcagcagctcattgacgaccacttcctcttcgacaagcctgtgtcgcctctgctgctggcctccgcgatggcccgcgactggccggatgctcgcggcatttggcacaatgacaataagacgttcctggtgtggatcaacgaggaggaccacctgcgggttatctccatgcagaaagggggcaacatgaaggaagttttcacgcgattctgcactggcctcactcagattgaaactctcttcaagtctaagaactatgagttcatgtggaaccctcacctgggctacatcctcacgtgcccatccaacctgggcactgggcttcgggcaggcgtgcacatcaagctgccccacctgggaaagcacgagaagttctcggaggtgctcaagcgactgcggcttcagaagcgaggcacaggtggtgtggacaccgctgctgtgggtggagtttttgatgtctccaacgctgaccgcctgggcttctcggaggtggagctggtgcagatggtggtggacggagtgaagctactcattgagatggagcagcggcttgagcagggtcagcccattgacgacctcatgcctgcccagaagtga

SEQ ID NO: 1740 - DNA, 1531 bp, Rattus norvegicus
  Genbank Accession No. NM_012531
atgccgttggctgcagtctcattgggtctcctgttgttggccctcctcctgctcttgcgacacctgggctggggcttggtgactattttctggtttgagtacgtgctgcagccagtccacaacctgatcatgggtgacacaaaggagcagcgcatcctgcgctacgtgcagcagaatgcaaagcctggagaccctcagagcgtcctggaggccatcgacacctactgcacacagaaggaatgggccatgaatgtgggtgacgcgaaaggccaaatcatggatgcagtgattcgggagtacagcccctccctggtgctggaactgggagcttactgtggctactcagcagtgcgaatggctcgcctgctgcagcctggagccaggcttctcaccatggagatgaaccctgactacgctgccatcacccagcaaatgctgaactttgcaggcctacaggacaaagtcaccatcctcaatggggcatcccaggatcttatcccccagctgaagaagaagtacgacgtggacacactagacatggtctttcttgaccactggaaagaccgctaccttccagacacacttctcctggagaaatgtggcctgctgcgcaaggggacagtgctcctagctgacaacgtcatcgtcccgggaacccctgacttcctggcgtatgtgagagggagcagcagcttcgagtgcacacactacagctcatacctggagtacatgaaagttgtagacggcttggagaaggcaatctaccagggtccaagtagccctgacaagtcttgatccctcagcctgcccccctgctccccttccagcttctctctgcgagatgacacacattcaatctgaccctttctatgctcctggggcttgtcctcgggggctgtggttccagactgtcatacactggcacattttaaaggtagtgagcccactatgcaaaatcacttcaataaccctgaaaagcacctatggatgaaaggctgaattgaggccaaaggtacactagatcacagcctgcccagcatgcaaaaggcctcaaggttaatcctctgcacccgagcctcatggtctcgctaactagaagaggagatcttcacggggtttcagtgtgggatcactaggcattgtatcaccagttaggcccagcaggaagtcagcaaactgtaaatgtccagacgccaaataacagcagaggctcagagacagtactgtcacttactgtccccagcagctcacaccacatctcatctgaagaatgagtcacaagctttccaggtatggtggtgcacgcctgtcatccccagtatccaggaggcagaggcatcggagttcagcgccagcctggtctacataagtgagttccaagacagccagggctacgtagaaatacatttttaaaaaagttataaccttggggttggggatttagctcagtggtagagcgattgcctagcaagctctaccactgagctaaatccccagccccaacctcttttatattataaaagaaattaaa

SEQ ID NO: 1741 - DNA, 3700 bp, Rattus norvegicus
  Genbank Accession No. NM_012532
ccaagaggaagaaacatgaagtttttgctgcttagtgcacttttatttttgcatagttccttagcttggacaagagaaaagcattattacatcggaattactgaagcagtttgggactatgcttctggcagtgaagaaaaggaacttatttcagttgacacggaacagtccaatttctatcttcgaaatggtccagatcgtattggaagaaagtataagaaggccctttattctgagtacacagatggcacctttacgaagactatagacaaaccagcctggctagggtttttaggccctgtcatcaaagctgaagttggagacaaagtttctgttcacgtaaagaactttgcctctaggccctacacttttcatgctcatggggtaacttacaccaaggcgaacgagggggccatctaccctgacaacaccactgattttcaaagagccgatgacaaactgtttcctggacagcagtatttgtacgtgctgcgtgccaatgagccaagtcctggcgagggagacagcaattgtgtgaccaggatttaccactctcatgtggatgctccaaaagatattgcatcaggactcataggaccgttgatactctgtaaaaaaggttctctgcataaggaaaaagaggaaaatattgaccaagaattcgtactgatgttctctgtggtggatgaaaatctcagctggtacctagaagataacatcaaaaccttctgctctgaaccagagaaagtcgataaagacaatgaagacttccaggaaagcaacaggatgtactctataaatggatatacatttggaagcctcccagggctctcgatgtgtgcagaagacagagtgaagtggtacctttttgggatggggaatgaagttgacgtgcattcagagctctttcatggtcaagccctgaccagcaagaactatcatactgatataatcaacctgttccctgccactctaattgatgtttctatggtggcccagaatcctggagtctggatgctcagttgccagaacctgaaccatctgaaagctggtttgcaggcctttttccaggttcgtgactgcaacaagccctcaccggacgacgatatccaagacagacatgtgagacattattacatcgctgccgaggagaccatttgggactatgctccgtctgggacagacaccttcactggagagaacttcaccagtctgggaagtgattcaagggtcttttttgagcaaggtgctacaagaattggtggctcttataaaaaattggtttatcgtgagtacacagatgattccttcacaaaccggaaggaaagaggccctgatgaggaacatcttggaatccttggtcctgtcatttgggcagaagtaggagacatcattagagtcacctttcataacaaaggacaatttcctctcagcattcagccaatgggggtaagattcaccaaggaaaatgagggaacatactatggcccagatggccgttcctcaaagcaagcctcccatgtggctcccaaagaaacctttacgtatgaatggactgtccccaaagaaatgggacccacttatgcagatcctgtgtgcctatctaagatgtattattctggagttgacctcaccaaagatatatttactgggcttattgggccaatgaaaatatgcaagaaaggcagcttacttgcagatgggagacagaaagatgtagacaaggagttctacttgtttgcaacagtgtttgatgagaatgagagtttactcttggatgataatatcagaatgttcacaactgcacctgagaatgtggacaaggaagatgaagactttcaggagtccaacaagatgcactccatgaatggattcatgtatggcaatctgcctggcctcaatatgtgcctaggagaatccatcgtgtggtatttgttcagcgctggaaatgaggcagacgtgcatgggatatacttttcaggaaatacctatctgtccaaaggagaaagaagagacactgcaaatctgtttcctcataaaagtctcacccttctcatgacacctgacacagaagggtcttttgatgttgagtgtcttacaacagatcactacaccggcggcatgaagcaaaagtacactgtgaaccagtgcaaggggcagtttgaagatgtcactctctaccagggagaaaggacctactatattgcagcagtggaggtggaatgggattattcaccaagcagggactgggaaatggagctgcaccatttgcaagagcaaaatgtttcaaatgcatttttggataaggaagagtttttcataggctcaaagtacaagaaggttgtgtatcgagagtttactgacagcacattcagagaacaggtgaagagaagagctgaagaggagcacttgggcatgctcggtccactgattcatgcagatgttggagccaaagttaaagttgtctttaaaaatatggcaacaaggccatattcaatacatgcccacggagtgaaaacaaagagttctacagttgctccaacgttgccaggtgaagttcgcacttatatatggcaaattccagaaagatcaggtgctggaacggaggattcaccttgtatcccatgggcttattactcaaccgtggatcgagttaaggatctctacagtgggctaataggcccattgattgtttgtcggaaatcttatgtgaaagtattcaatcctaaaaagaaaatggagttttcccttttgtttctagtttttgatgagaatgaatcttggtacttagatgataacatcaatacataccccgatcaccctgagaaagataacaaagacaacgaggaattcatagaaagcaataaaatgcatgctatcaatgggaaaatgttcggaaacctccaaggtctcacgatgcacgtgggagatgaggtcaactggtatgtgatggctatgggcaatgaaatagacctgcacactgtacacttccacggccacagcttccaatacaagcacaggggaattcatagttctgatgtctttgactttttccctggaacataccaaaccctagaaatgtttccccaaacgcctggaacctggttactccactgccatgtgactgaccatattcatgcggggatggtaactacctacactgttttaccaaatcaagagactaagtctggctgaaagaaataaattggtgataagtggaatacgagcacaatgacgttgttttaaacatttaaaaaaatcaaagccacacaaatgttcatttgtgagggaattggtaatgccgatggacagatgaacagactgtatcatgacatgtatttgtttgctgggtaacagaatcgctttacatagtccacttacacctgcactgaaaggactctgaaaagtggaaaaaaataagcaaaaccgtatgatcagatgctgtccttgactgtcctcacaggatcactataaagtccactaaactgtctccaactcttctcatcaagtcctctaacaaaccatggggtaagagggtatagaaaagaaggaaagatgaagataccaagatgcactttgtaaaaatctgaaaaacagttgaaggatgctctcggaaaatagagaaagtcaggatccaattatgttacattttgaaaaaatgaaatggagataataaagtaataaattttaaaatgccaat

SEQ ID NO: 1742 - DNA, 1056 bp, Rattus norvegicus
  Genbank Accession No. NM_012534
gaattccggaacatggacgtcaccatccagcacccttggttcaagcgcgccctggggcccttctaccccagccgactgttcgaccagttcttcggcgagggcctttttgaatacgacctgctgcccttcctgtcttccaccatcagcccctactaccgccagtctctcttccgcacagtgttggactccggcatctctgaggtccgatctgaccgggacaagtttgtcatcttcttggatgtgaagcacttctctcctgaggacctcaccgtgaaggtactggaagatttcgtggagatccatggcaaacacaacgagaggcaggatgaccatggctacatttcccgtgaatttcaccgtcgctaccgtctgccttccaatgtggaccagtccgccctctcctgctccttgtctgcggatggcatgctgaccttctctggccccaaggtccagtctggcttggatgctggccacagcgagagggccattcccgtgtcacgggaggagaagcccagctcggcaccctcgtcctgagcaggcctcgccttggttgtcccctgaggcccctgatccatccagcccaggggccacagcaaagagtctgccttcctgacttcttttctttctctttgtttcctttccactttctcagagggctgaggatttgagagagtggcttaaagagcttggggggtcttggcctgagatggctgcgggttcagggtgacccaggctcaacaccagccggtcagagggaatgatggcattgaactcttaagatttcctgtcctcctggaaagtggcatcgagctctgctccaaaggcagagtgaatggtggctaaccaaccccaagagccctctgccaagcccctggatggcagcctcccaccccctttgcccacacttaccgcaggcgtatatgctgggctccaacagtccgcttctctcatgccctcttcctgtgactttctctactatgtagtatcgctcctggggaccctggtcacccatgagaatggagcccctggcagacaataaagagcaggtgcgaattc

SEQ ID NO: 1743 - DNA, 1542 bp, Rattus norvegicus
  Genbank Accession No. NM_012541
atggcgttctcccagtatatctccttagccccagagctgctactggccactgccatcttctgtttagtgttctgggtgttgagaggcacaaggacccaggttcccaaaggtctgaagagtcctcccggaccctggggcttgcccttcattgggcacatgctgaccctggggaagaacccacacctatctctgacaaagctgagtcagcagtatggggacgtgctgcagatccgcattggctccacacccgtggtggtgctgagcggcctgaacaccatcaagcaggccctagtgaagcagggggatgacttcaaaggccggccagacctctacagcttcacacttatcactaatggcaagagcatgactttcaacccagactctggaccggtctgggctgcccgccggcacctggcccaggatgccctgaagagtttctccatagcctcagaccccacatcagtatcctcttgctacttggaggagcacgtgagcaaagaggctaaccatctaatcagcaagttccagaagctgatggcagaggttggccacttcgaaccagtcaaccaggtggtggaatcggtggctaacgtcatcggagccatgtgctttgggaagaacttccccaggaagagcgaggagatgctcaacctcgtgaagagcagcaaggactttgtggagaatgtcacctcagggaatgctgtggacttctttccggtcctgcgctacctgcccaacccagccctcaagaggtttaagaacttcaatgataactttgtgctgtttctgcagaaaacagtccaggaacactatcaagacttcaacaagaacagtatccaggacatcacaggcgccctgttcaagcacagtgagaactacaaagacaacggtggtctcatccctcaggagaagattgtcaacattgtcaatgacatctttggagctggatttgaaacagtcacaacagccatcttctggagcattttgctacttgtgacagagcccaaggtgcagaggaagattcatgaggagctggacacggtgattggcagagatcggcagccacggctttctgacagaccccagctgccatatctggaggccttcatcctggagatctaccgatacacatcctttgtccccttcaccatcccccacagtacaacgagggacacctcactgaatggcttccacattcccaaggagcgctgcatcttcataaaccagtggcaggtcaaccatgatgagaagcagtggaaagacccctttgtgttccgcccagagcggtttcttaccaatgacaacacggccatcgacaagaccctgagtgagaaggtgatgctcttcggcttgggaaagcgccggtgcattggggagatcccggccaagtgggaagtcttcctcttcttagccatcctcctgcatcagctggagttcactgtgccaccgggcgtgaaggtggacctgacacccagctatgggctgaccatgaagcccagaacctgtgaacacgtccaggcctggccacgcttctccaagtga

SEQ ID NO: 1744 - DNA, 1671 bp, Rattus norvegicus
  Genbank Accession No. NM_012543
cctttctttgcgagaagtgcaaaattggctagagccagagtctcgcccacctggtacagaaggagcgcgcgcctgtgtcccttggggacccacagttgcaaagagacagctgcttgatttggtcacccactcgcccagactataggagcctcccgggacactcttgagttgcacctttctgcagagcagactgtttgagcccccgcagtgctcgtaggatttgaagcgttctgatactggaggcttgctcgccgcgctcgcccgactctgggacacatttgtccgagccacaggagtgtgcgggtgactgacatatcatctcttcgactctccatgagctcatgaacctgggagcaggtgcccggaaatggcgcggcctctgagcgacaggaccccgggccccctgctgctgggtggcccggctggggccccccctggcgggggagcgctgcttgggctgaggagccttctgcagggaaacagcaagcccaaagaaccggccagctgtctcctgaaggaaaaggagcgcaaggcaactctgccctcagcccccgtcccgggacccgtcctggaaacggcgggcccagcggatgccccaactggggcggttagtggcggtgggtcccctcgggggcgctcagggcctgtggctggcccgagtctttttgcgccgctgctgtgggaacgcactttgcctttcggggacgtggaatacgtggacctggacgccttcttgctggagcacgggctaccgccgagcccgccgccccccgggggcctgtcgccggcaccctctccagcgcgcactcccgcgccctcccccgggcccggctcttgcagctcctcttccccccgctcctcgcccgggcacgcccccgcgcgggccactctgggagccgccggcggccaccgcgcaggcttgacctctagggacacacccagtcctgtggacccagacaccgtggaggtgctaatgacctttgaacctgatccggctgatcttgccctgtcaagcattccaggccatgagacttttgaccctcggaggcaccgcttctcagaggaggaattgaagcctcagccaatcatgaagaaggcaaggaaagtccaggtgcccgaggaacagaaggatgagaagtactggagccggaggtacaagaacaatgaagcagccaagaggtcgagagacgcaagaagactcaaggagaaccagatatctgtgcgggcagccttcctggagaaggaaaacgccctattgcggcaggaggtggtggctgtgcggcaggagctgtcccactaccgtgctgtgctttcacgctaccaggcccaacacgggacactgtgaggccacttccaccctgccagggcagagtcctgttccttgttcagacttacacctgacaccccccttcctccttgtcccatggccaatggtctggccagctaggtgcccaggaacgtcatgatgcagacaaatacatttatatttttaagaaaaagctagccttcccccacctcccttgtgggggtggggagggtcctgtgtgcacttttagcatgtcgaggaacccatccatccaaccgcctccatcaacacaatcctgaataaatcttgagaacccaaaaaaaaaaaaaaaaaaaaaaaaaaaaaaaaaaaaaaaaaaagaattc

SEQ ID NO: 1745 - DNA, 4142 bp, Rattus norvegicus
  Genbank Accession No. NM_012544
cgccgcaccgcgcgcaccgcgccatgggggccgcgtccggccagcgggggcggtggccgttgtcaccgccgctcttgatgctgtcgctgctgctgctgctgctgctgccgccgtcgcccgccccggcgcttgaccctggattgcagccgggcaacttttccgcggacgaggcaggggcgcagctcttcgctgacagctataactcgagtgccgaggtggtgatgttccagagcaccgcagccagctgggcgcacgacaccaacatcacggaggagaatgcgcggctccaggaggaagcggccctgatcaaccaggagtttgcagaggtctggggcaagaaggccaaggagctgtatgagtccatctggcagaacttcactgaccaaaagctgcgaaggatcatcggatccgtacagaccctaggacctgccaacctgcccctgacccagcggctgcagtacaactctctgctaagcaacatgagcagaatctactccaccggcaaggtctgcttccccaacaagactgccacctgctggtccctggacccagagctcaccaacatcctggcttcctcacgaaactatgccaaggtgctgtttgcctgggaaggctggcatgatgctgtgggtatcccactgaagcccctctatcaggactttactgccctcagtaatgaagcctacagacaagatggcttctcagacacaggagcctactggcgctcctggtatgagtccccctcctttgaagagagtttggagcatctctaccaccaagtcgagcccctctacctgaacctccatgcctttgtccgtcgcgcactgcaccgccgctatggggacaaatacatcaatctcagaggtcctattcccgctcatctgctgggagacatgtgggcgcagagctgggagaacatttacgacatggtagtgcctttcccggacaaacccaacctcgatgtcaccagtacaatggtacagaagggctggaatgccacgcacatgttccgggtcgcagaggaattctttacctcgctggggctctcccccatgcctccagagttctgggcggagtcgatgctggagaaaccagctgatggacgggaggtggtgtgccatgcctctgcgtgggacttctacaacaggaaggacttcaggattaagcagtgcacgcgggtcacgatggaccagctgtccacagtacaccacgagatgggccacgtgcagtactatctccagtacaaggacctgcacgtctctctgcgtcgaggtgccaaccctggcttccacgaggccatcggggatgtactcgctctctctgtctctaccccagcacatctgcacaaaattggcctgctagaccgtgttgccaatgacatagaaagtgacatcaattacttgctaaagatggccctagagaaaattgccttcttgccctttggttacctggtggaccagtggcgctggggggtcttcagtggacgtaccccaccctctcgctacaactacgactggtggtatcttcgaaccaagtatcaggggatctgcccaccagttgctcggaatgaaacccattttgacgctggggccaagtttcacatcccaagcgtgacaccatacatcaggtactttgtgagtttcgtgctacagttccagttccatcaagcgctgtgcaaggaggcaggccaccagggtccactacaccagtgtgacatctaccagtccaccaaggcaggggccaagctccaacaggtgctgcaggctggctgctccaggccctggcaggaggtgctgaaggacctggtgggttcagatgcgctggatgccagtgcgctaatggagtacttccaaccagtaagccagtggctgcaggagcagaatcagcggaatggcgaggtcctaggctggccggagtatcagtggcgtccaccgttaccagacaactatccagagggaattgacctagagactgatgaagccaaggctaacaggttcgtggaggagtatgaccggacagccaaggtgttgtggaacgaatacgcagaggccaactggcattataacaccaacattaccatagagggcagcaagatcctgcttcagaaaaacaaggaagtgtccaaccataccttgaaatatggcacctgggccaagacatttgacgtgagcaacttccagaactctaccatcaagcggatcataaagaaggttcagaacgtggaccgggcagtgctgcctcccaacgagttagaagagtacaaccagatcctgctagacatggagacgacttacagtgtagccaatgtttgctacacaaatggcacttgtctgtcactggagcctgatctgacaaatataatggccacgtcccggaaatacgaagaattgctttgggtgtggaagagctggcgagacaaggtggggagagccatccttccctttttcccaaagtacgtggacttctccaacaagatcgccaagctcaacggctactctgatgcaggggattcctggagatcctcatatgagtccgacgacttggagcaagacctggaaaaactataccaggagctgcagccgctctacctgaacctgcatgcctatgtgcgccgctccctgcaccgccattatgggtctgagtacatcaacctggatggtcccattcctgctcacctgctagggaacatgtgggcacagacttggtccaacatctatgacttggtggcacccttcccttccgcccccagtatagatgccacggaggccatgataaagcagggatggacacccagaaggatatttaaggaagctgacaatttttttacctccctggggctgttacctgtgccccctgagttctggaacaagtcaatgttagagaagccaaccgatgggagggaggtggtgtgccatgcctcagcctgggacttctacaacggcaaggacttcaggatcaagcagtgtacctctgtgaacatggaggaattggtgatagcccaccacgaaatgggccacatccagtatttcatgcagtacaaagacttgcctgtgacctttcgggagggcgccaaccccggttttcatgaggctattggagatgttttggctctgtctgtgtctacacccaagcatctacacagtctcaacctgctcagcagtgagggcagtggctacgagcatgacatcaactttctaatgaagatggcccttgacaagatcgccttcatccccttcagctacctcattgaccagtggcgctggagggtctttgacggaagcatcaccaaggagaactacaaccaggagtggtggagtctcagactgaagtaccagggtctctgccctccagtgcctagatcccaaggtgactttgacccagggtccaagttccacgttcctgcgaatgtgccatacatcaggtactttatcagcttcatcatccagttccagttccacgaggcactatgtcgcgcagccgggcacaccggccccctgtacaagtgtgatatctaccaatccaaggaagcagggaagctgctggcagatgccatgaagttgggctacagtaagcagtggccagaagccatgaagataatcacaggccaacctaacatgtcagcctctgccattatgaattacttcaagccactgactgaatggctcgtcacagagaacaggagacatggagagacactgggctggccggagtacacctggacaccaaacacggctcgtgcagaaggctccctcccagagtccagtcgcgtcaacttcctgggtatgtacctggaaccacagcaggcccgtgtgggccagtgggtgctgctcttcctaggcgtcgccctgctggtggccaccgtgggtctcgcccaccgactctacaacatccataaccatcacagcctccgccggccccaccgtgggccccagtttgggtccgaggtggagctcagacactcctgaggtgaccctgccgtcaaggccaacagaggagtgtcccattaaaaaaaaattagatgggggacatggtgtttgagtggaacatacccaagctgggccttcttcctttgctgttcccatccactctgccccccagcccagcccccattctctagatacccagcatctaacctggaattc

SEQ ID NO: 1746 - DNA, 3112 bp, Rattus norvegicus
  Genbank Accession No. NM_012551
cgcagaacttggggagccgccgccgcgattcgccgccgccgccagcttccgccgccgcaagatcggcccctgccccagcctccgcggcagccctgcgtccaccacgggccgcggccaccgccagcctgggggcccacctacactccccgcagtgtgcccctgcaccccgcatgtaacccggccaacatccggcgagtgtgccctcagtagcttcggccccgggctgcgcccaccacccaacatcagctctccagctcgcacgtccgggatggcagcggccaaggccgagatgcaattgatgtctccgctgcagatctctgacccgttcggctcctttcctcactcacccaccatggacaactaccccaaactggaggagatgatgctgctgagcaacggggctccccagttcctcggtgctgccggaaccccagagggcagcggcggcaataacagcagcagcagcagcagcagcagcagcgggggcggtggtgggggcggcagcaacagcggcagcagcgctttcaatcctcaaggggagccgagcgaacaaccctacgagcacctgaccacagagtccttttctgacatcgctctgaataacgagaaggcgctggtggagacaagttatcccagccaaactacccggttgcctcccatcacctatactggccgcttctccctggagcctgcacccaacagtggcaacactttgtggcctgaaccccttttcagcctagtcagtggccttgtgagcatgaccaaccctccaacctcttcatcctcagcgccttctccagctgcttcatcgtcttcctctgcctcccagagcccacccctgagctgtgccgtgccgtccaacgacagcagtcccatttactcagctgcacccacctttcctactcccaacactgacatttttcctgagccccaaagccaggcctttcctggctctgcaggcacagccttgcagtacccgcctcctgcctaccctgccaccaagggtggtttccaggttcccatgatccctgactatctgtttccacaacaacagggagacctgagcctgggcaccccagaccagaagcccttccagggtctggagaaccgtacccagcagccttcgctcactccactatccactatcaaagccttcgccactcagtcgggctcccaggacttaaaggctcttaataacacctaccagtcccaactcatcaaacccagccgcatgcgcaagtaccccaaccggcccagcaagacacccccccatgaacgcccgtatgcttgccctgttgagtcctgcgatcgccgcttttctcgctcggatgagcttacacgccacatccgcatccatacaggccagaagcccttccagtgtcgaatctgcatgcgtaatttcagtcgtagtgaccaccttaccacccacatccgcacccacacaggcgagaagccttttgcctgtgacatttgtgggagaaagtttgccaggagtgatgaacgcaagaggcataccaaaatccacttaagacagaaggacaagaaagcagacaaaagtgtcgtggcctcctcagctgcctcttccctctcttcctacccatccccagtggctacctcctacccatcccccgccaccacctcatttccatccccagtgcccacctcttactcctctccgggctcctctacctacccgtctcctgcacacagtggcttcccatcgccctcggtggccaccacctatgcctccgtcccacctgctttccctgcccaggtcagcaccttccagtctgcaggggtcagcaactccttcagcacctcaacgggtctttcagacatgacagcaaccttttctcctaggacaattgaaatttgctaaagggaatgaaagagagcaaagggaggggagcgcgagagacaataaaggacaggagggaagaaatggcccgcaagaggggctgcctcttaggtcagatggaagatctcagagccaagtccttctagtcagtagaaggcccgttggccaccagccctttcacttagcgtccctgccctccccagtcccggtccttttgacttcagctgcctgaaacagccacgtccaagttcttcacctctatccaaaggacttgatttgcatggtattggataaaccatttcagcatcatctccaccacatgcctggcccttgctcccttcagcactagaacatcaagttggctgaaaaaaaaaatgggtctgggccctcagaaccctgccctgtatctttgtacagcatctgtgccatggattttgttttccttggggtattcttgatgtgaagataatttgcatactctattgtactatttggagttaaattctcactttgggggagggggagcaaagccaagcaaaccaatggtgatcctctattttgtgatgatcctgctgtgacattaggtttgaaacttttttttttttttgaagcagcagtcctaggtattaactggagcatgtgtcagagtgttgttccgttaattttgtaaatactgctcgactgtaactctcacatgtgacaaaatacggtttgtttggttgggttttttgttgtttttgaaaaaaaaattttttttttgcccgtccctttggtttcaaaagtttcacgtcttggtgcctttgtgtgacacaccttgccgatggctggacatgtgcaatcgtgaggggacacgctcacctctagccttaagggggtaggagtgatgtttcaggggaggctttagagcacgatgaggaagagggctgagctgagctttggttctccagaatgtaagaagaaaaatttaaaacaaaaatctgaactctcaaaagtctatttttttaactgaaaatgtagatttatccatgttcgggagttggaatgctgcggttacctactgagtaggcggtgacttttgtatgctatgaacatgaagttcattattttgtggttttattttacttcgtacttgtgtttgcttaaacaaagtgacttgtttggcttataaacacattgaatgcgctttactgcccatgggatatgtggtgtgtatccttcagaaaaattaaaaggaaaataaagaaactaactggt

SEQ ID NO: 1747 - DNA, 1358 bp, Rattus norvegicus
  Genbank Accession No. NM_012559
agtgctggctgtaaggggctgggagcaccggtcacccagacactatgaattggtccttgcaactccggagtttcattctatgctgggcgcttttactactttctccaacgggcctggcacagtacactgctactagagataactgttgcatcctagatgagagattcggtagttactgcccaaccacttgtggcatctcagacttcctgaattcttaccaaaccgacgtggacactgacctccagactctggaaaacatcttacaacgagctgaaaacagaaccacagaagccaaggaactgattaaagccatccaggtttactacaacccggaccaacccccaaagccgggtatgatagagggtgccactcagaagtctaagaagatggtagaagaaatcttgaagtacgaagcactgttactaacccatgagtcgagtatccggtatttacaggacatctatacttcaaataagcagaagatcacgaacctgaaacagaaggtggcccagcttgaagctctgtgccaggagccttgcaaggactctgtgcgaatctatgacataaccggaaaagattgtcaggataccgccaacaagggtgccaaagaaagtggactttactccattcggcctttgaaagccacggagcagttcttagtgtactgtgaaaccgacggacctggaaatggctggaccgaattcaagaagaggcttgatggcagtgtggatttcttgaagaactggattcagtataaagaaggatttggacacctgtcacctactggcaccacagagttttggctgggcaatgagaagaatcatctgataagcatgcagtccaccatcccatacgcactgagaatacagctcaaagactggagtggcaggaccagcaccgcggactatgccatgttcagggtgggtcctgaatccgacaaataccgcctgacctatgcctacttcattggtggagatgccggggatgccttcgacggctacgattttggtgatgatcccagtgacaagtttttcacatcccacaacggcatgcacttcagtacctgggacaatgacaacgacaagttcgaaggcaactgtgctgagcaggatggatctggctggtggatgaacaagtgtcacgctggccacctcaatggagtttattaccaaggtggcacttactccaagtcatctactcctaacggttatgacaatggcattatttgggccacgtggaaaacccgctggtattccatgaaggaaaccaccatgaagataattcccttcaacagactctccattggagatgggcagcaacatcacatgggaggatccaaacaggttggagacatgtaa

SEQ ID NO: 1748 - DNA, 2326 bp, Rattus norvegicus
  Genbank Accession No. NM_012565
ctcagccagacagtcctcacctgcaacaggtggcctcaggagtcaggaacatctctacttccccaacgacccctgggttgtcctctcagagatggctatggatactacaaggtgtggagcccagttgttgactctggtcgagcagatcctggcagagttccagctgcaggaggaagacctgaagaaggtgatgagccggatgcagaaggagatggaccgtggcctgaggctggagacccacgaggaggccagtgtaaagatgttacccacctacgtgcgttccaccccagaaggctcagaagtcggagactttctctccttagacctgggaggaaccaacttcagagtgatgctggtcaaagtgggagagggggaggcagggcagtggagcgtgaagacaaaacaccagatgtactccatccccgaggacgccatgacgggcactgccgagatgctctttgactacatctctgaatgcatctctgacttccttgacaagcatcagatgaagcacaagaaactgcccctgggcttcaccttctccttccctgtgaggcacgaagacctagacaagggcatcctcctcaattggaccaagggcttcaaggcctctggagcagaagggaacaacatcgtaggacttctccgagatgctatcaagaggagaggggactttgagatggatgtggtggcaatggtgaacgacacagtggccacaatgatctcctgctactatgaagaccgccaatgtgaggtcggcatgattgtgggcactggctgcaatgcctgctacatggaggaaatgcagaatgtggagctggtggaaggggatgagggacgcatgtgcgtcaacacggagtggggcgccttcggggactcgggcgagctggatgagttcctactggagtatgaccggatggtggatgaaagctcagcgaaccccggtcagcagctgtacgagaagatcatcggtgggaagtatatgggcgagctggtacgacttgtgctgcttaagctggtggacgagaaccttctgttccacggagaggcctcggagcagctgcgcacgcgtggtgcttttgagacccgtttcgtgtcacaagtggagagcgactccggggaccgaaagcagatccacaacatcctaagcactctggggcttcgaccctctgtcaccgactgcgacattgtgcgccgtgcctgtgaaagcgtgtccactcgcgccgcccatatgtgctccgcaggactagctggggtcataaatcgcatgcgcgaaagccgcagtgaggacgtgatgcgcatcactgtgggcgtggatggctccgtgtacaagctgcacccgagcttcaaggagcggtttcacgccagtgtgcgcaggctgacacccaactgcgaaatcaccttcatcgaatcagaggagggcagcggcaggggagccgcgctggtctctgcggtggcctgcaagaaggcttgcatgctggcccagtgaaatccaggtcatatggaccgggacctgggttccacggggactccacacaccacaaatgctcccagcccaccggggcaggagacctattctgctgctacccctggaaaatggggagaggcccctgcaagccgagtcggccagtgggacagccctagggctctcagcctggggcagggggctgggaggaagaagaggatcagaggcgccaaggcctttcttgctagaatcaactacagaaaatggcggaaaatactcaggacttgcactttcacgattcttgcttcccaagcgtgggtctggcctcccaagggaatgcttcctggaccttgcaatggcctggcttccctgggggggacacaccttcatggggaggtaacttcagcagttcggccagaccagaccccaggagagtaagggctgctagtcacccagacctggctgttttcttgtctgtggctgaagaggccggggagccatgagagactgactatccggctacatggagaggactttccaggcatgaacatgccagagactgttgccttcatatacctccacccgagtggcttacagttctgggatgaaccctcccaggagatgccagaggttagagccccagagtccttgctctaaggggaccagaaaggggaggcctcactctgcactattcaagcaggaatcatctccaacactcaggtccctgacccaggaggaagaagccaccctcagtgtccctccaagagaccacccaggtccttctctccctcgttcccaaatgccagcctctctacctgggactgtgggggagtttttaattaaatatttaaaactacttca

SEQ ID NO: 1749 - DNA, 2768 bp, Rattus norvegicus
  Genbank Accession No. NM_012567
ggcttttacgaggtatcagcacttttctttcattggggggaaggcgtgaggaaagtaccaaacagcagcagacttttaaactttaaacagacaggtctgagagcctgaactctcatttttcctttgacttcagcctccaaggagttccaccaactttggcggcggcttcactttcattaagtgaaagagaggtgcccagacatgggtgactggagtgccttggggaagcttctggacaaggtccaagcctactccaccgctggagggaaggtgtggctgtcagtgctcttcatattcagaatcctgctcctggggacagctgttgagtcagcttggggtgatgaacagtctgcctttcgctgtaacactcaacaacctggctgcgaaaacgtctgctatgacaagtccttccccatctctcacgtgcgcttctgggtccttcagatcatattcgtgtctgtgcccaccctcctgtacttggcccatgtgttctatgtgatgaggaaggaagagaagctaaacaagaaagaagaggagctcaaagtggcccagactgacggggtcaacgtggagatgcacctgaagcagattgaaatcaagaagttcaagtacgggattgaagagcacggcaaggtgaaaatgaggggcggcttgctgagaacctacatcatcagcatcctcttcaagtctgtcttcgaggtggccttcctgctcatccagtggtacatctatgggttcagcttgagcgcggtctacacctgcaagagagatccctgcccccaccaggtagactgcttcctctcacgtcccacggagaaaaccatcttcatcatcttcatgctggtggtgtccttggtgtctctcgctttgaacatcattgagctcttctacgtcttcttcaaaggcgttaaggatcgcgtgaagggaagaagcgatccttaccacgccaccactggcccactgagcccatcaaaagactgcggatctccaaaatacgcctacttcaatggctgctcctcaccaacggctccactctcgcctatgtctcctcctgggtacaagctggttactggtgacagaaacaattcctcgtgccgcaattacaacaagcaagctagcgagcaaaactgggcgaactacagcgcagagcaaaatcgcatggggcaggccggaagcaccatctccaactcgcacgcccagccgttcgatttccccgacgacaaccagaatgccaaaaaagttgctgctggacatgaactccagccattagccatcgtggaccaacgaccttccagcagagccagcagccgcgccagcagcaggcctcggcctgatgacctggagatttaaaccggcttgagcatcgagctgtcgattatggaggagaaaaaaaggtgcttgcagaacatgcacctagggtgttcattttcgttcccgtggagttggtactcaacaacctcagcaatgaggccatagaaaacaaagacattacaatacctaggttccttgggggtgcttgggatagctgggcgaacaggtggggataagggaggtacacattgatatttaatgtagaagattcaaagaacttaaattctagtaagagtcgcattgggtgaacatagataagggctttctctctctgcccccatcccccaactgaaccttaagaatgagtctgtgtattgtgtgtgtttgtgtgtgtgtgtgattattcatcagtcactgagcattaaactttcctgtcttgactattataaaagatgtacacttgagaatgtggatatctctttgagatcctgatttcaactcttttctgaaagtattgaaatgtaatgtcactcagtcatgtgtcagctctggttttactttttgaaagacttttataatccctggcctaggattgcaccattttatgttacgttcaacagagcactgaagtccaatctcaccgtcaataccttactaatacacatgtttactttctaagcatttgattttacttaacacagagagagagagagacagagagagagacagacagagagagagagagagagagagagagagagagagagagagatgcacatacatgtatctatgaagtccagaagagggggtaggatctcctggagctggagttacatgtgtttctgagctgctcagtttaaatgctggaacagaacccaggtcctctgtgagggcagaatggctcttaatctctgagtcctctctccagcccccacttctttcctttcatactagctgtgctgacgagcatgaagtaatactttcttggagccgtgtagctgtggattatgctaatttagtaagtgatggtttgtggttctctcacatccatgagttcactaaccctgaatagttagctaggttttcagtaggaagcctggtttccattttgttgagtggatttcaagtcccattaggagctattggttacaccaaccatgccattgctacaccctaacagttactgcaccagatcaacaacgaaaagcaggtttctcattcctgaaattgaaggattttgttaggtgatctttgactcttgatcattgtcagcccagataagaagattttatttaaactacatatgaatatttatacacacaattattcttattatactttttatttataattgcttatatttatttataagtttttatttacatttgtggttaatagaatgattccttataaccttttcagatatccttattgttaatttacctccatcctcttcc

SEQ ID NO: 1750 - DNA, 1779 bp, Rattus norvegicus
  Genbank Accession No. NM_012578
ccggagcaggccggccaccatgaccgagaactccacctccaccccggcggcgaagcccaagcgggccaaggccgccaagaagtccacggaccaccccaagtattcagacatgatcgtggctgccatccaggcagagaagaaccgcgccggctcctcgcgccagtccatccaaaagtatatcaagagccactacaaggtgggtgagaacgccgactcccagatcaagttgtccatcaagcgcctagtgaccaccggtgttctcaagcaaaccaaaggggtgggcgcctcggggtccttcaggctggccaagggcgatgagcccaagaggtcggtggctttcaagaagaccaagaaggaagtcaagaaagtggccactccaaagaaggcagccaagcccaagaaggctgcttccaaagccccaagcaagaaacccaaagccaccccggtcaagaaggccaagaagaagccggctgccacgcccaagaaagccaaaaagcccaagattgtcaaagtcaagccagtcaaggcatccaaacccaagaaggccaaacccgtgaagcccaaagccaagtcgagtgccaagagagccagcaagaagaaatgacaatgaaggctttgcttggggacactccttcctccctcctgttttctgtaaatacatttctctcttgatcccatctgcaaccctttgcccattctatttggactctatatagaggacagagtttggcttcctcagacagactttgtggaatattttccttaacccattgttcaaggacagcaaacagacctcatctttataatgatggagatgtacttttttcttgatttgatattaaccttatggggttgtgggggggggcgttgtgtgtttccttcggtggtttgtttactatgaaggtaaatggaactggcaaagttctgggtaggtgaggacccaggaactaggttgcttgtccctagtgagcgtttcagaacctttgatgagcaggtgatacccatctacctggccaaggggggttgttggggagaagagaataaactccctgggctgccctaccaatggtggtaagttgggggacctgatttctttttctcttctgccctagtgcctctccaagtgacagctggttagagaagccatagcttctcacaaccgggatttagccattgggaaggaagggtcttctcagcagtctccggttaaatgggagtggacttaggggaggggtgcagagtcagccaagtgcctcagtgtgtctatggaaacttgggtctttccacacggttgatggattgtgtcctaggaggacgttgttcgtttcctttcccctcttcctgtgtaagatgtggcattgcttggtgccacttcagttctaccagcggccacttaaaacccctccaagcttttgagtcttttctaagtagccgaggagggggagaggcagggagtggactgtgggatatactcccgtggattcgaatttgcctaggtagctttagagaagcggattgtgtgcatgtgtgtatatgtatatatccatatctaagactagtacttagtctcacctcgggagctgggagaaaaactctgtacagttgtcctcttattttaataaagtaggaaactcgggtaccctaccccactttttaaacaagtgtaactagtgccgggaaaaaattactgtggttgtaattttaaaactttaaaataaaactggaaaggaaaaaaaaaaaaaaaaaaaaaaaaaaaaaaaaaaaaaaaaaaaaaaaaaa

SEQ ID NO: 1751 - DNA, 870 bp, Rattus norvegicus
  Genbank Accession No. NM_012580
atggagcgcccacagctcgacagcatgtcccaggatttgtccgaggccttgaaggaggccaccaaggaggtgcacatccgtgcagagaattctgagttcatgaggaactttcagaagggtcaggtgtccagggaaggctttaagctggtgatggcctccttgtaccatatctatacggccctggaagaggagatagagcgaaacaagcagaacccagtctatgccccgctctacttccctgaggagctgcaccgaagggctgccctagagcaggacatggccttctggtatgggccccactggcaggaggccatcccttacacaccagccacacagcactacgtaaagcgtctccacgaggtgggaggtactcatcctgagctgctggtggcccacgcatatacccgctacctgggtgacctctcagggggtcaggtcctgaagaagattgcgcagaaggccatggccttgccaagctctggggaaggcctggcttttttcaccttcccgagcatcgacaaccccaccaagttcaaacagctctatcgtgctcgcatgaacactctggagatgacccccgaggtcaagcacagggtgacagaagaggctaagaccgccttcctgctcaacattgagctgtttgaggagctgcaggcactgctgacagaggaacacaaagaccagagtccctcacagacagagtttcttcgccagaggcctgctagcctggttcaagatactacctctgcagagacgccccgaggaaaatcccagatcagcactagttcatcccagacaccgctcctgcgatgggtcctcacactcagtttcctgttggcgaccgtggcagtgggaatttatgccatgtaa

SEQ ID NO: 1752 - DNA, 1576 bp, Rattus norvegicus
  Genbank Accession No. NM_012581
ttaattctcggagacaaggttgaaattggaccgaattggctgtaatcagtgaaccagaaaaaaaacaccccagcagcgatcttctatgatagatttttttttccttcgctctcgcctttttcctgggccttgcccccccaaagcccctccaaaagagggaacttttcctccgagagggctccaaggagaaggccatgaattacgaatttgagcgagagattggttttatcaatagccagccgtcgctcgctgagtgcctgacatcttttccccctgtcgctgatacatttcaaagttcatcaatcaagacctcgacgctttcacactcgacactgattcctcctccttttgagcagaccattcccagcctgaacccgggcagtcaccctcgccaaagcgctggcgctggcggccgccccaagtcgagccccgcgggcagtcgcggcagcccggtgcccgcccgcgccctgcagccgcctgagtacccctggatgaaggagaagaaggcggccaagaaaaccgcgctgccgcccgccgccgcctccacgggccctgcctgcctcggccacaaagaatccctggaaatagccgatggcagcggtgggggatccaggcgtctgagaactgcttacaccaacactcagcttttggaactggaaaaggaatttcatttcaacaagtacctctgcagaccccggagggtggaaatcgccgcgctgctggatttgaccgagagacaagtgaaagtgtggtttcagaaccggaggatgaagcataagaggcaaacccagtgcaaggagaaccaaaacagcgaagggaaatttaaaaacctggaggattcggacaaagtggaggaagacgaggaagagaagtcactctttgagcaagccctcagtgtctccggggcccttctggagagggaaggttacacttttcagcaaaacgcgctctctcaacagcaggctcccaatggacacaatggcgactcccaaactttcccagtttcgcctttaaccagcaatgagaaaaatttgaaacattttcagcaccagtcacccactgttcctaactgcttgtcaacaatgggccagaactgtggagctggcctaaacaatgacagtcccgaggccctcgaggtcccctctttgcaggactttaatgttttctccacagattcctgcctgcagctttcagacgcactgtcgcccagtttgccaggctccctgggcagtcctgtagatatttcagctgacagctttgacttttttacagacacactcaccacaatcgacctacagcatctgaattactaagaacattaaagcaaaagaaagcttcacaaaacaaaacgcctttggccaggtgctttgccttcttttattccgggagttgattttcgttctattctcttctcgatctacccctgttctcttaaatgttcaggactttctgttttacacccagtttgaaagccatctcttccaaatgatgttggcgttctaagtgttttacaccgaacccaacaagcttctatgtgattttcctgaaaacaaaacacgaggcctgcaagaaagtg

SEQ ID NO: 1753 - DNA, 1269 bp, Rattus norvegicus
  Genbank Accession No. NM_012585
atggatgtgttcagttttggccagggcaacaacaccacagcgtcccaggagccctttgggaccggcggcaacgttactagcatctccgacgtgaccttcagctaccaagtgatcacctctctgttgctgggtactctcattttctgcgcggtgctcggcaatgcctgcgtggttgctgccatcgccctggagcgctccctccagaatgtggccaactatctcatcggctccttggcggttactgatctcatggtatcagtgctggtgctgcccatggctgctctgtaccaggtgctcaacaagtggaccctgggccaggtcacctgcgacctgtttatcgccctggatgtactgtgctgcacctcgtccatcctgcacctgtgcgccatcgcgctagacaggtactgggctatcaccgaccctatagactatgtgaacaaaaggacgccccggcgcgccgctgcgctgatctcgctcacttggctcattggctttctcatctccatcccgcccatgctgggctggcgcaccccggaagaccgatcggaccccgacgcgtgcaccatcagcaaggaccacggctacaccatctactccactttcggcgctttctatatcccgctgttgctcatgctggttctctacgggcgcatcttcagagccgcacgcttccgaatccgcaagactgtcaggaaggtggaaaagaagggagcaggcaccagcttaggaacttcgtcggcaccgccccccaagaagagcctgaacggacagccaggtagtggggactggaggcgctgtgctgagaacagggcggtggggactccgtgcactaatggggcagtgaggcagggtgacgacgaggccaccctggaggtgatcgaggtgcaccgagtgggcaactccaaagagcaccttcctctgcccagcgagtcaggatctaactcctatgcccccgcctgcttggagagaaaaaatgagcgcaatgctgaagcaaagcgcaagatggccttggcccgtgaaaggaagacggtgaagactctgggcatcatcatgggcaccttcatcctctgctggctgccgtttttcattgtggctctggtcctgcctttctgtgaaagcagctgccacatgcctgcgttgttgggtgccataattaactggctaggctactccaactccctgctcaatccggttatttatgcttatttcaacaaagactttcaaaacgcttttaagaagataatcaagtgcaagttctgccgccgatga

SEQ ID NO: 1754 - DNA, 2352 bp, Rattus norvegicus
  Genbank Accession No. NM_012588
gggagcagcgagcaagcaggtcctcagcgtccagtcaccgctctaagccaggcgccatgcatcccgcgcgccccgcgctctgggcggctgcgctcaccgccctcactctgctccgcggaccgccagtggcgcgggccggcgcgggcgcggtgggcgcgggccccgtggtgcgctgcgaaccgtgcgacgcgcgtgcgctggcccagtgcgcgcctccgcccaccgcgcccgcgtgcacggagctggtgcgagaacccggctgcggctgctgcctgacttgcgcgctgcgcgaaggcgacgcgtgcggcgtctacacggagcgctgtggcaccggcctccgctgccagccgcgaccggccgagcagtatcccctgaaggcgctgctgaatggccgcgggttctgcgccaacgccagcgccgccagcaacctgagtgcctacctcccctcccagccgtctcctggaaacaccactgagtctgaggaggaccacaatgctgggagtgtggaaagccaggttgtccccagcacacatcgcgtgactgattccaagttccatccactccattcaaagatggaggtcatcataaaaggccaggctagggacagccagcgctacaaagttgactatgagtcccagagcacagacacccagaacttctcctccgagtctaagcgggagacagaatatggtccctgccgcagagaaatggaggacacactgaatcatctgaagttcctcaatgtgctgagtcccaggggcgtccacatcccaaactgtgacaagaaggggttctataagaagaaacagtgtcgcccttccaaaggcagaaagcggggcttctgctggtgcgtggacaagtacgggcagccattgccaggctatgacaccaaggggaaagacgacgtgcattgcctcagcgtgcagagccagtagataccgctgtgccacttaacgtggagctcaaatacgccttattttgcacaaaagactgccaacaacgtgatcagcagctggctataccttgatttatatttctctctctctctctctctctctctctctctctctctctctcttttgtggtgaactgaataaaaacaaacaaaacacatacaaaaacaaaaacaaaaaaaaaagccaagtttagacagatttctgaaatgcctctggttgtttaaatagtgaacttggtcatctttgtatctcgcagtagtcaaccaaaagcagtttgaattttcttgttgcttcctatgaaaaccacacgtgtactccaggccacggatgccgtcgccccctaactcacccacccactgtgggcttcagtgctgctggccctctgccttcttgatttcagaggctctgttgctgatagagaaaaaccctctttccatcccctgtaagtaagtgcaggcactgtggagaatggggaagcctggaacccagtgacccggacgtctggaagcatcctcctgaggcctctggtccttattgtgccatctctgaatcaagggcctggccctgtatctgcaagtggcctgacctacttgggaactgtgggagagaaaaatgtgttgtctctcttactaaaaatgactaagaatgttctagggcgctccgagagcccataaagacaaggacaaggaccttcctttgtcaggcagcttcctgatgacttggcccagcagaaatatcaaactccatgtgcagagatgtcgcaaataacggtgcgcttagttctccggatgacttcaagaaaacagtgttttctggcccagcctctcaaaataaaatttgttgtggggtggggctgaggggaggcagctttcaaaagagagaaggttttcatcttccttgttggagaccctggtaagaacatggagagaatcacctgtttgttgatcttggggtccttctcaaactttctttataattcatgcgtatatgcagacaaaatatgttcttaattgttaacattgtatacaacatagcccaaatatattagaatctgtactagataatcctagataaaaggttagagatgctaggtgatgtaaccacagacacgcccgaggaaaggagcctgtgtctggaggctgggccgctttccccgaggccaaggccatggtggtctggcaatacagggtgtgaggagactgtactgcatcccacggggtggacatgcgctgtacagagctttccttgagagcacaaaggaatcttgagacattctgcctgcctgtcagcttttctttatttttttaattaagtttttgggggaaaaatgtatttttgaaaagtttgtcttgcaatgtatttataaatagtaaataaagtttttttactatttaag

SEQ ID NO: 1755 - DNA, 1046 bp, Rattus norvegicus
  Genbank Accession No. NM_012589
agctcattctgtctcgagcccaccaggaacgaaagtcaactccatctgcccttcaggaacagctatgaagtttctctccgcaagagacttccagccagttgccttcttgggactgatgttgttgacagccactgccttccctacttcacaagtccggagaggagacttcacagaggataccacccacaacagaccagtatataccacttcacaagtcggaggcttaattacatatgttctcagggagatcttggaaatgagaaaagagttgtgcaatggcaattctgattgtatgaacagcgatgatgcactgtcagaaaacaatctgaaacttccagaaatacaaagaaatgatggatgcttccaaactggatataaccaggaaatttgcctattgaaaatctgctctggtcttctggagttccgtttctacctggagtttgtgaagaacaacttacaagataacaagaaagacaaagccagagtcattcagagcaatactgaaaccctagttcatatcttcaaacaagagataaaagactcatataaaatagtccttcctaccccaacttccaatgctctcctaatggagaagttagagtcacagaaggagtggctaaggaccaagaccatccaactcatcttgaaagcacttgaagaatttctaaaggtcactatgaggtctactcggcaaacctagtgtgctatgcctaagcatatcagtttgtggacattcctcactgtggtcagaaaatatatcctgtcgatgggtatctaaattatgttgttctctacgaagaactggcaatatgaatgttgaaacactattttaattatttttaatttattgataatttaaataagtaaactataagttaatttatgattgatatttatactttttatgaagtgtcacttgaaatattatgttatagttttgaaaagataatataaaaatctatttgatatgaatattctcttacctagccagatggtttcttgcaatatataagtttacctcaatgaattgctaatttaaatttttt

SEQ ID NO: 1756 - DNA, 2104 bp, Rattus norvegicus
  Genbank Accession No. NM_012592
tggtatacagcggagatggcgactgcagtccggctgctggggcggcgagtttccagttggagactgcggcctttaccgtcgccccttgctgtcccgcagcgggcccactcgatgttgcctgtggatgatgatatcaacgggctaaacgaggagcagaagcagcttcgtcatacgatatctaagttcgttcaagagaacctggcccccaaggcccaagagattgatcaaagcaatgacttcaagaacctgagagagttctggaagcagctgggaagcctgggagtcctgggcatcacagcccccgttcagtatggtggctctggcctgggctacctagaacatgtgttggtgatggaagagatatcccgggcttcagcagctgtggggctcagctatggcgctcactccaacctctgcatcaaccagattgtccgcaatgggaatgaggcacagaaagagaaatatcttcccaagctcatcagtggtgagttcatcggagccctggccatgagtgagcccaacgctggctctgacgttgtctccatgaggctgaaagcagagaagaaaggagatcactacgttctgaatggcaacaagttctggatcaccaatggccctgacgctgatgtcctagttgtctatgccaagacagacttgactgctgtgcctgcgtctcggggcatcacagccttcattgtggaaaaggatatgcctggtttcagcacctcgaagaagctggacaagctaggcatgaggggctccaacacctgtgagctagtctttgaagactgcaaggttcctgctgctaacatcctgagccaagagagtaagggtgtctacgtactgatgagcgggctggacctagaacgcctggtgctggcaggtggaccccttgggatcatgcaggctgtcctggaccacaccattccctatttgcatgtgagggaagcctttggccagaagatcggccaattccagctgatgcagggaaagatggctgacatgtacacccgcctcatggcatgtcgacagtatgtctacaatgtcgccagggcctgtgacgagggccacatcactgccaaggactgtgctggtgtgattctgtatacagccgagtgtgccacacaagtagccctggatggcattcaatgtttaggtggaaatggctacatcaatgacttccccatgggccgctttcttcgagatgccaaactgtacgagatcggaggtgggaccagtgaggtgaggcggctagtcattggcagagctttcaacgcagacttccgctagcctggggccatcaccctgctcccagcagcaggaggcctttggaagcagagacgtggcagccctctgacttggctaaggaagctctgctgctcaactgccctcttgccagccctctgctcttcgtgaagtcggattctccagccgtgccagccagtcaatcaagaaagcctaaaattcggtccccagctccgaaaaaaaaaaaaaaaaaaaagaaccaaaagaaagcctaaaatggctgctaaaaggactttggcttttctggggtttgcagggagggtaacagtgtctgcgcccttgttctctacttctgaatgtagtaacctcaccctctggggtagcatatgacaggtacccaactccttttcgtgggcaagcctctggcaggggagctctttctgttgcaatgtaacagaggcattgcctctttcaattgtcagatacttgtggtctcttttcttgaggaaaaggcaaaaaccatgtccttcttagctgtttccccaagagctagctagacagttccagaatgcctgtgtggcagacccatgaagggcagagtccacagtctagccaagacaacttggagattggctccctggtgtggctgagtgtctacatcactccgtcacaggctagcactgggcctgctcacgtgaccttctgcagctgcctgactccggtggcccagcttaggttgcctggctcaactccagccttgctgtctatgtatatttctctagacgccctgtggctaattttgttacaaccacacaggctctgctgccattttgtattaaacatactgcaaagtaaaaaa

SEQ ID NO: 1757 - DNA, 1217 bp, Rattus norvegicus
  Genbank Accession No. NM_012595
cagagcctcctcttgtctggacaagatggcaacccttaaggaaaagctcattgcgccagtcgcagacgacgagactgccgtcccgaacaacaagattactgtagtaggcgttggacaagttggaatggcttgtgctatcagcattctggggaagtctctggctgatgagcttgccctggtggatgtcttggaagacaagctcaaaggagaaatgatggatctgcagcacgggagcttatttctccagactccgaaaatcgtggctgataaagattactccgtgacagccaattctaagattgtggtggtgaccgcgggagtccgccagcaggagggggagagtcggctcaacctggtgcagagaaacgtcaatgtattcaagttcattattcctcagatcgtcaagtacagccccgactgcaccatcatcgtggtttccaacccagtggatattcttacctatgtcacctggaagctgagcgggctacctaagcaccgcgtgattggaagtggatgcaatctggattctgctcggtttcgttacctcatggccgaaaagcttggtattcatcccagcagctgccacggctggatcctgggcgagcacggggactccagtgtggcagtgtggagcggggtgaatgtggcaggagtctccctccaggaactgaacccagagatgggaacggacaatgacagcgagaactggaaggaggtgcataagatggtggtggacagtgcctatgaagtcatcaagctaaaaggctacaccaactgggccatcggcctaagtgtggctgacctcatcgaatccatgctgaaaaacctctctcggattcaccccgtgtctacaatggtgaagggaatgtacggcatcgagaacgaagtcttcctcagtctcccgtgcatccttaatgctcggggactgaccagcgtcatcaaccagaagctgaaggacgatgaggtcgctcagctcaggaagagtgcggacaccctgtgggatatccagaaagacctcaaggacctgtgactgccaggcgccaggctgtagaaatccaaacctccaatgtgactaagtgaacctttagtcttcggccttgtacgtaggtcacagtttgcttcttccctaacatgtgataatgagctcacagatcaaaaccaggagtgtttgatgtttgcactaggagctcctgaacaaataaagtttagcaattgca

SEQ ID NO: 1758 - DNA, 3617 bp, Rattus norvegicus
  Genbank Accession No. NM_012598
ttctgccccttgtagctgttctgccctcccctttaaaggttgacttgccccgcggcgctccaccgcgctctagtcctctgacgcctccggctcaaccctttgcaacgcggatccccgcccgcctgactgcccgcgcagcgcagttccagcagcaaagcagaagggcgcgccgagatggagagcaaagccctgctcctggtggccctgggagtttggctccagagtttgaccgccttccgcggaggggtggccgcagcagacgggggaagagatttctcagacatcgaaagtaaatttgccctaaggacccctgaagacacagctgaggacacttgtcatctgattcctggattagcagactctgtgtctaactgccacttcaaccacagcagcaaaacctttgtggtgatccatggatggacggtgacaggaatgtatgagagttgggtgcccaaacttgtggctgccctatacaaaagagaacctgactccaatgtcattgtagtagactggttgtatcgggcccagcaacattatccagtgtctgccggctataccaagctggtgggaaatgatgtggccaggttcatcaactggctggaggaagaatttaactaccccctagacaatgtccacctcttagggtacagtcttggagcccatgctgctggcgtggcaggaagtctgaccaacaagaaggtcaatagaattactggcttggatccagctgggcctaactttgagtatgcagaagcccctagtcgcctttctcctgatgatgcggatttcgtagatgtcttacacacatttaccagggggtcgcctggtcgaagtattgggatccagaaaccagtagggcatgttgatatttatcccaatggaggcactttccagccaggatgcaacattggagaagccattcgtgtaattgcagagaaggggcttggagatgtggaccagctggtgaagtgctcgcacgagcgctccatccatctcttcattgactccctgctgaatgaagaaaaccccagcaaggcatacaggtgcaattccaaggaggcctttgagaaagggctctgcctgagttgcagaaagaatcgctgtaacaacgtgggctatgagatcaacaaggtcagagccaagagaagcagtaagatgtacctgaagactcgctctcagatgccctacaaagtattccattaccaagtcaagattcacttttctggaactgagaatgacaagcaaaacaaccaggccttcgagatttctctgtatggcacagtggctgaaagtgagaacattcccttcaccctgccggaggtcgccacaaataaaacctactccttcttgatttacacggaggtggacatcggggaattgctgatgatgaagcttaagtggaagaacgactcctacttccgctggtcagactggtggagcagtcccagctttgtcatcgagaagatccgagtgaaagccggagagactcagaaaaaggtcatcttctgtgccagggagaaagtttctcatctgcagaaaggaaaggacgctgcagtgtttgtgaaatgccatgacaagtctctgaagaagtcgggctgacactggacaaaccaacaagagaagaaagcatctgagttctttgaagaccgaagaaaatgaagtaaattttatttaaaaaaaatacccttgtttgggtgtttgaaagtggattttcctgagtattaatcccagctatatcttgttagttaaatagaagacagtgtcaaatattaaaaggtggctaacacaacgtgaggaacctaatggccgatagcatgtcctccagcatcagaagacagcagagaggagaagcatgccatcttatatcccttaagaaggaatcatttgttcccaaccatacaagactccttcatgtgacccatttggtcatggtctaaaattagtaagggcctcttattttcattagatctctgaggttttaaattgagaccttctcaaagttctcttgaagtctaatatagacaacatttttttgtgctgtgagtcagatccatttctttagcagttgaaacagctggccattgtaactagttcttttaccatcaggatatagcacccctaccaaataaaataaataaataaagtgaccagggacatgtgactttgcaaaagcaatggacgacgtggctcgtggattcctgacccttagtcccaccacaacgaagtacaagtcagtagaggtacaaaacctagactgagtaattcttagtagacttcaagttttatggcttaattcctctgtcttttaaaaacgtgtcacatattataacattattctctagacagatgttgaaatgagcttgtgattcaggtgacatatgaattgagctgagagaaaataatgccctggctgattttatttctctgttttgctttcttgagaaaaggaatacttgtcccactccgtatctgagcctgaccaagaactaaactatgtacttcaggcttaccttgaactctcaaccatcctgccttggcttcctgagtgctgggagcttgataaccataattttattatcagatttttcttagtcattttcaccaatagaacacattcaatgcccaatcgttagcatttcgtttgagactcatcttgaccgtacctctgtcacacgtctaacacatcacattaatttctagtttagaagtgatcaagttcaaattctgcactgcgcaaagtacaagttttagagcaggaccattttttttttaccacgtaaaagtcgaaattactaggaaatgtgtatatcgatgcttgtacactgttgcgtgcaaagtgaggagccttctattgtgatagccatagacagtaccaggctcgttgccgctcttttgttttactataaaaaaataatgaagaattatttatgaacaagatctcatatgttcagattgcttttactattcatcaatataaaatgttaaaaaaaaaaaataaaacaagttctatctcagaggctgttgctgggaacagaaactgtgaaatgtgtgggtatctgaacacctacacacaagcaaagccccacaagagtctttgtcattcaatgtcattcagaaaggaaagagtcaagagatataccataatatgtcagagaagtagttccagatatgctggaatgctagcccttgctaggagaaagttggttgtgcctatgtaatataggacaaaagtgactggtttcattaggctcagtgtcattctaacaataaaatgatgtaccatatgtcaccagcatccccattattgctaattcatggcagtatatacgtacatatctcaatgatgctttgactttaaattttatttattagctgtaaataatgtgtgggtgtgtaaggaagcttgtaaacactggaaacgctgttgtggctatctggggtgtagatttgtggtgctaactctgtgtccacctccatcagtgattgtctcactgagccaactcactctgatgaacagcacaatggaatagcttttgaaggaagaaaataaactcacctgtgtgaagaaatgggatctgctttcaataaaatcgagaacgttttatccggaatccgcg

SEQ ID NO: 1759 - DNA, 2168 bp, Rattus norvegicus
  Genbank Accession No. NM_012603
actcgctgtagtaattccagcgagagacagagggagtgagcgggcgggttggaagagcccagtgtgcagagccccactccgggcttcctaggaaggcagctctggagtgagaagggctttgcctccaggcttgctgcctcctcgacccaatcctcccgctgacccaacatcagcggtcgcaaccctcgccgcctctgggaaactttgcccattgcaacgggcagacacttctcactggaacttacaatctgcgagccaggacaggactccccaggcgcaggggagggaatttttgtctatttggggacagtgttctctgcctctgcccgcgatcggctcccctgaaaagagctcctcgcgttatttgaagcctgaatttcctttgggaggtggaaaacccgacagtcacgacgatgcccctcaacgtgagcttcgctaacaggaactatgacctcgactacgactcggtgcagccctatttcatctgcgacgaggaagagaatttctatcaccagcaacagcagagcgagctgcagccgcccgcacccagtgaggatatctggaagaaattcgagctgctgcccaccccgcccctgtcccccagccgccgctccgggctctgctctccgtcctatgtcgcggtcgctacgtccttctccccaagggaggacgatgacggtggcggtggcaacttctccaccgccgatcagctggagatgatgaccgagctacttggaggagacatggtgaatcagagcttcatctgcgatcctgacgatgagaccttcatcaagaacatcatcatccaggactgtatgtggagcggcttctcggccgctgccaaactggtctccgagaagctggcctcttaccaggctgcgcgcaaagacagcaccagcctgagccccgcccgcgggcacagcgtctgctccacctccagcctgtacctgcaggacctcaccgccgcagcgtccgagtgcatcgacccctcagtggtcttcccctacccgctcaacgacagcagctcgcccaaatcctgtacctcgtccgattccacggccttctcttcttcctcggactcgctgctgtcctccgagtcctccccacgggccacccctgagcccctagtgctgcatgaagagacaccgcccaccaccagcagcgactctgaagaagaacaagatgatgaggaagaaattgatgtggtgtctgtggaaaagaggcaaccccctgccaagaggtccgagtcagggtcatccccatcaagaggccacagcaaacctccacacagcccactggtcctcaagaggtgccatgtctctactcaccagcacaattatgcagcacccccctccacaaggaaggactatccagctgccaagagggccaagttggacagtggcagggtcctgaaacagatcagcaacaaccgcaaatgctccagccccaggtcctcagacaccgaggaaaacgacaagaggcggacacacaacgtcttggaacgtcagaggagaaacgagctgaagcgtagcttttttgccctgcgcgaccagatccctgagttggaaaacaacgaaaaggcccccaaggtagttatcctcaaaaaagccaccgcctacatcctgtccgttcaagcagatgagcacaaactcatctcagaaaaggacttactgaggaaacggcgagaacagttgaaacacaaactcgaacagcttcgaaactctggtgcataaactgaccggaagtgaggaggagctggaatctcgagtgtaaggagaacggttccttctgacagaacttggacttcaaaaaatgcatgctcaaagcctaacctcacaaccttggctggggctttgggacttcagccataatgttaactgcctcaaagttaaggcataaaagaacttttttttatgcttcccatcttctttctttttcctttaacagatttgtatttaattgttttttttaaaaaaatcttccggtgtacatagggcctttaaatgtaaataactttaataaaacgtttataacagttatacaagattttaagacatgtatgataaaccataattttttttatttaaagaccttttcatttttaaagttgatttttttctattgtttttagaaaaaataaaataattggaaaaaatataattgagcca

SEQ ID NO: 1760 - DNA, 9132 bp, Rattus norvegicus
  Genbank Accession No. NM_012609
gaacgctagctgcccgcactcctcagccgcttggctcgccgctgccctcacctccgcgccggccgcccgccctccggcggcgcccggacgccggcccacccggccctccgccgcccccgggtctcggggaggacatggccgcacacaggccggtggaatgggtccaggccgtggtcagccgcttcgacgagcagcttccaataaaaacaggacagcagaacacacataccaaagtcagcacggagcacaacaaggagtgtctgatcaacatttccaagtacaagttttctttggtcatcagtggactcaccaccattctaaagaatgttaacaatatgaggatatttggagaagctgctgaaaaaaatttgtatctctctcagttgatcatattggatacactggaaaaatgtcttgctgggcaaccaaaggacacaatgagattagatgaaacaatgctggtcaaacagttgctaccagaaatctgccattttcttcacacctgccgtgaaggaaaccaacatgcagccgaacttcggaattctgcttctggggttttattttctctcagctgcaacaacttcaatgcagtctttagtcgaatttctacaaggttacaggagttgactgtctgttcagaagacaatgttgatgttcatgatatagaattgttacagtatatcaatgtggattgtgcaaaattaaaacgactcctgaaggaaacagcatttaaatttaaagccctgaagaaggtggcacaattggcagttataaatagcctagaaaaggctttttggaactgggtggaaaattatccagatgaatttacaaagctataccaaattccacagacagatatggctgagtgtgcaggaaagctgtttgacttggtggatggttttgcagaaagcaccaaacgtaaagcagcagtttggccactacagatcattctcctcattctgtgtccagaaataatccaggacatatccagggatgtggtcgatgagaacaacacaaacaagaaactgtttctggacagtttacggaaagcacttgctggccatggcggaagcagacagctgactgaaagtgctgccatcgcttgtgtcaagttgtgtaaagcaagtacttacatcaactgggaagacaactctgtcattttcctactggttcagtccatggtggttgatctgaagaacctgctttttaatccaagtaaaccattctctagaggcagtcagcctgcagatgtggacctcatgattgactgtcttgtctcttgctttcggatcagccctcacaacaaccaacactttaagatctgtctggctcagaattcaccttctacatttcactatgtgttggtaaactcactccaccgcattatcaccaattctgcatgggattggtggcctaagattgacgctgtatattgtcactcagttgaacttcgaaatatgtttggtgaaacccttcataaagcagtgcaaggctgtggagcacacccagcattacggatggcaccaagtcttacctttaaggaaaaggtaacaagccttaagtttaaagaaaagcctacggacctagaggcaaggagctacaagtatcttcttttgtctatggtgaaactgattcatgcagacccaaagcttttgctttgtaatccaagaaaacagggccctgaaactcaaggtagtacagcagaactgattacagggctcgtacagctggttcctcagtcacacatgccagaggtcgctcaggaggctatggaggctttgttggttcttcatcagttagacagcattgatctgtggaatcctgatgctcctgtagaaacgttttgggaaattagttcacaaatgcttttttacatctgcaagaaattaactagtcatcaaatgcttagtagcacagaaattctcaagtggttacgggaaattctgatctgcaggaataaatttcttcttaaaaataagcaggcagatagaagttcctgtcattctctctacctttatggagtaggatgtgacctgcctgctagtggaaatgtcactcagatgtcagttgatcatgaggagtcactacgtacctgtgctcctggagcctctctgcggaaaggaagagggaattcctccatggatagcacagcagggtgcagtggaaccccacctatatgccgacaagcccagaccaagctagaagtggccttgtacatgtttctgtggagtcctgacacggaagttgttctggttgctatgtcctgtttccgccacctctgtgaagaagcagacatccgatgtggtgtggatgaagtgtcagtacacaacttcttgcccaactacaacacattcatggaatttgcctcagtcagcaatatgttgtcaacaggaagagcggcacttcagaaaagagtgatggccctgctaaggcgcattgagcaccctactgcaggaaacactgaggcctgggaagatacacatgcaaagtgggaacaggctacaaaactaatccttaactacccaaaggccaaaatggaagatggccaggctgcagaaagtcttcataagaccattgttaagagacggatgtcccatgtcagtggaggaggatccatagacttgtctgacacagactccctgcaggaatggatcaacatgactggcttcctctgtgcccttggtggggtgtgcctgcaacagagaagcagctctggcctagcaacatacagcccacctatgggccctgtcagtgaacgcaaagggtctatgatttctgtaatgtcttctgaagggaatgttgattcacctgtcagcagatttatggaccggcttctgtccttgatggtgtgtaaccatgagaaagtggggcttcagatacggaccaatgttaaggacctggtgggtctggagctgagtcctgctctgtatccaatgctgttcaacaaactgaagagtgccatcagcaagttttttgactctcaaggacaggtattattaactgacagcaatactcagtttgtagagcaaaccatagctataatgaagaacctactggataatcatactgaaggcagctctgagcatctgggacaagctagcattgagacaatgatgctaaatctggtcagatatgttcgtgttcttgggaatatggttcatgcaattcaaataaaaacgaaattgtgtcagttagttgaagtcatgatggcaagaagagacgacctctcgttttgtcaagagatgaaatttcggaataagatggtggagtacctaacagactgggttatgggcacttcaaaccaagccgcagatgatgatgtaaagtgtctcacaagagatctagaccaagcaagcatggaggcagtagtctcgctcctcgctggtcttccactgcagcctgaagaaggagacggagtggagctgatggaggccaagtcacagctattccttaagtacttcacattatttatgaaccttttgaatgactgtagtgaagttgaagatgaaaatgcacaaacaggtggcaggaaacgtggcatgtctcggaggctggcatccctgaggcactgtacagtgcttgcaatgtcaaacttactcaatgctaatgtggacagtggactcatgcactccataggcttaggttatcataaagatcttcagacaagagctacatttatggaagttctgacaaaaatccttcaacaaggaacagaatttgatacacttgctgaaaccgtgttggcagatcggttcgagagacttgtggaactggtcacaatgatgggagaccagggagagctccctatagctatggctctggccaatgtggtcccttgttctcagtgggatgagctggctcgagttctggtcacgctgtttgattctcggcatttgctctaccagctgctctggaacatgttttctaaggaggtagagttggcagactccatgcagactctctttcgaggcaacagcttggccagtaagataatgacgttctgcttcaaggtgtacggtgctacttacctacaaaagctcttggaccccttgttacgaatcattatcacatcctccgattggcagcatgttagctttgaagtggatcctaccaggttagagccctctgagagccttgaggagaaccagaggaacctccttcagatgacagagaagttcttccatgccatcatcagttcttcctcagagttcccctcgcagcttcgaagtgtctgccattgtttgtaccaggtggttagccagcgcttccctcagaacagcatcggtgccgtcggaagtgccatgttcctgaggttcatcaaccctgccattgtctcaccgtatgaagcagggattttagataaaaagccaccacctagaattgaaaggggcttgaagttaatgtcaaaggtccttcagagcattgccaatcatgtactgttcacaaaggaagagcacatgaggccttttaatgattttgtgaaaagcaacttcgacttggcacggaggtttttcttagatatagcatcagattgtcccacaagtgacgcagtaaaccatagtctttccttcatcagtgatggcaatgtgctcgctttacatcggctgctttggaataatcaggagaaaattggccagtatctttccagcaacagggatcataaagctgttggaagacgacctttcgataagatggccacacttcttgcatatctgggtcctccggagcacaagcctgtggcagatacacactggtccagccttaaccttaccagttcaaagtttgaggaatttatgaccaggcatcaggttcatgagaaggaagagttcaaggccttgaaaacattaagcatcttctaccaagctggcacatccaaagctgggaatcctattttctattatgttgcacggaggttcaaaactggccaaatcaatggggatttgctgatataccatgtcttgctgactttaaagccatattatgcaaagccatatgaaattgtagtggaccttacccatactgggcctagcaatcgctttaaaacagacttcctctctaagtggtttgttgtttttcctggctttgcttatgacaacgtgtctgcagtctatatctataactgtaactcctgggtcagggagtacaccaaataccatgagcggctgctgactggcctcaagggcagcaaaaggctcattttcatcgactgtcctgggaagctggctgagcacatagagcacgagcaacagaagctccctgctgctaccttggcactggaagaggatctaaaggttttccacaatgcgctcaagctagctcacaaggacaccaaagtttctattaaggttggttctactgctgttcaggtaacctcagcagaaagaacaaaagtattggggcaatccgtctttctaaatgatatctactatgcttctgaaatcgaagagatctgcctagttgatgagaaccagttcactttaaccattgcaaaccaaggcacaccgctgacctttatgcaccaagagtgtgaagccattgttcagtctatcattcatatcaggacccgatgggaactgtcacagcctgactccatccctcagcataccaagattcgaccaaaagatgtccctggaacactgcttaatatcgcattactgaatttgggcagttcagaccctagtttacggtctgctgcctataacctcctgtgtgccttaacttgtacctttaatttaaagatcgaaggtcagttactagagacatcagggttatgcatccctgccaacaacaccctcttcattgtctctatcagtaaaacgcttgcagccaacgagccacacctcaccttagagtttttggaagagtgtatttctggatttagcaaatctagtattgaattgaaacacctttgtttggaatatatgaccccatggctgtcaaacctagtccgtttttgtaagcataacgatgacgccaaacgacaaagggttactgccatccttgataaactcataacaatgaccataaatgaaaagcagatgtacccttctattcaagcaaaaatatgggggagccttgggcagatcacagacctgctagatgttgtgcttgacagtttcatcaaaaccagtgctaccggagggttggggtctatcaaagctgaggtgatggcagacacagctgtggctttagcttctggaaatgtgaaactggtgtcaagtaaggttattggaaggatgtgtaaaataattgacaagacttgcttatctccaactccaactttagaacagcatcttatgtgggacgacattgccattttagcccgctatatgctgatgctgtccttcaacaactccctggatgtggccgctcatctcccctatctcttccatgttgtcaccttcttagtagccacaggtcctttgtcccttcgcgcttccacccacggattggtcattaatatcattcactctctgtgcacttgctcacagcttcattttagtgaagagaccaagcaagttttgaggctcagtctgacagagttctcgttacccaaattttacttactgtttggcatcagcaaagtcaagtcagctgctgtcattgccttccgttccagctaccgggaccggtcgttctctcctggctcctatgaaagggagacttttgctttgacgtccctggaaacagtcacagaagctttgttggagatcatggaggcatgtatgagagatattccaacatgcaagtggctggatcagtggacggaactggctcaaagatttgcatttcagtacaacccatccctgcagccaagagctcttgtggtgtttggctgtattagcaaacgtgtgtctcacgggcagataaagcagattatccgaatccttagcaaggcacttgaaagttgtttaaagggacctgacacttacaacagtcaagttctgatagaagccacagtgattgcactgaccaaactacagccacttcttaataaggactcaccactgcacaaagccctcttctgggttgctgtggctgtgctgcagctagatgaagtcaacttgtactcagctggcactgcacttctggaacagaatctgcataccttggatagtctccggatattcaatgacaagagtccggaagaggtatttatggcaatccggaatcctctggaatggcactgcaagcaaatggatcactttgttggactcaatttcaactctaattttaactttgcactagttggacacctcttaaaagggtacagacatccttcacctgccattgttgcaagaacagtcagaattttgcatacactactaactcttgttaacaaacatagaaattgtgacaaatttgaggtgaatacacagagtgtggcttacttagcagctctactcacagtgtctgaagaggttcgaagtcgctgtagcctcaagcataggaagtcccttcttcttactgatatctcaatggaaaatgttcctatggatacatatcccattcatcacggtgatcccagctctaggacactaaaggagactcagccatggtcctctcccagaggttcagaaggataccttgcagccacctacccagctgtaggccaaactagtccccgagccaggaaatccatgagcttggacatgggacagccttctcaggccaacacaaaaaaattgcttggaacaaggaaaagttttgatcacttgatatcagacacaaaggctcctaaaagacaagaaatggaatcagggattacaacacccccaaaaatgagaagagtggcagagaccgactatgaaatggaaacccaaaggatttcctcctcgcagcagcacccacatttacggaaagtctcagtgtctgaatctaatgttctattggacgaagaagtacttactgacccaaagatccaagcactgcttcttactgttctggctacactggtaaaatataccacagatgaatttgatcagcgaattctttatgaatatctagcagaggccagtgttgtgtttcccaaagtgtttcctcttgtgcacaatttgttggactctaagatcaataccctcttgtctttgtgccaagatccaaatttgttaaatccgatccatggaatcgtgcagagtgtggtgtaccatgaggaatcccctccacagtaccaaacatcatacctgcaaagtttcggttttaatggcttatggcggtttgcaggacccttttcaaagcaaacacaaatcccagactatgctgagctcattgttaaatttcttgatgccttgattgacacgtacttgcctggaattgatgaagaaaccagtgaggagtccctcctgacacccacatctccttaccctcctgcactgcagagccagcttagtatcactgccaaccttaacctctctaattctatgacctcacttgcaacttcccagcattccccaggaatcgacaaggagaacgttgaactctcccccaccactggccactgtaacagtggacggactcgccatggatccgcaagccaagtgcagaagcaaaggagtgctggcagtttcaaacgtaatagcattaagaagatcgtgtgaagctttctttctttcactcttcaaaccaacctaacatggcttctcactcatgactctcccccaccttgcactgctgcttcgtgtcttatgaacgcatctggtctgctgtgttgccagacggtcacctcttggagcattgcctaagtttaatgctgcttctctttgatgttttccttctactttggcatgtgtctggttgagcacttgttctgaggactgcagagaaagcaggaggtcaggaagcctgactgagagcgtggactgtgggcgtggatgaaccgtccagtgccgccactgctgccagccatgggccatacacagaagacgaccttctgtgttccggtcttacagagtgaagtggtcgtcttatttacacacttacaagttcgggggagaaataatattttaaccccagtgtatttaatcttctagctgtgggcttttttaccttatgaagttgaaggaaccacagaggccaagcctcagcgaagccacaggccaggggctgggggagggggacaaactagtattttgt

SEQ ID NO: 1761 - DNA, 3259 bp, Rattus norvegicus
  Genbank Accession No. NM_012610
cagctccggcgggcagcaggcgctggagcgcatcgcagttcagctcagcgcagcaccatcggtctgcggagcggactgagctagaagcggagcgctgacgccggaggcgtgcaatgaggagggcaggtgctgcctgcagcgccatggaccggctgcgcctgctgctgctgctgattctaggggtgtcctctggaggtgccaaggagacatgttccacaggcctgtacacccacagcggagagtgctgcaaagcctgcaacttgggcgaaggcgtggcccagccctgcggagccaaccagaccgtgtgtgaaccctgcctggacaatgttacattctccgatgtggtgagcgccactgagccgtgcaagccgtgcaccgagtgcctgggcctgcagagcatgtccgctccctgtgtggaggcagacgatgcagtgtgcagatgtgcctatggctactaccaggacgaggagactggccactgtgaggcttgcagcgtgtgcgaggtgggctcgggactcgtgttctcctgccaggacaaacagaacacagtgtgtgaagagtgcccagagggcacatactcagacgaagccaaccacgtggacccgtgcctaccctgcacggtgtgcgaggacactgagcgccagttacgcgagtgcacgccctgggctgatgctgaatgcgaagagatccctggtcgatggatcccaaggtctacgcccccggagggctccgacagcacagcgcccagcacccaggagcctgaggttcctccagagcaagaccttgtacccagtacagtggcggatatggtgaccactgtgatgggcagctcccagcctgtagtgacccgcggcaccaccgacaacctcattcctgtctattgctccatcttggctgctgtggtcgtgggccttgtggcctatattgctttcaagaggtggaacagctgcaaacaaaataaacaaggcgccaacagccgccccgtgaaccagacgcccccaccggagggagagaaactgcacagcgacagtggcatctctgtggacagccagagcctgcacgaccagcagacccatacgcagactgcctcaggccaggccctcaagggtgatggcaacctctacagtagcctgcccctgaccaagcgtgaggaggtagagaaactgctcaacggggatacctggcgacatctggcaggcgagctgggttaccagcctgaacatatagactcctttacccacgaggcctgcccagtgcgagccctgctggccagctggggtgcccaggacagtgcaacgcttgatgcccttttagccgccctgcgacgcatccagagagctgacattgtggagagtctatgcagcgagtccactgccacatccccagtgtgaactcacagactgggagcccctgtcctgtcccacattccgacgactgatgttctagccagcccccacagagctgccccctctccctcggggatggcccaacggtcagaacggagcatctctgtgcagggcctctgtgttcccactcctgactccgttgctgctcccgagggggcccttgcttctgaccaccctctcctcagcaagagagagagagaggaccacccgagcctgacttgctccatttccatctcaggcctttccttcctttctacacattagctgtgtcagatctgggggtttgacactaggagaagggagcgggggcacccctaagactcaggaggtactgaagaaccagagccatggactccacactgtgaaccggagaacaaggggcggggcattgtggtaggctagaccttccttagcccctcccttctcccctctggccaaagaagaggattacggacctatctgagctgaaagcaggtttggaacccagcccacacttctctctcacacacaggatggtaaaacccagagaaaggcagggactgacctaggccacccaaccacaggaagaacaaatgaaggctgatacactccgtttctgaatgagggcgtcaagtgtgcttgttgacagggatggcgtgactttcagggaaatatctggaagccatgtctgccccgccctcaaccacttccaggcccctacccaacccttgtgcagatgaactgtttgttcaagggctggtccattggtctattctgatggagtcaagctaagggctcaggcttatccataaggcatttgtggagagatgaatctgttagtgcgctcattcttggcataagcctgaagccaacacggcccttaatgtcagccctcggggtcaggaaccaaggactcccaccccacaatccaacactatactacattacacacacacacacacacacacacacacacacacacacacacacacagatatcttgcttttctccccatggctcttttggggctgagactagatcctgctgggagtcactgccagtgagagatccggaggggacagagctgagcttcatggggctgtcttcctcgcccccgggtctggcaggccaagaatgactgcatctgagctggtgtctgtcttccaatggcctgtgcgtggaggaaatgctcccactcctccccttcttgaagctgcccccagaagactacagtgcaaaagagcagactggtgtgagaacacaagaaaaagcagatgctggccctgcagtctgtggcagctttctcctcagcttcaaggcccctgcaaaggacggatttcctgagcacggccaggaaggggcaagagggttcggttcagtggcgctttctcccggctccttggcctgttctgttttgcttgctgttggaatgagtgggcaccccctctatttagcatgaaggagccccaggcagggtatgcacagactgaccaccatccctccccacccagggtccacccaacccggtgaagagaccaggagcattgtacgcatacgcgggtggtatttttatggaccccaatctgcaattcccagacacctgggaagtgggacattctttgtgtatttattttcctccccaggagctggggagtggtggggggctgcaggtacggtttagcatgtgtttggttctgggggtctctccagccttgttttgggccaagttggaacctctggccctccagctggtgactatgaactccagaccccttcgtgctccccgacgccttccccttgcatcctgtgtaaccatttcgttgggccctcccaaaacctacacataaaacatacaggaggaccattaaattggc

SEQ ID NO: 1762 - DNA, 4068 bp, Rattus norvegicus
  Genbank Accession No. NM_012613
actcctggggcaagcgcgagcgcacactcccctttccttgctggcgctccctctcccctcgctctctctctctagaccgtcctctccttccctcgctctccaccgactcccttcgggtgctgtgcttgctcccacctgctctgaagcgctctccgctctcggacgctcccaatttagcgctcctgctcgacggccgaaccgtcgcagcctccgcaggcagcgtgccctcggggttgcggcttcaacccaccccagcttcctccctcgctacgactcgggcgccctggacgttcgaccctcgccgctgagcccgaggatggcgagcagaccatggtgacagcgctgcccggtcgctgcactcgctgaggccatgccgggctcccgacgcgtccgtccgcgcctaagggcgctgctgctgctgccgccgcttctgctactccggggcggccacgcgagcgacctgaccgtggctgtggtgctgccgctgaccaacacctcgtacccgtggtcctgggcgcgtgtagggccggccgtggaactggctctcgcgcgggtgaaggctcggccggacttgctgccgggttggacggtccgcatggtgctgggcagcagtgagaacgcggcgggcgtctgctcggacaccgccgcaccgctggccgcggtggacctcaagtgggagcacagccccgcggtgttcctgggccccggctgcgtctactccgctgccccggtggggcgcttcaccgcgcactggcgggtgccgctgctgaccgccggcgccccggctctgggcatcggggtcaaggatgagtatgcgctaaccacccgcacaggacccagccatgtcaagctgggcgatttcgtgacggcgctgcatcgacggctgggctgggagcaccaggcgctggtgctctatgcagatcggctgggcgacgaccggccttgcttcttcatagtggaggggctgtacatgcgggtgcgtgaacgcctcaacatcacagtgaatcaccaggagttcgtcgagggcgacccggaccactaccccaagctactgcgggccgtgcggcgaaagggcagagttatctacatctgcagttctccggatgccttcaggaatctgatgcttctggccctgaacgctggcctgactggggaggactatgttttcttccacctggatgtgtttgggcaaagccttaagagtgctcagggccttgttccccagaaaccctgggaaagaggagatgggcaggacaggagtgcccgccaggcctttcaggctgccaaaattattacttacaaagagcctgataatcctgagtacttggaattcctgaagcagctgaaactcttggctgacaagaagttcaacttcaccgtggaggatggcctgaagaatatcatcccagcctccttccacgacgggctcctgctctatgtccaggcagtgacagagactctggcacaggggggaactgtcacagatggagagaacatcactcagcggatgtggaaccgaagcttccaaggtgtgacaggatacctgaaaattgatagaaacggagatcgggacaccgatttctctctctgggatatggatccagagacgggtgccttcagggttgtcctgaactataatggtacttcccaggagctaatggctgtgtcagaacacaaattatactggcctctgggatatccacctcctgacgtccctaaatgtggctttgacaatgaggacccagcctgcaaccaagaccacttttccacactggaggttctggctttggtgggcagcctctctctgattagctttctgattgtgtctttcttcatatacaggaagatgcagctggaaaaggagctggtctcagagttgtggcgggtgcgctgggaggacttgcagcccagcagcctggagaggcatcttcggagcgctggcagccggctgaccctgagtgggcgaggctccaattatggctccctgctaaccaccgagggccagttccaagtctttgccaagacagcatactataagggcaaccttgtggctgtgaaacgtgtgaaccggaaacgcattgagttgacacgaaaagtcctgtttgaacttaaacatatgcgggatgtgcagaatgagcacttgacaagatttgtgggtgcttgtaccgacccccccaacatctgtatcctcacagagtactgtccccgtggaagcctacaggacattctagagaatgagagtatcaccctggactggatgtttcggtactcgctcaccaatgacattgtcaagggaatgctctttctacacaatggggccatttgttcccatgggaacctcaagtcatccaactgtgtggtagacgggcgcttcgtgttaaagatcacagactacggtcttgagagcttcagagacccggagccagagcaaggacacaccctctttgccaaaaaattgtggacggcacctgagctcctgcgaatggcttcgccacctgcccgtggctcccaagctggggatgtgtacagctttggtatcatcctgcaggagattgccctaagaagtggggtcttctatgtggaaggtttggacctcagcccaaaagagatcattgagcgtgtgactcggggtgagcagcccccattccgaccctccatggatctgcagagccacctggaggaactggggcagctgatgcagcggtgctgggcagaggacccacaggagcggccaccctttcagcagattcgcctggcgctgcgcaagttcaacaaggagaacagcagcaacatcctggacaacctgctgtcacgcatggagcagtatgctaacaacctggaggaactggtagaggagagaacacaagcttatctggaggagaagcgcaaagctgaggccttgctttaccagattctgcctcactccgtggctgagcagctgaagagaggcgagacagtccaggctgaggcctttgatagtgttaccatctacttcagtgatattgtgggctttacagctctttcagcagaaagcacacccatgcaggtggtgactctgctcaatgatctgtacacctgttttgatgctgtcatagacaactttgatgtgtacaaggtggagaccattggtgatgcttacatggtggtgtcagggctcccagtgcggaatggacaactccacgcccgagaggtggcccgaatggcacttgcactactggatgctgtgcgctccttccgcatccgccataggccccaggaacagctgcgcttgcgcattggcatccacacaggtcctgtgtgtgctggtgtggtagggctaaagatgccccgatactgcctctttggagacacagtcaacacagcttcaagaatggagtctaatggagaagccctcaagatccacttgtcttcagagaccaaggctgtgctggaagagttcgatggtttcgagctggagctccgaggggatgtggaaatgaagggcaaaggcaaggttcggacctattggctcctgggggagcggggatgtagcactcgaggctgacctactgccctgctgttccttgtcacccctcctccctgtgccagaggtgacagaggtgtccagcttccacctctcccacagcagcccagccactgtggaaggattagggacctgaccagcacagtcaccagatgtgacctctgagagaggatggagatggtggggactgcaggggacacctaagtttgtaggactgactgaaacacacagtccctcccatggcacccttgtggcacacatgcccagtcccacccttactctgctgcctagattgggacagcgattccttctctgccctcaacttagctccactgtgacttatagggagggaattgccacctgaaggaaacagaaagaggttagagtttgcaggaggcgggcagtcctgtgtcacaaatactcccctcacttccagcccaccacctgccccacagactttggacacagctcactgaggagaagagaagctgccggttaccttgcttctcctgtgaaccaaaccattaaagtctttattcctgtga

SEQ ID NO: 1763 - DNA, 539 bp, Rattus norvegicus
  Genbank Accession No. NM_012614
caagctcattcctcgcagaggcgcccagagcagagcacccgctgcgcagagaccacagcccgcccgccatgatgctaggtaacaaacgaatggggctgtgtggactgaccctcgctctatccctgctcgtgtgtttgggcattctggctgaggggtacccctccaagccggacaatccgggcgaggacgcgccagcagaggacatggccagatactactccgctctgcgacactacatcaatctcatcaccagacagagatatggcaagagatccagccctgagacactgatttcagatctcttaatgagagaaagcacagaaaatgcccccagaacaaggcttgaagacccttccatgtggtgatgggaaatgaaacttgctctcctgacttttcctagtttccccccacatctcatctcatcctgtgaaaccagtctgcctgtcccacccaatgcatgccaccaccaggctggattccgacccatttcccttgttgtcgttgtatatatgtgtgtttaaataaagtatcatgcattc

SEQ ID NO: 1764 - DNA, 487 bp, Rattus norvegicus
  Genbank Accession No. NM_012618
aaaacctctctgttcagcacttcctctctcttggtctggtctcaacggtcaccatggcgagacccttggaggaggccctggatgtaatagtgtccaccttccacaaatactcaggcaacgagggtgacaagttcaagctgaacaagacagagctcaaggagctactgaccagggagctgcctagcttcctggggagaaggacagacgaagctgcattccagaagctgatgaacaacttggacagcaacagggacaatgaagttgacttccaggagtactgtgtcttcctgtcctgcattgccatgatgtgcaatgaattctttgagggctgcccagataaggagccccggaagaagtgaagactcctcagatgaagtgttgggccagtgggggaatcttccatgttggctgtgagcatagtgccttactctggcttcttcatacatgtgcacagtgctgagcaagtttaataaagagttttgaaact

SEQ ID NO: 1765 - DNA, 3053 bp, Rattus norvegicus
  Genbank Accession No. NM_012620
cccccgagagctttgtgaaggaggaacgctgcacacccgcctcccgcagcacacagccaaccacagctgagcgacacgcaacaagagccaatcacaaggcacttccgaaagctccaggatgcagatgtcttcagccctcacttgcctcaccctgggcctggttctggtctttgggaaagggttcgcttcaccccttccagagtcccatacagcccagcaggccaccaacttcggagtaaaagtgtttcagcatgtggtccaggcctccaaagaccgaaatgtggtcttctctccctacggcgtgtcctcggtgctggctatgctgcagctgaccacagcagggaaaacccggcagcagatccaagatgctatgggattcaatatcagtgagaggggcacagctcctgccctccgaaagctctccaaggagctcatggggtcatggaacaagaatgagatcagtactgcggacgccatctttgtccagcgggacctagagctggtccagggcttcatgccccacttcttcaagctcttccggaccacggtgaagcaggtggacttctcagaggtggaaagagccagattcatcatcaacgactgggtggagaggcacaccaaaggtatgatcagtgacttactggccaagggggctgtaaatgagctgacacgcctggtgctggtgaacgccctctatttcaacggccaatggaagacccccttcttagaggccagcacccaccagcgcctgttccacaagtctgatggtagcaccatctccgtgcccatgatggctcagaacaacaagttcaactacactgagttcaccactccggatgggcacgagtacgacatcctggaactgccctaccacggcgaaaccctcagcatgttcattgcagcaccctttgaaaaagatgtgcccctctccgccatcaccaacattttggacgctgagctcatcagacaatggaagagcaacatgaccaggctgccccgcctcctcatcctgcctaagttctctctggagactgaagtggacctcagagggcccctggagaagctgggcatgactgacatcttcagctcaacccaggccgacttcacaagtctttccgaccaagagcagctctctgtagcacaagcactacaaaaggtcaagatcgaggtgaacgagagcggcacagtggcgtcttcctccacagccattctagtctcagcccgcatggcccccacggagatggttttagaccgatcctttctctttgtggttcggcacaatccaacagagacaatcctcttcatgggccagctgatggagccttgagagtgggatgagaagcctttcctttgggacaaaactggacgtgttataagcagagactctgaagaaaagaattgttttaaggactctttggggagaaagagaaggcctttctttcttaccccggcactggtaaatctttccaaccagcctcccagacctcagactctcgaagaggaaagagtctaactccctcactagggacctatcttactaaggtctcatccaaccatagaactcacagaatctggatctgcccagcattcagcctttggacccagttcccaccaaggccccagcagggccaacccactacgccttcactcagcaaagtcttttgtgttccagtcacactctgggtacctcttgtatcgtcctccattgctatgaaggatgacccaggccaaaggaagaagcactgtcctatctcaaggtccactgtggaaatgaacaccttgcccatccccaaggggcagcagatagacagatcgaatgatcgcccgatatcaagccttctcccagctcccgtcctgccctcccttccctgacagccgccttgtgttatttcagagtgtagatgacttgtttacagcttttttcgacccacaaacttttctcattttgaaagcgtgaaagaaaggtcagatgtgcacgtgccttgctctttatcctgggtctccctgtgaggggagaggggtcctggggagattccaggggtgtgattgaatatttatcttgtttatcttatacgtttgttggggagaagaagcactattaaggagaaagccttttatttaaaccatggcatatggtgtcccatttggggtctgtatccctgtatgtcagggaggcatcactccacaaacccgcccctcgggtggcccggcgtcggggctcacactgccgcctagtggcagccgaacacgcccttgccccatccctcccccgcatcctcccccgtggctcttttccttagggatcttgccaaggtgatgcttggcagcccacggtaaaggaagggggaaaaagattaggtgggagagagagagagagagagagagagagagagagagagagagagagagagagagagagagagagagagaaagagagagagatgtttgagagagggcaaagtggtttcaaatttttccaatacattcagaagccgagtgggaaagggggctgtgtgacctaacaggacagaactttctccaattactgggtgactcagctgcactggtgactcacttcaatgtgtcatttccggctgctgtaagtgagcagtggacacgtgggggggggggggtgaggatgaaagaaacagccagctcctggtcaaccaccttagttagataatcttttttgaaagcttcctagctgggggtatgatcagaaaaccaatttactgaaaaactgcacaggaaggtaacgtgaatctaatttcatagcgggccgctctgcatccgttacatctccactggaaaaaaataatcattttctttttgtgtgtgtgtgtgtgttttagcttttctccctctccctctttctctctcatttcattatgcactggataaccatacaccgtgtaccacaggggcccaaatgtggggtcacatggtcttgaattttgtggggtacatatgcctttgtttgtttgttttcacttttgatatataaacaggtaaatgtgtttttaaaaaataataaaaatagagaatatgcagac

SEQ ID NO: 1766 - DNA, 3113 bp, Rattus norvegicus
  Genbank Accession No. NM_012628
cctagatgccccagtcttctactgctctgaccccacccgctttctcccggctcggtacagctggtgccggggggtgctgctttctgccctgcgctgcgcaccgttagtgccctgcccctgtccttccgatctcagagtctgcggagtgcccctatcgccgtccacctgtttcctcagaaaaaaggccagctcgtgatccctgctgcgttcctggggccatggcgggtctgggtcctggcgggggcgactcagaagggggaccccgacccctgttttgcagaaagggggcgctgaggcagaaggtggtccacgaggtgaagagccacaagttcaccgctcgtttcttcaagcagccaaccttctgcagtcactgtaccgacttcatctggggcattggaaagcagggcctgcaatgtcaagtctgcagctttgtggttcaccgccgatgccacgaatttgtgaccttcgagtgtccaggagctggaaagggcccccagacggacgaccctcgcaacaagcacaagttccgtctgcacagctacagcagtcccaccttctgcgaccactgtggttccctcctctacgggctggtgcaccagggcatgaaatgttcctgttgcgaaatgaatgtgcaccgacgctgtgtgcgcagcgtgccctccctttgcggcgtggaccatacagagcgccgtggacgtctgcaactggaaatccgggctcccacatcagatgagatccatattactgtgggtgaggcccggaacctcattcctatggaccccaatggcctgtctgatccctatgtgaaactgaagctcatcccggaccctcggaacctgacaaaacagaagacaaagaccgtgaaagccacactgaatcccgtgtggaacgagaccttcgtgttcaacctgaagccgggggatgtggagcgccggctcagtgtggaggtgtgggattgggataggacatcccgaaatgacttcatgggtgccatgtcctttggtgtctcagagctactcaaggctcctgtggatggatggtacaagttactgaaccaggaggagggcgagtattacaatgtaccggtggccgatgctgacaactgcagcctcctccagaagtttgaggcctgtaattaccccttggaattgtatgagagagtgcggatgggcccctcttcctctcccattccttctccatcccccagtcccacggactccaagagatgcttcttcggtgccagcccaggacgcctgcatatctctgacttcagcttcctcatggttctagggaaaggcagttttgggaaggtgatgctggcagagcgcagaggatccgatgaactctatgccatcaagatactgaaaaaagacgtcattgtccaggatgatgatgtagactgcacccttgtggagaagcgtgtgctggcattgggaggccgaggtcctggaggccggccacactttctcacacaacttcattccacctttcagactccggaccgcctgtattttgtgatggagtacgtcactgggggcgatttaatgtaccacattcagcaactgggcaagtttaaggagccccacgcagcattctatgccgcggaaatcgccataggcctcttcttccttcacaaccagggcatcatctacagggacctcaagttggataatgtgatgctggatgctgaaggacacatcaagatcacagacttcggcatgtgtaaagagaatgtcttccctgggtccacaacccgcaccttctgtgggaccccagactacatagcacctgagatcattgcctatcagccctatgggaagtctgtcgactggtggtcctttggagtcctgctgtatgagatgttggcaggacagccaccctttgatggggaagatgaggaggagctgtttcaagccatcatggaacaaactgtcacctatcccaagtcactttcccgggaagctgtggccatctgcaaggggttcctgaccaagcacccaggaaagcgcctgggctcagggccagatggggaacccaccatccgggctcatggctttttccgttggatcgattgggagaggttggagagactggaaattgcgcctccttttagaccacgtccgtgtggccgcagcggcgaaaactttgacaagttcttcacgcgggcagcgccagccttgaccccgccagaccgcttggtcctagccagcatcgaccaagctgatttccagggctttacttatgtgaacccggacttcgtgcacccagatgcccgcagccccacaagccctgtgcctgtgcccgtcatgtaatctcatctgctgccgctaggtgttcccagtgctccctccgccaagttggctgtaactcccatccacccccatccccgcctctagtccgaattttaggtctcttaaaccacccaaccttctggcctctttcacgcgccccaagtgggttctagacgctgttccccagcattgctggcattttaaacttcaaacagtctctagggcctttctgtgttctaggttcgttgtgctgagccctggtttttccccacccccaacatctggatgctgttccaactcttcccagaaaccccactccgtgtggggttctagactctatcttggtagttttatgccttctctctccctagaccacgttgggagaaatagtctcatgagattgcctgctccagactaagattccagatcagctctctgcatccttcaaggcccctcctacctccacttcagttgtagaattaagtgggaggctgggctccgtgttccaggccacctcccttccatgttctggggattcctggcatgcacggaggattctctccccgacttttctcagtcagcttttgttctagatttgttccagaacccttcactgctcacctgccccgtgcatggctccagccttggtcggaatcacacacacacacacacacacacacacacacacacacacacacacacacacaccccttgtcctccgcagtgcctgccactttctgggactttctcatcccccacgcccttcctttatcctctcccacccagacacagctgctggagaataaatttggagctctcgag

SEQ ID NO: 1767 - DNA, 4127 bp, Rattus norvegicus
  Genbank Accession No. NM_012637
agccgctgctggggaggttggggctgaggtggtggcgggcgacgggcctcgagacgcggagcgacgcggcctagcgcggcggacggccgagggaactcgggcagtcgtcccgtcccgccatggaaatggagaaggaattcgagcagatcgataaggctgggaactgggcggctatttaccaggatattcgacatgaagccagtgacttcccatgcagaatagcgaaacttcctaagaacaaaaaccggaacaggtaccgagatgtcagcccttttgaccacagtcggattaaattgcatcaggaagataatgactatatcaatgccagcttgataaaaatggaggaagcccagaggagctatatcctcacccagggccctttaccaaacacgtgcgggcacttctgggagatggtgtgggagcagaagagcaggggcgtggtcatgctcaaccgcatcatggagaaaggctcgttaaaatgtgcccagtattggccacagaaagaagaaaaagagatggtcttcgatgacaccaatttgaagctgacactgatctctgaagatgtcaagtcatattacacagtacggcagttggagttggagaacctggctacccaggaggctcgagagatcctgcatttccactacaccacctggcctgactttggagtccctgagtcacctgcctctttcctcaatttcctattcaaagtccgagagtcaggctcactcagcccagagcacggccccattgtggtccactgcagtgctggcattggcaggtcagggaccttctgcctggctgacacctgcctcttactgatggacaagaggaaagacccgtcctctgtggacatcaagaaagtgctgttggagatgcgcaggttccgcatggggctcatccagacggccgaccaactgcgcttctcctacctggctgtgatcgagggtgcaaagttcatcatgggcgactcgtcagtgcaggatcagtggaaggagctttcccatgaagacctggagcctccccctgagcacgtgcccccacctccccggccacccaaacgcacattggagcctcacaatggcaagtgcaaggagctcttctccaaccaccagtgggtgagcgaggagagctgtgaggatgaggacatcctggccagagaggaaagcagagccccctcaattgctgtgcacagcatgagcagtatgagtcaagacactgaagttaggaaacggatggtgggtggaggtcttcaaagtgctcaggcatctgtccccactgaggaagagctgtccccaaccgaggaggaacaaaaggcacacaggccagttcactggaagcccttcctggtcaacgtgtgcatggccacggccctggcgactggcgcgtacctctgttaccgggtatgttttcactgacagactgctgtgaggcatgagcgtggtgggcgctgccactgcccaggttaggatttggtctgcggcgtctaacctggtgtagaagaaacaacagcttacaagcctgtggtggaactggaagggccagccccaggaggggcatctgtgcactgggctttgaaggagcccctggtcccaagaacagagtctaatctcagggccttaacctgttcaggagaagtagaggaaatgccaaatactcttcttgctctcacctcactcctcccctttctctggttcgtttgtttttggaaaaaaaaaaaaaagaattacaacacattgttgtttttaacatttataaaggcaggtttttgttatttttagagaaaacaaaagatgctaggcactggtgagattctcttgtgccctttggcatgtgatcagattcacgatttacgtttatttccgggggagggtcccacctgtcaggactgtaaagttcctgctggcttggtcagcccccccacccccccaccccgagcttgcaggtgccctgctgtgaggagagcagcagcagaggctgcccctggacagaagcccagctctgcttccctcaggtgtccctgcgtttccatcctccttctttgtgaccgccatcttgcagatgacccagtcctcagcaccccacccctgcagatgggtttctccgagggcctgcctcagggtcatcagaggttggctgccagcttagagctggggcttccatttgattggaaagtcattactattctatgtagaagccactccactgaggtgtaaagcaagactcataaaggaggagccttggtgtcatggaagtcactccgcgcgcaggacctgtaacaacctctgaaacactcagtcctgctgcagtgacgtccttgaaggcatcagacagatgatttgcagactgccaagacttgtcctgagccgtgatttttagagtctggactcatgaaacaccgccgagcgcttactgtgcagcctctgatgctggttggctgaggctgcggggaggtggacactgtgggtgcatccagtgcagttgcttttgtgcagttgggtccagcagcacagcccgcactccagcctcagctgcaggccacagtggccatggaggccgccagagcgagctggggtggatgcttgttcacttggagcagccttcccaggacgtgcagctcccttcctgctttgtccttctgcttccttccctggagtagcaagcccacgagcaatcgtgaggggtgtgagggagctgcagaggcatcagagtggcctgcagcggcgtgaggccccttcccctccgacacccccctccagaggagccgctccactgttatttattcactttgcccacagacacccctgagtgagcacaccctgaaactgaccgtgtaaggtgtcagcctgcacccaggaccgtcaggtgcagcaccgggtcagtcctagggttgaggtaggactgacacagccactgtgtggctggtgctggggcaggggcaggagctgagggtcttagaagcaatcttcaggaacagacaacagtggtgacatgtaaagtccctgtggctactgatgacatgtgtaggatgaaggctggcctttctcccatgactttctagatcccgttccccgtctgctttccctgtgagttagaaaacacacaggctcctgtcctggtggtgccgtgtgcttgacatgggaaacttagatgcctgctcactggcgggcacctcggcatcgccaccactcagagtgagagcagtgctgtccagtgccgaggccgcctgactcccggcaggactcttcaggctctggcctgccccagcacaccccgctggatctcagacattccacacccacacctcattccctggacacttgggcaagcaggcccgcccttccacctctggggtcagcccctccattccgagttcacactgctctggagcaggccaggaccggaagcaaggcagctggtgaggagcaccctcctgggaacagtgtaggtgacagtcctgagagtcagcttgctagcgctgctggcaccagtcaccttgctcagaagtgtgtggctcttgaggctgaagagactgatgatggtgctcatgactcttctgtgaggggaacttgaccttcacattgggtggctttttttaaaataagcgaaggcagctggaactccagtctgcctcttgccagcacttcacattttgcctttcacccagagaagccagcacagagccactggggaaggcgatggccttgcctgcacaggctgaggagatggctcagccggcgtccaggctgtgtctggagcagggggtgcacagcagcctcacaggtgggggcctcagagcaggcgctgccctgtcccctgccccgctggaggcagcaaagctgctgcatgccttaagtcaatacttactcagcagggcgctctcgttctctctctctctctctctctctctctctctctctctctctctctctctaaatggccatagaataaaccattttacaaaaataaaagccaacaacaaagtgctctggaatagcacctttgcaggagcggggggtgtctcagggtcttctgtgacctcaccgaactgtccgactgcaccgtttccaacttgtgtctcactaatgggtctgcattagttgcaacaataaatgtttttaaagaac

SEQ ID NO: 1768 - DNA, 1540 bp, Rattus norvegicus
  Genbank Accession No. NM_012645
ggatcgcacatgggggcgatggcaccgcgcacgctgctcctgctgctggcggcggtcctggcccccacccagacctgggcgggctcacactcgctgcggtatttccacaccgccgtgtcccggcccggcctcggggagccccggttcatttctgtcggctacgtggacgacacgcagttcgtgcgctacgacagcgacgcggagaatccgagatacgagccgcgggcgcggtggatggagcgggaggggccggagtattgggaggagcagacactggtcgccaagggacaggagctggattaccgagtgagcctgaggaacctgctaagctactacaaccagagcgagggcggctctcacaccatccagaggatgtatggctgtgacgtggggtccgacgggagcctcctccgcgggtatgagcagcacgcctacgacggccgcgattacatcgccctgaacgaagacctgaaaacatgggctgtggcagactttgcagcatggatcacccggagcaagtggcagcggaatggtgctgcagagagaagcagggcctatctggagggcacgtgtgtggagtggctcctcagatacctggagcgcgggaaggagacgctgctgcgctcagatcccccagaggcacatgtgacccttcaccccagacctgaaggtgatgtgaccctgaggtgctgggccctgggcttctaccctgctgacatcaccctgacctggcagttgaatggggaggacctgacccaggacatggagcttgtggagaccaggcctgcaggggatggaaccttccagaagtgggcatctgtggtggtgcctcttgggaaggagcagaattacacatgccgtgtggagcatgaggggctgcctgagcccctttcccagagatgggagccttctccatccaccgactccaacttacttctgttgttcttggagctgtggcagtttttgtagttttggccatcattggagctatggtggttgttgtgaggaggaggaggagaaacacaggcaggtacagctcccagagctccgttgtgtctctcccagattgtgaagcatgaagacagctgcctggagtggactgagtgacagacgatgtgttcaggtctctcctgtgacatccagagccctcagttctctttagacaccagtgtctgaagttccctgtgattctatggcttcagtgtgaagaactgtggagtccagcctgccctacacaccaggaccctgtccctgcactgcctgtgttgcctaccacattcagccttgctggtccagcctgggggtggagggtggggacatctgcatcctgtccccctgtgccaccctgagcttcagcccctcactccacactgagaataagaatctgagtgtgaacttgattgttcacatccttgacacagtgtggatagctttttaaattactggatggaatacttagaggttttttgttttggggttttgctttgtttccttttgtttttgaaaaaataaatggcagatggagaagcttccagaaaaa

SEQ ID NO: 1769 - DNA, 2462 bp, Rattus norvegicus
  Genbank Accession No. NM_012649
tgtgctgttggaaccatggcgcctgtctgcctgtttgcgccgctgctgctgttgctcctcggaggtttccccgtcgccccaggcgagtcgattcgagagactgaggtcatagacccccaggacctcctggaaggcagatacttctctggagccctcccggacgatgaagacgctgggggccttgagcaggactctgactttgagctgtcgggttccggagatctagatgacacggaggagcccaggaccttccctgaggtgatttcacccttggtgccactagataaccacatccccgagaatgcccagcctggcatccgtgtcccctcagagcccaaggaactggaagagaatgaggtcattcccaaaagggtcccctccgacgtgggggatgacgatgtgtccaacaaagtgtccatgtccagcacttcccagggcagcaacatttttgaaagaactgaggtcttggcagctctgattgtgggcggcgtagtgggcatcctcttcgccgttttcctgatcctgctgctggtgtaccgcatgaagaagaaggatgaaggcagttacgacttgggcaagaaacccatctacaaaaaagcccccaccaacgagttctacgcatgaagcttcttcccatgagtgctgcttggacttcatggggagaggagttgaggattgtggacagtggacattggcagagagagggcaccttaatactgacttgtatctccatctctggtcacctttctggtgtcagaagagatatgatcttctactgtgctgcctcagagagagagagagagagagagagagagatgggatggggtgcggagggagtgtccgtgtgtgtgtgtgtgtgtgtgtgtgtgtgtgtgtgtgtgtgtctgtctgtctgtctgagttgccctggcagaaaaatggggttaaacttgttctttcttgaaggcaagcctggaattgggtctttttgttgttgtttcaaatttctagaatagaatgtaggaccagtttagttcctgccgttaacatgtctcatttatgactgcctttattctagaggcaaggagttgggggcaaggagctggaacccgctgcaccttgagatgtgttcacccgagtacttcctcacactacagggtctctgtggtgtatctcggggcattctaggctcagtgacttttgaaattcaaccttttttttttttttttaaatccagggagggtgggactgaagtgctgacagctcatgctgaagtacacttgtagaagatttgtaaaatgtaaggttttttttttttttttttaatggtccattccttcatgggagcgtgtgccctgggctgagagcgtggggatgcacagatgttctttctagaacatattcgttgcaacagctaactttgtgttttcatggttttttatgttttgttttgtttttttgaaaatgagagaagagctggagagatgatttttatgatttttttttgttttgttttttactatttatagcttcagacggggctgcttttctctacctttctgtctttactgtttcccactattttttttttttaatgttctgtgctcttgtttttgaccctggccctttctgaagttgctttatcttaaaaagtagctacagtgttctagcagattccagaatataatgtagggggtagcgggatatttgtgttcttgtaatatatattatccttcctcggttctaggagaatagataaatatatttttttaggatatagaatgatactacaggtctcatgttggctgggtggctgcgtgagtgagttttcgtgcggctgagtaagctgttgccctcttctcttgccctgctcctggtgccttctcgagatcgagctggagtgactgagggtacctgactctaacctcactgtgccttctgccgggggctctgcccaggagcctctgggtttgctttctccaggctctctagatgcacgatccaatacagtgacctcctgtggctgtatcaatcagttcacttgactatgtgattggaaatcattcctctgttgcactggccacacaatttaagtgcctagtcaccatccaccgagcacagagattgaggctggtttagcaggttacggttcagttttgcttgtctccccgggcaagagaaggggacttaggaggaaggtgatgaggtcccagggactcctgtcacccaggactctccctcttacagaggaaagacctagtagcttaaaaggtctgggctgtgtgggggtggggcggtcataccactccctcaaccatgccctatgcctgtaagcccccatcaccacctccgtgcagggtcctagctggctgggtcctcttctagccttgtgcctgctccttttctgtatcccttactctgttgtctgttactgatttttttgataaaaagataataaaacctggtactttctaaaaaaaaaa

SEQ ID NO: 1770 - DNA, 2025 bp, Rattus norvegicus
  Genbank Accession No. NM_012656
tctgctgcctgcccaactgcctgcctgcctgtgccgagagttcccagcaccatgagggcctggatcttctttctcctttgcctggccgggagggccctggcagcgcctcagacggaagctgcagaagagatggtggcggaggaaaccgtggtggaggagacagggttacctgtgggtgccaacccagtccaggtggaaatgggagagtttgaagaaggtgcagaggaaactgtcgaggaggtggtggctgaaaacccctgccagaaccatcattgcaaacatggcaaggtgtgtgagctggacgagagcaacacccccatgtgtgtgtgccaggaccccaccagctgcccagctcccattggcgagtttgaaaaggtgtgcagcaatgacaacaagaccttcgactcttcctgccacttctttgcgaccaagtgcaccctggagggcaccaagaagggccacaagctccacctggactacatcggaccatgcaaatacattgccccctgcctggattctgagctgaccgaattccctctgcgcatgcgtgactggctcaaaaacgtcctggtcaccttgtacgagagagatgagggcaacaacctcctcactgagaagcagaaactgcgtgtgaagaagatccacgagaacgagaagcgcctggaggctggagaccaccctgtggagctgctggcccgagactttgagaagaactacaacatgtacatcttccctgtccactggcagtttggccagctggatcagcacccgattgatgggtacctgtcccacacggagctggccccactgcgcgctcccctcattcccatggaacattgcaccactcgcttctttgagacctgtgacctagacaatgacaagtacattgccctggaggaatgggccggctgcttcggcatcaaggagcaggacatcaacaaggatctggtgatctaagttcaagcctcctgcagcagtcctggactctctccccctgatgtccccacccacttccactacccccttgtttaaaatgtttggatggttggctgttctgcctggggataaggtgctaacatagatttaactgaatacattaacggtgctaaaaaaaaacaaaaaacaaaaaaaacagaaagaaagaaaccagatcccaagtcacagcattttcccacgttactcgactctgaggccatagcctatccacagcctcctcgtcccctgcaccgcccagtgtctcactggctgtgttggaaacgggaattgcataagcttgccttcctcaagcaagaaatatctctagctttcatttccattttgactcttaacactcacccagactctgtgcttatttcatttgggggggggtgtgggcttcctggggtcttcccctggtagtttggaggtaggcagagggaagttacagacacagatacaaaacttgggcaaggacgctgtgaggccagtcagaaccagatggcaagtcttggtagcctaggtcaacgactgacagaataatccagagctctgatgcacaaaacagactcccagcagcccgggaccttgctgtctcctccactcttcaggcagtttctttccatgtttggctgttggttttaattttggtgagccaaggggaggcatgggcagaccaatacctcactagggattctcttactcaactgctatagggctttcaggctcttgctgggagctctaggcactgggctacaggaaagtgagactcaagaggaagacagagaaggttgtaacgtagagagagtgagtcataaagtttcaagcatgccccccccacctctccccaccctttgccagttgaaacttactaatcaagagaaacttccaagccaacggaaggaatggtcggatcccacaggctgagaatttgttcccctccaagcatttcatgaaaaagctgcttctcattaaccatgcgaactctcacagtgatgtgaagagcttgacagatctttcaaaataaaaagtaatgacttagaaatggcc

SEQ ID NO: 1771 - DNA, 2472 bp, Rattus norvegicus
  Genbank Accession No. NM_012661
ggcaacaccgcgacctctgaacccgtgcctcagagacaacaccgcgaccctctggcgacctctgaccctgtgaccctgtgtggtgtgacctcacgaccctggcgccctcagcggtgacctttgaccccgcagcgaccccgagaccccaggacccctgcacttatccacaactctgggacctccaaccccgcgaccccaacagcgacctctgaccctggtgaaagcaggagaacccgggacaccagtgaccctgcaacttctgaccccactaagggcaacaactctgagactgtacggtgacctctgacctctgaccctgggctgttcccccgagataacagtgaccccaggaactccaactcagctacaacctggtgacaaccaaggtaacccagggacaacctctgaccccttgaatccacgacttttcacccagtgctgaccactgcagtgtggggcagtctgagagagtgcgtgacctttgatctctgacctctgaccccgacccagccttgcccacaggacgatgctctggccctgtctccttgccctgctcctctcccagctcaactttctctgtgctgcccgtcctggccctggacctaacttcctgctcatcatggctgatgaccttggcattggggacctaggctgctatggcaaccgcacactcaggacgccacacatcgaccgcctggcccttgagggggtgaagttgactcagcacctggcggctgcgcccctgtgcaccccgagccgcgctgccttccttaccgggcgctaccctgtgcggtcagggatggcatcacatggccgcctgggtgtattcctgttctcggcatcatctggggggctcccgcccaatgaagtcacctttgcaaagttgctcaagggtcaaggctacaccaccgggcttgtagggaagtggcatctggggctgagctgccaagcagcctctgacttctgccaccaccctgggcgccatggctttgaccgcttcctgggcacgcccaccaccaacctgagggactgcaagccagggggcgggaccgtgtttggctctgcccaacaagtattcgtggtcctgcccatgaatattctgggggcagtgctgctggccatggcacttgcgcggtgggcagggctggcccggcccccagggtgggtgttcggggtgacagtggctgccatggcggcggtgggcggggcctatgtggccttcctctaccacttccgcccagccaactgcttcctcatggccgacttcaccatcacccaacagcccacggactacaaggggctcacacagcgcctggcaagcgaggctggggacttcctgcgcaggaacagggacacgcccttcctgctattcctgtctttcatgcatgtgcacacggcacacttcgccaaccctgagtttgccgggcagagcctgcatggggcctatggagatgctgtggaggagatggactgggccgtaggccaggtccttgccacactggacaagctgggcctcgccaacaacacactcgtgtacttgacgtccgaccatggcgcacacgtggaggagcttggccccaacggtgaacggcatggcgggagcaacggaatttacaggggcgggaaggccaacacgtgggagggtggcatccgtgtgcctggacttgtgcgctggcccggcgtgattgtgcccggccaggaggtcgaggagcccacgagcaacatggacgtcttccccactgtggccaggcttgcaggggcagagctgccgactgacagggtgattgacgggcgtgacttgatgcccctgctgctgggccatgtacaacactctgagcatgaattcctgttccactactgcaatgcctacctcagcgctgtggcatggcggccccacaacagctcgtccgtgtggaaggcgttttacttcacaccgaacttcgaccccccgggctctaatggctgcttctccacacacgtgtgcatgtgccacggccaccatgtcacgcaccatgatccgcccctgctcttcgacattgcccgtgaccccagggagcgccacccgctcacgcctgaaacagagccgcgccatggtgagatcctgcgcaacatggatgctgcggcccgtgcacacgttgctaccctagaggaggcgcccaatcagctttccatgtcaaatgtcgcatggaagccatggctgcagctctgcctgccttccaagccccacccactcgcatgccgctgtgctggcgacgggtgagttgggcatgccaaacacacaggtatgcaagcatgggacactgtggcctggtgatttcacctcctgaactgatacctgacacaatcttgctgacatgtatgaaaacatatgaacatgtatgaacatgtgtatgctgagtacaaaacacaggaagagcccctcagcatgaccctgatgaataaatgatgtggacacggaaaaaaaaaaaaaaa

SEQ ID NO: 1772 - DNA, 2071 bp, Rattus norvegicus
  Genbank Accession No. NM_012663
gaattcgggctacccccgccatgtcggctaccgctgccaccgtcccgcctgccgccccggccggcgagggtggcccccctgcacctcctccaaatcttaccagtaacaggagactgcagcagacccaggcccaggtggatgaggtggtggacatcatgagggtgaatgtggacaaggtcctggagcgagaccagaagctatcggaactggatgatcgcgcagatgccctccaggcaggggcctcccagtttgaaacaagtgcagccaagctcaagcgcaaatactggtggaaaaacctcaagatgatgatcatcttgggagtgatttgcgccatcatcctcatcatcatcatcgtttacttcagcacttaagtccctgaggagtctgccctgcctaagaagggcctctcccccaccctcagcccgtcctccacctctcagccatatctttcagccccctcccttggatccgtgtgtgtgtgtgtccgtgtgtgtgccccctgtaaatagccagctgttatttatacatatataatattatatatatttggtctgtttgtagttttattactagaagattttttccggttgtccttaacaccccttcctgaggttcccatcacctctctctctcaccctctgccccctttcctctttcctgttcagccccaagtcccttcatttgcatctgctatgcaatagcccctctcctccttcccttggatttaaccaatccttcccctatcttccctgtacaattccagaccctccccaaacagagcaaaccccacagaaacaaacaaaacaccccacctgtctaggcttccataggttgcatctttgtatcccttgggagcctctaagactggtcctacttggtcctaagaatcccaaggatttctgggagcttccaacatgttgattagcatatcatttgcatacactgtcttttttttccctcggtttcttcctttctgttccattactcttcactcttctgtgtttttttttttttctttctttcttttcggaagagttagtttccattggtcctcttatcacacttttatttgcacgacattatctgcaggtggtggggagcctgggcttttggggaactaggaccccaaagttgcctcctcccagcccctctagtctagtttgcttcccttaccccatttccacacctcttgtaccctcctctccctcccccagctggtgtgtaagtgtcttggagttcagtgtgttatgatgggaccaataattctgccacttggggtctctccctacattcctgctccccagttttcgtgtggggcattcagctgacatttcccgggggtctccctccctcccatctgcctgatctgctgcctcctcccaccaggagaactggaggctgaccacaatctggttctttgaggaggggtggctctagtgtgtgtgggggtcatcactgccttggggaggagtaggacaaaacagaaccccccctaattcctgcctgaaatctctggcctcatccttgctagaggttggactgaaaactttcctccccaatcctggggggtattaccccccatcactgcccagctcctctgactgcccccctgtattcagggtgggggtactagtcactgccaatatgtgtatgggacttgctggaggatggggatccttgtccttctctagggctgctgagccctgagagagagagagagagagagagagagagagagagagagagagagagaagcaagctatttccctgttgggtacaatgatagagaaaggatctaatcgggaaaaatggcacagttttaggggtctgagggtacagccccttaacctgcctcttgggggggggtgttccccaaactcttcccccacacacaccaggttttctgtgtggaggggaaccaaggagatgtaaactgtggtgtgaaagggtaggagagatgctgggggtgggggtgcttgtgttttacacccccaatattatcccagtgtcccctgccttccttcttcccctgccccatgcccccaattctgtggcgcatccagccgaattc

SEQ ID NO: 1773 - DNA, 1096 bp, Rattus norvegicus
  Genbank Accession No. NM_012676
atgtctgacgccgaggaagaggtggtggagtacgaggaggaacaggaagaggaagactggagcgaagaagaggaagacgagcaagaggaggcagtggaggaggaggatggtgaggccgagcctgatcccgagggtgaggcagaggcagaggaggacaaggcagaagaggttggtcctgatgaagaagccagagatgctgaagatggtccagtagaggactccaaacccaagcccagcaggctcttcatgcccaacttggtgccacccaagatccctgacggagagagagtggactttgatgacatccacaggaagcgcatggagaaggacctgaacgagctgcagactctgatcgaggctcacttcgagaacaggaagaaggaggaagaggagctcatttctctcaaagacaggatcgaaaagcgtcgggcagagcgggctgaacagcagcgtattcgcaatgaacgagagaaggaaaggcagaaccgcctggctgaagagagggcccggcgtgaggaggaggagaacaggaggaaggctgaagatgaggcccggaagaagaaggctctgtccaacatgatgcattttggagggtacatccagaaggctcagacagagcggaagagtgggaagagacagacagagcgagagaagaagaagaagattctggcagagaggaggaaggtgctggccatcgaccacctgaatgaagaccagctgagagagaaggccaaggagctatggcagagtatccacaacctagaggccgagaagttcgacctgcaggaaaagttcaagcagcagaaatatgaaatcaacgttctgcgaaacaggatcaacgacaaccagaaagtctccaaaactcgtgggaaggccaaagtcaccgggcgttggaaatagatggaactgtgttcgacaaagctctgttccttgcctgtgcccttgccctgtgaatcccagctctaggtcttgccaggcacccgatgcagactcctgtctggaaagtaggagctgacctagctagaagccagtactctgcctgacccctatgcccacaccacgtcaggaataaaaagccagcacattgtgcacatgg

SEQ ID NO: 1774 - DNA, 900 bp, Rattus norvegicus
  Genbank Accession No. NM_012678
cgcgagcccagtggagcgagtgagctatggccggcctcaactcactggaggcggtgaagcgcaagatccaggccctgcagcagcaggcggacgacgcagaggaccgtgcgcagggcctgcagcgcgagctggatggcgagcgcgaacggcgcgagaaagctgaaggagatgcggccgctctcaaccgtcgcatccagctggtggaggaagagctggaccgggctcaggagcgactggccacagccctgcagaagctggaggaggcagagaaggctgctgacgagagtgagagaggcatgaaggtgatagagaaccgagccatgaaagacgaggagaagatggagatccaggagatgcagctcaaagaagccaagcacatcgctgaggaggctgaccggaagtatgaggaggttgctcgtaagttggtcatcctggagggtgagctggagagagcagaggagcgggcggaggtgtctgaactaaagagtagcgacctggaagaggagctcaagaacgtaactaacaatctgaaatcactggaggctgcttctgaaaagtactctgaaaaggaggataaatatgaagaagaaatcaagcttctgtctgacaaactgaaagaggctgagacccgagctgagtttgcggaaaggacagtttctaaactggagaagacaatcgatgacctggaagaaaaacttgcccaggccaaagaagagaacgtgggcttgcatcagacactggaccagacactaaacgaacttaactgtatataaaccaaaccagaagagtcctgtcttgataccaactccactccagagagtgcaccctgtcttcctctcttataagaagttccgcttactaccatgtctccaccttgctggaaaggccaagcagaaaaat

SEQ ID NO: 1775 - DNA, 1240 bp, Rattus norvegicus
  Genbank Accession No. NM_012698
tgcgagcctgggcgcggcgcttgactttccgggagccccgtggctcggacaagcttactcctccgcgctaaccctcccctgactgcctgtgaaatccttacaaccatgagggaacacctcaaaggccacgagacccaaacaacttgttgggaccatcccaaaatgacagagctctaccagtctttagctgacctgaataatgtcaggttctccgcttataggactgccatgaagctcagaagactccagaaggccctttgcttggatctcttgagcctgtcagctgcatgtgacgccttggaccagcacaacctcaagcaaaatgatcagcccatggatatcctgcagataatttactgtttgactactatttatgaccgcctggagcaagagcacaacaatttggtcaatgtccctctctgtgtggatgtgtgtctcaactggcttctcaatgtttatgatacgggacgaacagggaggatccgtgtcctgtcttttaaaactggcatcatttctctgtgtaaagcacacttggaagacaagtacagataccttttcaagcaagtggcaagttcaaccggcttttgtgaccagcgtagactgggtcttcttctgcatgattctattcaaatcccaagacagttgggtgaagttgcctcctttgggggcagtaacattgagccgagtgtcaggagctgtttccagtttgccaataataaacctgagattgaagccgctctcttccttgactggatgcgtctggaaccccagtctatggtgtggctgccggtcttgcacagagtggctgctgctgaaacagccaagcatcaggccaagtgtaacatctgtaaggagtgtccaatcattggattcaggtacagaagcctgaaacactttaattatgacatctgccaaagctgctttttttctggccgagttgctaagggccataaaatgcactaccccatggtagagtactgcactccgactacatctggagaagatgttcgtgactttgccaaggtactgaaaaacaaatttcgaaccaaaaggtattttgcgaagcatccccgaatgggctaccttccagtgcagactgtgttagagggggacaacatggaaacgtgagtagtggcagaagcaaagcaaactttaaactttcatttgctatatccttggaccccctcccggccaaaaaaccgtccttcgctctcaaatgcaaacagtctcctaagctaat

SEQ ID NO: 1776 - DNA, 1253 bp, Rattus norvegicus
  Genbank Accession No. NM_012704
cgccgtcctccagcgcgctccgctgcaaccccgcagctgagcccagaggctccggccctgtgcgccctaccgcggccccgccactatggccggcgtgtgggcgccggagcactcggttgaagcgcacagcaaccagtcaagtgctgccgacggctgcggctctgtgtccgtggccttccccatcaccatgatggtcactggcttcgtgggcaacgcgctggccatgttgcttgtgtcgcgcagctatagacgccgggagagcaaacgcaaaaagtctttcctgctgtgcattggctggctggcgctcaccgacttggtggggcagctcctgaccagtccggtggtcatcctcgtgtacctgtcgcagcgacgctgggagcaactcgacccatcggggcgcctgtgcaccttcttcgggctgaccatgacagtgttcggactgtcctcgctcttggtggccagcgccatggccgtggagcgcgccctggctatccgtgcgccgcactggtatgccagccacatgaagactcgcgccacgcgcgcggtactgctgggtgtgtggctgtctgtgctcgccttcgcgctgctgcctgtgctgggcgtgggccgctacagcgtgcagtggcccggcacgtggtgcttcatcagcaccgggccggcgggcaacgagacggactctgcgcgggagccgggcagcgtggcctttgcctccgccttcgcctgtctaggcttgctggctctggtggtgacctttgcctgcaacctggcgaccatcaaagccctggtgtcccgctgccgggccaaagccgccgcctcgcagtccagcgcccagtggggccggatcaccacggagacggctatccagcttatggggatcatgtgtgtactgtccgtctgctggtcgccgctattgataatgatgctgaaaatgatcttcaatcagatgtcagtagagcaatgcaagacgcagatgggaaaggagaaggagtgcaattccttcctaatcgccgttcgcctggcttcgctgaaccagatcttggatccctgggtttatctgctgctaagaaagatccttcttcgaaagttctgccagatgatgaacaacctgaagcggagtttcattgcaatacctgcttccctgagtatgagaatttcttcccccagggaaggataactgaatcattttggattgtatcttctttcggcctcatattttaagttttccttgccattaaacacaccgagacaagctt

SEQ ID NO: 1777 - DNA, 880 bp, Rattus norvegicus
  Genbank Accession No. NM_012708
gatctccgcactgctaggatgctgcaagccggagcacctaccgccggctctttccggacgggagaagtccacaccgggacaaccatcatggctgtggaatttgacgggggtgtcgtggtgggctctgattcccgagtgtcagcgggagcagccgtagtgaaccgcgtgtttgacaagctctcccctctgcaccagcgcatctactgtgccctctcgggttccgctgctgatgcccaagccatagccgacatggccgcctaccagctggagctgcacgggttggaactggaggagccgccccttgttctggctgctgcaaacatagtgaagaacatctcctacaagtaccgcgaggacttgttagcgcatctcatggtagctggttgggaccaacatgaggggggccaggtgtatggaaccatgggagggatgctaattcgacagccctttgcgatcggcggttccggaagcacctatatttacggttatgtggacgcagcttataaaccaggcatgacccccgaggagtgccggcgtttcaccacagacgccatcactctggccatgaaccgagatggctccagtgggggtgtcatctacctggtcaccattacagctgatggtgtggaccatcgcgtcatcctgggagacgagctgccaaaattctacgatgagtgaagtcccttctttgtttgcaataaactttatggagccagaggttggtgtaatgggcagaggtgaaatgggtatcagagaaacggagtgcgtggagggaagcttcctcccggccgagagatcagcaagcacctcccattcttttttaaaaaataaactttattattaaaataaaaaactcttataaataaaaaataagtaaaac

SEQ ID NO: 1778 - DNA, 1395 bp, Rattus norvegicus
  Genbank Accession No. NM_012715
gacactaggcagaacaactccagcctttaccgctcctggtttctcggcttctcatcgcagtcagtcttggactttgcgggttttgccgctgtcagaaggacgtctcggactttctgcttcaagtgcttgacaactcaccctttcagcagggtatcggagcatcgctacagaatgaagctggtttccatcgccctgatgttattgggttcgctcgccgttctcggcgcggacaccgcacggctcgacacttcctcgcagttccgaaagaagtggaataagtgggcgctaagtcgtgggaagagggaactacaagcgtccagcagctaccctacggggctcgttgatgagaagacagtcccgacccagactcttgggctccaggacaagcagagcacgtctagcaccccacaagccagcactcagagcacagcccacattcgagtcaaacgctaccgccagagcatgaaccaggggtcccgcagcactggatgccgctttgggacctgcacaatgcagaaactggctcaccagatctaccagtttacagacaaagacaaggacggcatggcccccagaaacaagatcagccctcaaggctatggccgccggcgccggcgttccctgccagaggtcctccgagcccggactgtggagtcctcccaggagcagacacactcagctccagcctccccggcgcaccaagacatctccagagtctctaggttataggtgcgggtggcagcattgaacagtcgggcgagtatcccattggcgcctgcggaatcagagagcttcgcaccctgagcggactgagacaatcttgcagagatctgcctggctgcccctaggggaggcagaggaacccaagatcaagccaggctcacgtcagaaaccgagaattacaggctgatactctctccgggcaggggtctgagccactgccttgcccgctcataaactggttttctcacggggcatacgcctcattacttacttgaactttccaaaacctagcgaggaaaagtgcaatgcttgttatacagccaaaggtaactatcatatttaagtttgttgatgtcaagaggttttttttttgtaacttcaaatatatagaaatatttttgtacgttatatattgtattaagggcattttaaagcgattatattgtcaccttcccctattttaagaagtgaatgtctcagcaaggtgtaaggttgtttggttccccgtgtgtgtgtgtgtgtgtgtgtgtgtgtgtgtgtgtgtgtgtgtgtaaggtggagagcgcctgattaccgcctgtggatgaagaaaaaacattgtgtcttctataatctatttacataaaatatgtgatctgggaaaaagcaaaccaataaactgtctcaatgctg

SEQ ID NO: 1779 - DNA, 3320 bp, Rattus norvegicus
  Genbank Accession No. NM_012716
gaattcggcacgagctgcgaagtgactggtcggtcgtgtaggtgctgcagccaacgagcccggtggcgggcaagggacacgagcaggacccccggctccgaagaattgcggcccgcgccgccgcgtcacgcacactctgggcgccgcgagatacacataacgatactaggttttcgccgcatcttggaattcatcgacacctaagatgccacctgcgattggcgggccagtggggtacacccccccagatggaggctggggctgggcggtggtagttggagccttcatttctattggcttctcctatgcatttcccaaatccatcactgtcttctttaaagagattgaaattatattcagtgcaacgaccagtgaagtgtcatggatatcgtccatcatgctggctgtcatgtatgccggaggtcctatcagcagtatcttggtgaataaatatggcagccgtccagtaatgattgctggtggctgcctgtctggctgtggcttgattgcagcttctttctgtaacacggtgcaggaactttacttctgcattggtgtcattggaggtcttgggcttgctttcaacttgaacccagctctgactatgattggcaagtatttctacaagaagcgaccattggccaatggcctggctatggcaggcagcccagtgttcctctctaccctggctccacttaatcaggctttctttggtatttttggctggagaggaagcttcctaattcttgggggcctcctcctcaactgttgtgtagctggatccctgatgcgaccaatagggcctcagcaaggcaaggtggaaaaactcaagtccaaagagtctctccaggaagctgggaagtctgatgcaaatacagatctcattggaggaagtcccaaaggagaaaagctgtcagtcttccaaacagttaataaattcctggacttgtccctgtttacccatagaggctttttgctgtacctgtctggaaatgtggtcatgttctttgggctctttacccctttggtctttcttagtaattatggtaagagtaagcatttttccagtgagaagtcagccttcctcctttccattttggcttttgttgatatggtggccagaccgtccatgggtcttgcagccaacaccaggtggatcagacctcgagtccagtacttttttgctgcttctgttgttgcgaatggagtgtgccatttgctggcacctttgtctacgacctatgttgggttctgcatctacgcgggagtctttggatttgcctttggttggctcagctccgtattgtttgagacgttgatggacctcgttggaccccagaggttctccagtgctgtgggcttggtgaccattgtggaatgttgtcctgtcctcctgggaccaccacttttaggccgcctcaatgacatgtatggagactacaaatacacatactgggcttgtggcgtgatcctcatcatcgcaggcctctacctcttcattggtatgggcatcaattatcgacttgtggccaaagaacagaaagcggaggaaaagaagagggacggtaaagaggacgagaccagcactgatgttgatgagaagcccaagaagacaatgaaagaaacacagtcgccagcgccactgcagaacagctctggagaccccgcggaggaggagagcccagtctgacctgtggagcatgaagagagcaggtgtgacccgagacatccgaaaccattctgctggcccctagtctaccagtggtgccccgtgcagacagtggacaattgtgtggaaaacccaccagggtgttcattggtgggatttttttttttcactccttaccaatgcctggatttaaaatatactctgctttaggtagggagtggttgacaaagaatatggggaagaagcagtgatctgtttgtttgtttgtttgtttgtttgtttgtttgttttaatcttagcttttaacagtgtcatgaagattataatatgtgccttaagttttagtttttagaactctttagagagccttaacttttaaaaccattctgctgaattcatctgtttaaaacgtcattttaagaggaaaaataacaactagcttgcttgaggtaactaaccttaatcttgttttgttgttgttgtaatgctttgtcagacagacattgttaccggaacatttatgaatagaaatactgcttaaaggtcacaggtttataaaatactgagctaaagtatttttctagcattatagttgcctggtacatctgctgctaggtatatatttgagaaatttgaagcataaaattctggatcttggcagttccagccacagcctgtcacctgctgggcacctcttctggaatgctcactacagtctagtgctaaggtgttgccactgaattgatacctttgctcctattcagagacactgtgtggttagaagtaattggccatttttgaaatcaaatgcaaaaagttagtattaaaatctacaaaacaattccttaacacgtctgatttaatgtaaacagtatttcaagcatcagctgaattcagcgtaggttgtcccaaaaccttagttatggtgtgatactctgggtatgtgtgggtttgaggggctgtgagtgaggtcttggttcttaggattgacccagggccatgagcatgcgaagtacatgctgtacggccgagccacaacccacaggcaccctggagtcctcctagtccctgagaccttttctctgatttttgatagctcatttatttactgatagtttagagctgtatgtgagatatccagtacagggtgaatgtatgcgctctttgttttttacattgttttcagtatttgcaaaaccgagagggtcagtgtttggcctcagggaagccaataaagataaaatagggtggaagtttgcagactttcagtaagtacccacctcccgccacacacaccagacttacaggggaacttctatcatgcttacgattatttgacgcagtcttacctccacatcttaactttcacgaccctttcacttacctgacatgtagaaaaatgggtttaatatatggataggaggaaagatggaccagattggaattacagtgggttttttttttttaaacctgatgttttctgaatagaggcagaaaaaataagacatatgacactgaattggacgatgcatttaaaataccattgtaatgacagggtgaatacagatttacaaccttgtgtaagaagctgactttttccaaataaaacatttattttatttttagaaaaaaaaaaaaaaaaaaactcgag

SEQ ID NO: 1780 - DNA, 2095 bp, Rattus norvegicus
  Genbank Accession No. NM_012717
gggaactcttttctactatctcagaaaatcaaattccctcctgagactattcacacagaatttccttaggagccgtgcggggccctatgatgatacaccaacatcttgtgctaccaactgtcaaaactttggatggtctaacactcaggtcatgacccttgtaattaagaaattctcgaagacaatattgagcatgattcaggagaaaatgtgatttgagtctggagacaattgtgcatgtatatcttttcttaagatcttaaaaagaaagagaaaacaaatccagggttgtcggtcactgattgatagaagagaaaacaatattcagacgattgcttatgattgacaagagcagctgcggccgctacccagcttgaacatatcgcacacttcagttggactctaatgatggataaaaagtgtacactatgttttctgtttctcttgcttcttaatatggctctcatcgcagcagagtcggaagaaggcgcgaaccaaacagacttgggagtcactaggaacaagatcatgacggctcagtatgaatgttaccaaaagatcatgcaggatcccattcaacaaggagaaggcctttactgcaacagaacctgggacggatggctatgctggaatgacgttgcagcaggaaccgagtcaatgcagtactgccctgattactttcaagattttgatccttcagagaaggttacaaagatctgtgaccaagatggaaactggttcagacatccagatagtaacaggacatggacaaactacaccttgtgtaacaacagcacgcatgagaaagtgaagacagcactgaatttgttctacctaactataattggacatggattatctattgcctctctgatcatctcactcatcatatttttttatttcaagagcctaagttgccaacggattacattgcataaaaacctgttcttttcatttgtttgtaattcgattgtgacaatcattcacctcacggcagtggccaataaccaggccttagtggccacaaatcctgtgagctgcaaggtgtcccagttcattcatctttacctgatgggctgtaactacttttggatgctctgtgaaggcatttacctgcacacactcattgtggtggctgtgtttgcagagaagcagcacttgatgtggtattattttcttggctgggggtttcctctgcttcctgcctgcatccatgccatcgccagaagcttgtattacaatgacaactgctggatcagctcagacactcatctcctctacatcatccatggtcccatttgtgctgctttactggtaaatctctttttcctattaaatattgtacgtgttctcatcaccaagttgaaagttacacaccaagcagaatccaatctctacatgaaagctgtaagagccactctcatcttggtaccactacttggcattgaatttgtgctttttccatggcggcctgaaggaaaggttgctgaggaggtgtatgactatgtcatgcacattctcatgcactatcagggtcttttggtgtctacaattttctgcttctttaacggagaggttcaagcaattctgagaagaaattggaaccagtataaaatccaatttggcaatggcttttcccactctgatgctctccgcagcgcatcctatacggtgtcaacaatcagcgatgtgcaggggtacagccacgactgccccactgaacacttaaatggaaaaagcatccaggatattgaaaatgttgccttaaaaccagaaaaaatgtatgatctagtgatgtgaaaatacagaaatctcacttgttttgtgtcacttgaacctatgattttatagtcggaagatttaatagcaaatgggtttcttgaataccatgaagaaagccctcaaatgaaatgagaattgtgtggataaatgtttaacgaccctctctctatgggggagaaaagcctcaatttttattgttggccagtaaatactcctaccatagctgatttcaagttaccaacctgacatcaccgaatgtggaattggaaagaaaataagcacaatcaactcttgggagctgacatgcgtcgtc

SEQ ID NO: 1781 - DNA, 3144 bp, Rattus norvegicus
  Genbank Accession No. NM_012732
ccgtgactgaagaagccattgccaagggtatcgcaggattgttgctgtcacaggtgctgtagactgaggttgaaggactaccccggagacggctgcagtcgttcggttcctgtctcttccgtgtaggatttgatttctcctaaacttggtttaagacttttaaagaaggccctaatttatcgaggcctgtttgtgaagtaaaattcggctggctactctcaacggaagaaagatgcaactgctaggccgggtgatctgtttcgtcgttgggatcctgctttctgggggcccaacggggaccatatcagctgtggaccctgaagcaaacatgaatgtgactgagataatcatgcactggggatatccagagcactcagtacagacaggagatggctacattctgggtgttcaccgaatcccgcatgggcggaagaaccagtttgataaaggtcccaaaccagttgtgtatcttcagtggcgacatggcttcctggcagattctagtaactgggtcacaaacattgacaacaacagcctgggcttcatcctggcagatgctggctttgatgtgtggatgggaaacagcagaggaaacacctggtctcggaagcacaagactctgtcagtttctcaggatgaatactgggccttcagttttgatgagatggcaaaatatgacctccctgcttcaattaactacattttgaataaaactggccaagaacagctgtataatgtgggccactctcaaggctgcaccataggttttatagcattttcacagatgcctgaactggcaaagaaggttaaaatgttttttgccctggctcctgtgttgtctctcaattttgcttcgggcccgatggtcaaattgggacggttgccggatctgcttcttgaggacttgtttgggcagaagcaatttcttcctcagagtgcaatggtgaaatggctaagcactcacatttgcacgcacgtcatcatgaaggagctttgcgccaacatcttctttctgatatgtggcttcaatgagaagaatttaaacatgtctagagtggatgtgtatacaacacactgtcctgcgggaacctctgtgcaaaacatggtacactggacccaggttgttaaataccataagcttcaagcttttgactggggaagcagtgacaagaattattttcattacaatcagagttatccacccttgtacagcataaaagacatgcaactacccactgctttatggagcgggggcaaggactggctggcagacaccagtgacatcaatatcttactgactgaaatccccacgttagtgtaccacaagaacattcccgagtgggaccatctggattttatctggggtttggatgccccctggaggctgtataatgaagtagtcagtctaatgaagaaataccagtgagtgccaagacttgagatgcttccccttcactaggggaaaaaaggacagatgtttgcttaattcctgcaaaatactgtgttttcctggtctagatcatttgtattttttatgtgcaagaaaacgatgatgttgaagacatacatgggtctggtcagtaagaagcacgctggctgtcttctgcttcattctgactgacaagccagagtcacaaccagtgatgcctttgaagtttttagaaagtatgggtgttacgtgaaagaagccattgcaacctcttgtttactttttacggtcgttttcggtgtctgcatgctgtgcatatacatgcctatgtgtgtgccctgtgctggccagagcctccttgtgtggaggtaatggctcacatcagggtatcttccctcagacactggtctctcgacgaaccagtcagtagcttgctattccagttagactggctgaccagggagcctccagaatctgtccgtctctaccttccctcaccaggtctacggagggtgatgtcccagccagcattttacactggttctagggacaggaactcaggttctcatgcttgatagcaagccctttcttcaccaaaccattgcctcaaaccctctgtgatcgaaaagctgctcaattacctttatgttcccacccaatgcaagtgaacgagcacaagacatttcaagctgttgtttgtgagctaaaaatcaatctgccagtgacttgaacatgctagggagaaactcctggccctgagcttgacaaacctgcagtccaggttctccagagattgagacagggaggctgctgttacatttagggttcatttggagagtgagactttgtctctacaaaaccaaagacaaaggagaagaagaaaaaaaaaaccctaaagtactcagttctcatctgttagcctcagagggcttagagagttcctgtgtttacctatccgaacaacattttcatgtctttatgcagtagctacctagtgaaatccagtgttatcccagcttctccaggcgtaaacattctctcttcaatctcatcagacctcagtagcaagcatttagtgaatatttagatttttcaggccaagccaagacaaaaatgaatagaataaaagaaaaaagagcccagactcttgaaagcggtttgcactgatttaaaaataaaaaaaaagaatcttgaagaatgacatgataaactgtgttggttccgcatgtgtagtcggatcccttttctgtggagaacgttctgtggagggacaaaccactaatttgccccaagtgaatgtggctgtagtgacagcgacagtgcctctgatcctgagaagcagggctggctgccggtgacaagcatcccagttcctttccccagagatgaagaggatgttttcagacagagctcggctcagggaatttcgcttggagaatcagtggtttatgtgcacaatgttttagtgagcctgctctgcgcctgatatggggaagccctcgactgttcaccgggctcgtgggcgacggctgccgtcagctggacagtggataagttttctgagtagtcaccacagattcagggatatcgctttgtgtcgactcctaaggaaggcaggacgatatgacttggtaacattgtaaaggttcacatttaaacttttcaataaatctcagcctcacaggcctgaacatcaaaaaaaaaaaaaaaaaaaa

SEQ ID NO: 1782 - DNA, 695 bp, Rattus norvegicus
  Genbank Accession No. NM_012733
ccttcacccggagcgcattggcagccacagtcccagcggacgccacagccgctcccgccttctccgtgtcggcgatccccagtctgtccccaaaatgcctgtggacttcaacgggtactggaagatgctgagcaacgagaatttcgaggagtacctgcgtgcgctcgatgtcaacgtggccttgcgaaaaatcgccaacttgctgaagccggacaaagagatcgtgcaggatggcgaccacatgatcatccgcacgctgagcacttttcgaaactatatcatggacttccaagttgggaaggagttcgaggaggatctgacaggcatagatgaccgcaagtgcatgaccacagtgagctgggatggtgacaagcttcagtgtgttcagaagggagagaaggagggacgtggctggacccagtggattgagggtgatgaacttcacctggagatgagagcagagggtgtgacctgcaagcaagtgttcaagaaagtacactgagcggcccgagcagataaccttggtctcgaggaacaagtgggatggcccaatggtcaggagccctctctgcctagcacagggctgaaacacatagccaccccaggtttctgccagcagagtctgtctcattgccttgtctcttttccttttcttaaaatgaagctaccccaataaaaatgatctctgtttaaga

SEQ ID NO: 1783 - DNA, 3635 bp, Rattus norvegicus
  Genbank Accession No. NM_012735
cggaaaacctgtttctggaaacgcgaggccctcagctggtgagccatcgtggttaagcttctttgtgtggctcctggagtctccgatcccagccggacacccgggcctggtttcaaagcggtcgaactgctctgcccgctccaccggtagcgctcgagcctcggtttctctactcgaccccgactcgccgcagcaggatgatcgcctcgcatatgatcgcctgcttattcacggagctcaaccaaaaccaagtgcagaaggttgaccaatttctctaccacatgcgtctctcagatgagacccttctggagatttctaggcggttccggaaggagatggagaaagggctaggagctaccacgcaccctacagcagctgtgaaaatgttgcctacctttgtgaggtcaactccggatgggacagaacatggggagttcctggctctggatcttggaggaaccaacttccgtgtgctccgagtaagggtgacggacaatggcctccagagagtggagatggagaaccagatctacgccatccctgaggacatcatgcggggcagtggaacccagctgtttgaccacatcgccgaatgcctggccaacttcatggacaagctacaaatcaaagagaagaagctccctctgggtttcaccttctcgttcccctgccaccagacaaaactggatgagagttttttggtctcgtggactaaggggttcaagtccagtggcgtggaaggcagagatgtggtggacctgatccggaaggctatccagcgcagaggggactttgacattgacattgtggccgtggtgaatgacacagttgggaccatgatgacttgtggctatgatgatcagaactgcgagattggtctcattgtgggcactggcagcaacgcctgctacatggaggaaatgcgtcatattgacatggtggagggagatgaggggcgcatgtgcatcaacatggagtggggagcctttggggacgacggtacactcaatgacatccgaaccgagtttgaccgagagatcgacatgggctcgctgaaccctgggaagcagctgtttgagaagatgattagcgggatgtacatgggggagctggtcaggctcatcctggtgaagatggccaaggcagagctgttgttccaagggaaactcagcccagaactccttaccactggctccttcgagaccaaagatgtctcggatattgaagaggataaggatggaatcgagaaggcctaccaaatcctgatgcgcctgggtctgaatccattgcaggaggattgtgtggccacgcaccgaatctgccagattgtgtccacgcgctcggccagtctgtgcgcagccaccctggccgcggtgctgtggcgaatcaaagagaacaagggcgaggagcgacttcgctccaccatcggtgtcgatggctccgtctacaagaaacatccccattttgccaagcgtctccataaggcagtgaggaggctggtgcccgactgtgatgtccgcttcctccgctctgaggatggcagcggcaagggggctgctatggtgacggcggtggcttaccgtctggctgaccaacaccgggcccgccagaagaccctggagtctctgaagctgagccacgagcagcttctggaggttaagagaagaatgaaggtggaaatggagcagggtctgagcaaggagacgcatgcggtcgcccctgtgaagatgctgcccacttacgtgtgtgccactccagatggcacagagaaaggagacttcttggccttggatcttggaggaacaaacttccgggtcctgctggtgcgtgtgcgtaatggcaagcggaggggcgtggagatgcataacaagatctactccatcccacaggaggttatgcatggcactggggaagagctcttcgaccacattgtccagtgcattgcggacttcctggagtacatgggcatgaagggcgtgtccctgcctttgggtttcacattctccttcccttgccagcagaacagcctagaccagagcatcctcctcaagtggacaaagggattcaaggcatctggctgcgagggtgaggatgtggtcaccttgctgaaggaagcgattcaccggcgagaggagtttgacctggatgtggttgccgtggtgaatgacacagttgggactatgatgacttgtggctacgaagaccctcactgtgaagttggcctcattgttggcaccggaagcaacgcctgctacatggaagagatgcgtaatgtggagctggtggacggagaggagggacggatgtgtgtcaacatggagtggggagcatttggggacaatggctgcctggatgacttgcggaccgtgtttgatgttgctgtggatgagctttctctcaaccctggcaaacagaggttcgagaagatgatcagcggcatgtacttgggagagattgtgcgcaacattctcatcgatttcacgaagcgggggctgctcttccgaggccgcatctcagagcgcctcaagacaaggggaatctttgaaactaagttcctgtctcagatagagagcgactgcctagccctgctacaggttcgtgccatcctgcgccacctagggctggagagcacgtgcgatgacagcatcatcgtgaaggaggtgtgcactgtggttgcccggcgcgctgcacagctctgtggcgcaggcatggccgccgtagtggacaagataagagagaaccgtgggctggacaacctcaaagtgacagtgggcgtggacgggactctgtataagcttcatcctcactttgccaaggtcatgcatgagacggtgagagatctggctccgaaatgtgacgtgtccttcctggaatccgaggacggcagtgggaagggagcagctctcatcactgccgtggcctgccgcatccgggaggctgggcagagatagaagcttggggaccagacggggcttctctgcttcctcacttccccgttttaaattatgagaagatggaccccttggcagagaggaccctgtgagactgggacttttgtctctgtatattcactgtagagtttggtacccaatccttggccttcctgagaatctgaagtaaggagttgttcgcagttcctgctggtcacctcctgggatggtcctcccccactctacttcctgtacaatcctatgggatggggacagtcttgagaaaatggttgcctcagcttggagctgaacctgacatttgtaggtggagaacatcttgaaatgtcgatgcttctctcatcagaggtagatgttgggtgggagggaggaggagagataggacgtcccctgccctacgtggctgtccctcttcaactcaacccataagcatcaccctgccggttctaaaacatttgctgtcctgggatagaggaatctgaaccaaagctagagtggacgtcttcttcaagtgtttgtggctttacctcacatggctgaatgtgtcatccacgagctacagaccttggggacaggagtggctttggtcgctttttagttttttgttttgttttgtttttttcttttttaatttatgtttgaaatttacttagtttaaagcaggtcctctccattgtgtaatggttg

SEQ ID NO: 1784 - DNA, 2400 bp, Rattus norvegicus
  Genbank Accession No. NM_012736
ggtgaggccgactgactccgttctagctggaggttcctgacttccctgctcgccgacccctggcgtgtgacgaccgatctcaggctgagcaatggcgtttcaaaaggtagtgaaagggactattcttatgggtggaggagctctggccactgttttgggactctctcagtttgctcactacagaaggaagcaagtaagcctggcgtatgtggaagcagcaacatgcttctcagagcccgtgaacagggagcctccttccagagaagctcagctcatgactctgcagaacacatcggaatttgacatcctcgtcattggaggaggagccacaggatgtggctgtgcgctagacgccgtcaccagaggactgaaaacagcccttgtagagagaaatgacttcgcatcagggactagcagcagaagcactaaattgatccatggtggcgtacgatacctccagaaggctatcacgaacttggatgttgaacagtataggatggtgaaagaggcccttcatgaacgtgccaacttactagaaatcgctccccatctatcagctccgctgcctataatgctgccactttataagtggtggcagttaccttattactgggtgggaatcaagatgtatgatctggttgcaggaagtcattgcctgaagagcagttatgtcctcagtaaatccagagcccttgagcatttccccatgctccagaaggacaagctggtcggagccattgtctactatgatggacagcacaatgacgcccggatgaacctcgccatcgccctcaccgctgccaggtacggggctgccacggccaattacatggaggtggtgagcttgctcaagaagacagaccccgaaactgggaaagagcgcgtgagtggtgcccggtgcaaggacgtgctcacagggcatgagtttaacgtgagagctaaatgcgttatcaatgccaccggccctttcacagactccgtgcgcaaaatggatgataacgatgttgttcccatctgccagcccagtgcaggggttcacattgtgatgcccgggtactacagccccgagaacatgggacttcttgatcctgcaaccagtgatggcagagttattttcttcttgccttgggagaagatgacaattgcgggtaccactgattcgccaacggacgtcacgcaccatcctattccttcggaagacgacattaacttcatcttaaatgaagtgcggaactacctgagttgcgacgttgaagtgagaagaggggatgtcctggcagcgtggagtggcattcgcccgcttgttaccgatcccaagtctgcaaacactcagtccatctctcgaaatcatgttgtggaagtcagcgacagtggcctcatcacaatagcaggtgggaagtggaccacatatcgctccatggcagaagatactgtgaacaaagctgtcaagcttcacaacttgaatgcaggacccagtaggaccgttgggctcttccttcaaggaggcaaagattggagccccacactctacatcaggcttgtccaggactatgggcttgagagtgaggttgcacaacacctggccaaaacctatggtgacaaggctttcgacgtggccaaaatggcaagtgtgactggaaaacggtggcctgttgttggagtgcgtcttgtgtcagaatttccgtacatcgaagcagaggtgaaatatgggattaaggagtacgcatgcaccgctgttgacatgatttcacgtcgcacccgcctggcctttcttaatgttcaggctgcagaggaagccctgcccaagattgttgagttaatgggaagagaattgaactggagtgaattgaggaaacaggaagaacttgaaacagccacgaggtttctgtactatgaaatgggctataagtctcgaacagaacaactcacagatagtactgaaatcagcctgctgcctccagacatcgatcggtacaagaagagatttcacatgtttgatgaagacgaaaaaggcttcattaccattgttgatgttcaacgtgtgctagagagtatcaatgtacaaatggacgaagacacactacatgaaattctctgtgaagtagacttgaacaagaatggtcaggttgagctccatgagtttctgcagctgatgagcgcagttcatacaggaagggtgtctggaagccggcttgccatcctcatgaagactgccgaggagaacttggaccgtagagttccaatccccgtggatcgtagttgtggaggattgtgagtctgaccaataaatccacaaccaacaagcctaggacagtcagcactatgtacaaccagagacgacttaaaccactctaaaatagtggccattgtagctgcctttttttttttttttttttaaaa

SEQ ID NO: 1785 - DNA, 3945 bp, Rattus norvegicus
  Genbank Accession No. NM_012744
cgcggcggccacggcttgaggcgacggggcgaagatgctgaagttccaaacagttcgagggggcctgaggctcctgggtgtccgccgatcctccacagcccccgttgcctccccaaatgtccggcgtctggagtacaagcccatcaagaaagtaatggtggccaacagaggtgagattgccatccgagtgtttcgtgcctgcacagagctgggtatccgcacagtggctgtctactcggagcaggacacaggccagatgcaccggcagaaagctgatgaagcctaccttattggccgtgggctggctcctgtgcaagcctacctgcacattccagacatcattaaggtggccaaggagaatggtgtagatgctgtgcaccctggctatgggttcctctcagagagagcagactttgcccaggcctgccaagatgctggagtccgattcattggtccaagcccagaggtggtccgcaagatgggagacaaggtggaagcccgggccattgccattgctgcaggcgttccagtggtccctggcactaattcccccatcaattccctgcatgaggcacacgagttctctaacacctatggtttccctattatcttcaaggctgcctatggaggtgggggccgtggcatgagggttgtgcatagctacgaggagctggaagagaattacacccgggcctaccctgaggccttggcagcctttgggaatggggcattgtttgtggagaaattcattgagaagccaagacacattgaggtgcagatcctaggggaccaatatgggaacatcttgcacttgtatgagcgggactgctccatccagcggcggcaccagaaggtggtagagattgcccctgctacccacctggacccccaacttcggtcacgcctcaccagtgactctgtcaaacttgccaagcaggttggctatgagaatgcaggcactgtggagttcctggtggacaagcatggcaagcactacttcatcgaggtcaattcccgcctgcaggtggagcacacggtcactgaggagattacagatgtggacctggtccatgctcagatccatgtgtccgaaggccggagcctgcctgacctaggcctgcggcaggaaaacatccgaatcaatggttgtgccattcagtgtcgggtcaccactgaggaccctgcacgcagcttccagccagacactggccgcattgaggttttccggagtggtgagggcatgggcatccgcctggacaatgcctcagcattccagggagctgtcatatccccccactatgactccctgctcgtcaaagtcattgcccatggcaaagaccaccctacagctgccaccaagatgagcagagccctggcggagttccgtgtccgaggtgtaaagaccaacatccccttcctgcagaatgtgctcaacaaccagcagttcctagcgggcattgtggacacccagttcatcgatgagaaccccgagctgttccagctgcggcctgcacagaaccgggcccagaagttgctacattaccttggacacgtcatggtcaatggccctaccactccaatccccgtcaaggtcagtcccagccctgtggaccccattgttcctgtggtgcccataggcccacccccagctggtttcagagacatccttctgcgagaggggccagagggctttgccagagctgtgcggaatcaccaggggctgctgctaatggacacaaccttccgggatgcccaccagtcactacttgccactagagtgcgcacacacgatctcaaaaagattgcaccctacgttgcccacaacttcaacaacctcttcagcatagagaactggggaggagccacatttgacgtggccatgcgcttcttgtatgagtgcccctggcggcggctccaggagctccgggagctcatccccaacatcccattccagatgctactgaggggggccaatgctgtgggctacaccaactaccctgacaacgtggtcttcaagttctgtgaggtggccaaagagaatggcatggacgtcttccggatctttgactcccttaactacctgccaaacatgctgctgggcatggaagcagctggcagtgctgggggtgtggtggaagctgccatctcctacacgggtgacgtggctgaccccagtcgcactaaatactcactggagtactacatgggcttagctgaagaactggtgcgagccggcactcacatcctctgcattaaggacatggcaggcctgctgaagcctgcagcatgcaccatgctggtcagctccctccgggaccggttccccgacctcccactgcacatccatacccatgacacatcagggtcaggtgtggcagccatgttggcctgtgcacaagctggggctgatgttgtggatgtggcagtcgactctatgtctgggatgacctcacagcccagcatgggggccctggtggcctgtaccaaagggactcctctggacacagaggtacccctggagcgtgtgtttgactacagtgagtattgggaaggggctcgggggctgtatgcagcctttgattgcacggctaccatgaagtctggcaactcagacgtgtatgagaatgaggatccagggggccagtacaccaacctacacttccaggcccacagcatgggacttggctccaagttcaaggaggtcaagaaggcctatgtggaggctaaccagatgctgggggacctcatcaaggtgacaccatcctccaagattgtgggggatctggcccagttcatggtgcagaacgggttgagccgggcagaggcagaagctcaggcagaagagctgtccttcccccgctctgtggtggagttcctgcagggctacattggcattccccatgggggtttccctgaacccttccgttctaaggtgctaaaggacctgccaaggatagaaggagggcctggagcctccctccctcccttgaacctgaaggagctggagaaggacctgattgataggcatggagaggaggtgaccccagaggacgttctctctgcagccatgtaccctgatgtctttgctcagttcaaagacttcacggctacctttggccccctggatagcctgaatactcgtctctttcttcaaggacccaaaattgcagaggagtttgaggttgagctggaacggggcaagaccttgcacatcaaagccctggctgtaagcgacctgaaccgtgctggccagaggcaggtgttctttgaactcaatgggcagcttcgatccattctggttaaagacacccaggccatgaaggagatgcacttccatcccaaggccttgaaggatgtgaagggccaaattggggcccctatgcctgggaaggtcatagacgtcaaggtggcagcaggagccaaggtggttaagggccagcccctctgtgtgctcagcgccatgaagatggagactgtggtgacttcgcccatggagggcactatccgaaaggttcacgtgaccaaggacatgactctggaaggcgatgacctcatcctagagattgagtgatcttactccagactggcagcctggccaaccctaccccaagcctctcaacagaagctgtgcagccagggcaggcccaggcagtacctgagggctaggccttgaggtcctgtcccatgggacagcacacacactacctgcaatggccctcccattcccttcagctatttgtccttgtcttgctggcaggcagttctcacatattcatctcttgccaaataagggtctgctcctcgtgggagaccacaggtgtacagtaggtggccttgtacctgggagaggggttctacctctgggggtagagggaagaagacctaattcataggtcctgggaaatttgctcaataaaagtggccttcccttgccctccacaaaaa

SEQ ID NO: 1786 - DNA, 2924 bp, Rattus norvegicus
  Genbank Accession No. NM_012747
atggctcagtggaaccagctccagcagctggacacgcgctacctggagcagcttcatcagctgtacagcgatagcttccccatggagctgcggcagttcctggcgccttggattgagagccaagattgggcatatgcagccagcaaagagtcacacgccactctggtgtttcataacctcttgggcgagatcgaccagcagtatagccgattcctgcaggagtccaatgtcctctatcagcacaacctgcgaagaatcaagcagttcctgcagagcaggtatcttgagaagccaatggaaattgcccggattgtggcccgatgcctgtgggaagagtctcgcctcctccagacggcagccacggcagcccagcaagggggccaggccaaccaccccacagctgccgtagtgacggagaagcagcagatgctggaacagcatcttcaggatgtccggaagcgtgtgcaggatctagaacagaaaatgaaagtggtggagaatctccaggatgactttgatttcaactataaaaccctcaagagtcaaggagacatgcaggatctgaatggaaacaaccagtctgtgaccagacagaagatgcagcagctggagcagatgctcacggccctggaccagatgcggaggagcatcgtgagcgagctggcagggctcttgtcagcaatggagtacgtgcagaagacactgaccgatgaagagctggctgactggaagaggcggcagcagatagcgtgcatcggaggccctcccaacatctgcctggaccgtctggaaaactggataacttcattagcagaatctcaacttcagacccgccaacaaattaagaaactggaggagctgcagcagaaagtgtcctacaagggggaccctattgtgcagcaccggccaatgctggaggagaggatcgtggatctgttcagaaacttaatgaagagtgccttcgtggtggagcggcagccctgtatgcccatgcacccggaccggcccttagtcatcaagactggtgtccagtttaccacaaaagtcaggttgctggtcaaatttcctgagttgaattatcagcttaaaattaaagtgtgcattgataaggactctggggatgtcgctgccctcagagggtctcggaaatttaacattctgggcacgaacacaaaggtgatgaacatggaggagtccaacaacggtagcctgtctgcagagttcaagcacctgaccctgagggagcagagatgtgggaatgggggccgtgccaattgtgatgcctccttgattgtcactgaggagctgcacctgatcacctttgagacagaggtgtaccaccaaggtctcaagatcgacctagagacccactccttgccagtcgtggtgatctccaacatctgtcagatgcctaatgcttgggcatcaatcctgtggtataacatgctgaccaataaccccaagaacgtgaacttcttcactaagcctccgattggaacctgggaccaagtggccgaggtgctgagctggcagttctcgtccaccaccaagcgagggctgagcatcgagcagctgaccaccctggccgagaagctcttagggcctggtgtgaactactcagggtgtcagatcacatgggctaagttttgcaaagaaaacatggccggcaagggcttctcgttctgggtctggctagacaatatcatcgaccttgtgaaaaagtatatcttggccctttggaatgaagggtacatcatgggtttcatcagcaaggagcgggagagggccatcctaagcacaaagcccccgggcaccttcctgctgcggttcagtgagagcagcaaggaaggaggggtcactttcacttgggtggaaaaggacatcagtggcaagacccagatccagtctgtagaaccatataccaagcagcagctgaacaacatgtcatttgctgaaatcatcatgggctataagatcatggacgctaccaacatcctggtatccccactggtctacctctaccctgacattcccaaggaggaggcattcggaaagtattgtcgccccgagagccaggagcaccctgaagctgacccaggtagtgctgccccttacctgaagaccaagttcatctgtgtgacaccaacgacctgcagcaataccattgacctgccgatgtccccccgcactttagattcattgatgcagtttggaaataacggtgaaggtgctgagccctcagcaggagggcagtttgagtcgctcacgtttgacatggatctgacctcggagtgtgctacctccccgatgtgaggagctgaaaggcaaagctacagagtatgactgagacactgcccatgtcaccttagcagcaactcagatcactgaactcactgtgtccagattttttctttaacctcctacttctgctgtctttgggcagtctgggtactttttaaaatagagaactgagtgagcgtgggtgatgcgctcttatgtgaggaggagggcacctcttgagtccgtgatggctgtgaaagcagagggctgggggggagcgaaaggaaacacctatgttctgtccgcctgtcctcctggtttgttgttgacaagcgcctcctggtgccatggcatcctgctgcccctttctgtgagctgataccccaggctgggactcccggctctgcactttcaacctggttaatgtccacatagaagctaggactaagcctataggcttctctttaagttaaaaaaaaaaaaaatactaagaattaaagggcaaaacacactgaaaacagcatagcctttccatatcaaagaaaactcgggtaacagccttttcggtgctttaagctgtcttaggctgatcatttatataaactctgcaatggttcaatcaatctgtaaagacagctgagaac

SEQ ID NO: 1787 - DNA, 2142 bp, Rattus norvegicus
  Genbank Accession No. NM_012749
atggtgaaactcgcaaaggccggcaaaacccacggagagtccaagaaaatggctcctcctccaaaggaggtggaagaagatagtgaggatgaagaaatgtcagaagatgaagatgacagcagtggagaagaggaggttgtcatccctcagaagaaaggcaaaaaggctaccacaactccagcaaagaaggtggttgtttcacaaacaaaaaaggctgcagttcccacaccagctaagaaagcagctgttaccccaggcaaaaaggcagcagccacaccagccaagaaagctgttacaccagccaaagtagttccaacacctggtaaaaagggagctgcacaagcaaaagcattggtaccaactcctggtaaaaagggagctgtcactccagccaagggggctaagaatggtaagaatgccaagaaggaagacagcgatgaggatgaagatgaagaggatgaagatgacagcgatgaggatgaagatgaagaggatgaatttgagccaccggtagtaaaaggagtgaaaccagcaaaagcagctcctgctgctcctgcctcagaggatgaggatgaggaagatgatgatgatgaagatgatgatgatgatgatgaagaggaggaggaggaagatgactctgaggaagaagttatggagatcacaccagccaaaggaaagaaaactcctgcaaaagttgttcctgtgaaagccaagagtgtggccgaggaggaggaagatgatgaggatgatgaagatgaagaggaggatgaagatgaagaagatgaagaggacgatgaagatgaggatgaggaagaagaggaagaacctgttaaagcagcacctggaaaacggaagaaggagatgaccaagcagaaagaagcccctgaagccaagaaacagaaaatagaaggctcagaaccaactacacctttcaacctgttcattggaaaccttaatccaaacaagtctgttgctgaattaaaagttgccatcagtgaactttttgctaaaaatgatcttgctgctgtggatgtcagaactggtacaaataggaaatttggttatgttgattttgagtctgctgaagacctagaaaaggccctggagctcactggtttaaaagtgtttggcaatgaaattaaactagaaaaaccaaaaggaagagatagtaagaaagttcgagctgcaagaacacttttagccaaaaacctctctttcaacatcactgaggatgaattaaaagaagtgtttgaagatgctgtggagatcagattagtcagccaggatgggagaagtaaagggattgcttatattgaatttaagtctgaggctgatgcagagaaaaacttggaagaaaagcagggggcagaaattgatggacggtctgtttcactctactacactggagagaaaggacaaaggcaagagagaactggaaagaatagcacttggagtggtgaatcaaagactttggttttaagtaacctttcctacagtgcaacagaagaaacacttcaggaagtattcgagaaagcaacctttattaaagtgccccagaacccacatggcaaatctaaagggtatgcatttatagaatttgcttcatttgaagatgctaaagaagctttaaattcctgtaataaaatggaaattgagggcagaacaatcaggctggagttgcaaggacccaggggatcacctaatgcgagaagtcagccatccaaaactctgtttgtcaaaggtctgtctgaggataccactgaagagaccttaaaagaatcatttgagggctctgttcgtgcaagaatagtaactgatcgggaaactggttcttctaaagggtttggttttgtagactttaatagtgaggaagatgccaaagctgccaaggaggccatggaagatggagaaattgatggaaacaaagttaccttggactgggccaaacctaagggtgaaggtggctttggtggtcgaggtggaggcagaggaggtttcggaggcagaggtggtggcagaggcggaagaggcggatttggcggaagaggccggggagggtttggaggcagaggaggcttccgaggcggcagaggaggcgggggagacttcaagccacaaggaaagaagacgaagtttgaatag

SEQ ID NO: 1788 - DNA, 2506 bp, Rattus norvegicus
  Genbank Accession No. NM_012751
cttgggttgtggcagtgagtcccaccagacccgccctttgcacaccacttccgaaggccggggtcttctgcccgccaggccgggacactataccctattcatttttttattgcagtgcctgagtcttcttttaaaacaagatgccgtcgggtttccagcagatcggctctgaagatggggaaccccctcagcagcgagtgactgggacactggtccttgctgtattctcagctgtgcttggctcccttcagtttggctataacattggagtcatcaacgccccacagaaagtgattgaacagagctacaatgcaacttggctgggtaggcagggtcctgggggaccggactccatcccacaaggcaccctcactaccctttgggctctctccgtggccatcttctctgtgggtggcatgatttcctcctttctcattggcatcatttctcaatggttgggaaggaaaagggctatgctggccaacaatgtcttggctgtgctggggggcgccctcatgggcctagccaatgccgcggcctcctatgagatactcattctcggacggttcctcattggcgcctactcagggctaacatcagggttggtgcctatgtatgtgggagaaatcgcccccactcatcttcggggtgccttgggaacactcaaccaattggccatcgtcattggcattctggttgcccaggtgttgggtttggagtctatgctgggcacagctaccctgtggccattgcttctggctatcacagtactccctgctctcctgcagctgcttctgttgcccttctgtcctgagagcccccgatacctctacatcatccggaacctggaggggcctgcccgaaagagtctaaagcgcctgacaggctgggctgatgtgtctgatgcactggctgagctgaaggatgagaaacggaagttggaaagagagcgtccactgtccttgctgcagctcctgggcagccgcacccaccggcagcctctgattattgcagtggtgctgcagctgagccagcagctctcaggcatcaatgctgttttctactattcaaccagcatctttgagttagctggggtggaacagccagcctacgccaccataggagctggtgtggtcaataccgtcttcacgttggtctcggtgctcttagtagagcgagctgggcgacggacactccatctcctgggcctggcaggcatgtgtggctgtgccatcttgatgacggtggctctgctgctgctggagcgggttccatccatgagttatgtgtccatcgtggccatatttggctttgtggccttctttgagattggtcctggccccatcccctggttcattgtggccgagctcttcagccagggcccccgcccagcagccatggctgtagctggtttctccaactggacctgtaacttcatcgttggcatgggtttccagtatgttgcggatgctatgggtccctacgtcttccttctatttgccgtcctcctgcttggcttcttcatcttcaccttcctaagagtgcctgaaaccagaggccggacatttgaccagatctcggccaccttccgacggacaccttctctcttagagcaggaggtgaaacccagtacagaacttgaatacttagggccagatgagaatgactgaggggcaaaatggtgggagagccaccctccccaccagactccctcctttcctcgcagcactttagccctctcttcccttacctccaggatgaaggaaacagcagcctggggaactgggaagctggagggaggggcgggtcacatacccctcattccctctgtgtgattcttttggattatttatgtgttgtggctaggctgtggccacctagatgggcttttctcccgtcctgccttcctcttacccctatccagagactcagctctagaatacttctgttccctttaagagaaggggtctgctggagggtgaagctgccctgagttcagggggatgagaagcaggggggctgtgagtgagtgctttcctactatgactcctcccacaaactggcgctttcactgaactcttgccacatagactctgggtgaagggggttgtcttgacccctccagggcaaaggatacaccctcccaaaatctagccttgcctcgctgctgtaggctccaccctccagggcaaaggaacacaacagtacatccctgacagggcaaggatggtagagcacatcagtctccatttggggccctggcctgttccccagggctgccaagtgtgggtaccaacactttcttgttcccctccaggaagggtgctaaacccgaaagcttctgaccaactaaggcaggaggggatttgaaaggctgcctataaacactggttgggagggagcctttggtatttttgtatgtacgatagggagcagaaacctgggggctggtgtattaaatatgtatatagagattcatccataaagtcactgtatggagacaagt

SEQ ID NO: 1789 - DNA, 1844 bp, Rattus norvegicus
  Genbank Accession No. NM_012755
gagctcctgggcccggccgcggaccaccggagccgccagggcctcgccggaggagggcggggagaggaccatgtgaatgtgctccggaaccgagcgccacgccacgcagtgtttgaaaggaacacaatgctgatctagtcgtggcaaaaggtcagtcctactgctggtttagaagacatgtggtgtatataacgtttgtgatagttggtggaaatttgggagcttggataatgggctgtgtgcaatgtaaggataaagaagcagcgaaactgacggaggagagggacggcagcctgaaccagagctctgggtaccgctatggcacagaccccacccctcagcactaccccagcttcggtgtgacctccatcccgaactacaacaacttccacgcagccgggggccagggactcacggtctttgggggtgtgaactcctcctctcacaccgggaccctgcgtactagaggagggacaggagtgacactatttgtggcactttatgactatgaagcacggacagaagatgacctgagttttcacaaaggagaaaaatttcaaatattgaacagctcggaaggagactggtgggaagcccgctccttgacaactggggaaactggttacattcctagcaactacgtggctccagttgactccatccaggcagaagagtggtactttggaaaacttggccgcaaggatgctgagagacagctcctgtcctttggaaacccaagaggtacctttcttatccgcgagagcgaaaccaccaaaggtgcctactccctctccatccgagactgggacgacatgaagggagaccatgtcaaacattacaaaatccgcaagcttgacaacggcgggtactacatcaccacgagggcccagtttgagacccttcagcagcttgtacagcattactcagagagagccgcgggtctctgctgccgtctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtacctggaatggaaacacaaaagtagccataaagactcttaagccaggcacaatgtccccggaatccttcctggaggaagcacagatcatgaagaagctgaagcacgacaagctggtgcagctctatgcagttgtgtccgaagagcccatttacattgtcacggaatacatgaacaaaggaagtttgctcgacttcttaaaagacggtgaaggacgggctctgaaattgccaaacctcgtggacatggcggcacaggttgctgcaggaatggcttacatcgaacgcatgaattatatccacagagatctgcggtcagctaacattctggtggggaacggactcatttgcaagattgctgacttcggattggcccggttgattgaagacaatgagtacacagccagacaaggtgcaaagtttcccattaagtggacagcccccgaagcggccctgtatggaaggttcacaatcaagtctgacgtgtggtcctttggaatcttactcacagagctggtcaccaaaggcagagtgccgtacccaggcatgaacaaccgtgaggtgctggagcaggtggagagaggctacaggatgccctgcccgcaggactgcccgatctccctgcacgagctcatgatccactgctggaaaaaggatccggaggagcgccccactttcgagtacttgcagggcttcctggaggactactttaccgccacagagccccagtatcagcccggtgaaaacctgtga

SEQ ID NO: 1790 - DNA, 8810 bp, Rattus norvegicus
  Genbank Accession No. NM_012756
agcttcgactcgctgttgcggcgcgatcgagacccaggcgcggctcggaacggccagccgccgtgagccccacgccacacgcgatgcgggccgttctgccgggacccgtgcctccggggccgcgcgtcgcgctcctgctgccgctcctgctgctgctgctcgtggcggccgcgggctccgcgcagggccaggccgtggacttggacgccttgtgcagttacacatgggaagctgttgattccaaaaataatgcagtttataaaatcaacccctgtggacatgtggataatcccaggtgtgggccgacaagtgctgtctgtatgtgtgacctaaagtcagaaaactgccggtcagtgggtgactcacttttgagaagttcagccaaatcactcctggaatttaacaccactacgggctgccagccttcagagcacagaatccagactagcattacatttctgtgtgggaagaccctgggaactcctgaatttgtaactgccacagactgtgtgcattacttcgaatggaggactactgcagcctgcaagaaagacatatttaaagctgataaggaggtgccatgctatgtatttgatgacaagttacagaagcatgatttgaacccactgatcaagctgaatggcggctacctggtggatgactctgacgctgacgcatctctgttcatcaatgtgtgtagagacatagactcccttcgggaccccagcacacagctgagagtctgccctgctggcactgctgcctgtctgctgaaggggaaccaggcatttgatgttggccggcccaaggaggggctgaagctattgagcaaggacaggctcgttctgacttatgttaaggaagaaggagaaaagccagacttctgtaatggtcacagccctgcagtgacagtaacatttgtgtgcccatctgagcggagagagggcaccattcctaaactcactgccaactgtcgctatgaagttgagtggatcactgagtatgccagccacagagattacttggagagtgaaacctgctccctcagcagtgagcagcatgatattgctattgaccttagtcccttggcccagcatgaagaagggtccccctatgtagctgatggaggagaatataggttttttatgaatgtctgtggggacacaaaggtctcactctgtaacaaagaggctgctgtttgtcaagagaaaaaggtggattccactcaagtcaaaatagcaggaagacaccagaaccagacactccggtactcagatggagatctcaccctaatctattctggaggtgatgagtgtagttccggcttccagcggatgagtgtcataaactttgagtgcaacaaaaccgcaggtcaagatgggagaggagagcctgtgttcacaatcgaggtggactgcacatacttcttcacgtgggacactaaatatgcctgtgtaaaagagaaggaagatctcctctgcggggccatcgacggcaagaaacgttacgacctgtctgtgctggctcgtcactcagaatcagaacagaattgggaagcagtggatggcagccaggctgagtcagaaaagaggaatttcttcatcaatgtctgtcaccgggtgctgcaggcgggaaaggccaagaactgtcctgaaggtgctgccgtgtgtgctgtggataagagtggaagtaaaaatctaggaaaatttgtctcttctcctacaaaagagaaaggacacattcagctctcttactctgatggcgatgactgtggtaatgataagaaaataacaactaacatcacatttgtgtgcaaaccaggtgatctggaaagtgctccagtgctgagagctgcagggcccgatggctgctcctatgagtttgagtggcacacagctgctgcctgtgtcctgtcgcagacggagggagaaaactgcactgtccttgatgctcaggcagggttttcttttgatttgtcactcctcacaaagaagaatggtgcatataaagttgagacagacaagtatgacttctacataaatgtttgtggccctgtatccgtgaacctgtgtcagtcaaactcaggagcctgccaggtagcaaaaagtggtaagtcttggaacttggggctgagtaatactaagcttacgtactatgatgggatgatccagctgagctacaggaatggcacgctgtataacaatgaaaagcacacaccgagatccacactgattaccttcctctgtgaccgtgatgctggagtgggcttcccagaatatcaggaagaggacaactctacctacaacttccggtggtacaccagttatgcttgcccggaagagcccctggagtgcatggtgacagacccctccatgatggagcaatatgacctctccagtctagtgaagtttgaaggtggccgtggaggaaactggtatgccatggaaaactcccgagaacatttcacacggaggaaatactacctcaacgtgtgccggcctctaaatcctgtgccaggctgtgatcgatatgcatctgcttgccagagtaaatacgaaaacaatgagggctccttggcagagactgtggccatcagtaacttgggagttgcaaagacaggccctgtggtggaggagagcggcagcctcctcttagagtatgtgaacggctctgcgtgcaccaccagtgatggccggctaaccacctacagcaccaggatccatcttgtgtgtggtcgaggaactatgaattcccatcccatattcactttcaactgggaatgtgtggtcagtttcttgtggaacacggaggctgcctgccccatccagacgatcacagattcagaccaggcttgctctataagggaccccaacagcggatttgtgtttaatctgagcccacttaactattctcaaggacacatggtcttaggcattgggaagacttttgtgttcaatatctgtggtacaatgcctgcctgtggaacggttgcagggaagccagcccttggctgtgaggcagaaactaagatcaaagacattaaggatctgaagccagaaaggccagtcgggatggagaagagcctccagttgtctgccgaggggttcctcactctgacctacaaaggctcttctccttctgacagaggcacagccttcatcatccgtttcatttgcaatggtgacatttacccagggacccccaagttcctgcatcaggacattgactctgcacgagggatccggaacaccttctttgagtttgaaactgcattggcttgtattccttctgtagtggattgtcaagtgactgacccagctgggaacgagtacgacctgagtgccctgagcatggtcaggaagccgtggactgctgtggacacgtctgtgcatgggaagaagaggcgcttctatctgagcgtgtgcaccccactgccttacattcctggctgcgatggcattgcaatggggtcctgcatggtgtcagaagacaaaagtcagaacttgggtgtggtgcagatcagtcctcaagctactggaaacggatctctcagcatcctgtatgtgaatggggataggtgtggaaaccagcgctactccaccaggatagtgttcgaatgtgcccagacgtcgggctcacctatgttccagctcctgaacaactgtgagtatgtgtttgtgtggcgaacagtggaggcctgccctgtggtcagagaggaaggagacaactgccaggtgaaagaccccagacacggcaatttgtatgacctgaagcccctggccctcaatgacaccatcatcagtgctggcgagtacacctactacttccgggtctgtggaaagctgtccttagatgtgtgctctgcccatgatgggtccaaggcagtctcatcatgccaggaaaagaaaggaccacaaggattccagaaagtggcagggctccttaatcagaagctgactttcgaaaatggactgttgaaaatgaactacagtgggggggacacctgccataaggtgtatcagcgctccacaaccatctatttctactgtgaccggacgactcagaagccagtgtttctgaaggaaactttggactgctcctatttgtttgagtggcgaacacagtatgcctgcccacctttcaatgtgacagagtgctctatccaggatgaggctggcaactccattgacctctcctcactgtcaagatacagtgacaactgggaggctgtgaccaggacaggggccactgagcattacctcatcaacgtatgcaagtctctgtctccacaggctggcacagatccatgccctccagaggcagctgtttgtctgctggatggctccaagcctgtgaacctcggcagggtgagggatggtcctcagtggacagctggtgtgactgtcctgaagtatgtggatggtgacttgtgccccgacaaaattcggaaaaggtcaaccattattcgcttcacctgcagtgacagccaagtgaactccaggcctctgttcatcagtgctgtacaggactgtgagtacacattttcctggcccacacctgctgcctgtcctgtgaagagcaacatacacgatgactgccaagtcaccaaccccagcacaggccacctgtttgacctgagctccctaagtggcaaagctggcatcacagcctcctacagcgagaaggggatggtcttcatgagcatctgtgaggagaatgtgaactgtagccctggagtaggggcctgctttggacagaccaggatcagtgtgggccaggccagcaagaggctgagctacaaggatcaggtcttgcagctggtgtatgagaatgggtccccatgcccctccaagtcaggcctgaggtacaagagtgtcatcagcttcgtgtgccggccggaggctggacccaccaacaggcccatgctcatctccttggacaagcagtcgtgtacactcttcttctcctggcacacgcccctggcctgtgagcaggcgacggaatgcaccgtgcggaatggaagctcgattattgacctgtcacctctcatccaccgcactggtggttatgaagcatacgatgagagtgaggacgacacctctgataccacccctgacttctacatcaacatctgtcagccactgaatcccatgcatggagtgccctgccctgcaggcgcctcagtatgcaaagtccccgtggacgggccccctatagatattgggagagtcacaggccctccaatattcaatcccgtggccaatgaggtctacctgaactttgagagcagcactccttgcttagcggacaaatatatgaactacacctcactaattgcgtttcactgcaggagagggatcagcatgggaactcctaagctgataaggaacaatgactgtgactttgtgtttgagtgggagactccgattgtctgtcctgacgaagtgaagacacagggctgtgctgtaacagatgagcagctgctctatagcttcaacctgacgagcctttccacaagcactttcaaagtcactcgggacgctcacacatacagtataggggtgtgcacaacggcagctgacttagaccaggaaggctgcaaggacggcggggtctgtctgctctctgggagcaaaggagcttcttttgggcgcctagcgtcgatgcagctggattacaggcaccaggatgaagcagtcatcctgagttatgtgaacggtgatccttgccctccagaaacggaagatggcgagccctgtgtcttccccttcatttacaaaggggagacctatgacgaatgtgtattagagggacgagcgaaactgtggtgtagcaaaactgcgaattacgatcgtgaccacgagtggggcttctgcagaccgagcaacagtcaccggatgtctgcgatcatatttacttgtgatgagaacgaagatattgggaggccagaagtgttcagtgaagatcgtgggtgtgaggtgacatttgagtggaaaacaaaagttgtctgccctccgaagaagatggagtgcaagtttgttcagaagcataaaacctatgacttgcgattgctctcatccctcacggggtcctgggattttgtgcatgaaggaaactcgtactttatcaatctgtgccaaagagtatataaaggtcccctggactgctctgagagagccagcatttgcaagaagagtgccactggtcaagtccaggttttggggcttgttcatactcaaaaactggaagtcatagatgaaacagtccttgtcacttactcaaaaggccattcttgtggtgggaataagactgcatcctcagtgatcgagttgacctgtgcaaagactgtgggcaggcctgcattcaagaggtttgatattgacagctgcacctactacttttactggtactcacgggctgcctgtgctgtgagacctcaggaggtgaacatggtgaatggaactcttaccaaccctgtgactggcaagagcttcagcctcggggaaatttattttaagctgttcagcgcctctggggacatgagaagcaatggggacaactatctgtatgagatccagctctcctctatctccagctcttctaaccctgcgtgctccggtgccaacatctgccaggtgaagcccaatgaccagcacttcagcaggaaagtgggcacctctgacatgaccaagtactacgtccaagacggtgatctggatgtggtgtttacctcttcctccacgtgtggcaaagataagaccaagtctgtgtcttccaccatcttcttccactgtgaccctctgctgaaggacggggtccccgagttcagccacgagactgctgactgccagtaccttttctcctggtacacttcagctgtgtgtcctctgggtgtggactttgatgatgagaatgctgtgccagagtataaagggctctcagagcggagtcaggccgttggggcagtcctcagtctcctcctggtggcactgactggctgtctgctggccttgctgcttcataagaaggagagaagggaaactgtgataaacaagctgaccaattgctgcagaaggagctcgggggtgtcctataagtactcaaaggtcagcaaggaggaggagacagatgagaatgagacagaatggctgatggaagagatccaggtgccagcccccagactaggcaaggacgggcaggagaacggccacattaccaccaagacggtgaaagcagaagctctcacttccctgcatggggatgaccaagacagtgaggatgaggtcctgaccatcccagaggtgaaagttcacacaggcagaggagccgaggtggaaagctcacagcccctgagaaatccccagcgcaaggtcctgaaggaaagggagggggagaggatggggctggtccgcggtgagaaggccagaagagggaagttcagacccggacagcgcaagccaacaacccctgccaagctggtgtccttccatgatgacagtgacgaggacctcctacacatctgactccgtggtgcctacaggagaaggtggcaccatggacagccaagcatctccaaccaaataagacttcagctcgatgatgcgtctgtcattttgcctttaacaaaactgcttcaaagggaagtttctgtaatgggggagaggatgggggaggtgggcaccactcttccatgatcgtttacagtcagtggaacaaggtgttgcttgaatcggccaaagggcgctacttggtgcccagggttttgccccaagtcctcacttacgatcatagctgctgtgtgcttccaacaggtgcccaggccacatgcatctcacaacagagggctgtgtttgaaaaaaacccttgctgctttagaccctatagggtgaccatttatatttttagcattgtaattctctccccctatttattgactttgacaattactactcaggtttgcgaaaaaggaaaaaaaaaaaaaaaccagtttcttctgccagcaagggcataaggtgaagctggcattatgctggagccttgtacgtggctcctgagctggtccttgatgcacactttagtgagctgcagtattctattcttcgctttgcgttttgtaagggcacacatacatgcacaggtccccgagtgcctcggtttgggaaggcccgcctgctccgtgccctacctcgtctctatagctgcagctctttgcacgaatccttctgggtgtcgcttttgcccgctggtgagcgccagcagctcacccagaggtgggtgtttgtgcatgcgatggagtagaggctcttggagaggagccgcacttcaggtttgggctgtaggtctcatctcttcaggttctcaatgccacctttactgtgctttttgcttttattttaagggggaaatgtttatcacccattcaacctataagaagccttaatttgcacagggtgacttacagacaccgtgaaatacggtgggccagtgttgtgtgtgggcttgtgcagggcagtgtcccgggatggaaggccaggcccggtccactggctgtggactcctttcctgatgtgttcaatgacttctcacattatagagttgtatataggtggtatttacatacccagaagcaaagtaccccgcagaatttcttggtttatgcctgattttgctagcttatttgatttcacattgagtgtatttttaaaaattgatttttttcttcattttttaatcaactttactgtaatatgaagtattcaatttcaataaaaataaattattaaaaaaaaaaaaaaaaaaaaaaaaaaaaa

SEQ ID NO: 1791 - DNA, 1209 bp, Rattus norvegicus
  Genbank Accession No. NM_012762
atggccgacaaggtcctgagggcaaagaggaagcaatttatcaactcagtgagtgtagggacaataaatggattgctggatgaacttttagagaagagagtcctgaaccaggaagagatggatacaatcaaacttgcaaatatcactgttatggaaaaggcacgagacctgtgcgatcatgtcactaaaaaaggaccccgggcaagccagatgtttatcacttacatttgtaatgaagactgctacctggcagaaattctggagcttcagtcaggtccatcagctgaaactgtttttgttacagaagattctaagggaggacatcctttctcctcagaaacaaaagaaaaactgaacaaagaaggtggcgcatttcctggaccgagtggttccctcaagttttgccctttagaaatagcccagaaattatggaaagaaaatcattcagagatttatccaataatgaaaacacccactcgtacacgtcttgccctcattatctgcaacacagactttcaacatctttctcggagagtcggagctgatgttgacctcagagaaatgaagttgctgctgcaggatctgggctatactgtgaaagtcaaagaaaatctcacagctctggagatgacaaaagaattgaaagaatttgctgcctgcccagagcacaagacttctgacagtaccttccttgtattcatgtctcatggtctccaggagggaatatgtgggatcacatactctaatgaagttgcagatattttaaaggttgacacaatctttcaaatgatgaacacattgaagtgcccaagcttgaaagacaagcccaaggttatcattattcaggcatgccgtggagagaaacaaggagtggtgttgttaaaagattcagtaggaaactccgaagagggattcttaacagatgcaatttttgaagatgatggcattaagaaggcccatatagagaaagattttattgctttctgctcttcaacaccagataatgtgtcctggagacatcctgtccggggatccctcttcattgagtcactcatcaaacacatgaaagaatatgcctggtcttgtgacttggaggacattttcagaaaggttcgattttctttcgaacaaccagactctagactacagatgccaaccactgaaagggtgaccctgacaaaacgtttctacctcttcccaggacattag

SEQ ID NO: 1792 - DNA, 1843 bp, Rattus norvegicus
  Genbank Accession No. NM_012766
tctcactcacacgcgacgcgtcgcttctcctaggactcgctagcccgcactcctgctctcacccgtgagccatagcaggatggagctgctgtgttgcgagggcacccggctcgcgccccgggccgggcccgacccgcggctactgggggaccagcgtgtcctgcagagtttgctccgcttggaggagcgctacgtgccgcgaggctcctacttccagtgcgtgcaaaaggagatcaagccgcacatgcggaagatgctggcgtactggatgctggaggtgtgtgaggagcagcgctgcgaggaggatgtcttccctctggctatgaactacctggatcgctacctgtcctgcgtccccacccgaaaggcgcaactgcagcttctaggtaccgtctgcctgttgctggcctccaagctgcgcgaaaccacacccctgactattgagaagctctgcatctatacggaccaagctatggctccctggcagttgcgggaatgggaggtgctggtcctggggaagctcaagtgggacctggctgctgtgattgcgcacgacttcctggccttgattctgcaccgcctctctctgcccagtgaccggcaggcactggtcaaaaagcatgctcagacctttttggccctctgtgccacagattacacctttgcgatgtaccctccatccatgatcgccacgggcagcatcggggctgcagtgctaggcctgggtgcctgctctatgtctgcagatgagctcacagagctgctggcgggaatcacaggcactgaagtggactgcctgcgtgcctgccaggagcagcagatcgaagctgccctcagggagagcctcagggaagctgctcagacagcccccagccccgtgcccaaagcccccggggggtctagcagccaggggcccagtcagaccagcactcccacagatgtcacagccatccacctgtagtttgggacaggccccctcaggtggccaccaagcagaggaggggcccctgccaccccctccctccctctaggaacaattcatgccatatctgaagcccgagggggctctttttcccctcacaaagcccaaggggccaggtcctgcctatccccacagtgtgcactaaggggctgcttggtcatgagggtgtctacatggccagtcagttcctcttccttcccactcaaccagcttggctgtcctgggccatgatggtcagagagatacaaacaggtagaacccacacaccagcatttcttttgagtccctcctctgtctggggcgccgatcctttcagttgccaaaacgccccagtaccttccaaaggtgttgttgcccctcgcagggtcactgcatttggatctgggtccttcagaaatcccgatagacgcctatgaggagccaacctagatggctgctgtgtaatccctactccagctgctcttagcgggaaccagcctaggccttggctagaagagcaagcgcccgtaaactgttgctttgcttcctgctatgcttctgtggttgagggtcttgagggtgctgatggtcattttaatttattgctttgaatacaccgtaagagggtacagtgaggcctgtaccccacaagtggtggtaaccctggcggttgctctttccctcccctctgctaccgctttgtggcccaggagctgctacagcctgggagggggtcctgccttcctctccgtagccctccagctcatcttcagcggggagggtttaatagggatggatgccgtggaggtgactggactatccggagagagggcgagccccatggacacaggtgtttcctcaggccacaaggtttggggcgcc

SEQ ID NO: 1793 - DNA, 2623 bp, Rattus norvegicus
  Genbank Accession No. NM_012778
gagctcttggagggagttgagcaccaggcatccagcggttatgtcaaggcccctgccaacatggccagcgaaatcaagaagaagctcttctggagggctgtggtggctgagttcctggccatgaccctcttcgtcttcatcagcatcggttctgccctaggcttcaattacccactggagagaaaccagacgctggtccaggacaatgtgaaggtgtcactggcctttggtctgagcatcgctactctggcccaaagtgtgggtcacatcagtggtgctcacctcaacccagcggtcacactggggcttctgctcagctgtcagatcagcatcctccgggctgtcatgtatatcatcgcccagtgtgtgggagccatcgttgcctccgccatcctctccggcatcacctcctccctgctcgagaactcacttggccgaaatgacctggctcgaggtgtgaactccggccagggcctgggcattgagatcattggcaccctgcagctggtgctgtgcgttctggctaccactgaccggaggcgccgagacttaggtggctcagccccacttgccattggcttgtctgtggctcttggacacctgctggccattgactacactggctgtgggatcaaccctgcccggtcatttggctctgctgtgctcacccgcaacttctcaaaccactggattttctgggtgggaccattcattgggagtgccctggcagtgctgatctatgacttcatcctggccccacgcagcagcgactttacagaccgcatgaaggtgtggaccagtggccaagtggaggagtatgacctggatgctgatgatatcaactccagggtggagatgaagcccaaatagaggaggcttggcctgggcatccgtatgggggtggggcagggatgggcggagggaggggagggctgaactcatattatagacactctgacaagctgaccaaagtcactccccaagacctggctgtcccacatggtctagccttgtctggggcagtaatatcactgtctttctttctgtttcctggtctcagagcttcctggggcccaagacttatcaactcagcacctcactcctttgacatcatggaggagtgaaagggagggacccacctgctagttgtcccctcagagtgtgctagaaagtccccctcactccaaagttgcccagcaagacacccaccttaggtgcctgggattctgccattgttactttgtgcctttgatcatggccttccttaggtaggcaccttagccccaaaggcactttgagggagaggaagtcccttagctttcccctttggtctgacttacctccaggacccttccccttaaactcactctaagaccttggaattttccctatgctgaggcctcagtgatcacgtctgtaaagtggcaaggaagggacagctttggggactctgtaagtgtggacaagccacaggttctagaagggagagtctagacagcactgcatagtgcacctggctgagctctttcccaacatccacagcccatgagcacgtgtggatgagctacagagcggagaagcagtccaggatgctgggagtgcctgttcacacagagagccttcctttaggcaggtctgttgcagcagagtaaaggtcatttcatggtggaggaagagctcacgaaatctctcctagctctagtgggtctgctcatgtaccatggcaccaactggctgtttccctctagtctcccttgcagtgtagatgtgacgtgtgtgtttattaaagagcactgggctattgcagcgtcatgtctgaggaaagaagcagctagacatgcaacagaccccagacagatgcccatgccgggcacacaggggtttggatgcccctagttcatcatgatcaaggaggccactcttgtcctggcttatgagctgctggctggatgaatttgaccagagcctggacaatctgaaggggctcactatgtgactccaggcacagtctccttattgcaaggacctgatgctgtggcttctgctatagcccaagaacatctcagagtgcattcagctcagggcttgcatttagctctctgggttattctattcaatcccaccaagccagagcagctctaccactgtgccgttaaccatgtcgtgaaccgagagccacattcttcaggtgcttagaagcagcagaatagtcaggaggccattgaccactggcatagtacagctgcatactcttctccattccctagcaggcactatactcacttcacaggtcaggacactgaggacccatatgctcaactatatcatattgggtcaagctcagcagtcaaagccatgtttggccacttcatagtcaatgaagtggactcctctcatttccagcttctccgtttctgcctggacaatggctaagggccagggatgggggtaggggtgggagtggaggtggtgagagctgtgctggaggggggcaggcaggcccatcccacctggctctggccactgtgaaccaggaccctgcatctgtctgcctgtgtatgtttctttgcaattggaattccatcttatggtaagaaaataaaggacaatgacttgtaaggtc

SEQ ID NO: 1794 - DNA, 1426 bp, Rattus norvegicus
  Genbank Accession No. NM_012779
ggcacgaggcaccgcgcgcagagccccgcagacagacgcccgccgctaccagcgccgccccgacggccgccccgcaaccctcccgctgccaccgggcccccaaggcaccatgaaaaaggaggtgtgctcccttgccttcttcaaggcggtgttcgcagagttcctggccaccctcatcttcgtcttctttggcctgggctcagcactcaagtggccctcggctctgcccaccattctgcaaatctcaattgcctttggcctggccataggtaccttagcccaagctctgggacctgtgagtggtggccacatcaatccagccattactctggccctcttaataggaaaccagatctcgctgctccgagctgtcttctacgtggcagcccagctggtgggcgccattgctggggcaggcatcctgtactggctggcgccactcaatgcccggggtaacctggccgtcaatgcgctgaacaacaacacaacgcctggcaaggccatggtggtggagttaatcttgactttccagctagccctctgcatcttctcctccaccgactctcgccgaaccagccctgtgggctccccagccttatccattggcttgtctgtcacactgggccatcttgtggggatctacttcaccggctgttccatgaacccagcccgatctttcggccctgcggtggtcatgaaccggttcagcccctctcactgggtcttctgggtagggcctattgtgggggccatgctggcggccatcctctatttctacctgctcttcccctcctctctgagcctccatgatcgcgtggctgtcgtcaaaggcacatatgagccggaggaggactgggaagatcatcgagaggagaggaagaagaccatcgagctgacggcacactgactggtgccggacaggggccagtccctcagcccctggaccactggagaaaaggaagacgaagagtttgaagcacccctccccaacatcctctcagctggggaagaggcattggatccccatgctgctgcacagggacaggagcagaagcccataatgggacacttgggtgtgggccaagggctggagtctgacagggtcagggacatagccgctttggaatcaggcagaatgtctgccacagctcagacctcagagattcgtgaatgcggtgccaagctcacaggcggtccaggaccacaccagaaagggacgacagcttgcttatctctcccaacccagtatctcaagtgccaaagccggcccccaggtggacagaggggacatttcccccagagctcttcaggagagggatagatggctcacggagtgctattttatttatttctggtcaaggatgggggtggggtggggctgctggtgtttgagctggcgcttcccaataaaccacctatcttcaaa

SEQ ID NO: 1795 - DNA, 330 bp, Rattus norvegicus
  Genbank Accession No. NM_012786
gacattcagggtgcctctttggggccaaggaaagagtgcgaccccgagaatcatgccaaggcttccccctatcctgcggctgctccaagcgcccgagaagtacacagtgattcctaaagcccgtatctcttccaagccagccaaatctcccacttccgccatggatcaggctgtggggatgtcagtcatagtcgctggcttcatggttccagcaggatgggtcttatcccacttggagagctataagagaagctccgcagcatgaggagctcggcgcatccctgagaggccaattaaacgcttccagtacctccaaaaaaaaaaaaagaa

SEQ ID NO: 1796 - DNA, 3256 bp, Rattus norvegicus
  Genbank Accession No. NM_012788
cacgaggcgactgggggcgcggaagggaggcgaggttccgggggtggggcggcccggaggcgagcgggcgagcggggccgccgagcggcggcgagagggcaggcggcggcggccgaggcggagagagcggcgcggggtgcggccgccgagaggagctcctcccccgtcccctcaccccctcagctgagctcgagtcggggcggggcggggtacgtggagcggggccgggcggggagctgctccgagtctggccggagcgcacccggggcgcccgcgttcgccgctcgcgggaactttgcggcggacggtgtggaggccgcggaggggtgcatgagcggcgcagggcggcgcacagagcggcggctgtccggtccggcccctgctggagtcgccgccggaggaggcgagcgaggagccaggtgtgtgtgccttcttcctgcttctggaaaaaatgccggtccggaagcaagatacccagagagcattgcatctgttggaagaatatcggtcgaaactaagccaaaccgaagacagacagctcaggagttccatagagcgggttattagcatatttcagagcaacctctttcaggctttaatagacattcaagaattttatgaagtgaccttacttgataatccaaaatgtgtggatcattcaaagcagtgtgaaccggtccaacccgggaatccttgggagagtggcagcctttcaagtgctgctgtgacttcagagagcctgcccggcggccttagccctccagtagagaaataccggtatcaggacgaagaggtgctgccttcagagcggatttccccgcaagtcccaaatgaggtgctgggtccggagctggttcacgtctcggagaagagcctgtcagagattgagaatgtccacgggtttgtctctcactctcatatctcacccataaagcccacagaagctgttcctccctcctctcccattgtccctgtgacccctgccttgccagtccctgctgagagtcctgtcgtcctgccctccacaccacaggcaaatcctcctcctgtcctggtcaacacagacagcttggagacaccaacttatgttaatggtactgatgcagattatgaatatgaggaaatcacacttgaaaggggaaattcaggcttgggtttcagcattgcaggaggtacagacaacccacacattggagatgactcaagtattttcatcaccaaaattatcacgggaggagcagctgcccaggatggaagattgcgggtaaatgactgtatactgagagtaaatgaagcagatgttcgtgatgtaacccacagcaaagcagttgaagcattgaaagaagctggatcgatagtgcgattatatgtgaaaaggcggaaggccttcagaaaaaatcatgaaataaaacttattaaaggccctaaaggtcttgggttcagcattgctggaggtgttggaaaccagcacattcctggggataacagcatctatgtaaccaaaataattgaaggaggtgcagcacacaaggacggcaaacttcagattggagacaagcttctagcagtgaacagtgtctgtttagaagaagttactcatgaagaagcagtgactgccttaaagaatacatctgattttgtttatttgaaagcggcaaaaccaacaagtatgtatataaatgatggctatgcaccacccgacatcactaattcttcttctcagtctgttgacaaccatgttagcccgtcttcatacttgggccagactccagcgtcaccagccagatactcacccatttctaaagcagtgcttggagatgatgagatcactagggaacctagaaaagttgttcttcatcgtggctcaacgggacttggtttcaacattgtgggaggcgaagatggagaagggatttttatctctttcatccttgctgggggacctgctgacctaagcggagagctcagaaaaggagatcgcattatatcggtaaacagtgttgacctcagagctgcaagtcatgaacaagcagctgccgcattaaaaaacgcaggccaagctgtcactattgtcgcacagtatcggcctgaagagtacagtcgttttgaagctaaaattcacgacttgcgggagacgatgatgaacagcagtgtcagctcagggtcagggtctctccgaaccagccaaaagcggtccctctatgtcagagccctttttgattacgacaagactaaagacagtggccttcccagtcaagggttgaacttcaaattcggagatattctccatgttatcaatgcttctgatgacgagtggtggcaggccagacaggtgaccccagatggtgagagtgacgaagttggagtaattcctagtaaacgcagagttgagaagaaagaacgagcccgattaaaaacagtcaaattcaattctaaaacaagaggagataaaggggagatccctgacgacatgggatcaaaaggcctgaagcacgtaacttctaatgccagcgatagcgaaagtagttaccatgaatatggctgctcaaaaggtggtcaagaagaatatgttttatcgtatgagccggtgaatcagcaagaagttaattatacccgaccagtcatcatattaggacctatgaaagacagagtaaatgatgacttaatctcagaatttcctgacaaatttggatcctgtgtccctcatacaactagaccaaagcgtgactatgaggtggatggacgagattaccattttgtgacttcaagagaacagatggagaaagatatccaggagcataaattcattgaagctggccagtataacaaccatctatacggaacgagtgtccaatctgtgcgagcagtagcagagaagggcaagcattgtatccttgatgtgtctggaaatgccatcaagaggttgcagattgcacagctctatccaatatctatttttattaaacccaaatccatggaaaatatcatggaaatgaataaacgcctaacagacgaacaggccagaaaaacgtttgagagagcagtgagactggagcaggagttcactgagcatttcacagctattgtccagggagacacgctggaggacatttacaatcaagtgaagcagatcatagaagagcagtctggtccttacatctgggtcccagcaaaagaaaaattatgaagacagatgttgctctttctttttccatggtctcatctctctgccctgctctggaggtctgtcttcagc

SEQ ID NO: 1797 - DNA, 2840 bp, Rattus norvegicus
  Genbank Accession No. NM_012791
agagtctcaagttttcagagtggctttgctcttactgtgctttcattcgcagctgttatagttttgccgctggactcttccctcccttcccccaccccatcaggatgatatgagacttgaaagaagacgatgcatacaggaggagagacttcagcatgcaaaccttcatctgtccggctcgcaccgtcattctcattccatgctgctggccttcagatggctgcacagatgccccattcacatcagtacagtgaccgtcgccagccaaacataagtgaccagcaggtttctgccttatcatattctgaccagattcagcaacctctaactaaccaggtgatgcctgacattgtcatgttacagaggcggatgccccaaaccttccgtgatccagcaactgctcctctgagaaaactctctgtggacttgatcaaaacatacaagcatattaatgaggtttactatgcaaaaaagaagcgaagacaccaacagggccagggggacgattctagtcataagaaggagcggaaggtttacaacgatggttacgatgacgataactatgattacattgtaaaaaacggagaaaagtggatggaccgttatgaaatcgactccttaataggcaaaggttcatttggacaggttgtgaaagcatatgacagagtggaacaagaatgggtcgccattaaaatcatcaagaacaagaaggcgtttctgaatcaagcgcagatagaagtgcggctgcttgagctcatgaacaaacatgacactgagatgaagtactacatagtgcatttgaaacgccactttatgtttcggaaccatctctgtctagtgtttgaaatgctgtcctataatctctatgatttgttgaggaacaccaacttccgaggggtctctttgaacctgacacgaaagtttgcacaacagatgtgcacagcattgcttttccttgcgactccagaacttagtatcattcactgtgacttaaagccggagaacatccttctgtgtaaccccaaacgaagtgcaatcaagattgttgactttggcagctcttgtcagttggggcagaggatataccagtatattcagagtcgcttctatcggtctccagaggtgctactgggaatgccttatgaccttgctatcgacatgtggtcccttggatgtatcttggttgaaatgcacactggagagcctctgttcagtggtgccaatgaggtggatcagatgaataaaatagtggaagtcttgggcatcccacctgctcatattcttgaccaagcaccgaaagcaagaaagttctttgagaagttgcctgatggcacttggagcttaaagaagaccaaagatggaaaacgggagtacaaaccaccaggaacccgtaaacttcataatattcttggagtggaaacaggaggacctggcgggcggcgtgctggggagtcaggtcacactgtagctgactacttgaagttcaaagacctcattttaaggatgcttgattatgaccccaaaactcggattcaaccttattatgccctgcagcacagttttttcaagaaaacagctgatgaaggtacaaacacaagcaacagtgtgtccaccagccctgccatggagcagtcccagtcttcaggcaccacctccagcacctcctccagctcaggtggatcctcgggaacgagcaacagtgggagagccaggtcggatccgacgcaccagcatcggcacagtggcgggcacttcgctgctgctgtccaggccatggactgtgagacacatagtccccaggtgcgccagcagtttccggctcctctgggctggtcaggcactgaagctcctacacaagtcactgttgaaactcatcctgttcaagaaacaacctttcatgtagcccctcagcagaatgcattgcatcatcaccatggaaacagttcccatcatcaccaccaccaccatcaccaccaccaccaccatggacagcaagccttgggtaaccggaccaggccaagggtctacaattctccaacaaatagctcctctacccaggattctatggaggttggccacagtcaccactccatgacatccctgtcttcctcaacaacttcttcctcgacatcttcctcctctactggtaatcaaggcaatcaggcctatcagaaccgcccagtggctgctaacaccttggactttggacagaatggagctatggacgttaatttgaccgtctactccaatccccgccaagagactggcatagctggacatccaacataccaattttctgctaatacaggtcctgcacattacatgactgaaggacatctgacgatgaggcaaggggctgatagagaagagtctcccatgacaggagtttgtgtgcaacagagtcctgtagctagctcgtgactacattgaaacttgagtttgtttcttgtgtgtttttatagaagtggtgtttttttcccaaaaacaaaagtgcaaagctgcttgaatcagaaggagattaacacactgaaccgctacgagagggcaaagctgacttttttttttaacttgaaaagattgcaaagggacaatgaagtttttaagagccatgtccacccatcttcatggagcgctcagagtgtcctctttctgcctcccccatttaacttccatctcccggtcacagtgggttttgtctttctatccaacaaaagttaatgttcagctgttggtcttggtcatttgccaactaattttaaaataaaaaggcactgcacataatttgcataaagggccccatagggtgttttggttttttcatttttattttttcccctttt

SEQ ID NO: 1798 - DNA, 924 bp, Rattus norvegicus
  Genbank Accession No. NM_012793
cctggtggttccgcagccgtactctcctggcctggtgtgcacagcctcaccatgagttcttctgcagccagcccgcttttcgcgcctggcgaggactgcggccccgcgtggcgcgcggcccccgcggcctatgatacgtctgacacgcacctgcagatcctgggcaagccagtaatggagcgttgggagaccccctacatgcattcgctggcggctgctgctgcctccagagggggccgggtcctggaagtgggctttgggatggccattgcagcctccagggtgcagcaggcccccataaaggaacactggattattgaatgcaacgatggggtcttccagcgtctacaaaactgggccctgaagcagccacataaggttgttcccttgaaaggcctgtgggaggaggaggcacctacactgcctgatggtcactttgatgggattctatacgacacatatccactgtctgaagagacctggcacactcaccagttcaactttattaagactcatgctttccgtttgctgaagcctgggggtatcctcacttactgcaacctcacgtcctggggggaactcatgaagtccaagtacacagacatcactgccatgtttgaggagactcaggtgcctgcactgctggaagctggcttccagagagaaaacatctgtacagaggtgatggcgctggtgcccccagccgactgccgctactatgccttccctcagatgatcacacccctggtcaccaagcactgagcggctggcccagggctacaaggagaatatgtcctcctcagtgcctttgtagctggagtgtggctccagcctctccactatccctgcagtgtgacatcctaacctctgcctggtacggccatctccccagagctcaggagtaaaataaatgctaccaagact

SEQ ID NO: 1799 - DNA, 1258 bp, Rattus norvegicus
  Genbank Accession No. NM_012796
gggggaacgcgtcagacttggccaactgaggctgggctggacccctattgtggaatcgcggacacttcctacagttgtcgaacgcaatccgtctacaccaccttgtgtcactacctaccaccatgggtttggagctctacctggacctgctgtcgcagcccagccgcgcggtctacatcttcgccaagaagaatggcattccctttcagttgcgtaccgtggatttactcaaagggcagcacttgagcgagcaattctcccaggtgaactgcttaaagaaagtgcctgtcctcaaagacggaagcttcgtgttgaccgaaagcactgccatcttgatttacctgagttccaagtaccaggtggcagaccactggtacccggccgacctacaggcccgtgcccaagtccacgaatacctgggttggcatgccgacaacatccgtggcacctttggagtactcctgtggaccaaggtgttggggccactcattggggtccaggttcccgaggaaaaggtggaacggaacagaaatagtatggtcttggctctgcaacgtctggaggacaagttcctcagggacagggccttcattgctggccagcaggtgacgctagcggatctcatgtctctagaggagttgatacagccggtggctcttggctgtaatctgtttgaggggcggcctcaactgacagcgtggcgagagagggtggaggcgttcttgggtgctgagctatgtcaggaggcgcacaaccccatcatgagcgtcctgggacaggcagccaagaaaacattaccagtaccccctccggaggcccatgccagcatgatgcttcgaattgccaggattccctgagtggttttttttccctgagtatttttattgctataaagactcattttgtattttgcctctttgttttgttttgtttttgtttcttcttgtcccaacctttttttttttttttttttttctggctccttttctggctctgggaggagctttgctcaaaagggacaccacctatccttagcatgcttctcttgaggtacagtatgcacaaccaataggagacccaagtcaataatatataaaaggtgcttaaaaaaaaaaaagcaaacagtaacacacacgaagaaatcaaccaaaaattggtggacatctgttttttattataatatagattctgaatattttaaggaataaagagttattgttttattacattgccctctaatctgtatggaataaattat

SEQ ID NO: 1800 - DNA, 1124 bp, Rattus norvegicus
  Genbank Accession No. NM_012797
cggcacgagctaacaccctgttctcagactcctccgcgcctctccgcctgtcctcaggatcatgaaggtcgccagtagcagtgccgcggccaccgcaggccccagctgttcgctgaaggcaggcaggacggcgggcgaagtggtgcttggtctgtcggagcaaagcgttgccatctcgcgctgcgctgggacgcgcctgcccgccttgctggacgaacagcaggtgaacgttctgctctacgacatgaacggctgctactcacgcctcaaggagctggtgcctaccctgcctcagaaccgcaaagtgagcaaggtggagatactgcagcatgttatcgactacatcagggacctgcagctggagctgaactctgagtctgaagtcgcgaccgccggaggccgggggctgcccgtccgggccccgctcagcaccctgaacggcgagatcagtgccttggcggccgaggtgaggtccgagtcagagtattacattattctcctgtgggaaactaaggccacgggaggggggtgtcccccttacttctcaggagcatagttatttaggggcgaccaataggaaaaagctcgcgctttcatcgtgcctcctggagtagagaagtgggaatgcctctcccctccagttctttccagtgggtctcatgccttatctcgctctggtgttcacaggcggcatgtgttccagccgacgaccgcatcttgtgtcgctgaggcggcgcactgaggaaccagatggactccagcccttcaggaggcaagaggaaaaaaagtgctctcggttccccagagcaacccggggaaagacactaccgcggccacgggactcttgacggatctgtccagggggtagagggttgatcaacggagtctcgccctctccacctttcagcctccagagactttgaggagggggttattcaaccccgtgtgtttctgtttttttgaaaaagcagacattttttttaaatggtcacatttcgtgcttctcagatttctgagaaaatgttttgtattgtatattacaatgatcactggctgagaatattgttttacaatagttcttatgggggtgggttttttgttgttattaaacaaacactttagat

SEQ ID NO: 1801 - DNA, 2382 bp, Rattus norvegicus
  Genbank Accession No. NM_012807
atggctgctggccgccccgtgcgtgggcccgagctggcgccccggaggctgctgcagttgctgctgctggtactgcttgggggccggggccggggggcggccttgagcgggaacgtgaccgggcctgggcctcgcagtgccggcgggagcgcgaggaggaacgcgccggtgaccagccctccgccgccgctgctgagccactgcggccgggccgcccactgcgagcctttgcgctacaacgtgtgcctgggctccgcgctgccctacggagccaccaccacgctgctggctggggactcggactcgcaggaggaagcgcacagcaagctcgtgctctggtccggcctccggaatgctccccgatgctgggcagtgatccagcccctgctgtgtgctgtctacatgcccaagtgtgaaaatgaccgagtggagttgcccagccgtaccctctgccaggccacccgaggcccctgtgccattgtggagcgggaacgagggtggcctgactttctgcgttgcacgccggaccacttccctgaaggctgtccaaacgaggtacaaaacatcaagttcaacagttcaggccaatgtgaagcacccttggtgaggacagacaaccccaagagctggtacgaggacgtggagggctgtgggatccagtgccagaacccgctgttcaccgaggctgagcaccaggacatgcacagttacatcgcagccttcggggcggtcaccggcctctgtacactcttcaccctggccacctttgtggctgactggcggaactccaatcgctaccctgcggttattctcttctatgtcaatgcgtgtttctttgtgggcagcattggctggctggcccagttcatggatggtgcccgccgggagattgtttgccgagcagatggcaccatgagatttggggagcccacctccagcgagaccctatcctgtgtcatcatctttgtcatcgtgtactatgccttgatggctggagtagtgtggttcgtggtcctcacctatgcctggcacacctccttcaaagccctgggcaccacttaccagcctctctcgggcaagacatcctatttccacctgctcacgtggtcactccccttcgtcctcactgtggcaatccttgctgtggctcaggtagatggggactccgtgagtggcatctgctttgtaggctacaagaactatcggtaccgtgctggctttgtacttgccccaattggcctggtgcttattgtgggaggctacttcctcatccgaggggtcatgactctgttctccatcaagagcaaccaccctgggcttctgagtgagaaggcagccagcaagatcaatgagaccatgctgcgcctgggcatttttggcttcctcgcctttggcttcgtgctcatcaccttcagctgccacttctatgacttcttcaaccaggctgagtgggagcgtagcttccgggactatgtgctatgccaagccaatgtgaccattgggctgcctaccaagaagcccattcctgattgtgagatcaagaatcggcccagcctcctggtggagaagatcaatctgtttgccatgtttggcactggcattgccatgagcacctgggtctggaccaaggccaccctgctcatctggaggcgcacctggtgcaggttgactgggcacagtgatgatgaacccaagagaatcaagaaaagcaagatgattgccaaggccttctctaagcggcgtgaactgctgcagaacccgggccaggagctctccttcagcatgcacactgtctcccatgatggacctgttgccggtttggcttttgaactcaatgaaccctcagctgatgtctcctctgcctgggcccagcacgtcaccaagatggtggctcgaagaggagccatattaccccaggatgtgtctgtcacccctgtggcaactccagtgccaccagaagaacaagccaacctgtggctggttgaggcagagatctccccagagttagagaagcgtttaggccggaagaagaagcggaggaagaggaagaaggaggtgtgccccttggggccagcccctgaacttcaccactctgcccctgttcctgccaccagtgcagttcctcggctgcctcagctgcctcggcagaagtgcctagtagctgcaaatgcctggggaacaggagagccctgccgacagggagcctggactgtagtctccaaccccttctgcccagagcctagtccccatcaagatccatttctccctggtgcctcagcccccagggtctgggctcagggccgcctccaggggctgggatccattcattcccgcactaacctaatggaggctgagctcttggatgcagactcggacttctga

SEQ ID NO: 1802 - DNA, 1504 bp, Rattus norvegicus
  Genbank Accession No. NM_012816
gctgcgtggcgtcagggttctggagctggcaggcctggccccagggccgttctgcgggatgatcctggcggacttcggcgccgaggtggtgctcgtggacagactgggctccgtgaaccaccccagtcacctggcccgaggcaagcgctcgctggcgctggacctgaagcggtctccgggagccgcggtgttgcggcgcatgtgcgcacgcgcggacgtgttgctggagcccttccgttgcggtgtcatggagaaactccagcttgggccagagactctacggcaggacaatccaaagctcatctatgccaggctgagtggatttggccagtcgggaattttctccaaagtagctggccatgacatcaactatgtggctttgtcaggtgtcctgtcaaagattggcaggagcggtgagaacccataccctcccctgaacctcctggccgactttggtggcggtggcctcatgtgcacattgggcattttgctggctctcttcgaacgcacgcggtctggcctagggcaggtcattgatgcgaacatggtggaaggaacggcatacttaagtactttcctgtggaaaactcaggccatgggtctgtgggcacagcctcgagggcaaaacctgttagatggcggggcacctttctacacaacctacaagaccgcagatggggagttcatggctgtaggtgcaatagaaccccagttctacacactgctgcttaaaggacttggacttgagtctgaggaactccccagccagatgagcatagaagattggccagaaatgaagaagaaatttgcagatgtgtttgcaaggaagactaaggcagagtggtgccagatctttgacgggacagatgcatgtgtgaccccagtgctgactcttgaggaggccctccaccaccagcacaacagagaacggggctccttcatcactgatgaggagcagcatgcatgcccccgtcctgcaccccagctttccagaacccctgctgttccttctgccaaaagggacccttctgtgggagagcacactgtagaggtgcttaaagactatggattcagtcaggaagagatccatcagctgcactcggatagaatcattgaaagtaataagctaaaagccaacctctgactcaggttcacagctcaagtgaatctgaaggctgtatctgtactggagaaggatgcccaccactgtccgtatggaaatgtgaatgaacagtaatgaagtaatccaaatattccaatcaagacacaacgaaagactgattacagagaaatgactgtgctctcacactgctcatccgagcctctgattgaggagtatttttgtgtgtgtactgatattaacttgtggcagttttctgcctttcagcttacttggtgaagtgcattcactgattaaaacccttttgtaaatgcaactctgataatatattaaatgaactaatataactttaataaataaagcttttttttccttgaaaaaaaa

SEQ ID NO: 1803 - DNA, 1454 bp, Rattus norvegicus
  Genbank Accession No. NM_012823
ctcaccttctcagagcttctcctcgggcttcgctgccgccctaaaggttactgtgatctcggcttgagagcaaggtggacagccatggcggcgtctttgtgggttggacctcgagggaccataaacaattatccaggctttaacccatcagtggatgccgaagctatccggaaagcaatcaaaggaattggaactgacgagaaaactctcatcaacattctgacggagcggtcgaacgcacagcggcagctgattgtcaagcatatacaagaggcgtatgaacaggcgctgaaagctgacttgaagggtgatctctctggccactttgagcatgtcatggtggctcttattactgcaccggccgtgtttgatgccaagcaactgaagaaatccatgaggggcatgggcacagatgaagacaccctgattgaaatcttaacaaccaggacaagcaggcagatgaaggagatctcgcaggcctattatacagcatataagaagaatctcagagatgacattagctctgaaacgtctggagacttccggaaagctctgctgactttggcagatggtggaagagacgaaagcctgaaagtggatgaacatctggccaaaaaagatgcccagaccctctacgatgctggtgagaaaaaatggggcacggatgaagacaaattcaccgagatcctgtgtctacggagctttccgcagctgaaactgacatttgatgagtacagaaacattagtcagaaggacattgaggacagcattaaaggagaattatctgggcattttgaagacctgctgctggccgtagttcgctgtacgaggaacaccccagcttttttggcaggaagacttcatcaggctttgaagggagctggaacagatgaattcactctgaacagaataatggtctccagatcagagattgaccttctggacatccgacgtgagttcaagaagcactacggctgctctttatactcagccatccaatcagatacttctggagactacagaactgtgctgttgaagatctgtggaggagatgattgaagaagatggcttccaacagctgcctgccccgatggtggaccgcctcaacagctctgcttactgctttcgtacagcactccagcaatgggcaagcgaatgcaagacagcaacccgtctgcctgatgcgcattggcttccttcaatgcaacagcaaaaatgaacttgattttattttagagcatctcattcataatgtagaggtttataagggaaattcaatctagaattaaagacctactaatgattttttatttggcttaggaagttggaatctgtgttgttcaaagccattaaacataaatcaggatactaaaaatggctgcctttgctaaatgtaatttttgtatttgttttccgtaactactaatactgtatgttgcctggtgccaacaaat

SEQ ID NO: 1804 - DNA, 590 bp, Rattus norvegicus
  Genbank Accession No. NM_012838
gcaggtttttctagggtccagacacccaggtctcctagttggctctctccgtagcttctctgtgatattctaaccagtgcttgccaaagatgatgtgtggcgcgccatccgccacaatgccggccacgaccgagacgcaggagatcgccgacaaggtgaagtctcaacttgaagagaaagcaaatcagaagtttgatgtctttaaagccatatccttcaggagacaggtagtggccggcaccaacttcttcatcaaggttgatgtcggcgaagaaaaatgtgtgcacttgagggtgtttgaacccctccctcatgagaacaagcctttgaccttgtcttcttaccagaccgacaaagaaaagcacgatgagctaacctacttctgattactgcagcccctttgccaaatacttcacctttggaatccgtgtttgggaccacgaagtaaatacccctctgtgagcagcttcctttgtgatgcccaaacggcgttgtattttgtttctttccaaacaattattttcagaaaactgtataaaaactatctctctaaatatatatttttagagaccgtaaaaaaaaaaaaaaaa

SEQ ID NO: 1805 - DNA, 981 bp, Rattus norvegicus
  Genbank Accession No. NM_012843
aaacctcctgaagagaggaccagaccagcagccagcgccaccactcagggcatctgcctctgtcactggatactccagaattctctactcaggagttacaaaaaagaagccaagatgttggtgctactggccggtctcttcgtggtccacatcgccactgccattatgctgtttgtctccaccattgccaacgtctggatggtggcggacggtatagactcgtccatagggctttggaagaactgcaccagtggcagctgtgacggctctctgagctacggcaatgatgatgctatcaaggcagtgcaagctttcatgatcctctccatcatcttctctataatctccctcgtggtcttcgtgttccagctcttcaccatggagaagggaaaccggttcttcctctcgggatccaccatgctggtgtgctggctgtgcattctgattggagtgtctatctacactcaccactacgcccacagcgaagggaactttttccccagcagccatcaaggctactgtttcatcctgacctggatttgcttctgcttcagcttcatcatcggcatactctatatggtcctgaggaagaaataagctcgtgggcatctggggtgggggtggggaagtagggaggaggaagcaactgaatccgggagggaagcagaagtcactgtgtagggataaccaagggaggggaggggggaagggagggggaaaggaagagtaggagaggcccaaacccaaaccatatctgggggggcgtggttctctactgccaaacgcccatccttggaagaaagttgttggctactatgctgatgcttccttgaggccaccagagagtcctcctctagccaccaaatatggccccatctatcctcaattaccgacacttggggcctcaccagctgccattccactggcgccactcttgagggtgactgctgggtcatacactgaggtcttgcaaacccattc

SEQ ID NO: 1806 - DNA, 1242 bp, Rattus norvegicus
  Genbank Accession No. NM_012844
atgtggctggaacttgtcctggcttcccttctgggctttgtcatctactggtttgtctcccgggacaaggaggaaaccttaccactaggagatggatggtgggggccagggtcaaagccatcagccaaagaagatgagagcatccggcccttcaaggtggaaacatcagatgaggagatcaaggacttacaccagaggatagataggttccgggcatccccacctttggagggcagccgcttccactatggcttcaactccaactacatgaagaaagtggtgtcctactggaggaacgagtttgactggaggaagcaggtggagatcctcaaccagtaccctcacttcaagaccaagatcgaagggcttgacatccacttcatccatgtgaagcctccccagctgccctcagggcgcaccccaaagcccttgctgatggtgcatggctggcctggatccttctatgagttttacaagatcatcccactactgactgaccccaagtcccacggtctgagtgacgagcacgtgtttgaagtcatctgtccctcgattcctggctatggctactcagaggcatccagcaagaaaggtttaaattcggtggccactgcgaggattttctacaagctgatgacacggctgggcttccagaaattctacattcaaggcggggactgggggtccctcatctgcaccaacatggcccagatggttcccaaccacgtgaaaggcctgcacttaaatatggctttcatttcgagaagtttttacaccatgactcctctcctgggccaacgcttcgggagattccttggctacacagagaaggatatcgagctcttgtacccctataaggagaaggttttctacagcatcatgagggagagtggctacttacacatccaagccaccaagccagacactgtgggctgtgctctcaatgactctcccgtgggcctggctgcctacatcttagagaagttctccacctggaccaagtcagagtaccgtgaactggaggatggaggcctggagaggatgaaggtctttgtgcccactggcttttcagccttcccttccgagctactgcatgccccagaaaagtgggtgaaggtcaagtaccccaaactcatctcctattcctacatggaacgtgggggccactttgctgcctttgaagagcccaagcttctggcccaggacatccgcaagttcgtgtccctggctgagctgcagtag

SEQ ID NO: 1807 - DNA, 1629 bp, Rattus norvegicus
  Genbank Accession No. NM_012850
aaacagcggactacaggcaccactgccatggacagcctgttgtgggctacctgggtcctctgcttgctgaacctgtggggagttgcactgggtcacctccacctagaatgtgacttcatcactcagctgagagacgatgagcttgcatgccttcaggcggcagaggggaccaacaactcgtccatgggatgccctgggacctgggatgggctgctgtgctggcccccaactggctctggccagtgggtctccctcccctgccctgaattcttctctcattttggctcagacccaggggctgtgaaaagggactgcaccatcacgggttggtctgatcccttcccaccatatcccgtggcctgtcctgtgcccttggaactgctaacagaggagaagtcttacttctccacggtgaagatcatctacaccacaggccacagcatctccattgtagccctctgcgtggctattgccatcctggttgctctcaggaggctccactgccccaggaactacatccacacgcagctgtttgctactttcatcctcaaggccagtgctgtgttcctgaaggatgctgctgtcttccagggtgatagcacggaccactgcagcatgtccactattctgtgcaaggtctctgtggccgtctcacattttgccaccatgaccaacttcagctggctgctggcagaagccgtctacctgagctgtctgttggcctccacatctcctaggtccaaaccagctttctggtggctggttctcgctggctggggactccctgtgctatgcactggtacgtgggtgggctgcaaactggcttttgaggacactgcgtgctgggacctagacgacagctccccctactggtggatcatcaaagggcccatagtcctctctgttggggtgaactttgggctgtttctcaatataatttgcatcctgctgaggaagctggggcctgcacaaggcggcttacacacacgggctcagtactggcggctttccaaatcaacacttctccttatcccgctgtttggaattcattacatcatcttcaacttcctgcctgacagtgctggccttggcatccgtctacccctggagctgggactggggtccttccagggttttgttgttgctgtcctctactgcttcctcaatcaagaggtgaggacggagatttcacgcaaatggtatggccatgaccctgaacttctgccagctcggcggacctgcactgagtggaccacacctccccgatcgagagtgaaggtgctcacctctgagtgctaggccagccatcacaaaggccgagccccaaaaccctgcactcaaactgccatgccaccaagggcaacaaggtcctcccttccgttctcattctctgcatctgctttctctaggtccctgtataccaacctccgactttctcagttcctgtatgcccccatctgttctttcttcctatctaggctattgcccaaggcccagggaaaccaataaacttgtacatgagtgatctgcagttgagtcaatgtggctctgaaggggagctcttgtcagcagccattatttgcacttccggtgcattcctcatcccttggctgcagctgcctcattgcc

SEQ ID NO: 1808 - DNA, 2006 bp, Rattus norvegicus
  Genbank Accession No. NM_012857
gccggcgccgcagctgccgggcctctcgagtcggtggacgcgccctcccgccggcctcgccgcccgcgcaaccgccgtccttcggcctcggctgcgtcgcgccatggcggccccgggcgcccggcggccgctgctcctgttgctgctggcaggccttgcacacagcgccccagcactgttcgaggtgaaagacaacaacggcacagcgtgtataatggccagcttctctgcctcctttctgaccacctatgatgctggacatgtttctaaggtctcgaatatgaccctgccagcctctgcagaagtcctgaagaatagcagctcttgtggtgaaaagaatgcttctgagcccaccctcgcaatcacctttggagaaggatatttactgaaactcaccttcacaaaaaacacaacacgttacagtgtccagcacatgtatttcacatataacctgtcagacacacaattctttcccaatgccagctccaaagggcccgacactgtggattccacaactgacatcaaggcagacatcaacaaaacataccgatgtgtcagcgacatcagggtctacatgaagaatgtgaccattgtgctctgggacgctactatccaggcctacctgccgagtagcaacttcagcaaggaagagacacgctgcccacaggatcaaccttccccaactactgggccacccagcccctcaccaccacttgtgcccacaaaccccagtgtgtccaagtacaatgtgactggtgacaatggaacctgcctgctggcctctatggcactgcaactcaacatcacctacatgaagaaggacaacacgactgtgaccagagcattcaacatcaacccaagtgacaaatatagtgggacttgcggtgcccagttggtgaccctgaaggtggggaacaagagcagagtcctggagctgcagtttgggatgaatgccacttctagcctgtttttcctgcaaggagttcagttgaacatgactcttcctgatgccatagagcccacgttcagcacctccaactattccctgaaagctcttcaggccagtgtcggcaactcatacaagtgcaacagtgaggagcacatctttgtcagcaaggcgctcgccctcaatgtcttcagcgtgcaagtccaggctttcagggtagaaagtgacaggtttgggtctgtggaagagtgtgtacaggacggtaacaacatgctgatccccattgctgtgggcggggccctggcagggctggtcctcatcgtcctcatcgcctacctcatcggcaggaagaggagtcacgcgggctatcagaccatctagcctggtgggcaggtgcgccacagacgcacacgggcctgttctcacatccccaagcttagataggtgtggaagggagggaggcacacttgtggcaaactgttttcaaatctgctttatcaaatgtgaagctcatcttgcaacatttactatgcacaaaggaataactattgaaatgacggtgttaattttgctaactgggttaaatattttgctaactggttaaatgttaatatgttaccaaagtagagctctaaagaggacaagaaggctccacgcatttgacttttaagacttggtgtttggttcttcattcttttactcagatttacgccttacaaagggaatctctggtccagacacttgggcctggcaagggtggctgatggtggttaggctgcacacttgagaagcaaacaggagcagggacgtcctgccacacaggcacgcacagggtcagcctctggacacttggcttgggctgcctggcctggggggctagactctggcatctggctgggcacacccaccagtgtttctgtgctctgccgcctgtgagctaccactttcctaaatagaaaatggcattatggggttggggatttagctcagtggtagagcccttgcctaggaagcgcaaggccctgggttcggtccccagctccggaaaaaaaaaaaagac

SEQ ID NO: 1809 - DNA, 521 bp, Rattus norvegicus
  Genbank Accession No. NM_012862
acacccgagaccatgaagagcctgctccctctggccatcctggctgcgctggccgtggcagccctgtgctatgaatctcacgaaagcatggaatcctatgaagtcagtcccttcaccacccggagaaatgccaacacctttatatcccctcagcagagatggcacgctaaagcccaggaaagagtccgggaactcaacaagcctgcccaggagatcaacagggaggcctgtgatgactacaagctgtgtgagcgctacgccctgatctacgggtacaacgccgcctacaaccgctacttcaggcagcgccgaggagccaaataagagcgcaaggaaacagtcgctttgttacggagtctggtttcatattcccctgcagtagcattaccgatacacagattcgtgttcgttgcttgttcctcacatgatctcctgtcggctgggccactccttccttccgcgggttgaaagtaatgaaagagcagtattaagaaatgtgtttatatataataaaattctgg

SEQ ID NO: 1810 - DNA, 1203 bp, Rattus norvegicus
  Genbank Accession No. NM_012866
gggggataggagtgacttaaattctccctgtccgaggagatataaataactccatgtaaaattaatgcagttctcggtgtcaaaatgtccacagaaggagggtttggcagtaccagcagcagtgatgcccagcaaagcctccagtccttctggcccagagtcatggaagaaatccgaaacttaacagtgaaagatttccgagtacaagaactaccactggctcgtattaagaagattatgaaactggatgaagatgtgaagatgatcagtgcagaagcccctgtgctgtttgctaaggcagcccagatcttcatcacagagctgactcttcgagcctggatccacacagaggataacaagcgtcgtactcttcagaggaatgatattgctatggcaattacaaaatttgatcagtttgactttctcatcgacattgttccaagagatgaactgaaacctccaaagcgccaggaggaggtacgccagtctgtgactcccgcggagcctgtccagtactacttcacgctggctcagcagcccactgctgtccaggtccagggacagcagcaaggccagcagaccaccagttctacgaccaccatccagcctggccagatcatcattgcgcagcctcaacagggtcagaccacacccgtgaccatgcaggttggagaaggtcagcaggtgcagattgtgcaggcccaacctcagggtcaggcccagcaggcccagagtggtactggacagaccatgcaggtgatgcagcagatcattaccaacacaggagagatccaacagatcccggtgcagctgaatgccggccagttgcagtatatccgcttagcccagcctgtatcaggcacccaagttgtgcagggacagatccagacccttgctaccaatgcccaacagatcacacagacagaggtccaacaaggacagcagcagttcagccagttcacagacggacagcagctgtaccagatccagcaagtcaccatgcctgcaggccaagaccttgcccagcccatgtttattcagtcagccaaccagccctctgatgggcagaccccccaggtgactggagactgaggcctgagctgcaaagccaaggaaccccaacacaatatttgccatagagcccccaggcgatggggacacaccttccctcaccagaggacccgggacttcattgcctcctgc

SEQ ID NO: 1811 - DNA, 2432 bp, Rattus norvegicus
  Genbank Accession No. NM_012870
atcaaaggcagggcatacttcctgttgcccagaccttatataaaacgtcatgttcgcctgggcagcagagaagcacctagcactggcccagcggctgccgcctgaggtttccagaggaccacaatgaacaagtggctgtgctgtgcactcctggtgttcttggacatcattgaatggacaacccaggaaacctttcctccaaaatacttgcattatgacccagaaaccggacgtcagctcttgtgtgacaaatgtgctcctggcacctacctaaaacagcactgcacagtcaggaggaagacactgtgtgtcccttgccctgactactcttatacagacagctggcacacgagtgatgaatgcgtgtactgcagccccgtgtgcaaggaactgcagaccgtgaaacaggagtgcaaccgcacccacaaccgagtgtgcgaatgtgaggaagggcgctacctggagctcgaattctgcttgaagcaccggagctgtcccccaggcttgggtgtgctgcaggctgggaccccagagcgaaacacggtttgcaaaagatgtccggatgggttcttctcaggtgagacgtcatcgaaagcaccctgtaggaaacacaccaactgcagctcacttggcctcctgctaattcagaaaggaaatgcaacacatgacaatgtatgttccggaaacagagaagcaactcaaaattgtggaatagatgtcaccctgtgcgaagaggcattcttcaggtttgctgtgcctaccaagattataccgaattggctgagtgttctggtggacagtttgcctgggaccaaagtgaatgcagagagtgtagagaggataaaacggagacacagctcgcaagagcaaactttccagctacttaagctgtggaagcatcaaaacagagaccaggaaatggtgaagaagatcatccaagacattgacctctgtgaaagcagtgtgcaacggcatatcggccacgcgaacctcaccacagagcagctccgcatcttgatggagagcttgcctgggaagaagatcagcccagacgagattgagagaacgagaaagacctgcaaacccagcgagcagctcctgaagctactgagcttgtggaggatcaaaaatggagaccaagacaccttgaagggcctgatgtacgcactcaagcacttgaaagcataccactttcccaaaaccgtcacccacagtctgaggaagaccatcaggttcttgcacagcttcaccatgtaccgattgtatcagaaactctttctagaaatgatagggaatcaggttcaatcagtgaagataagctgcttatagttaggaatggtcactgggctgtttcttcaggatgggccaacactgatggagcagatggctgcttctccggctcttgaaatggcagttgattcctttctcatcagttggtgggaatgaagatcctccagcccaacacacacactggggagtctgagtcaggagagtgaggcaggctatttgataattgtgcaaagctgccaggtgtacacctagaaagtcaagcaccctgagaaagaggatatttttataacctcaaacataggccctttccttcctctccttatggatgagtactcagaaggcttctactatcttctgtgtcatccctagatgaaggcctcttttatttatttttttattctttttttcggagctggggaccgaacccagggccttgcgcttgcgaggcaagtgctctaccactgagctaaatctccaacccctgaaggcctctttctttctgcctctgatagtctatgacattcttttttctacaattcgtatcaggtgcacgagccttatcccatttgtaggtttctaggcaagttgaccgttagctatttttccctctgaagatttgattcgagttgcagacttggctagacaagcaggggtaggttatggtagtttatttaacagactgccaccaggagtccagtgtttcttgttcctctgtagttgtacctaagctgactccaagtacatttagtatgaaaaataatcaacaaattttattccttctatcaacattggctagctttgtttcagggcactaaaagaaactactatatggagaaagaattgatattgcccccaacgttcaacaacccaatagtttatccagctgtcatgcctggttcagtgtctactgactatgcgccctcttattactgcatgcagtaattcaactggaaatagtaataataataatagaaataaaatctagactccattggatctctctgaatatgggaatatctaacttaagaagctttgagatttcagttgtgttaaaggcttttattaaaaagctgatgctcttctgtaaaagttactaatatatctgtaagactattacagtattgctatttatatccatccag

SEQ ID NO: 1812 - DNA, 324 bp, Rattus norvegicus
  Genbank Accession No. NM_012875
  misc_feature (1)..(324): n = a or c or g or t
tctctcttgattcagatcctcgccatgtcttctcacaagactttcagaatcaagcgattcctggcaaagaaacaaaagcaaaatcgtcctattcctcaatggattcggatgaaaactggtaacaaaatcaggtacaactctaagagaagacactggaggagaacgaagctgggtctataaggagtcacactacggccagactgaggatttctactgaatcaccgtcatcgatcagtccgaccagatggatttcaacatttttaacctagagatttacttgtgtctgaactaatttgtccagtaataaaatttagaacctttcan

SEQ ID NO: 1813 - DNA, 318 bp, Rattus norvegicus
  Genbank Accession No. NM_012876
ctcgttcctttttcctccttgggcgtctgaaggcaagatgggtcaccagcagctctactggagtcacccgcggaagttcggccagggttctcgctcttgccgcgtctgctctaaccgccacggtctgatccgtaaatacgggctgaacatgtgccgacagtgcttccgtcagtacgcgaaggacataggcttcattaagttggactaagcgacctgaatggatgattcgactgtctacccaatgaaaccaactgtctaccctgtgataccaatcatgctagtctttgcgcacacagaataaaaaactgaaggcctcta

SEQ ID NO: 1814 - DNA, 1457 bp, Rattus norvegicus
  Genbank Accession No. NM_012881
gcaagcctcagcatccttggctttgcagtctcctgcggcaagcattctcgaggaagccagccaaggaccaactacaaccatgagactggcagtggtttgcctttgcctgttcggccttgcctcctgtctcccggtgaaagtggctgagtttggcagctcagaggagaaggcgcattacagcaaacactcagatgctgtagccacttggctgaagcctgacccatctcagaagcagaatcttctagccccacagaattctgtgtcctctgaagaaacggatgactttaagcaagaaactcttccaagcaactccaatgaaagccatgaccacatggacgatgatgacgacgacgatgacgacggagaccatgcagagagcgaggattctgtgaactcggatgaatctgacgaatctcaccattccgatgaatctgatgagtccttcactgccagcacacaagcagacgttttgactccaatcgcccccacagtcgatgtccctgacggccgaggtgatagcttggcttacggactgaggtcaaagtccaggagtttccctgtttctgatgaacagtatcccgatgccacagatgaggacctcacctcccgcatgaagagccaggagtccgatgaggctatcaaggtcatcccagttgcccagcgtctgagcgtgccctctgatcaggacagcaacgggaagaccagccatgagtcaagtcagctggatgaaccaagcgtggaaacacacagcctggagcagtccaaggagtataagcagagggccagccacgagagcactgagcagtcggatgcgatcgatagtgccgagaagccggatgcaatcgatagtgcagagcggtcggatgctatcgacagtcaggcgagttccaaagccagcctggaacatcagagccacgagtttcacagccatgaggacaagctagtcctagaccctaagagtaaggaagatgataggtatctgaaattccgcatttctcatgaattagagagttcatcttctgaggtcaattaaagaagaggcaaaaccacagttccttactttgctttaaataaaacaaaaagtaaattccaacaagcaggaatactaactgcttgtttctcagttcagtggatacatgtatgtggagaaagaaatagatagtgttttgggccctgagcttagttcgttgtttcatgcagacaccactgtaacctagaagtttcagcatttcgcttctgttctttctgtgcaagaaatgcaaatggccactgcattttaatgattgctattcttttatgaataaaatgtatgtagaggcaggcaaacttacaggaacagcaaaattaaaagagaaactataatagtctgtgtcactataatcttttggttttataattagtgtatattttgttgtgattatttttgttggtgtgaataaatcttgtatcttgaatgt

SEQ ID NO: 1815 - DNA, 3508 bp, Rattus norvegicus
  Genbank Accession No. NM_012887
ggcacgaggctcgctgcgggctccaggcttggccgcacttgctcaccagtggtgcgcccggggcttttgtggcttagccggcctgggctttgtgtccgagttctgctccgtgcctgcggcgcttctcccggtcagggattcccgaggcggcgtgcgcagcccccgggaccagcgagcgatcgagcgagcgcgccggcttgagcggtggcgactgcgaggggccgaggaggagagaaggagggggacgagatgccggagttcctagaggacccttcggtcctgaccaaagacaagttgaagagcgagttggtcgccaacaacgtgacgctcccggccggcgagcagcgcaaggacgtgtacgtgcagctctacctgcagcacctcacggcgcgcaaccggccgccgctcgccgcgggagccaacagcaaagggccgcccgacttctcgagcgacgaggagcgcgagcccaccccagtgcttggctccggggcctccgtgggtcgcggccgcggcgccgtcggcaggaaagccacaaagaaaactgataagcccaggccagaagataaagatgatctggatgtgacagagctctctaacgaagaacttctggaacagcttgtgagatatggagtgaatcctggtcccattgtgggaaccaccaggaagctgtatgagaagaagctgttgaagctgagggaacagggagcagaatcgagatcctctactcctctcccaacagtctcttcctctgcagaaaacacgaggcagaatggaagtaatgactctgacagatacagtgacaatgacgaagactctaaaatagagctcaagcttgagaagagagagccgctaaagggcagagcaaagactccagtaacactcaagcaaaggaggattgagcacaatcagagctattctgaagctggagtaactgagactgaatggacaagtggatcttcaaaaggcggacctctgcaggcattaactagggagtccacgagagggtcgagaagaactccaaggagaagggtggaaccctcacagcattttcgtgtagatggtgcagtaatttcagagagtactcccatagctgagactataaaggcttccagcaacgactccttagtggccaataggttgactggaaatttcaagcatgcatcttctattctgccaatcactgaattctcagacataaccagaagaacaccaaagaaaccattgacaagagctgaagtgggagaaaaaacagaggaaagaagagtagaaagggatattctgaaggaaatgttcccgtatgaagcctctactccaaccggaattagtgctagttgccgcagaccaatcaaaggtgctgccggccggccgctcgagctcagtgacttcaggatggaagaatcgttctcatctaagtacgtcccgaagtacgttcccttggcagacgtcaagtcggaaaagacaaagaagggacgctccgttcccatgtggataaaaatgctgctgtttgctctcgtggcgggttttttgtttttggtctatcaagctatggaaaccaaccaaggaaaccccttcactaattttcttcaagatactaaaatatccaactgaagaaatcatttcggcacatccgactcgatctcctgtttttaataactgtagaaaagcatctgtgtccacttgttggccgaagaactaaattgtgatttcacctcagtaaaggtagcgctgcgttggaaagcagacaggaagcttacctggatctcatttcaatgttttggactttggagatcacactgtgccatatgaataatttttttagctccagaacttttttgtaggctttatttttttaatgtggacatcttatttcacttttggggaaaatgcattgttttgtgtatttgaaaaataaggcaaaacatggtgatgtaatgtgaagctacacattaaatacttggaattcttacagaaaagatttatgacttattctctgctgagtaaaaatgttagaaatgtgaatggcgttcagtaagagaagcggtcacgagttgtgcttccttccatatgcagcggtttgtccgtggaaggtccagcaataagctcttctgggactcctgtcgtgcgtgtggtgtcgctggcgcacctgccacactgctcactagaatattttcatatcatgaaagtgctacgtcattaaagccctgagtacacttagttttccactgggatcttggagagcaacatagatacctgcttagggagcctttagctggctgcgcgcgtctaagagaccgagggctagctagaagctcccgttgggatcctgtgcttgtatttacggcaaagcatctatcccgtccatccagctcatcagactgttctgtaggtaaataagcatgggggtgtttgtttagagttagaaactaaacaccagtcccctccacttcagtccgattccattgtcgtcttttaaccaaaaaaaagttttcctggccagggatttttgttttgctttgttttagatggagttggggtgttgagatttttgtttgttttaggcatgtaattcctgatgtaatttgatttaaaagtataactgacttgcttttaaatcacatatatagtagctaatgcttaatttgtaatttcaaataaggtgggcattatggttctgtgtattcctgaagtgattaacgatatccttatggttgtcttttttagctgaaatttacctcatgtatggcttagatgatgttgcagtcgatttaaattttggtaaaaatcaagtacagcataaacatttttaactaaatcatttaagttgcaattttacagtcattgaccacaaagcacactaaaaatgtaaattatttttaataacatccggaatgtaaagacagttttaatttttacaaaggaggaagctgaatatgaatatctagaccagcacacaactttgacttaatgtttactgtgtttagcttatagatatgtcgtaggcatttgaagtaaacttctgccccagagaccagaacatggaccagaacatgtaggcctggtccgtgaggcgtgtggggagctgacttagatctgaagtgctttcctctcaaagacaagccacaaggggcatgttttactcaactttccctctctacagtgacagccatctttctttgttctcagacacagcttctcatattgctttcagtcatctgtttataattaaaaattgtgagaagccccatttgatgtttaaaaacaggggtgggggttaatctggcttcacatttctataaggtcgctctggatagggaagtgtggtccagtacagtgaaagtcggaccaggtaaaacatgccattttctttttaaaagcgtgtacttggtcttttgtctgtgtctgttttattccactagagtaaatgtgtccttgatgtaaatgcaaagcatttattaattcgtagatgtagactttacaatataattcaataataaagtaattaacctct

SEQ ID NO: 1816 - DNA, 1123 bp, Rattus norvegicus
  Genbank Accession No. NM_012895
gggattagagtcaagatggcagctgcggacgagccgaagcccaagaagctcaaggtggaagcgccagaagcgctgagtgaaaatgtgctgtttggaatggggaatcctcttcttgacatctctgctgtggtagacaaagatttccttgataagtattctctgaaaccaaacgaccagatcttggccgaagacaagcacaaggaattgtttgatgaacttgtaaaaaaattcaaagttgaatatcatgccggtgggtccacgcagaattcaatgaaagtggctcagtggatgattcaggagccacacagagcagcaacgttcttcggatgcattgggatagataagttcggggagatcctgaagagcaaagccgcagatgcacacgtggacgcccattactatgagcagaacgagcagcccacaggaacgtgcgctgcatgcatcaccggtggcaaccggtctcttgttgctaaccttgctgccgccaattgttataagaaagaaaagcaccttgatctggagaacaactggatgttggtagagaaagccagagtttactacatagctggcttctttctcaccgtctccccagagtcagtgttgaaagtggctcgctatgctgccgagaacaacaggaccttcactcttaacctgtccgcaccgttacttagccagttcttcaaggaagccttgatggaagtcatgccttatgttgacatcctctttggaaatgagacggaggctgccacttttgctagagagcaaggctttgagactaaagacattaaagaaatagccagaaagacgcaggctcttccaaaggtgaactcgaagaggcagaggaccgtgatcttcacccaagggagagatgacactatagtagctacaggaaatgatgtcactgctttccctgtcttggatcaaaaccaggaagagatcgttgacaccaatggagctggagatgcatttgtaggagggtttctgtctcagctggtctccaacaagcctctgactgaatgcatccgggccgggcactatgcagcgagcgtcatcattaggcgaactggctgtacttttcctgagaagccaaacttccactgacggaagaaaagcaactcaggca

SEQ ID NO: 1817 - DNA, 1017 bp, Rattus norvegicus
  Genbank Accession No. NM_012903
ttcaaagtcctaaaacgcgcggccgtgggttcggggtttattgattgaattccgctggcgcaggatcctctgcagaaagagagagcgcgagagatggagatggacaaacggatttatttagagctgcggaacaggacgccctctgatgtgaaagagctggtcctggataactgtcggtcaattgaaggcaaaatcgaaggcctcacggatgagtttgaagaactggaattcctaagtacaatcaacgtaggcctcacctccatttccaacttaccaaagttaaacaaactcaagaagcttgaattaagcgaaaacagaatctcaggggacctggaagtattggcagagaaatgtccgaaccttaagcatctaaatttaagtggcaacaaaataaaagatctcagcacaatagagccgctgaagaagttagagaatctcaagagcctagacctgtttaactgtgaggtgaccaacctgaatgcctaccgagaaaacgtgttcaagctcctgccccaggtcatgtacctcgatggctatgacagagacaacaaggaggcccctgactctgatgttgagggctacgtggaggatgacgacgaggaagatgaggatgaggaggagtatgatgaatacgcccagctagtggaagatgaagaggaagaggatgaggaggaagaaggggaggaagaggacgtgagtggagaggaagaggaggatgaagaaggttacaacgacggggaagtggatgatgaggaagatgaagaagatgctgctgaagaagaagggagtcagaagcgaaaacgagagcccgatgacgagggccaagaggatgactaaggggaattaacctgtttggggaaattcctattgtgatttgactgtttttacccatatcccctccccctcctattcctgccccccgaaacttatttttttctgattgtagcgttgctgtgggaatgagaggggcaaagtgtactggggattgccgggggtggggtgggggtgggaggggag

SEQ ID NO: 1818 - DNA, 1402 bp, Rattus norvegicus
  Genbank Accession No. NM_012904
cgagcaaagcttctcttcagttccctggaagacaaggcaatacaaagatactttattaaaaatggcaatggtatcagaattcctcaagcaggcctgctatattgaaaagcaagagcaggaatatgttcaagctgtaaaatcctacaaaggtggtcctggatcagcagtgagcccctacccttccttcaatccgtcctcggatgttgctgccttgcacaaagctatcatggttaaaggtgtggatgaggcaaccatcattgacatccttaccaagagaaccaatgctcagcgccagcagatcaaggcagcatacttacaggagactgggaagcccctggatgaaaccttgaaaaaagcccttacgggccacctggaggaggttgttttggctatgctcaagaccccagctcagtttgatgcagatgaactccgtgctgccatgaagggacttggaacagatgaagacactctcattgagattttgacaacaagatctaaccagcaaatcagagagattactagagtctacagagaagagctgaaaagagatctggccaaagacatcacttcggacacatctggagactttcgtaatgccttgcttgctctcgccaagggtgatcgctgtgaggatatgagtgtgaatcaagatttggctgatacagatgccagggctttgtatgaagctggagaaaggagaaaggggacagacgtgaatgtgttcaatacaattttgaccacaagaagctatcctcatcttcggaaagtgtttcagaattatagaaagtacagtcaacatgacatgaacaaagccctggatctggaactgaagggtgacattgagaagtgcctcacaaccattgtgaagtgtgccaccagcactccagctttctttgctgagaaactgtatgaagccatgaagggtgctggaactcgccataagacattgatcaggattatggtctcccgttcggaaattgacatgaatgaaatcaaagtattttaccagaagaagtacggaatccctctctgccaagccatcctggatgaaaccaaaggagactatgaaaaaatcctggtggctctgtgtggaggaaactaaacatcccaactgctctgtaagattccgaggagaacatctcttagccgttgttttcttcctattgcaaggcttaagtaggaaagttgctttgtcagtaagtctaattaccttctttgaataatgtagcctataaatatgttttagatcattcatctgtacaatagagaaatacttgttttgttaattatgtttatcccaaattataaatccctgtaagcaagtcactttggtaccattcctgagaaagaagtttacatagaataaaataaaacaattttataagacaaaaaaaaaaaaaaa

SEQ ID NO: 1819 - DNA, 1308 bp, Rattus norvegicus
  Genbank Accession No. NM_012905
gaattcggcacgagcagagacttaaggaaggtgcagacggggtccgtttgcacagcctcagggcgcgtccacatcccccttcagcagcccaatcacctctgatgaggagtacctgagccccccagaggagttcccagaacctggggagacctggtcccgaacccctaccatgaagcccagtcccagccaggatcgagattcctctgactcttcctccaaggcacccccaaccttcaaggtctcactcatggaccaatcagtgagagaaggtcaagatgtcattatgagcatccgcgtgcagggggagcccaagcctgtggtctcctggctgaggaatcggcagcctgtgcgcccagaccagcggcgctttgcagaggaggccgagggtgggctctgccggttgaggatcctggctgctgagaggggagatgctggtttctacacttgcaaggcggtcaacgaatatggcgctcggcagtgtgaggcccgcctggaggtccgaggcgagtgagctcagggggccacctgcgctgcccccgctaccctccgagctgcacccctgtctcaggcacctcctggacctcgctgtgtttcactgcctcctgcccacagacccagccggctcgccggcccggacatagcccatgctccccttccctccctagcccatacagcaccctggggtaacccatcgggcccctgtggatcctccctccccaagtggatatgtggctgtgcagaccaggaggcccccagaaggactgagtgttgagaagggatggccatgaggttgtgacaagctccccccgtccccagcctccatgtagggagcatccagcgaatgcatgtgctatgctgctacaggccactgtctgtctctctgtctgtctgcctgtgtgtctgtgacagtcagggaagaaaaccttcgagctgaggtgggataagacagaataagatgatagaacacagcatctgtgagatgcaggggcccagaggggcaggcacagtggataggagactctctgggaagggtagggcactgaccattgcagaaatgggttttaaatggcacaacattttttattccacatgagaccaaaagctagaggtctgggattaagccctgactgctggcaagcttaggaccaagtggggtacccttcttcacagacacatccgacacgctctgtctgggaatgagagagtagccagactgagcacaggagcaggtcatagtgggactggaggtttggaaacactatttcgtagctcaaataaagtccagtttgtacccaaaaaaaaaaaaaa

SEQ ID NO: 1820 - DNA, 1758 bp, Rattus norvegicus
  Genbank Accession No. NM_012911
tttttttttttttgcctattaaaaggtttatttcttccctatgctcagaaacgaagatatggccttgctggtccctcccctgaaatctcatcttcaaggattgggaggcagaaggggacctggcagcgggtgagaaggctgcgagcgagccgcgaacccggcgggtggagggcggcgacggcgcgcgcaccatgggtgaaaaacccgggaccagggtcttcaagaagtcgagccctaactgcaagctcaccgtgtacttgggcaagcgtgactttgtggatcacttggacaaagtggatcctgtcgatggtgtggtgcttgtggatcctgactacttgaaggaccggaaagtgtttgtgaccctcacctgtgccttccgctatggccgagaagacctggatgtactgggcctgtctttccgcaaagatctgttcatcgccacctaccaggccttcccccccatgcccaacccacctcggccccccacccgcctacaggaccgactgctgaagaagttgggccagcatgcccaccccttttttttcacaataccccagaatttgccttgctccgtcacactgcagccaggaccggaggacacagggaaggcctgtggagtagactttgagattcgagccttctgtgccaaatctatagaagaaaaaagccacaaaaggaactccgtgcggcttatcatcagaaaggtacagtttgctcctgagacacccggcccccagccatcagctgaaaccacacgccacttcctcatgtctgaccggaggtccctgcacctagaggcttccctggacaaagagctgtactaccatggggaacccctcaatgtcaacgtccacgtcaccaacaattctgccaagaccgtcaagaagatcagagtgtctgtgagacagtatgccgacatttgcctcttcagcaccgcgcagtacaagtgtcctgtggctcagcttgaacaagatgaccaggtgtctcccagttccacattctgcaaggtgtacaccataaccccgctgctcagtgacaaccgagagaagcgtggccttgcccttgatgggcaactcaagcacgaagacaccaacctggcttccagcaccattgtgaaggagggagccaacaaggaggtgctgggaatcctagtatcctacagggtcaaggtgaagctggtggtgtctcgaggcggggatgtctccgtggagctacctttcgtcctaatgcaccccaagccccacgaccacatcacccttccccgaccccagtcagccccccgggaaatagacatccctgtggataccaacctcattgaattcgataccaactatgccacagacgacgacatcgtgtttgaggactttgcgaggcttcggctgaaggggatgaaggatgacgactgtgatgaccagttctgctaggaagaggggctgggagaggtaggggtgggcaggactgaggtccactgcccttgcgggtaggagggtcccagcctctcctccttccccgttcgtccacccgagatacacactggacccatcactcgttgaaagtgggcattaatcttttgacttcagctctgccaccccagccctgctccctagggtggcaagctgtgtacacacctaaagttttgggaagggaagggaacactgaaagcaaggagtgaatgtagagaaaaggagtagaaaggacacccatgtttggcctcataccaacccacccccagtcaccacttctgcctcccccgaattc

SEQ ID NO: 1821 - DNA, 1893 bp, Rattus norvegicus
  Genbank Accession No. NM_012912
tgtctcactcagcgagacgcgcggtgcacggtgcttccccggcggacgaccgaccaacccgcgctccggcagagtccttggcgctcgcctgccggcgggacagacagcccgcctctagccgctctctggaccctggccgccccgagcgaagactggagcaaaatgatgcttcaacatccaggccaggtctctgcctcagaagtcagcgcgaccgccatcgtcccctgcctctcacctcctgggtcactggtgtttgaggattttgctaacctgacaccttttgtcaaggaagagctgagattcgccatccagaacaagcacctttgccatcggatgtcctctgcgctggagtcagtcaccatcaacaacagacctctggagatgtcagtcaccaagtctgaggtggcccctgaagaagatgagagaaaaaggaggcggcgggaaagaaacaaaattgctgctgccaagtgtcgaaacaagaaaaaagagaagacagagtgcctgcagaaggagtcagagaaactggagagtgtgaatgccgaactgaaggcccagatcgaggagctgaagaatgagaagcagcatctgatttacatgctcaacctgcaccggcccacgtgtatcgtccgggctcagaacgggcggacgccggaagacgagaggaacctttttatccaacagataaaagaaggaacattgcagagctaagcagaggtggcatgggggcaattggggagtccttactgaatcctccttttccaccccaaaccctgaagccattggaaaactggcttcctgtgcacttctagaatctcagcagccacgagctgttgggtcaggagggcctgcggtgactactgcgttgtcccactctgtccccgagtgaaccgtggagcaggcaggagcatcctttgtctcaccggctccaggatttaggccttaccatcccggccattctcagatgacctagctggccccaggctggggtcccatgcaaagcaggatcgcactaatgggatgcaggcagaagtgtctaccttgacaggtggggtggaccacgtcctccactgcggctgacaacatccctcctagggaagatggagtgagaacattcatcattgaagttgtccaatggccagggtatgctttctagaaactatgctgttctgtcctagactgactgtgcatagggcattcatttctgagcctggtgttgtgctatttagatgtttgtcttgcacaacattggcgtgatttttttccgggagtttcatcagacctgatttccgagagtttgggggtctgccactgtggacaatatcccccaaaagtgtttgggtggccatgtaaactggctgatgaccagctgtgctactctgtgctgaccgaggactgatgcctccttcccctgtacccactgctgaggaagaacccgggcacagcagctgtccttggctacaaactgttacaatgtcacagaacgaaggcacaaagtcccgctttcaaagggcgtaggactccacactcagtgacagggcaggaagagccaaggattctccgttttcccttccttcccaccaaaaaccacagcccgtggagactggtatttgaagccaggagtggggcaaggaaggtgtctgcactgtgggatgttaactgcgcttttgtcttgaagctattttgagatgcggtccagagtatttcagctgggaggtccctcccactggccaccagggctctggctactgttaaaattctgatgtttctgtgaaatcctcagtgttcaatccagactcagtagtatattacagttttctgtaagagagaacgttacttatttatcccagtattcctagcctgtcaacgtaataaaatatcagaatgagacctggt

SEQ ID NO: 1822 - DNA, 4472 bp, Rattus norvegicus
  Genbank Accession No. NM_012914
actgccgtcggggaaggtcccagcgcggtcatggcctcccagggcggccgccccgcctcaagttcgcagcattctgcacagtagcccggaggagaagcggcctggacgtcgcggccggccggggaagcagcatggaggaggcgcacctgctctcggctgccgacgtgctgcgtcgcttctcggtgacagccgagggcggcttgaccctggagcaggtgaccgacgcccgggagcgatacggccccaacgaactccctactgaggaagggaaatccctgtgggagctggtggtggagcagtttgaggacctcttggtgcgcatcctgctgctggcagccctggtttcctttgtcctggcctggtttgaggagggtgaggagaccacgacggccttcgtggagcccctcgtcatcatgttaatccttgtggccaatgcgatcgtgggagtgtggcaggaacgcaatgctgagagtgccattgaggccttgaaggagtatgagcctgagatgggtaaggtgatccgctctgaccgcaagggtgtgcagaggatccgagccagggacatcgtccctggggacattgtggaagtggcagtgggagacaaggtacctgctgacctccgcctcatcgagatcaagtccaccacacttcgagtggaccagtccatcctgacaggggaatccgtgtctgtgactaagcacacagatgccattccagacccccgagccgtgaaccaggacaagaagaacatgctgttttctggcaccaatattgcatcaggcaaagccctgggtgtggctgtggccacaggcttgcacacagagctgggcaagattcggagccagatggcggctgtggagcctgagcggacgccactgcagcgcaagctggatgaatttgggaggcagctgtcccatgccatctctgtgatctgtgtggctgtgtgggtcatcaacatcggacactttgctgacccggcccatggtggatcctggctccgtggggcagtctactacttcaagattgctgtggccctggctgtggctgctatccccgagggcctcccagcagtcatcactacatgcctagcactgggcacaagacgtatggcacgtaagaacgccattgtgcggagcctgccctctgtggagaccctgggctgcacctcagtcatctgctctgacaagacagggacactcaccaccaatcaaatgtctgtctgcaggatgttcgtggtagctgaagcagaggcaggcgcctgtcgtttacacgaattcaccatttcgggtaccacgtataccccagagggcgaagtgaggcaaggggaacagcttgtgcgctgtgggcagtttgatggacttgtggagctcgcaaccatctgtgcactctgcaatgattctgcactggactacaatgaggccaagggtgtgtatgagaaggtaggagaggccacagagacagccctcacttgcctggtagagaagatgaacgtgtttgacacagacctgaaaggactgtcgcgggtcgagcgcgctggtgcctgcaattccgtcatcaagcaactcatgcagaaggagttcaccctcgaattctcccgggaccggaagtccatgtctgtgtactgcacacccactcgtgctgaccccaaggcccagggcagcaagatgtttgtgaagggagctcctgagagtgtaattgagcgctgcagctcagtccgcgtgggaagccgaacagtacccctaagcgccacctccagagagcatatcctggccaagatccgagactggggctcaggctctcatacattgcgctgcttagcactggccaccagggacacacccccaaggaaggaggacatgcaactggatgactgcagtcagtttgtacagtacgagacaggcctgaccttcgtgggctgcgtgggcatgttagacccaccgagaccagaggtggctgcctgtatcacacgctgttctcgggcgggcattcgagtggtcatgatcacaggggacaacaaagggacagctgtggccatctgccgccgacttggcatctttggggatacggaggatgtgttgggcaaggcttacacgggccgagaattcgatgacctcagcccagagcagcagcgccaggcttgccgtaccgcccgatgctttgcccgtgtggaacccgcacataagtctcgcatcgtggagaacctccagtcctttaatgagatcaccgccatgactggcgatggggtgaatgatgcaccagccctgaagaaggcagagatcggcatcgccatgggctcaggcactgctgtggccaagtcggcagcggagatggttctgtctgatgacaactttgcctccattgtggctgcagtggaggagggcagggccatctacaacaacatgaagcaattcatccgctacctcatctcctccaatgttggcgaggttgtctgcatcttcctcacagcaattctgggcctgcccgaagccctgatccctgtgcagctgctctgggtgaacctggtaacagatggcttacctgccacagcccttggcttcaacccacccgatctggacatcatggaaaagctgcctcggaacccccgggaggctctcatcagcggctggctttttttccgctatttggctattggagtgtacgtaggcctggctacagtggctgccgccacctggtggttcctgtatgacgctgagggaccacaagtcaccttccatcagctgaggaacttcctgaagtgctctgaagacaatccactgtttgccggcatcgactgcgaggtctttgagtcacgcttccccacgaccatggccttatctgtgcttgtgaccattgaaatgtgcaacgcccttaacagcgtctcagagaaccagtcactgctgcgtatgccaccctggctgaacccttggctgctgggggctgtggtcatgtccatggccctgcattttctcatccttttggtgccgcctctgcccctcattttccaggtgaccccactgagtggtcgacagtggggggtggtgcttcagatgtctctgcctgtcatcctgcttgacgaggccctcaagtatctgtccaggcatcacgtggatgaaaaaaaggacctgaagtaaatcctgagagcagaggggggtctccagttcggccctcggactcatcatgtccaagcacttgtcctggtcccacccctgcctcctcactcagccacctgtctcctgctgaacgtaacaggcctgaaacaacaccggccatttctaggccctgttccagggtcctgtctccattcctgtcctccctacagctctggcccagaagttgagcccaggaggggaagctgagaagccagagctgcctgaagggccaccacccatttcccccacagatctgcagccttcccctgctcggaggtgggcatttgcttggtagctagtgcctctgccctgatggagggctcatgggggccgtcttactgactctgacctcttgcttagtttgggtctggagcctggtcagctctgggaaggaggagtccgaggggaccatctgggtccagctgtgaacatgaggggcagccccttccacttggctcagcttccaccaagtccactcctgtgtctgtttatgtatctgctggccccagggagttgaaggatcacagacagataggaacataaggagcagcgggggcaggcctggacaaggactcctttcccaggagtcagcctccactggctggctgggctcagcactagtcccaccttgaggctcacttcctcggctcaggttggctcagggatcctaactttacagtccatgcccctggtgcctgagactccaggcatccctgggtccatgtcagcttctcctgccacgaagcctggggtgataccgtgtcacttgctgcagggctgggtgattctaaacctcctggacccctggcattactctttgccctcttttcctatcatgcatgtctgagtcagagagatgtcactaggaagtgactccacaatcctcccctacctccccactgaaaggaagcatctgatgggggtctatcagatgaatgtgtattggtctttgggatcttttttgcctcttaaccctgctgttgctcctttgacaaaagctagctaagcatcatgggaaacggagaaagcgcctgtcagtgtgacttagctcttccctgactgtgtataatatgattattttatatgtaaatcaaggttcacatcactgtcctgacacctggtagcaaaagtcccctcagcctacccagaagacagatgaactccatgtatacctgcccactctcctgcccatcctccctcccctctggcaggttctggaggggcctcagagagaaaccgagtttggagggatggcttggcaggaacagagccctgtgcccacttgctgatcatttcttgtggagaaataaaggcgtgcgtctg

SEQ ID NO: 1823 - DNA, 833 bp, Rattus norvegicus
  Genbank Accession No. NM_012915
gaattccaaaatatgtaaggctttcaatttattacagatcacccaagaacataatgatatacatgtagtcagaaaacacgatgtagaaatcatagtgagttgtccagacatggtcagtagattattctttctggcatgctccagtgtcaacactcaataaagagcactaaaatccttccatacaattaagtatcagcgatgtaccatattgcagaaaggggtggctgagcaacagtttgttgatactataagacttccatgctcaacagtcgtagcgttgcactcagcacagctctggtttccatatacaaattttccatctcgagtggttactacaacccaggcacaaatctcatcaggataagtctgacatttctgtcttccaacatgacaaaatcctgtagaatcgaagctagtacgctcggtgtctggggtatgagggtcctgcaaacccgaggcttcggctcggactcgtcggagagcatggattcgggcgctggctccatccgagaagctggtggggccttcgggaaacgagagaaggctgaagaggatcggtacttccgagagaagactagagagcagctggctgccttgaagaagcaccatgaagatgagattgaccaccattcgaaggagatagagcgtctgcaaaaacagatcgaacggcataagaagaagattaaatacctaaagaatagtgagcattgagtgcacacagtcagtctctcacagagtggccagtatcattccccacttctatagagattgttttgaatgattgatgtttgacctgtgtgctactaacagataataaattatcaccggaattc

SEQ ID NO: 1824 - DNA, 3804 bp, Rattus norvegicus
  Genbank Accession No. NM_012919
tcggccccgcccggccggcccgcccgtgccctgccctgcccgcctctctcctcgcgccctccggcagacgtcggcgccccggctcagtccctcgccgcgtgcagctccgcccgctccgggccggcagggagggcactgatcttcgatcgcgaagatggctgctggctgcctgctggccttgactctgacacttttccaatcttggctgatcggcccctcgagcgaggagcccttcccttcgcccgtcactatcaagtcatgggtggataaaatgcaggaagaccttgtcacactggcaaagacagcaagtggagtgactcagcttgctgacatttatgaaaaataccaagatttgtatactgtggagccaaataatgcacgccaactggttgaaattgcagctagagacattgagaaacttctgagcaacagatctaaagccctggtgcgcctggctatggaagcagagaaagtccaagccgcccaccaatggagggaagattttgcaagcaacgaagttgtctactacaacgctaaagacgatcttgatcctgaaagaaatgagagtgagtcaggcagccaacggattaaacctgttttcatcgaagacgctaattttggacgccagatatcctatcaacatgcagcggtccatattcccacggacatctatgagggctcaaccatagtgttaaacgaactcaactggacaagtgccttagatgaagttttcaaaagaaatcgagatgaagaccctacattgctgtggcaagtgtttgcagccgaccgcctggcccgatattatccagcttctccgtgggtggataacagcagaactccaaacaagatcgatctctacgatgtacgcagaagaccatggtacatccagggagctgcatcccccaaagacatgctcattctggtggacgtgagtggaagtgtgagcggattgactctgaaactcatccggacatctgtctctgagatgttagaaaccctttccgatgatgatttcgtgaatgtagcttcatttaacagcaatgctcaggatgtgagttgtttccagcacctggttcaagcgaatgtaaggaacaagaaggtgctgaaggatgcggtgaataacatcacagcaaaggggataacagattacaagaaaggctttacgttcgcgtttgaacagctacttaattataatgtttccagagccaattgtaataagatcatcatgttattcacggatggaggagaagagagagcccaggagatatttgccaagtacaataaagacaaaaaagtccgcgtgtttacattttctgttggtcaacataattatgacagaggacctattcagtggatggcttgtgaaaacaaaggttattattatgagattccctctattggtgcaataagaatcaatactcaggaatatctagatgttctgggaagaccaatggttttagccggggacaaagcaaagcaagtccagtggacaaatgtgtatttggatgctctggagctgggacttgtcattactggaactctaccggtcttcaacgtcactggccagtctgaaaataagactaacttgaagaaccagttgattcttggtgtgatgggcgttgatgtgtctctggaagatattaagagattgacaccacgttttacactgtgccccaacggttactattttgcaatcgatcctaatggttatgtcttactgcatccaaatcttcagccaaagaaccccaaatctcaggagccggtcacactggattttctcgatgctgagttagagaatgatattaaagtggagattcgaaataaaatgatagacggagaaagtggagaaaaaacattcagaactctggtcaaatctcaagatgagagatatattgacaaaggaaatcgaacatacacatggacacctgtcaatggcacagattacaggtatttggccttggtattgccaacctacagtttttactatataaaagccaaaatagaagagacaataactcaggccagatcaaaaaaggggaaaatgaaggattcagaaaccctgaagccagacaattttgaagaatctggctacactttcatagcaccaagggaatactgcaatgacctgaaaccttcagataataacactgaatttcttttaaatttcaatgaatttattgataggaaaactccaaacaacccttcctgtaatacagatttgattaatagaatcttgctggatgcgggttttacaaatgaacttgtccaaaattattggagtaaacagaaaaatatcaaaggagtgaaggcacgctttgtggtgactgatggcggaattacaagagtttaccccaaagaggctggagaaaactggcaagagaacccagagacgtatgaggacagcttctacaaacggagcctagataacgataactacgttttcactgcgccctacttcaacaaaagtggacctggtgcctatgaatctggaattatggtaagcaaagctgtagaactgtacatccaaggaaaacttcttaagcctgcagttgtgggaattaaaattgacgtaaactcctggatagaaaattttaccaaaacttcaatcagggatccgtgtgctggtccagtttgtgactgcaaaagaaacagtgatgtaatggactgtgtcattctagatgatggtggatttcttctgatggccaatcatgatgattacactaatcagattggacgtttttttggagagattgacccgcgcatgatgagacacctggttaatatatcactttatgcattcaataaatcatatgactatcagtctgtgtgtgatccaggggcagcaccaaagcaaggagcaggacatcgctcagcctatgtgccatcaattacagacatactccagattggctggtgggccactgctgccgcctggtctattctccagcagctactcttgagtttgacatttccacggctccttgaggcagttgaaatggaagaggatgacttcacagcttccctgtctaagcagagctgcatcacagaacaaactcagtacttcttcaagaacgatactaaatcattcagtggtttactggactgtggaaactgttccaggatctttcatgttgagaagcttatgaacaccaacctagtgttcataatggtggagagcaagggaacatgtccgtgtgacacgcggctgctcatgcaagcagaacagacttctgatggtccagatccttgcgacatggttaagcagcccagataccgaaaaggacctgatgtctgctttgataacaatgtgctggaggattataccgactgtggtggtgtttctggattaaacccttccttatggtctatctttggactccaatttatactcctttggctggtatctggcagcagacactatctatggtgaccctctaaacccatgatctgcaacttaattccatgccctgccaaaacatgagccctcagttacattaaaatagagcccgttgaagaagctccacagaaccttagctgggcctctaccctgatgtaactgtgaggcttagattcctgaccatcgctggctgcatgtcagggtgttggaaactgaaactcgtgtgaacatgctgcatcatctgtgtccaacatcaaagcaaagctctactcattctctgtgggaggtttgggagttcgctgttgcactgttggagattacgtggaaaaggctcccccacgcaggccttatgaaaagaagcagtcttgactttgacctagcatttcaacctgctgcagttttaccaa

SEQ ID NO: 1825 - DNA, 3169 bp, Rattus norvegicus
  Genbank Accession No. NM_012923
ccgcacgctgaaccggaggaactgcgcctagtcggggcgctgagggaccctccaccgggacgccggcccctccccgggcctctgctcacttgcccccctgcgagcccgtccccctagtcggcctctcggatcggggacgtggggcgagctgagagcaggcccggggtgggtggtcactgtggagaagacgtggctgtcaagatgatagaagtactgacaactgactctcagaaactgctacaccagctgaacaccctgttggaacaggagtccagatgtcagccaaaggtctgtggcctgaaactgattgagtctgcacatgataatggcctcaggatgactgcaagactccgggactttgaagtcaaagatctactgagtctaactcagttctttggcttcgacacagaaacattttcccttgctgtgaatttactggacagattcttgtctaaaatgaaggtacaggcgaagcatctcggctgtgtcggactgagctgcttttatttggctgtgaaatcgattgaagaggaaaggaacgtcccgctggcaactgatttgatccggataagtcagtataggttcacagtttcagacctgatgagaatggaaaagattgtgttggagaaagtgtgctggaaagtcaaagctactactgccttccaatttctgcagctctattactccctcattcgggagaccttgccatttgaaaggagaaacgatctgaattttgaaagactagaagcccaactgaaggcgtgccactgcaggatcatattttctaaggcaaagccttctgtgctggcgctggcaatcatcgctttggagatccaagcactgaagtatgtggagttaacagaaggagtagaatgtattcagaaacattccaagataagtggccgagatctgaccttctggcaagagcttgtttccaagtgtttaactgaatattcatcaaacaagtgttccaagccgaacggtcagaagttaaaatggatcgtgtctgggcgcactgcacgacaactgaagcacagttattacaggataacccacctcccaacaattcccgaaaccatgggttagttggcaaatctggttgttatcctctgtgtacagaacatttcccagtgagatcgtttttgtgctataacttaaggattgaaatactaccttcaatataaagaatacaggatgaaaacagtaaaggaaacgtgagtttgttggtctagacagagaatactgggaggcattcactgtgtaccgcagtctgaagagaaatgagtatcaaacctctagacacatgctcatactgctgtcaaaggactagcgtagaaaagagagtcctccaaaccggaagtttaaatgtagttactaaaatagcacttcttataacttacatatccccccactgtggcttatttaaagttacagaagtccaagcagaacgacaaaagatgtgacccatatatgaacacattttaatctgttcattgattaggagagtgaatatgaacttgcatgatgcccatgttaggtttctggaaactgccggggtatcttaattctctagtattctccctctgtggcagttgggctaatacaaagtaactatacgcatgagaatataaaatcagtctctgatacatacacatttttaccatcaaaatttcttaatcatagcaaagacttacctttttatgattaggaattttttttttaatgtatggcagcacatgcctttaatcccaacactagggaggcagaggcaggtggatctctttgagttcgaagccaggctggtctttacagtgagttccaggacagctggagagctacagaatggagagacgctgtctcaaaaacactcaaaacaaacaaacaaaccataccagtttgtaggcagacttctgttgggttgggtttgtactgtttgcctatgcagtgggattacagcagcagcaacaaaaactgtccctgaagtctttctctgccactgtgacctgagtttcctatggtacgcgatttactctaggaaacctcagcccctcaccacgttagctgttggcaaatggcctcacagttgcggaaagtcccaattctaggcttgggaaagcaatgcttagatttgaattggcccatgaagcattcaaatcaaggctaaagacataaatgtgaaataaaactgtgaaccttcattttaacattgatctcacttcccagatttaatcaatatatacttaggtggtattaaaaatggtaaactgcctaatttaaatctcaaaatttaaactatgaggtttacatcaaagccaacatttcacaaatgtactttttaaggtattaaaagaggtatttaagcagtaaatggtttcttggcacccataaccaagtaatagttaagttagaggtgggacttttttattgctatgagaattacatttaaacttttgggtgttttataaaaagcagatttcacaagttttgaaaattgtgacctttactgaaatttgttacctttaatatttcttctagaggataggtatttataaaagaaaaattcgtcagaattgctgcctcaatctagtcccatttgagaaaatttgtttctactgtctcaataactggatgaaatatcactctgaaaacttgcctattgcactaaagctagtttaggcttgataaaacactccaggaggtttttaccacagactgtttctattaaaactgctgcttctcatgtacaattttgttttaaaaggaaccgagtacatctgcaaaacctaagtcttaagggacgtcaggaggtaccttcagaattataggatcaccatggtagtggggattctccatgctggccttgaatgtttgatcttcactgctgaaatgtgggtagctcctcagcgccctgtagagcctgagtctacctagaatagctgtaaccattttgacaagtaatggataagaaaattatccattgagaagctaaaaacaaaacaaaacaaaaccaaagaacgggtgtattttattcttaacctttgtaaaccatcactgagaacacttcagttcttcctaacagctgttatgcttcgatttgaaaaaaatactgagtggataaccaactaccatcatgctttgggtacacctttcaataaaattactgaaatgc

SEQ ID NO: 1826 - DNA, 4038 bp, Rattus norvegicus
  Genbank Accession No. NM_012924
ctcattgcccagcagcccccagccagtgacaggttccattcaccctctttgccccttcccccgcgacccttttccagaggctactagatcctttggtttcatcctgcacatcatggacaaggtttggtggcacacagcttggggactactttgcctcttacagttgagcctggcacagcagcagatcgatttgaatataacctgccgttacgcaggtgtattccatgtggagaaaaatggccgctacagtatctccaggactgaagcagctgacctctgcgaggctttcaacaccaccttgcccaccatggctcagatggagttagccctgagaaaggggtttgaaacatgcaggtatgggttcatagaaggacacgtggtaatcccgaggatccaccccaacgctatctgtgcagccaacaacacaggagtgtatatcctcctcgcatccaacacctcccactatgacacatattgcttcaatgcctcagctcctcttgaagaagactgtacatcagtcacagacctacccaattccttcgatggaccagttaccataactattgtcaaccgtgatggcacccgctacagcaagaagggcgagtatagaacacaccaagaagacatcgatgcctcaaacattatagatgaggatgtcagcagtggatccaccattgagaagagcaccccagaaggctacattttgcacaccgaccttcccacttcacagcctactggagaccgggatgacgccttctttattgggagcaccctggccaccattgcctcaactgtgtactcaaaaagccatgcaacagctcagaaacaaaataactggatatggtcttggtttggtaattcacaatccacaactcagactcaggatagccccacaacaacagcaactacagccttgatgactacccctgaaacaccacccaagaggcaagaagcccagaactggttttcatggttttttcaaccatcagagtccaagagtcatcttcatacaacaacgaagatgcctggtacggagtcaaataccaacccaacaggctggaagccaaatgaggaaaatgaagatgaaacagacaaataccccaatttttctggatcaggcattgatgatgatgaagattttatctccagcaccattgcaactactccatgggtttctgcccacacaaaacagaaccaggaacggacccagtggaacccaatccattcaaacccagaagtactacttcagacaaccaccaggatgactgatatagacagaaacagcaccagtgctcatggagaaaactggacccaggaaccacagcctcctttcaataaccatgagtatcaggatgaagaggagaccccacatgctacaagcacaacctgggcagatcctaatagcacaacagaagaagcagctacccagaaggagaagtggtttgagaatgaatggcaggggaagaacccacccaccccaagtgaagactcccatgtgacagaagggacaactgcctcagcccacaacaaccatccaagtcaaagaatgacaacacagagtcaagaggatgtttcatggaccgatttcttcgacccaatctcacatccaatgggacaaggtcatcaaacagaaagcaaggatacaggctccagtcatagtacaacccttcagcctactgcggctccaaatacccatttggtggaagacttgaacaggacaggaccactttcagtgacaactccacagagtcattctcagaacttctctacattacctggagagctggaagaaggcgaagaccatccaacaacttctgttctgccatctagcactaagagtggtcgaagaagaggtggaagtcttcccagagatacaactacttcactggaaggctacacccctcaatatccagacacaatggaaaacgggactctcttcccagtgacccctgctaagactgaggtctttggagaaactgaagggactgttgctactgactccaactttaatgtggatggctccttaccaggtgatggagactcatccatggaccccaggggtggtttcgacactgtgactcatggatccgaattagctggacactcaagtgggaatcaagacagtggagtgaccacaacttctggtcctgcgaggagacctcagattccagagtggcttatcatcttggcatccctcctggcgctggctctgattcttgccgtctgcattgctgtcaacagtaggagaaggtgtgggcagaagaagaagctggtgatcaacagtggcaatggaacagtggaagacaggaaaccaagtgaactcaacggggaggccagcaagtctcaggaaatggtgcatttggtgaacaaggaaccaacagagactccggaccagtttatgacagctgatgagacccggaatctgcagagtgtggatatgaagattggggtgtagtgcctatgccactaacttgaaaagacacaacaattggagacatgtcattactgggagctgggacccttaacagatgcaatgtgctactgattattttttattgggattattttgggcataaaatttccctttttttgttttttaaaagtttgttttccaatttatgaaaatagcattgctttctgaaatgagggtctcttccagttcctccttagaggccttgcattaccagggtatgctaccataggcttctaccaaatgaatactcttggtcccgattgaacccaaagtcccaggtaacatccaccagctaaggatttccccagaacttagagagattggtctctgggaggaaatttgaatgggtccatattgcctcccagcagtccaatctgtaggcattgctttgcagtggatgggagatcaggtgtactggttacacactctctttatagactcccttctgctggaaaatttccacatgcttctgagagattccccaaaggtgacgctatttatctttagtaagctatttatctttgtttttgaaatatcaaaccctggaggtccttttttcagtatgactttttttattttgtttttttttattttgttttttaggttactttgtcagaagcataacagggtataagttgattcataataaatacctgtccatcttccatcttgacctgttgtgctgtgatccttcagtttctaaatcagcaaggtctgagtctttgtagcacatcaatgtgaccttagtatggtcctctgaaactcatgttagagcatccgtgccctgcttgggtttacccagctgaatctcagaagatcaaggacaggagcactgttttcattctaggactatcaaaggggtttctctcctgttcaagaatctgaattgggagtaggagagcttctgtcccttttatgtttcgataaccacccatttctctttcttaaagggcacattaagtttttatatcttacaacattcgcggtcctgtttcatagacactgatcttattggcactttcacaaaacagtgtggaggggacttctgacaccttatagtaaaaggagaagccaacagaaatgaaagtgtggacagagagcagtagattggcatgaggaggcatgatgtacaacccccagaccactctttccatcaccacatttgttgatgctttcgcaagccagttggtacttagaatcagttccccagggaatccttcaaaaagccataagaatgcccacccctggaatcttaccaccaccagatgagcaggtttatggtttagcaaaaggagaatgctgtcaccctctgacctcatagttttcacatactgggcaagtgttcatctgccaggatgccccattgctcctaggtcttcccaggtaccttgtagaagaacttaaatctataaaataaggctttctctaaaatggaacttcctttctaaggctcccatttttactgttgactaaatttatatgtttaatagttttttttcaaataaaaacaaacacaaaaaggaaaaaaaaaaaaaaaaaaaaaaaaaaaaaaaaaaaaaaaaaaa

SEQ ID NO: 1827 - DNA, 2296 bp, Rattus norvegicus
  Genbank Accession No. NM_012930
cctgcttgctcaggaactccctcagccgccgcgttctctagccgccgttgctgcccgggacgatgatgccgcgcctgctgtttcgtgcctggccccgctgcccctcgcttgtcctgggagcccctagtaggcccttaagtgctgtctcggggccggacgattatctgcagcacagcatcgtgcccaccatgcactaccaggacagcctgcccaggctgcctatccctaaacttgaagacaccatgaagagatacctcaatgcacagaagcctctcttggatgacagccagttcaggagaacagaagcgttgtgtaagaattttgagactggcgttgggaaggagctgcatgcccacctgcttgctcaggataagcagaataagcacaccagctacatctcaggcccctggttcgatatgtatttaactgctcgagactctatcgttttaaactttaatccatttatggcattcaatccggacccaaagtctgagtataatgaccagcttaccagggcaaccaacttgactgtttctgcagtccggtttctgaagacacttcaggctggccttttagaaccagaagtgttccacttgaacccttccaaaagtgacacagacgccttcaaaagactcattcgctttgttcctccctctctgtcctggtatggagcctacctggtcaacgcatatcccctggatatgtcccagtatttccggcttttcaattcaactcgtatacccagacccaatcgtgatgaactctttactgacaccaaggctagacacctcctggtcctaagaaaaggacatttctatgtctttgatgtcctcgatcaagatgggaacattgtgaatcccttagagattcaggcacatctaaagtacattctctcagacagcagccctgtgcccgagtttcctgtggcatatctgaccagtgagaaccgagatgtctgggcagagctcagacagaagttgatttttgatggcaatgaggaaaccctgaagaaagtggactctgctgtcttctgcctctgcctagatgacttcccgatgaaggatcttattcacttgtcacacaccatgctgcacggcgatggcacaaaccgctggtttgataagtcctttaacctcattgtagccgaggacggcactgctgcagtccacttcgagcactcgtggggggatggggtggcagtgcttaggtttttcaatgaagtgttcagagacagcactcagacccctgccatcactccccagagccagcctgccgccaccaactcctctgcgtctgtggagacgctcagcttcaacctcagcggtgctctcaaggctggcatcactgctgccaaggagaagttcgacaccacggtgaaaaccctcagcattgactccattcagttccagagaggtggcaaggagttcctgaagaagaagcagctgagccccgatgcggtggcccagctggccttccagatggccttcctgagacagtatggccagacggtggctacctatgagtcctgcagcactgcagccttcaagcacggccgcacagagactatccgcccagcctccatctttactaagagatgctccgaggcgtttgtcagggacccctccaagcacagtgtgggcgagcttcagcacatgatggctgagtgttccaaataccatggccagctgaccaaagaagcagcgatgggccagggctttgaccgacacttgtatgctctgcgctatctggcaacggccagaggactcaacctacctgagctctatctggatcctgcataccagcagatgaaccacaacatcctgtccaccagcactctgaacagcccagcagtgagccttgggggctttgcccctgtggtccctgatggctttggcattgcatatgctgttcacgatgactggataggctgcaatgtctcctcctactcaggacgcaatgcccgagagtttctccactgtgtccagaagtgcttggaagacattttcgatgctctagaaggcaaagccatcaaaacttagcttcctagtcgctgaaaagcctccattcttcctcatgaacatggatgttcatgtagctggaaggtgccatcttgtgcccaacaaaactaatcccaaggtgcttccacagccagtgctgcaggctgagctggaagagcccaactgaaggtagtgagaggtcgcagctgtaaagccctctttgttcaggagatagggtttggaaaactaactcagctgtatttattgtttaaatagaaataaaacctggtgttgcttag

SEQ ID NO: 1828 - DNA, 3335 bp, Rattus norvegicus
  Genbank Accession No. NM_012931
gtacgcgggtagcacggcctctggccgtggagcaccatgaagtacctggtgagtgtgggcgcggggccggccaggcgggcgggcggtctggaggacgtttcctgggggccccgagtgtcccgccggccgcagagttaccgggcagctcggcacgtaaacgagtccctccctcggtccgcctttcgagtccccgcagctcacggagctagcgtgacgccctccgcagcccttgggtccgggttgcctgagactcagcccgaggcggtatgcagagggactgagaaaccgagatttgctgagggctgcaaaccggcggcgagccgcgacaagaacgtgctggccaaagccctctatgacaacgtagctgagtctccggatgaactctccttccgaaagggtgacatcatgacagtgctcgagcgggacactcagggcctggatggctggtggctctgctcactgcatgggcgccagggcattgtgcctggtaaccgcctcaagattctggttggcatgtatgacaagaagccagcagcacctggaccaggcccacctgccaccccaccccagccccagcccagccttccccagggcgtccatactccagtgcctccagcttcccagtacagtcccatgctccccactgcataccaaccccaacctgacaatgtgtacctggtacccactcccagcaagactcagcaaggtctctaccaagcccctgggcccaacccacagttccagtcacccccagccaaacaaacatccacattctcaaagcaaacacctcatcactcatttcccagccctgccacagacctttaccaggtgcctccagggcctggaagtccagcccaggacatttaccaggtgccaccttccgctggcacagggcatgacatctaccaagtccctccatctttggacacccgcagctgggagggaacgaagccaccggcaaaggtggtggtacctactcgagtgggacagggctatgtgtacgaggcctcccaggcagaacaggatgagtacgacaccccgcgccacctgctagctccaggttcccaggacatctatgatgtgccccctgttcgaggactgcttcccaaccagtatggccaggaggtatatgacaccccgcctatggcagtcaaaggccccaatggccgagacccgttgttggatgtgtatgacgtgccccctagtgtggagaaaggcctgccgccgtccaaccatcattcggtgtatgatgttcctccttctgtgagcaaggatgtgcctgatggcccactgctgcgtgaggaaacatatgatgtaccccctgccttcgccaaacccaagccttttgatccgacccgacatccattaatcctcgctgcacctcctccggactccccaccagctgaggatgtgtatgatgtgccaccccctgctcctgacctctatgatgtgccccctggtttgcggcggcctggccctggaacactgtatgacgtgcctcgagagcgggtgctccctcctgaggtggctgatgggagtgtaattgatgatggtgtgtatgctgtgcccccaccagccgagcgagaggcgccaacagatggcaagcgcctgtcggcctctagcacgggcagcacacgcagcagccaatcggcgtcttccttggaggtagtggtgccaggtcgggagcccctggagctggaagttgctgtggagaccctggctcggctacagcagggtgtgagcaccaccgtagcccaccttctggacctggtgggcagtgccagtggccccgggggctggcgtagtacctctgagccccaggagcctcccgtgcaggacctgaaagctgcagtggccgcagttcatggggcagtacatgagctcctggagtttgcccgcagtgcagtgagcagtgccactcacacttctgaccgcactttgcacgccaagcttagccggcagctacagaagatggaggatgtgtaccagacactggtggtccatggtcaggtccttgacagtggccggggaggtccaggattcactctggacgacctggaccgcctggtggcctgctcacgggctgtgcccgaggatgccaagcagctggcctcctttttgcatggtaatgcctcgctgcttttcagacggaccaaagcccctggccccgggcctgagggcagcagctccctgcacctcaaccccaccgataaagccagcagcatccagtcacgccctctaccctcacctccaaagttcacctcccaggactctccggatggccagtatgagaacagtgaagggggttggatggaggactatgactacgttcatctgcaggggaaggaggaatttgagaagacccagaaggaactgctggaaaagggcaacatcgtgcgacagggaaaaggccaactggagctgcagcagctgaaacagtttgagcgactggagcaggaggtgtctcgtcccatagaccatgacctggccaactggacaccagcccagccccttgtgccggggcggacagggggactggggccttcagaccgacagctgctgctcttctacttggagcagtgtgaggccaacctgaccacactgacagatgcggtggacgccttcttcaccgcagtggccaccaaccagccacccaagatctttgtggcacacagcaagtttgtcattcttagtgcacacaagcttgtgttcattggggacacactgtcacggcaggcaaaggcagctgatgtgcgaagcaaagtgacccactacagcaatctgctgtgtgacctcctgcgtggcatcgtggccaccaccaaggccgctgccctgcagtacccatccccatctgctgcccaggacatggtagacagggtcaaggagctaggccacagcactcagcagttccgccgtgtcctgggccagctggctgccgcctgaaagcagaagactgggctgtgaggctggggagtgggtagcggtggtgtgagctacccaggcgctcgtcttgaagtggagatcctgcaggtttggggacaggtaaccccagctctgctttgggcctggtgccctcaactgtccagggatttgtacatatttatatcaaggcaggatgcagaatgcctcctcggagaggctgaggagccccgtcagagtggaccatgggctgggatcaccagggttggggcacatgggctccagtccacagggctccctgggacaggaagtacagtgtggtgtacacctctgcaccaagaaaacctaaagaactatttttcactattgatttttttccaatcatttgactaatagtctacatttaataaaatttt

SEQ ID NO: 1829 - DNA, 528 bp, Rattus norvegicus
  Genbank Accession No. NM_012935
atggacatagccatccaccacccctggatccggcgtcccttctttcctttccactccccaagccgcctctttgaccagttcttcggagagcacctgttggagtctgacctcttctctacagccacttccctgagccccttctaccttcggccaccctccttcctgcgggcacctagctggattgacactgggctctcagagatgcgtatggagaaggacaggttctctgtgaacctggacgtgaagcacttctctccagaggaactcaaagtcaaggttctgggagacgtgattgaggtgcacggcaagcacgaagagcgccaggacgaacatggcttcatctccagggagttccacaggaagtaccggatcccagccgacgtggatcctctcaccattacttcttccctgtcatcggatggagtcctcactgtgaatggaccaaggaaacaggcctctggccctgagcgcaccattcccatcacccgtgaagagaagcctgctgtcactgcagcccctaagaagtag

SEQ ID NO: 1830 - DNA, 735 bp, Rattus norvegicus
  Genbank Accession No. NM_012937
gtcacctcgacaccagagagtccaccatggcctcagaccaccagacacaggcgggcaagccccagccccttaaccctaagatcatcatcttcgaacaggagaacttccagggccattcccatgagctcagcgggccctgccccaacctgaaggagactgggatggagaaggcaggctccgtcctggtgcaggctggaccctgggtgggctacgagcaggctaattgcaagggagagcagtttgtgtttgagaagggcgagtacccacgctgggactcctggaccagcagccggaggacggactccctcagttctctgagacccatcaaagtggacagccaggagcacaagatcatcttatatgagaaccccaactttacgggcaagaagatggagattgtcgatgatgacgtacccagctttcacgctcacggataccaagaaaaagtgtcttccgtgcgcgtgcagagcggcacgtgggttgggtatcagtaccctggctaccgtgggctgcagtatctgctggagaagggggattacaaggacaacagcgacttcggggcccctcacccccaggtgcaatctgtgcgtcgcatccgtgacatgcagtggcaccagcggggcgccttccacccctccagctaaagccctgcccctccctccttcccagggtccaggccagccaccggggtcctcctgacacccagagtgaataaagtgtggcttgcaacttgaa

SEQ ID NO: 1831 - DNA, 4964 bp, Rattus norvegicus
  Genbank Accession No. NM_012940
gttgcagacacctctgcgacgccagcttgaaagccgccggcgggctgggatttagctccactttatcaactcccaacccctcacccatctcaaccgcaactccaactctgtgagaaagtcctgactttgcggagccccaggtgcactggagctcagcaaacttgagacacttcccccctgtcctccatcctaatctaagtttaggttctgactgagccaagagtgggtgctaaagcagcgggcctcaggtgtctaggactccgggtccttggggactctcaggttgaagtcttgcagagtctgggcagaggctccagagcttctcccagaccccactgctctacaccgctggaaccgcgcttcatcgcagcatggccaccagccttagtgcagacagtccacagcagctgagctcgctgtctacccaacagaccattcttctgctactcgtttcggtcctggccatcgtgcacttaggccagtggctgctgcgccagtggcgacggaaaccgtggtcctcgcccccgggtccctttccttggccattgatcggaaacgcggcgtctgttggccgggcatcgcacttgtacttcgctcgccttgcgaggcgctatggcgacgtttttcagatccgtctgggcagctgtcccgtggtggtgctgaatggcgagagtgccatccatcaggctctggtgcagcagggcggcgtctttgcggaccggcctcccttcgcctctttccgtgtggtgtctggtggccgcagcctggcgttcggccactactcagagcgctggaaggagcggcgacgtgcagcctatggcacgatgcgtgccttctccacccgccacccgcgcagccgcggtctcctcgagggccacgcgctgggagaggctcgagagttggtggcagtgttggtgcggcgctgcgccggtggcgcctgcctcgatccgacgcagccgatcatagtggcggtggctaatgtcatgagcgctgtatgcttcggctgtcggtacaaccacgacgatgccgagttcctggagctgctcagccacaacgaggagttcgggcgcaccgtgggcgcgggcagcctggtggacgtgatgccctggctgcagctttttcccaacccggtgcgcaccatcttccgcgagttcgagcagatcaaccgcaacttcagcaacttcgtcctggacaagttcctgaggcaccgagaaagcctcgtgcccggggctgctcctcgagacatgatggacgccttcatcctctccgccgaaaagaaggcgactggggaccctggtgacagtccctccgggctggatttggaggatgtgcctgccactattacagacatctttggagccagccaggacaccctttccaccgcgctgctgtggctgctcatcctctttaccagatacccggatgtgcaggcccgcgtgcaggccgagttggaccaggttgtggggagggaccgcctgccctgcatgagtgaccaacccaacttaccatacgtcatggcttttctttatgaatccatgcgattcaccagctttttgcctgtcacccttccacatgccaccactgccaacacctttgttttaggctactacatccccaaaaacacggtagtttttgttaaccagtggtctgtgaatcatgacccagcaaagtggtctaacccagaggactttgatccggcccgcttcctggacaaggacggcttcattaacaaggcactagccagcagcgtgatgatattttcagtgggcaaacgacggtgcatcggcgaggagttgtctaagacgcttctgtttctcttcatctccatcctcgctcatcagtgcaatttcaaggctaaccaaaacgagccctcaaacatgagtttcagttacggcctgagcattaagcccaagtcgtttaaaatccatgtgtctctcagagagtccatgaagctccttgatagtgctgtcgagaagctgcaagctgaggaagcttgccagtgagagagggagaggccggaggtaactgaaatgttcaaagaaaaccatctcattaactggagaggaaaacacagattttattttctccagcttcattttggcctcagttctcaagaatgagcggaaaccaagtggcctgaaggtgaggcgggcttaccaattcatggctcctcaccggccagcagctggagatcctgaagtattttgaaattgaagagtaatagggtccaaggaatttgcatactgttcccccctcacccccattaaacacatgcacacaaatcagcatgtgtgtacagctatccaacaaaatatttcagtaactctgcctttttgggtcgatttgaaagggaacttctattgcagaaattggccccataggaaaccacagtaagcagaggcttaggatatatatatatatatatatatattcaagattcaaagaagtgatttaagtgtaaaatataaagagcagaaatttaccaagagacaaatgagcactcccttgtggccctggacgaggttttctttctgcctgtagatgtgcctcccactctagaacggaccataaagccgttttgctccccctcaatttatggctagtttaataaccacagtaggttttagagattagtgaatccaaaggtaaattgtttgaaaggcaaaaggattttgtaagttaaaactgtatgtcattcagctgttcaaacgaagcattccagttatgagggagaaaaaggtttgccagtctaacgtaagctttcaactttgggatcgtaacaaactgatctgagtaataagtcggataaagtaaaaaataaaaaagcctcatgtcaccaaatagcattcaataaattttgcataattattcacaagcatcatatgaatattaactatttgacaggaaagcacttgaataatacatttcttatgtcatcttgcaaaccaaaaagtataatcagttgggtgaaatttgcccaaatccaggaaacgatcctgacaaaatcgatctgattaatatcagggaagcaagtaacaggacgatcctttcctttcttatttacagcccctacacgagacaaatctcaaaactaaaccagcaaaaccatgctctgatctggtaattgtagttacaacgcacttttcttttggaattgacccctttcggttgcgttaagattccaaactcttggctggctctgattttaaattagtttaaaatccaccttgattattttgtttcggttgaagctggagaaagtatggttattatctcacagaaggtgagacacctaacctttatctaaggacaaatgtcaaaggcaacaatcaatcaaacaaacaaacaaagccatgagtgctctgggtgttcttattagacgccctctgacaagaaactcagtaccactggtagttggtagtttctttttatgtgctattactatggttgttgtaggtgttttttaaattgagtattaaggtctgcggttttgtgtttttttttaagtcagaatctgaagattgtcttgggaggttgtttagcgactgcttggggagacagcagagacggctaaaattggctcttatttaggatggcagactgagcagccgccttcctggtagctgagagaggagaaatatatgtatttggattgtgtaaacaatccgaaacctgttaagaagggttggatgagtggaaaagtagggacagggcgcgtggggggtttcccatttctgttttcactgcaatttagacggaacaaaagaagcccacggcactcagagagcttatggttggctctgtttcattaggcttcttggaattttcctatcaaaattgcaaaggaaggagtgtgtgatattcttgtgtgcagaggccagaagctgacagacagagagtgcatgagcaggagagaaatgtttaaatggtccccattcactccaaattagtctcttgacctgtaacatttgaggcatgatgtttagaaaaaaaggagtttcaagggtcaggtcttaccttcaagtgtctcttaagactggctggagaccaagccctcaccctctctctcccccatccacatctattttgtagttggagattgaattataaaaaatataatgtaatccttatttaaatttctcacaacagaaccccttgaatgtgaaacacaggttgtgtcagtattttcgaggccttgatttcaactacaaaaattaactctgtaaacatttttaagtttttcagacattttaaaagcatgcacctcagtaaggtcgggacagtgatttgagcctccatggcctctttactatgagaaatttgtaagagtgaaaagtcttcatgaaccaatctggactcctcattaagccaaccagacccagatgttttgtgaacgtaggggtcatgttcgtctgatgctttcagcaaaggggaaagaagggggctactttgtatatatttagacccagtgaaaggaaggaggatacaagtcaggaaagagtaacaattgtcatattcggaagctaatagattactggcttagttggaaagcctgccttattctgctacagagggatttcttttgctggtcaccatcttcatcagagtatccacctcctgtcagggcaggcaaaaagtatgtttttattaaatgtctcccttgcacagtaaagcttggactatgtcagaacgttgcttttttttttaaaacaaaaaatatgcctcaggtgtgttttatgaattactcaaaagagttcatgccccagaacttagcctgtacctgtgaaatattatcatgccccttatgtattcacaccagggctgtgctagattaaatagagatcatcaccatggtatgctaattactgtttttagcagtgacacagttgtgtgacagaaggtgtatgttaccaggtgattataacccagaaataattccctatttaacctctaaaaaaaaaaaa

SEQ ID NO: 1832 - DNA, 2260 bp, Rattus norvegicus
  Genbank Accession No. NM_012941
cggaggccggggccgcctcccgacgcccacctactagcttctccagctccatctttcccgagaagcggcagggacctcggcctccagcttaccgggcggatcgaagcagcggtcgggatggtactgctgggcttgctgcagtcaggcggctcggtgctcgggcaggcgatggagcaggtgacaggaggcaacctgctttccacgctgctcatcgcctgcgccttcacgcttagccttgtctacctgttccgcctcgcagtgggccacatggtccagctgcccgctggagcgaaaagtccgccatatatttactctccaattccgttccttggccacgcgatagcatttgggaaaagtccaattgagttcctggaaaatgcatatgagaagtacggacctgtgtttagctttaccatggtgggcaagactttcacttaccttttggggagtgacgcagccgccctgctcttcaacagtaagaacgaagacctgaatgcggaagaggtctacggtcggctgacaacgcccgtgtttgggaagggagttgcatacgacgtgccaaatgcagttttcctggaacagaagaaaatactaaaaagcggccttaacatagcccacttcaagcagtatgtttctatcattgaaaaagaagcgaaggagtactttaaaagttggggagaaagcggagaaagaaatgtgtttgaagcgctgtctgagctcataattttaacagctagccattgcttacatggaaaggaaattagaagtcagctcaacgagaaggtggctcagctgtacgcagacctggatggaggctttagccatgccgcctggctgttgccaggctggctgcccctgccgagtttcaggcgcagggacagagcccatcgagagatcaagaatattttctacaaggccatccagaaacgtaggctgtcaaaagaaccagccgaggacattcttcaaactttactggattctacatacaaggatgggcgtcctctgacggacgacgagatcgcagggatgctcatcggactgctgctggccggacagcacacatcctccaccaccagtgcctggatgggcttctttctggccagagataaaccacttcaagacaaatgctacttagaacagaaaacggtgtgcggggaggatctgcctcccttaacttatgagcagttgaaggatctgaatttacttgatagatgcataaaagaaacactaagactgaggcctcctataatgaccatgatgagaatggccaagacccctcagactgtggctgggtacaccattcctccaggacatcaggtgtgtgtttctccaactgtcaatcaaagactgaaagactcctgggtagaacgcttggacttcaatcctgaccgctacctacaggacaacccagcgtcgggagagaagtttgcctatgtgccgtttggagccgggcgccatcgttgtattggagaaaattttgcctatgttcaaattaagacaatttggtccactatgcttcgtttatatgaatttgacctcatcaatggatattttcccagtgtgaattatacaacaatgattcataccccagaaaacccagtaatccgttacaaacgaagatcaaaatgaagaaaggaacaaggagccagtgtggagacgggactgcaagctgcagcttggcagagaatgaagctttgacacagctttcatactgtactgttttttaagtgtgtggttctgaaagccagtttgattttaatgttttattaactcggtgatttttgtcagacctaatggcatttgaaacagttataatagttctgataggatttcagggaagccaagtttatgttagaaatcgtttaggggagcctcggtattcagagatgatacagaatatagcatccaggtaactaacttcagaagcacacgttgccgtagggagattccggcttggaactagtttgggaagttttaagcctggtcagatgctacagaggcaatgggtcattggtgtggttgggccacttctgtgcgtaaagatgtgagagggtgaaggataagttttctgcgaagctctagatggtgtgagtgccctttgtagtgttaactgagagcaccactccagcgagatggcagcaatcttggaccttatcttgataaccttatttcctaaaaataataaatactaaagagtacttatgttattggttccagaaaaatccaaaatcaaatccttgtggaatttttaattttaatt

SEQ ID NO: 1833 - DNA, 1550 bp, Rattus norvegicus
  Genbank Accession No. NM_012945
gggcccccccgtctccgccaggctcgggaccatgaagctgctgccgtcggtggtgctgaagctctttctggccgcagtgttgtccgcgttggtgaccggtgagagtctggagcggcttcggagaggtctggcggcagcaaccagcaaccctgaccctcccactggaaccacaaaccagctgctacccacgggagctgatcgcgctcaggaggtccaggacttggaagggaccgatctggaccttttcaaagttgctttctcctccaagccacaagccctggccaccccaggaaaagaaaagaacgggaaaaagaagaggaaaggcaaggggttaggaaagaagagagatccatgccttaagaaatacaaggactactgcatccacggagagtgcagatacctgaaggagctccgtattccctcgtgccactgcctccctggttaccatggacagaggtgtcatgggctgaccctaccggtagagaaccccctgtacacatatgaccacactaccgtcttggctgtggtggctgtagtactgtcatctgtctgtcttcttgtcatcgtgggacttctcatgttcaggtaccataggcgaggaggttatgacttggaaagtgaggagaaagtgaagttgggcatggctagctcccactgaggaggatctgagctcaaggagccttcagaggatggctacttctgagatggcggttccttacaagttctacagagggaaaatacttcaccagcagccatgaagacttcttcattcattcccagttgctaccctgactgggcctcctgtaattgctctgcaaaaatatcagagcctctaagtgccaaacagactatgccccgctgggatctggatcagaagaaagcaggagcaagtgagcccttcaggccttcctgatcctccaccactgaacccactggtttgtttaaacacttagcttctggattaaagtgtcagctagtttccatatgctccaggatttttggctgaaaaaaaaaaaagaagagaggacggatgagtggtttatggactggaagagatcaacagagttgagaagctaagtgttcaagtagccacaggggatctgctgtttggaccctccagcacgctggatttgatgagctaactgtgaaatatctcaagcccgagaactcttgagttttgggacttctacccagagggaaaaataacaagtattttgttgttgttgttgtttgtttgtttttaaaatgcctcttaaattatatatttattttattctatgtatgttaatatatttagtttttaacaatctaacaataatatttcaagtgcctagactgttactttgccaatgtcctggcccgcctctcttgcagctcttccacctggctcaatgccacactcccatctgctctgtaacccatctgtagtaatttattgtctgtctacatttcagaagatgcccctgtagcagagtatcccagggtgggttgtgtatggtcggagtgcaaggatggatttgggcagagccactctgtgagttggactgcag

SEQ ID NO: 1834 - DNA, 680 bp, Rattus norvegicus
  Genbank Accession No. NM_012966
gaggggcttgttctttcacctcagcggccgacctggaaaagcctagaaagtgctccccttttcttccgcctccggctacccgcatcggccgcctgcgcggagtcctggccaccaatcggcgcgcgcgctggagtggccgccttctctcacgctaaggggctgagtgcgcctgcgcgctgcgctgtcttttcacgtgtcctgagccggcccacgggagtctccttgcagcaggagtccgagtgcagagtccggagctgcggcggcgtaagtcatggctggacaagcttttaggaagtttcttccgctatttgacagagtattggttgaaaggagtgccgctgaaactgtgaccaaaggtggcattatgcttccagaaaagtctcaaggaaaagtattgcaagcaacggtcgtggctgtgggatcaggcgggaaaggaaagggtggagagattcagcctgtcagtgtgaaagttggagataaagttcttctcccagaacacggaggcaccaaagtagtactagacgacaaggattacttcttatttagagatggcgacattcttggaaagtatgtcgactgaaatcactgttgaaatggtgtcacatgaagctgcccattccactgatattctgaactatttcatcatgtaaataatttccatgcctcccttttataataaa

SEQ ID NO: 1835 - DNA, 2602 bp, Rattus norvegicus
  Genbank Accession No. NM_012967
ctgctgcctgcactttgccctggtcctccaatggcttcaacccgtgccaggcccatgctgcctctgctcctggtcctggtcgccgttgtgatccccgggcctgtcggtgctcaggtatccatccatcccacagaagccttcctgcctcggggtggatccgtgcaggtgaactgctcttcctcttgcgaagacgagaacctcggcctggggttggagactaactggatgaaagacgaactatcgagtggacacaactggaagctcttcaagctgagcgacattggggaagacagcagaccactgtgctttgagaactgtggcaccacgcagtcctcggcttctgccaccatcactgtgtattcgttcccagagcgagtggagctggatcctctgcccgcctggcagcaggtgggcaagaacctcatcctgcgctgcctggtggaaggcggagcaccgcggacacagctctcagtagtgctgctccgtgggaatgagacactgagccgccaggcagtggatggggaccccaaggagatcacattcacggtgctggccagcagaggcgaccacggagccaatttctcatgcttcacagaactggacctcaggccacaagggctgtcactgttcaagaatgtctccgaggtcaggcagctccggactttcgatcttccgactagggtcctgaagctcgacacccctgacctcctggaggtgggcacccagcagaagttcttgtgttccctggaaggcctgtttcctgcctctgaagctcagatatacctggagatgggaggccagatgctgaccctggagagcacaaacagcagagattttgtgtcagccactgcctcagtggaggtgactgagaagttggacagaaccctgcagctgcgctgtgttttggagctggcggaccagaccctggagatggagaagaccttgagaatctacaacttttcagctcccatcctgaccctgagccagccggaggtctcagaaggggaccaagtaactgtgaagtgtgaagcccacggtggggcacaggtggtgcttctgaacagtacttcccccaggccacccacctcacagggtacttcccccaggccacccacctcacagatccaattcacactgaatgccagcccggaggatcacaaacgacgcttcttttgctctgcggccttggaggtggatgggaagtccctgtttaaaaaccagaccttggaactccatgtgctatatggtcctcacctggacaagaaggactgcttggggaactggacctggcaagaggggtctcagcagactcttacatgccagccccaggggaatccagcccctaatctgacctgcagccggaaagcagatggtgtcccgctgcctatcgggatggtgaagtctgtcaaacgggagatgaatggtacctacaagtgccgtgcctttagctcccgtgggagtatcaccagggacgtgcacctgacagtgctgtaccatgatcagaatacctgggtcataattgttggtgtgttggtactgatcattgcgggcttcgtgatcgtggcgtccatttacacctattaccgccagaggaagatcaggatatacaagttacagaaggctcaggaggaggccctaaaactcaaggtacaagccccgcctccctgagcccactggacaggacacctgcctgggccccgctgctcttgaacagatcaatggacagcatttacccctcacccacctcctctggctgtcacaggacaggacagtggcctggggatgcatacttgtagcctcaggcctaagaggactcggaggggcaagactgtgaactcgtgacctggacacacctacagcctggtgggcctgcagccaagaaaggctgacttccttctctattacccctgctgaggggccccctaccttaggaaggtgtgatatccggtagacacaagcaagagaagaaaaggaacaccatgcttcctctgacatgggaaagctgggacactgtccccaactcttgttgatgtatttattaattcagagttctgacagttatttattgagtaccctgtacagacactagaggagtgagcaggttaacatgtaagttattgcctagaccctggtgaaggggcacaacagagtctggggaaagatcatacgggtttgggcttctccacaggtcagggtgctttcctcaaaagagctgatttctttcacgagtcatataaatactatgtggacgagcagtggccctctgctcgtagacctctctgggacccctgcctcctcccacagcctggagtctcccagcaccagcatgggtgaccacctccccacctacatacattcctacctttgttcccaatgtcaaccaccatgcctaaatatggacgctcacctttagcagctcaacaatggagtctcatgcccgtgaaattatggtcaatccctgcatgcctccacccggctccacctcaaagagaatgcctgggagaaaatgttccaaccacttagaagggtcctgcaagctgttgtgggagggtaggcacccctcccagcgcagaagcctttcctttgaatcaataaagtttta

SEQ ID NO: 1836 - DNA, 5581 bp, Rattus norvegicus
  Genbank Accession No. NM_012974
agtgactgctggtcggaccctgggacagactgagggcctggagggaaaccagcccagtacccacacggatggagtgggcctcaggaaaaccagggaggggcaggcagggacagcctgtgccatgggaacttcgcttgggcctacttctaagtgtgctggctgccacattggcccaagtcccatccttggatgtacctggctgttctcgaggaagctgctatccagccaccggtgacctgttggtgggccgtgcagacagactgacagcctcctccacgtgtggcttgcatagccctcaaccctactgtattgtcagtcacctgcaggatgaaaagaagtgcttcctgtgtgactcccgacgtcccttctctgctcgagacaacccaaatagtcaccggatccagaatgtagtcactagctttgcgccacaacgccggacggcctggtggcagtcggagaacggtgttccgatggtcaccatccaactggacctggaagctgagtttcatttcacccacctcatcatgaccttcaagacatttcgtcctgcggccatgctggtggagcgctctgcagacttcggccgcacgtggcgtgtctaccgatatttttcctacgactgcggggctgacttcccaggaatcccgctggccccgccgcgtcgctgggatgatgtagtgtgtgagtcccgctactcagaaattgagccatctactgaaggcgaggtcatctatcgtgtgctggatcctgctattcctattccagacccctacagctcacggattcagaacctgttgaagatcaccaacctccgtgtgaacctcacccggcttcacacactgggagacaacttgcttgacccacggcgggagatccgggaaaaatattattatgctctctatgaacttgtcatccgcgggaactgcttctgctatggacatgcctcacagtgtgcgcctgcaccaggggcaccggcccatgctgagggcatggtacatggggcctgtatttgcaagcacaatactcgtgggctcaactgtgagcagtgtcaggatttctatcaggaccttccctggcatcctgctgaggatggccatactcacgcctgtcggaagtgtgagtgcaacgggcatagtcatagctgccactttgacatggctgtgtacctggcatctggaaacgtaagtggaggtgtctgcgatggctgtcagcacaacacggctgggcgccactgcgagctctgccggcccttcttctaccgtgacccaaccaaggacatgcgggatccagctgcgtgccgtccttgtgactgtgacccaatgggttctcaagacggtggccgctgtgattcccatgatgaccctgtgctaggtctggtctcaggccagtgtcgctgcaaagaacacgtggttggcactcgctgccagcaatgccgggacggcttctttggacttagtgccagcaaccctcgaggatgtcagcgttgtcagtgtaactcaaggggcacagtgcctgggggcaccccttgtgactccagtagtggaacctgtttctgcaagcgtctggtgactggagacggctgtgaccgctgtctgcctggccactggggcctgagccatgacctgctaggctgccgcccctgtgactgtgatgtgggcggtgccttggatcctcagtgtgatgaagccacgggtcagtgcccgtgccgcccacacatgattgggcggcgctgtgaacaagtacagcctggctacttccggccttttctagaccatctaacctgggaggctgagggtgcccatgggcaggtgcttgaggtggtagaacgtctggtgaccaaccgagagactccgtcctggactggtgtaggctttgtgcgactgcgggaaggtcaggaagtggagttcctggtgacctctttgcctagggccatggactatgacctgctactgcgctgggagccccaggttcctgagcagtgggcagagctggaattggtggtgcagcgcccagggcctgtgtctgcacacagtccgtgtgggcacgtgctgccgagggatgaccgcattcaggggatgcttcacccaaacaccagggttttggtgtttcccagacctgtctgccttgagcctggtctctcctacaagctgaagttgaaattgactggaacagggggacgtgcccatcctgaaaccccatactctggatctggaatactcattgactcgctggtgctgcagccccatgtcttgatgctagagatgtttagtgggggggatgctgctgccctggaacgccgtaccacctttgaacgctaccgctgccatgaggaaggtctgatgcccagcaagacccccctatctgaggcctgcgttcccctcctcatcagtgcgtcctccctggtctacaatggcgccttgccctgccagtgtgaccctcaaggctcactgagttccgaatgcaatcctcatggtggccagtgccggtgcaagcctggagtggttggacgacgctgtgatgcctgtgctactggctactatggctttgggcccgcaggctgtcaagcctgccagtgtagtcccgacggagcactcagtgccctgtgtgaagggactagtggacagtgtctctgccgaaccggtgcctttggtcttcgctgtgaccactgtcaacgtggccagtggggtttccctaactgccggccgtgtgtctgcaacgggcgtgcagatgagtgtgacgcccacacaggcgcttgcctgggctgccgtgattacacagggggcgagcactgtgagaggtgcattgctggttttcatggggacccacggctgccatatgggggccagtgccggccttgtccctgccctgaaggccccgggagccagcgacactttgctacttcatgtcaccgggatggatattcccagcaaattgtgtgccactgtcgagcaggctacacagggcttcggtgtgaggcttgtgcccccgggcactttggggacccatccaagccaggtggcaggtgccaactgtgtgagtgcagtgggaacattgaccccacggatcccggtgcctgtgatccccacacggggcaatgcttgcgctgtttacaccacacggaggggccccactgtggccattgcaagcctggcttccatgggcaagctgcccgacagagctgtcaccgctgtacctgcaaccttctgggcacagatccccagcggtgcccatctacagacctgtgccattgtgacccaagcactgggcagtgcccatgcctcccccatgtccaaggcctcagttgcgaccgttgtgcccccaacttttggaactttaccagtggacgtggctgccagccttgtgcttgtcacccaagccgggccagaggccctacctgcaatgagttcacagggcagtgccactgtcatgctggctttggtgggaggacctgttctgagtgccaagagctccactggggagaccctggactgcagtgccgcgcctgtgactgtgatcccagaggaatagacaaaccccaatgtcatcgttctactggtcactgtagctgccgcccaggcgtgtctggcgtgcgctgcgaccagtgtgctcgtggcttctcgggtgtttttcctgcttgtcacccctgccatgcatgctttggagactgggatcgtgtggtacaggaccttgctgctcgtacgcggcgcctggagcagtgggctcaggaattgcagcaaacgggtgtgctgggtgcctttgagagcagctttttaaacctgcaggggaagctgggaatggtgcaggccatcgtggctgcccgcaacacctcagctgcgtctactgcaaagcttgtagaggccacagagggactgcgtcatgaaattgggaagaccactgaacgcctgactcagttagaagcagagctcacagatgtacaggatgagaacttcaatgccaaccatgcactcagtggtctggagagagacgggctcgcacttaatctcacactgaggcagcttgaccagcatctggatatcctcaaacactcaaatttcttaggtgcctatgacagcatccgacatgcccacagtcagtctacagaagcagagcgccgggccaatgcctccacctttgcaatacccagccctgtgagcaactcagcagatacccggcgtcgggcagaagtgctaatgggtgcccaaagagagaacttcaaccgccagcacttggccaaccagcaggcacttggacggctgtccacacacacccataccctgagcctgacgggagtaaatgagctggtgtgtggggccccaggggacgcaccctgtgctaccagcccttgtgggggtgctggatgtcgggatgaggatgggcaaccccgctgtggtggcctcggttgcagtggagcagcagccacagcagatctagcactgggccgggctcggcacacacaggcagagctgcagagagcgctggtagaaggtggtggcatcctcagccgagtgtctgagactcgtcggcaggcagaggaggcccagcaacgagcacaggcagccctggacaaggctaatgcttctaggggccaagtggagcaggccaatcaggagcttcgagaacttatccagaatgtgaaggacttcctcagccaggagggagctgatcccgacagtattgaaatggtagcaacacgggtgctagacatctccatcccagcctcgcctgagcagatccagcgcctagcaagtgagattgcagaacgtgtccgaagcctggcggatgtggacacaatcctggcacataccatgggggatgtgcgtcgggctgaacagctactgcaagatgcacagcgggcacggagccgggctgagggtgagagacagaaggcagagacagtccaagcggcactggaggaggcccagagggcacagggagctgctcagggcgccatccggggagcagtggttgacacaaaaaacacagagcagaccctgcagcaggtccaggagaggatggcaggtacagagcagtctctgaactctgctagtgagcgggctcggcagttacatgcccttctggaagccctgaaactgaaaagggcaggaaacagcctggcagcatctacagctgaagagacagcaggcagtgcccagagccgtgccagggaggctgagaaacagctacgggaacaagtaggtgaccagtaccaaactgtgagggcgttggctgaacggaaggctgaaggtgttctggccgcacaagccagagcagaacaactgcgggatgaggctcggggtctgttgcaggctgctcaggacaagttgcagcggctacaggaactggagggcacatatgaagagaatgaacgcgaactggaggtcaaagcggctcagctggatgggctggaggccaggatgcgcagtgtgcttcaggcaatcaacctgcaggtccagatctacaacacctgccagtgaccactccctagggtttagccttgtctccaagcacagttccacatgcgtttgtccgcacattaaagagctcttggctagcaagtgctttcaataaaccagtgtgaacc

SEQ ID NO: 1837 - DNA, 872 bp, Rattus norvegicus
  Genbank Accession No. NM_012976
ggaagagagcgttggttctcccaagacagaagagatgtcttccttcagcacccagactccatacccgaacctagctgtacctttcttcaccagcatcccaaatgggctttacccatccaagtccatcgtcatatcaggcgtggtcttgtcagatgctaagaggttccagatcaaccttcgctgtgggggtgacattgctttccacctgaacccccgttttgatgagaatgctgtggtccgaaacactcagatcaacaactcctgggggcccgaagagcgaagcctgcctgggagtatgcccttcagtcgtggccagagattctcagtgtggatcttatgtgaaggtcactgcttcaaggtggccgtggacggtcagcatatttgtgaatacagccaccgcctgatgaacttgccggatatcaacactctagaggtggctggtgatatccagctaacacacgtggagacctaggaaggtctctggcctagggatgaaggctgaggaaccctacctgagtcttgtcacctcttccctgtctcagccctgcctccccaaatcctgtcatcaaagagagcctcattggcaggagttccaggaaggtgacattcccaattcacaccctccacaaagggggagtcctgggctgtgggacacatggctgtgagcccacagtgtcagccattgctcccaagctagtcatcttctgagggaagtgacctccctgggtttgcccctttctctgaccctttcccttcacccctccaggagggccaccttgatgtcatcccactggcctccaactgacccagaatgtccacattaacttttccccaatctttcccaatgcccataaaataaagaatatcaacgc

SEQ ID NO: 1838 - DNA, 1545 bp, Rattus norvegicus
  Genbank Accession No. NM_012977
gtgaactcgtgggagtcccgccctgtgcagagttctgtccagcaagtgaggaagagagcgttggttctcccgaaacagaagagatggctttcttcagcacccagcctccatacatgaacccagtcatcccctttactggaataatccaaggagggttgcagaacggacttcagatcaccctccaggggaccgtccacccttttccaaataggattgcggtgaactttcagactggcttcagtggaaatgacattgccttccacttcaatccccggtttgaggaaggaggatatgtggtttgcaacacaaagcagaatggaaagtgggggcctgaggagaggaagatgcagatgcccttccagaaggggatgccctttgagctttgcttcctggtacagaggtcggaattcaaggtgatggtgaacaagaacttctttgtacagtactcacaccgcgtgccctaccacctcgtggacaccatttcggtctcgggatgcttgcacctgtccttcatcaacttccagactcagggctttcagcctgcccaccaggcacccgtggctcaaactatcatccacacagttcacagcatccctggacagatgctctctactcctggaatccctcctatggcataccccaccccagcctatactatacctttcttcaccagcatcccaaatgggttttacccatccaagtccatcaacatatcaggcgtggtcttgccagatgctaagaggttccatatcaaccttcgctgtgggggtgacattgctttccacctgaacccccgtttcaatgagaaggttgtggtccgaaacactcagatcaacaactcctgggggcccgaggagcgaagcctgcctgggagaatgcccttcaatcgtggccagagtttctcagtgtggatcttatgtgaaggtcactgcttcaaggtggccgtggatggtcagcatatttgtgaatattaccaccgcctgaagaacttgccggatatcaacactctagaggtggccggtgatatccagctgacacacgtgcagacctaggaaggtctctggcttagggatgaaggctgaggaaccctacctgagtcttgtcacctcctccctgtctcagccctgcctccccaaatcctgtcatcaaagagagcctcattggcaggagttccaggaaggtggcattcccaattcacaccctccacaaagggggagtcctgggctatgggacacatggctgtgagcccacagtgtcagccattgctcccaagctagtcatcttctgagggaagtgacctccctgggtttgcccctttctctgacctttcccttcacccctccaggagggccaccttgatgtcatcccattggcctccagctgacccagaatgtccacattaccttttccccaatctttcccaatgcccataaaataaagaatatcaacgcttgtctacaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1839 - DNA, 420 bp, Rattus norvegicus
  Genbank Accession No. NM_012982
atgagccccaccacctgcaccctgaggaaacacaagaccaacaggaagccacgcacaccgttcaccacgtcccagcttctagccttggagcgcaagttccgccagaaacagtacctctccatcgcagagcgggccgagttctccagctctctgaaccttacagaaacccaggtcaaaatctggttccagaaccgaagggctaaggcaaaaagactgcaggaggcggaactggaaaagctgaaaatggctgccaaacctatgctgccctcgggcttcagtctgcccttccctatcaactcccccttgcaagcggcatccatatacagcgcctcctaccccttccatagacctgtgcttcccatcccgcctgtgggactctatgccacgccggtgggatatggcatgtaccatctatcctaa

SEQ ID NO: 1840 - DNA, 3368 bp, Rattus norvegicus
  Genbank Accession No. NM_012988
cgaccgacctgcagttgagccgagttggaaatgtgaacgcaagaagcaggcttgatttttttttcctccccccctctcctagctctctcctcctctctctccctctcgcacccacactcacgcacacctccagcccgcacacagacgtgcacgcaccccccgccgcccggcagttatgtattctccgctctgtctcacccaggatgagtttcatcctttcattgaagcacttctgccccatgtccgcgccttcgcctacacatggttcaacctgcaggcccgaaagcggaaatacttcaaaaagcatgagaagcgcatgtcgaaagaagaggagagggctgtgaaggatgaactgctaagtgagaagcctgaggtcaagcaaaagtgggcttcccgacttctggccaagttacggaaagatatccgacccgagtaccgagaggattttgttcttacagttacagggaaaaaacctccatgctgtgttctttccaacccagaccagaaaggcaagatgcggagaattgactgcctccgccaggcagataaagtatggaggttggacctcgtcatggtgatcttgttcaaaggtattccgctggaaagtactgatggtgaacgccttgtgaagtccccacagtgctcgaatccagggctctgtgtccagccccatcacataggggtttctgtaaaggaactcgatttatatttggcatactttgtacatgcagcagattcaagtcaatctgaaagtcccagccaaccaagtgatgctgacattaaggaccagccagaaaatggacatttgggcttccaggacagcttcgtcacatcaggtgttttcagtgtgactgagctagtaagagtgtcacaaacaccaatagctgcaggaaccggccccaatttttctctctctgatttggaaagttcctcatactacagcatgagtccaggagcaatgaggaggtctctacccagcacatcctctaccagctctaccaagcgcctcaagtctgtggaggacgaaatggacagtcctggtgaagaaccattttacacaggccaagggcgctccccagggagtggcagccagtccagcggatggcatgaagtagagccaggcatgccatctccaaccactctgaagaagtctgagaagtctggtttcagcagcccctccccttcgcagacctcctccctcggaacagcattcacacagcatcaccgacctgtcataacaggaccgagagcaagcccacatgcgacgccatcgactctccactttccaacgtcacctatcatccagcagcctgggccttatttctcacacccagccatccgttaccaccctcaggagacgctgaaggagtttgtccaacttgtctgccccgatgctggtcagcaagctggacaggtggggttcctcaatcccaatggaagcagtcaaggcaaggtgcacaacccattcctccccaccccaatgttgccgccgccaccgccaccaccgatggccaggcctgtgcctctgcccatgccagacaccaagcctccaaccacatcaacagaaggcggtgcagcctcccccacctcaccgacctactcgacacccagcacctcccccgcaaaccgattcgtcagtgttggaccacgggatccaagctttgtaaatatccctcaacagacacagtcctggtacctgggataaaagttgcagcgtcccaccatcctccagacagaccacctgaccccttctcaactctgtaacatggacgcaacctcaacccggcgcagttacaacttcactgtcagtggaaggggagagacaccaactcgaatcaacttgtacatggaaacagcgaacgtcgtggtcaaacagcaaaggcccataacttttcgggattcttttttttttttaatactttagggactgtcgaattctctaaatatggtgctggaaatgcgttgggctgtgtgacatttgaagtgttccagtggtggtgtgagcagtaggtgaagcggctggtaggggatgagccttgctcacgaacttcctgttgtaacacttttgagcctggccttttcacagtatttcaagaatttgcccgcgcaggtgtgtgaccctcccggagcacttggagacacctggagaatgaaatctttcgtagtagctaagatctgtgatctgtaacttacaggacactcaagggcaatgtttttggggttttcttttttttctgtaacatattagaaaaagcaatgcagttaagttatctttcttttagtttggtttggttcagcagtcagcagttaaatacataacacaaccctcaaggacagtgaacccactcatgttgcagagcaatccaaaaagacagcaaagactactactactactctcagttcggttgtttgtttttttttttttttttttgtttttttattaagttttgaaatgctgcacttacatttaaaaaaaacattttcaacaatttcaacaatgacacaaaagttcacatggaaatggggaagatggtctgttttgacagaaactgacaggaatcaaaacaatcgaattttgaattgagtgaagtgcaatttcattggatagctaagtatctttgtaagatagagattgttgaaaattctatttttgtttttcaagtcctcccaccccaggactctaaattattggggttaaaaaaaaacagccttgcaagaaaaaggggagctatttttgctttttatgttttttattgttaaacttgtatccctttaaaaaaaaaaaccgaaggaaaatttaaaaaaaaagcaaaaaaaaaaaatacaaatctaatggtgcttttacctccaatatgttaactacattaaatgctaattaattattttctgttatcaaagcacataactcaaatgaaatcatggtatctgttaattttataagctagaaatcactataatgaattatgccaattctggaaaattttacacatgtatggcaacaccagatctatcggttttcaaacgcctcgtcgtaaccagacattgtccagaagtttcaaagacccttcgcaaaccctgaatcggctacgggaaatatatcagatcgataaggacataactgtgtgagccattcagatcaaagtacttgttaggaaaataaacaaacaaacaaaaacaaaatgttcacacacacacacaccccaaatgtcttgtatcttatgtttaaggaaaaagaaaagacaaaacggcacgagggtctgaccaccatgacaacctacagcaacaaggaccaaagctgagagaggcgtctcattcactcgtgaccttctggtggcaccgagcaggctgctctcttgcacagatggttg

SEQ ID NO: 1841 - DNA, 1232 bp, Rattus norvegicus
  Genbank Accession No. NM_012992
gttttccgtccggcttctctcacactcaagtgcgcgcctccacctcatggaagactcgatggacatggacatgagccctcttaggcctcagaactaccttttcggttgtgaactaaaggctgacaaagattatcactttaaagtggataatgatgaaaatgagcaccagttatcattaagaacggtcagtttaggagcaggggcaaaagatgagttgcacatcgtagaggcagaagcaatgaactatgaaggcagcccaattaaagtaacactggcaactttgaaaatgtctgtacaaccaacagtttcccttgggggcttcgaaattacaccacctgtggtcttgaggttgaagtgtggttctgggcctgtgcacataagtggacagcacctagtagctgtagaggaagatgcagagtcagaagatgaagatgaggaagatgtaaaactcttaggcatgtctggaaagagatctgctcccggaggtggtaacaaagtcccacagaaaaaagtaaaacttgatgaagatgatgatgaggatgatgaagatgatgaggatgatgaagatgatgatgatgatgattttgatgaagaggaaactgaagaaaaggttccagtgaagaaatctgtacgagataccccagccaaaaatgcacaaaaatcaaaccaaaatgggaaagatttaaaaccatcaacaccaaggtcaaagggtcaagagtccttcaaaaaacaggaaaaaactcccaaaacacccaaaggacctagctctgtagaagacattaaggcaaaaatgcaagcaagtatagaaaaaggtggttctcttcccaaagtggaagccaagttcattaattatgtgaagaattgtttccggatgactgaccaggaggctattcaagatctctggcagtggaggaagtctctttaagaaaatggtttaaacagtttgaaataattctgtcttcatttctgtaatagttgctatctggctgtcctttttataatgcaaagtgagaactttccctactgtgtttgataaatgttgtccaggttcaattgccaagaatgtgttgtctaaaatgcctgtttagttttcaaggatggaactccgccctttacttggttttaagtatgtatggaatgttatgataggacatagtagtagtggtggtcagatgtggaaatggtagggagacaaatatacatgtgaaataaactcagtattttaataaagt

SEQ ID NO: 1842 - DNA, 2460 bp, Rattus norvegicus
  Genbank Accession No. NM_012998
ccccggcgccaacctagctgccccgcccgctgccgacgtccgacatgctgagccgtgctttgctgtgcctggccctggcctgggcggctagggtgggcgccgacgctctggaggaggaggacaacgtcctggtgctgaagaagagcaacttcgcagagccggcggcgcacaactacctgctggtggagttctatgccccatggtgtggccactgcaaagcactggccccagagtatgccaaagctgctgcaaaactgaaggcagaaggctctgagatccgactagcaaaggtggacgccacagaagagtctgacctggcccagcagtatggtgtccgtggctaccccacaatcaagttcttcaagaatggagacacagcctccccaaaggaatatacagctggcagggaagctgacgacattgtgaactggctgaagaaacgcacaggcccagcagccacaaccctgtctgacactgcagctgcagagtccttggtggactcaagcgaagtgacggtcatcggcttcttcaaggacgcagggtcagactccgccaagcagttcttgctggcagcagaggctgttgatgacataccttttggaatcacttccaatagcgatgtgttttccaagtaccagctggacaaggatggggtggtcctctttaagaagtttgatgaaggccgcaacaattttgaaggtgagatcaccaaggagaagctattagacttcatcaagcacaaccagctgcctttggtcatcgagttcactgaacagacagctccaaagattttcggaggtgaaatcaagacacatattctgctgttcctgcccaagagtgtgtctgactacgatggcaaattgagcaactttaagaaagcggccgagggctttaagggcaagatcctgttcatcttcatcgatagtgaccacactgacaaccagcgcatacttgagttctttggcctgaagaaggaggaatgtccagctgtgcggcttattaccctggaggaagagatgaccaagtacaaaccggagtcagacgagctgacagctgagaagatcacacaattttgccaccacttcctggagggcaagatcaagccccacctgatgagccaggaactgcctgaagactgggacaagcagccagtgaaagtgctagttgggaaaaactttgaggaggttgcttttgatgagaaaaagaacgtgtttgttgaattctatgctccctggtgtggtcactgcaagcagctagccccgatttgggataaactgggagagacatacaaagaccatgagaatatcgtcatcgctaagatggactcaacagccaatgaggtggaagctgtgaaggtgcacagctttcccacactcaagttcttcccagcaagtgcagacagaacggtcattgattacaacggtgagcggacactagatggttttaagaaattcttggagagcggtggccaggatggagcgggggacaatgacgacctcgacctagaagaagctttagagccagatatggaagaagacgacgatcagaaagccgtgaaggatgaactgtagtgcagaagccagatctgggcgcctgaacccaaaacctcggtgggccatgtcccagcagcccacatctccggagcctgagcctcaccccaggagggagcgccatcagaacccagggaatctttctgaagccacactcatctgacacacgtacacttaaacctgtctcttctttttttgcttttcaattttggaaagggatctctgtccaggccagcccatcttgaagggctacgttttgttttaattggtggtgtacttttttgtacgtggattttgtcccaagtgcttgctaccatatttggggatttcacactggtaatgtctttcctgttagagaggtttatgctatcacttcagatttcgtctgtgagatgtttcatcttcctgacatgtctccatgtcgaggtacttgttccaccacgcagacctccctgagaccccttcctgccctgcgcaggaggcgatggttctgggtcgtatgctctctctctctccaccttgtactagtgttgccatgacagcatggcttttgtagtttgcatttaacctggggatttctgcatcctgtcagagggtgggtccccacgtgtggaaaagagacagtggtggcttgctgccaggctcaggccaggcctggacagctctcactcttcttaagccagaactaccgaccagccggccggctgtgggcacattactctggctgctggatcctcttccagcatggcatgtggcctgtgtgaggcagaaccgggacccttgattcccagactgggagtcagctaaggacactggggctgaatgaaatgcccattctcaaggtctatttctaaaccataatgttggaattgaacacattggctaaataaagttgaaattttactaccat

SEQ ID NO: 1843 - DNA, 4153 bp, Rattus norvegicus
  Genbank Accession No. NM_012999
tcgggcgccgcgcgagcctgccgctgccatgcctccgcgcgcgccgccagcgcccgggccccggccgccgccccgggccgccggccggcacgggctctcgccgctggcgccgcgcccctggcgttggctgcttctgctcgctctgcccgccgtctgctccgcgctgccgccgccgcgccccgtctacaccaaccactgggcagtgcaagtgctgggcggccccggcgcggcggaccgcgtggctgcggctcacggctacctcaacttgggccagattggaaatctggacgattactatcatttttaccacagcaagaccttcaagagatcaaccttgagtagcaggggcccccacaccttcctcagaatggacccacaggtaaaatggctccagcaacaggaagtgaaacgcagggtcaagagacaggcgcgaagcgactctctttatttcaatgatcccatttggtccaacatgtggtatatgcattgtgctgataagaacagtcgctgtcggtcagagatgaacgtccaggcggcatggaagcgcggctacacaggaaagaacgtggttgtcaccatcctcgatgacggcatagaaaggaatcacccagacctggcccccaactacgattcctatgcaagctacgatgtcaacggaaacgattatgacccatcaccgagatatgatgccagcaacgagaacaaacatggtactcgctgtgcgggagaagtcgctgcttcagccaacaactcctactgcatcgtgggcatagcatataatgcaaagataggaggcatccggatgctggacggtgacgtgaccgacgtggttgaggccaagtctctgggcatcagacccaactacattgacatttacagcgctagttgggggccagatgatgatgggaagaccgtggatgggcccggccgtctggctaaacaggctttcgagtatggcattaaaaagggccgccaaggtctgggctccatttttgtctgggcctctgggaatggtgggagagaaggggaccactgctcctgtgatggctacaccaacagcatctacaccatctctgtgagcagcaccactgagaacggccacaaaccctggtacctggaggaatgtgcttccaccttggctaccacctacagcagcggggccttctatgaacggaagatcgtcaccacggacctgcgtcagcgctgcaccgacggccacactgggacatctgtctcagctcccatggtggctggcatcattgccctggctctagaagcaaacaaccagttgacctggagggacgtgcagcacctgttagtaaagacgtcacggccggctcatctgaaggcgagtgactggaaagtcaacggagctgggcataaagttagccatctctatggatttggcttggtggatgctgaagcgctcgtcctagaggcaaggaagtggacggcagtgccatcccagcacatgtgcgtggccaccgcagacaaaaggcccaggagcatccccgtagtgcaggtgctgcggaccacagccctgaccaatgcctgtgcagaccactctgaccagcgtgtggtgtacctggagcatgtggtagtccgaatctctatctcacatccacgacggggtgacctccagatccacctgatttctccctctggaaccaagtctcaacttttggcaaagagattgctggatttttccaatgaggggttcacgaactgggagttcatgactgtccactgctggggagaaaaggctgaaggtgaatggaccctggaagtccaggatataccatcgcaggtccgcaacccagagaaacaaggaaagttgaaagaatggagcctcattttatatggcactgcagagcacccataccgcaccttcagctcccaccagtctcgctcacggatgctggagctttcagtcccggaacaggagcctctcaaggctgagggaccaccaccgcaggcagagactccagaagaagaggaagagtacacaggtgtgtgccatccagagtgtggtgataaaggctgcgatggtcccagtgcagaccagtgcttgaactgcgtccacttcagcctgggaaactccaagacaaacaggaagtgtgtgagcgagtgccccttgggctactttggggacacagcagcaagacgctgccgtcgatgccataagggatgtgagacatgcacgggcaggagcccaacacagtgcctgtcttgtcgccgtgggttctatcaccaccaggaaacgaacacatgtgtgaccctgtgtcctgccggactttatgctgatgaaagtcagagactctgcctcaggtgccacccgagctgtcagaagtgtgtggatgaacctgagaagtcgactgtgtgcaaggagggattcagcctcgcacggggcagctgcattccggactgtgaaccaggtacctacttcgattctgagctcatcagatgtggggaatgccatcacacctgccggacctgcgtggggcccagcagagaagaatgtattcactgtgcaaaaagcttccacttccaagactggaaatgtgtgccggcctgtggtgagggcttctacccggaggagatgcctggcttaccccacaaagtgtgtcgaagatgtgatgaaaactgcctgagctgcgagggctccagcaggaactgcagcagatgtaaagctggcttcacgcagctggggacctcctgcatcaccaaccacacgtgcagtaacgccgatgagaccttctgcgagatggtaaagtccaaccggctctgtgaacggaagctcttcatccagttttgttgccgcacctgcctcctggctgggtagggcgggcgccagctgccacagagggcagggtcctcctgtctgcccttttgcccagctaccttcctacagatggccagccatagcccattccttggggtggccctgagtctgacagctgtgccctcccccccccagagctgggtcccactgcagcatctctgagcacctgaactaggtggaggtggcccttaaggataaggctaaatcggcaaaaatccccctgaactctgcttgctggctgcagtctaaagctggactcgaaataggaacagagtgaattatgagactcatgcctgcagcttgggagtggcttctgggaccctagtttactgaaacttcaagaccaaagcagaaaaagagagatgcctggcatcccatcaagtcctcctcccacacattcgtgtgaccgtgacagatctcaccgagttggctggcaggaccccatgctgtcctcacctataatgaagggcctcgcttcctccccatgcatcactggccaccaaacagcctgagggatggtttgatgagactgtaaataaaataggtttcagggcataagatgtatgaccactggggatagaacctatgtctacacagctccttccgaaactacagccccctgactggaaggtccggcaccagactgaagtaggtctactcatcctctcctcagcattctcctctgagtgagctgagctgtccaagtgactgttcaacctgtgtcccagggcctcctgggcctgagccaccagtcatctacagatacagagcctgtggaggagggtccaaaggagctacttaaggctagccgaaagacctctaatggccaagcagttcctccttatgcaaagccagccccaaatcactaatcgccagccctccatggcacacaactgcttctcaagtgcatttggcctccacactcaggactctgttctcgggtggacactgctctggcccagtatagtacaagcctacgttgatagagctggattgatttttctgccaagcctgtgtgggcattttataagctacgtgttctaatttttaccgatgttaattattttgacaaatatttcatatattttcattgaaatgcgcagatctgcttggtccagttccctttaacgtgggaataacatttgccttaaatttttccaacctcgtctctctccatatggtcctgctctcctctctgaatataatgtgttttgtcttgtcacctgtaagtggcaaggactcagctgttgtctgttgaatccacaacttcaaataagaaatcagtgaagcaaatctaatgttaaccctgag

SEQ ID NO: 1844 - DNA, 893 bp, Rattus norvegicus
  Genbank Accession No. NM_013003
tccccgctgagttcatcaccagggacaggtgacctgagctgcccctggagcccagctcccatttccttctggttctggccgatctcttcgttatgagctggctgctgggttacgtggaccccacagagcccagctttgtggcggctgtgctcaccattgtgttcaatccactcttctggaatgtggtagcaaggtgggagcagagaactcgcaagctgagcagagccttcgggtccccttacctagcctgctattccctgggcagcatcatcctgcttctgaacatcctccgctcccactgcttcacacaggccatgatgagccagcccaagatggagggcctggatagccacaccatctacttcctgggccttgcactcctgggctggggactcgtgtttgtgctctccagcttctatgcactggggttcactgggacctttctaggtgactactttgggatcctcaaggagtccagagtgaccacatttcccttcagcgtgctggacaaccccatgtactggggaagtacagccaactacctaggctgggcacttatgcacgccagccctacaggcctgctgttgacggtgctggtggcactcgtctacgtggttgctctcctgtttgaagagcccttcactgcggagatctaccggcggaaagccaccaggttgcacaaaaggagctgacagggccatgagggacctttggaaagccggattgcctcccggctgacccaagcaacaacccttctcggggagagcagcgctggccattgtacctgtgccttggaaaccagtcatgggggtgctcaggcattatgtcatgtgactgctgagacccccatccccaccaatccctgacacactaataaaggctttgtgacctcc

SEQ ID NO: 1845 - DNA, 1328 bp, Rattus norvegicus
  Genbank Accession No. NM_013010
aagctttccaagctgaggaactggcgggtgctagcaatggagtcggttgctgcagagagcgctccagctccggagaatgaacactctcaagagaccccggaatcgaacagtagtgtgtacaccaccttcatgaagtctcatcgctgctatgacctgatccccacaagctccaagctggtggtatttgatacttcgctgcaggtaaagaaagccttctttgccctggtgactaacggtgttcgtgctgcccctttgtgggatagtaagaagcagagctttgtgggcatgctgaccatcactgacttcatcaatattctgcaccgatactacaagtcagccctggtgcagatctatgaactggaggagcacaagatagagacttggagagaggtctacctgcaagactcctttaagccacttgtctgcatttctccaaatgccagcttgttcgatgctgtctcttcattaattcgaaataagatccacaggcttccagttattgacccggagtcaggcaacaccttgtacattcttactcacaagcggatcctcaagttcctcaagttgtttatcactgagttccccaagccggaattcatgtctaagtctctggaagagctacagattggcacctacgccaatattgccatggtccgtaccactacacctgtctatgtggctctgggcatctttgtacagcaccgagtctccgccttgcctgtggtggatgagaaagggcgtgtggtggacatctactccaagtttgatgtgattaatttggcagcagaaaagacatacaacaacctagatgtgtctgtgacaaaagccctacagcaccggtcacactacttcgagggtgttctcaagtgctacctacatgagactctagaagcaatcatcaatagactggtggaagcagaggttcaccgtctggtggtggtggatgaacatgacgtggtcaagggcattgtatcgctgtctgacatcttacaggctctggtgctcacaggtggagagaagaagccctgagcatggggcggaacaggcagtgcctggggagatggccccctcactgcctgcctgctgtaagagccggaatcagatggaatcctgagagaacggagtcttccctcaggacgtccacgcccactgtctagaactgagagaaggggaaaggaggagaaggactgttagcttctctcaccatcgtgctacacttagagaaaacacttgtcagcctagccagccccagtcgctcgtcacagcccccttgtgggtgaaccatgggttttgtgctcctcaggcagatcctgatctctaagagatcc

SEQ ID NO: 1846 - DNA, 1687 bp, Rattus norvegicus
  Genbank Accession No. NM_013011
cccagagactgccgagccgggtccgtgtgccgccacccactccggacacagaatatccagttatggataaaaatgagctggtgcagaaggccaagctggccgagcaggcagagcgatacgatgacatggcagcctgcatgaagtctgtcactgagcaaggagccgagctgtctaacgaggagaggaaccttctctctgttgcttataaaaacgttgtaggagcccgtaggtcatcttggagggtcgtctcgagtattgagcagaagacggaaggtgctgagaaaaagcagcagatggctcgagaatacagagagaagatcgagatggagctgagggacatctgcaacgacgtactgtctcttttggaaaagttcttgatccccaatgcttcgcagccagaaagcaaagtcttctatttgaaaatgaagggtgactactaccgctacttggctgaggttgctgctggtgatgacaagaaaggaattgtggaccagtcacagcaagcataccaagaagcatttgaaatcagcaaaaaggagatgcagccgacacaccccatcagactgggtctggccctcaacttctctgtgttctactatgagatcctgaactccccagagaaagcctgctctcttgcaaaaacagcttttgatgaagccattgctgaacttgatacattaagtgaagagtcgtacaaagacagcacgctaataatgcagttactgagagacaacttgacattgtggacatcggatacccaaggagacgaagcagaagcgggagaaggaggggaaaattaaccggccttccaacctttgtctgcctcattctaaaatttacacagtagaccatttgtcatccatgctgtcccacagatagtttttttgtttacgatttatgacaggtttatgttacttctatttgaatttctatatttcccatgtggttttatgttttaatattaggggagtagagccagttaactttagggagttactcgttttcatcttgaggtggccaatatgggatgtggaatttttacatgagttacacatgtttggcatagttagtacttttggtccattgtggcttcagaagggccagtgttcaaactgcttccatgtctaagcaaagaaaactgcctacatattggtgtgtgctggcggggaataaacaggataatgggtccagtcatgagtgtagtctgtgtgggtactgtaaggcttggagcacttgtgaggctgggacacgaacaccctgtggatgcacgctaagaccgtgtgtctgcgtgcacacccttgaccacagctccagaagttgtctgtagacaaagttgtgacccaatttactctgataagggcagaaacggttcacattccattatttgtaaagttacctgctgtttgctttcattatttttgctacacattttatttgtatttaaatgttttaggcaatctaagaacaaatgtaaaagtaaagatgcagtacaaacgagttgcttggtgttcccggctccatgcggatcaagcacagcggtaaacaaaatcccatgtatttaactttttttttttaagttttttgttttgttttgtttttgcttttgtgattttttttctctttttgatacttgcctaacatgcatgtgctgtaaaaatagttaacagggaaataacttgagatgacg

SEQ ID NO: 1847 - DNA, 2175 bp, Rattus norvegicus
  Genbank Accession No. NM_013013
attgcagcctgcggagtgaagcgcgccatgtatgctctcgctctcctcgccagccttctggtcaccgctctgaccagccctgtccaggacccgaagatatgctctgggggctcagcagtagtgtgcagagatgtgaagacggcggtggactgtagggctgtgaagcactgccagcagatggtctggagcaagcccacagcaaaatcccttccttgtgacatatgcaaaacggttgtcaccgaagctgggaacttgctgaaagataatgctactgaggaggagatcctccattacctggagaagacctgtgcgtggattcatgactccagcctgtcagcctcttgcaaggaggtggttgactcttacctgcctgtcatcctggacatgattaagggggagatgagcaaccccggggaagtgtgctctgcgctcaacctctgccagtcccttcaggagtacttggccgagcaaaaccagagacagctggagtccaacaagatcccggaggtggacctggcccgcgtggttgcccccttcatgtccaacatccctctcctgctgtaccctcaggatcggcctcgcagccagccgcagcccaaggctaacgaggacgtctgccaggactgtatgaagttggtgactgacatccagactgctgtgaggaccaactccagctttgtccagggcttggtggaccacgtcaaggaggattgtgaccgcctcgggccaggcgtgtctgacatatgcaagaactatgttgaccagtattctgaggtcgccgtccagatgatgatgcacatgcaacccaaggaaatctgtgtgatggttggcttctgtgatgaggtcaagagagtgccaatgaggactctggtccccgccactgaggccatcaagaatatcctccctgccctggagctgacggacccctatgagcaggatgtgatccaggcccaaaatgtgattttctgccaagtttgtcagcttgtgatgcgcaagttgtctgaactgattatcaacaatgccactgaggaacttctaattaaaggtttgagtaaagcctgctccctgctccctgctcctgcttcaaccaagtgccaggaagtgctggtaacatttggcccctccctgttggacgtcctcatgcatgaggtgaacccgaactttctgtgcggtgtgatcagcctctgttctgccaacccgaatttggtggggacccttgaacaacctgcagcagccattgtatctgcactgcccaaagagcctgcaccgccaaaacagcctgaagagcccaagcagtctgcattgcgcgcccatgtgcctcctcagaagaacggggggttctgtgaggtgtgcaagaagctggtcatctatttggaacataacctggagaaaaacagcaccaaggaggagatcctggctgcacttgagaagggctgcagcttcctgccagacccttaccagaagcagtgtgatgaatttgtggctgagtatgagcccttactgctggaaatccttgtggaggtgatggatccttcctttgtgtgctcgaaaattggagtctgcccttctgcctataagctgctgctgggaaccgagaagtgtgtctggggcccaggctactggtgtcagaacagtgagactgctgcccgatgcaatgctgtcgatcattgcaaacgccatgtgtggaactagctttccagcttgcagaagtcgcctacttgtgggtctagggtaatgaacacatagatctatttgacttaataagtaggagcccccttttgtcttcccccatctcctgtcccttactatagcatttctgtcacgtaagaggcgctgacagcacttccgtgtcccatttctgctccaaggatgaggacacttgggcttcagctccccggctgcccttttcacccacctgctggaggggggtggtgagccagagggcaggagcatgtgctcagccctctcggtgtgtagggatcatggccatctcctagcgtcagggaactgcgcaacttcctgtgctaccaaggagtttaatttggatgcttagaagcacagagtgatcaggcctttagagtgtgggatggccattgccacagcacagagacttgagaagcacctgctgcaggtggcttgctgtgacgttgccgtccctggtcagccttcattctg

SEQ ID NO: 1848 - DNA, 471 bp, Rattus norvegicus
  Genbank Accession No. NM_013014
atggctgcaggaagacttcggatcttgtttctgctgctcctgtccttgcacctgggccttggctgggtccttgatcttcaagaggctcctgcggcagatgagctctcatctgggaaaatggcagagactggaaggacctggaagccccatcagggtaacaacaatgtccgccttccaagagccttacctggtttgtgccggctgtggagcctgaccctaccagtggctgagcttggcctgggctatgcctcagaggagaagattatcttccgatactgtgctggcagctgtccccaagaggtccgtacccagcacagtctggtgctggcccgtcttcgagggcagggtcgagctcatggcagaccttgctgccagcccaccagctatgctgatgtgaccttccttgatgaccaccaccattggcagcagctgcctcagctctcagccgcagcttgtggctgtggtggctga

SEQ ID NO: 1849 - DNA, 743 bp, Rattus norvegicus
  Genbank Accession No. NM_013018
tcggcttcttctggggcccggtcgccagcgcagtcgccacggtccgtgtcgccagcttgtctcagtttagagagggcaagatggcctcagccacagactctcgatatgggcagaaggagtcctcagaccagaacttcgactatatgttcaagatcctgatcattggtaacagcagtgtgggcaaaacctcattccttttccgctacgcagacgactcttttactccagcctttgtcagcactgtgggcatagacttcaaggtcaaaaccatctaccgcaatgacaagaggatcaagctgcagatctgggacacagcaggacaagagcggtaccgaaccatcaccacagcctactaccggggcgccatgggcttcattctaatgtatgacatcaccaatgaggagtccttcaatgcagtgcaggactggtccactcagatcaaaacttactcatgggacaatgcccaggtgctgctggtggggaacaagtgcgacatggaggacgagcgagtggtgtcctcagaacgaggccggcagctggccgaccacctgggctttgagttctttgaggccagcgccaaggacaacattaatgtcaagcagacctttgaacgtctggtggacgtgatctgtgagaagatgtcggagtccctagatactgcagaccttgcagtcacgggtgccaagcagggcccacagctcaccgaccagcaggcaccacctcatcaggattgcgcctgctga

SEQ ID NO: 1850 - DNA, 4470 bp, Rattus norvegicus
  Genbank Accession No. NM_013022
gggccgggcggaggttcgcgggcggcgctaggccgggcgaagcggcatgagccggcccccgccgacggggaaaatgcccggcgcccccgaggccgcggccggggacggggcgggcgcgggtcgtcagaggaagctggaggcgctcatccgagaccctcgctcgcccatcaacgtggaaagcctgctggatggcttaaattccttggtccttgatttggattttcctgctttgaggaaaaataaaaatatagataatttcctaaatagatatgagaaaattgtgaaaaaaatcagaggtttacagatgaaagcagaagactatgatgttgtaaaagttattggaagaggtgcttttggtgaagttcagttggttcgtcataaggcatcacagaaggtttatgcaatgaagcttcttagtaaatttgaaatgataaaaagatcagattctgcttttttctgggaagaaagagatattatggcttttgctaacagtccgtgggtggttcagctcttttgtgcctttcaagatgacaggtatctgtacatggtgatggagtacatgccaggtggagaccttgttaacctgatgagcaattatgatgtgcctgagaagtgggccaagttttatactgctgaagtcgtgcttgcactggatgcaatacactccatgggcttaatacacagagatgtgaagcccgataacatgctattggataaacacggacatctaaaattagcagattttggcacatgtatgaaaatggatgaaacaggcatggtgcattgtgatacagcagttggaactccagactacatatcacctgaggttctgaaatcacaaggaggtgatggttactatggacgagaatgtgattggtggtctgtaggtgttttcctttttgagatgttagtaggggacactccattttatgcagattcacttgtaggaacctacagcaaaattatggatcataaaaattcactgtgttttcctgaagatacagaaatttctaaacatgcgaagaatctcatatgtgccttcttaacagacagggaggtacgacttggaagaaatggggtagaagaaatcaaatcagcatccttctttaagaatgatcagtggaattgggataacataagagagacggcagctccagtggtgcctgagctcagcagtgacatagacagcagcaactttgatgacattgaggatgacaaaggcgatgtagagaccttcccgattcctaaagcttttgtgggaaatcagctgccttttataggatttacctactttagagaaaatttgttactaagtgattctccaccttgtagagaaaatgatgcaatacaaacaaggaaaagtgaagaaagtcaggagattcagaaaaaattatatgcactagaagaacaccttagcagtgaggtacaagccaaggaggaactggaacagaagtgcaagtctattaatactcgtctagagaaaacagcaaaggaactagaagaagagattacctttaggaaaaatgtggaatcaacattaagacagctagaaagagaaaaggcccttcttcagcacaaaaatgcagaatatcaacggaaagctgatcatgaagctgacaagaaacggaatttggaaaatgatgttaacagcttaaaagatcaacttgaagatttgaagaaaagaaaccagagctctcagatatccactgagaaggtcaatcagctccagaaacaactggatgaagctaatgctttgctaagaacagagtctgatactgcagcacggttaagaaaaacccaggcagaaagttccaaacagattcagcagctggaatctaacaatagagatctacaagataaaaactgcctgcttgaaactgccaagttaaaacttgagaaggaatttatcaatcttcagtcagctctagaatctgaaagaagggaccggacccatggatcagagataattaatgatttacaaggtagaatatctgggttggaagaagatttgaagactggcaaaaccttactagcaaaagtagagctggagaagagacagctgcaggagaagctcactgacttagagaaggaaaagagcaacatggaaatagatatgacatatcaactgaaagttatacagcagagtttagaacaagaagaagctgaacacaagaccacaaaagcacgactagcggataaaaataagatctatgaatccattgaagaagctaaatcagaagccatgaaagaaatggagaagaagctgttggaagagaggtctttaaagcagaaagtggagaacctactcctggaagccgagaagagatgttctatattggattgtgacctcaaacagtctcagcagaaactgaatgagctgctgaagcagaaagatgtgctgaatgaggatgttagaaatttgacattaaaaatagagcaggaaactcagaagcgttgtcttatgcaaaatgacctgaagatgcagacccagcaagttaacaccctaaaaatgtcagaaaagcaaataaaacaagaaaataatcatcttatggaaatgaaaatgaacttggaaaagcaaaatgctgaacttcgaaaagagcggcaggatgcagatgggcagatgaaggaactgcaagaccaacttgaagcagagcagtatttctcaaccctctataaaacacaagttagagaacttaaagaagaaaatgaagagaaaactaaactttgtaaagagttgcagcagaaaaagcaggatttacaggatgaaagagactccttggctgcccagctggagatcaccctcaccaaagcagactctgagcagctggctcgctccattgctgaggagcaatactctgacttggaaaaagagaagatcatgaaagagctggaaatcaaagagatgatggctagacacaaacaagagcttactgaaaaggacgctacaattgcatcccttgaagaaacaaatagaacactaactagtgatgttgcaaatcttgcaaacgagaaagaagaactaaacaacaagttgaaagatacccaagaacaactgtcaaagttgaaagatgaagagatcagtgcagcggctattaaagcacagtttgagaagcagctgctgactgagcgaacactcaagactcaagctgtgaataagttggcagagatcatgaatcgaaaagaacctgtcaagcgtggtagtgacacagatgtgcgaagaaaagaaaaggaaaacagaaaattacatatggagcttaagtctgaacgtgaaaaattgacacaacagatgatcaaatatcagaaagaactgaatgaaatgcaggctcaaatagctgaagagagccaaattcgaatagaactgcagatgaccctggacagtaaagacagtgacattgaacagcttcggtcgcagctccaggccttgcatattggtatggacagttccagtataggcagtggaccaggggatgctgagcctgatgacggatttccagaatcacgattagaaggatggctgtcgttgcctgtgcggaacaacactaaaaagtttggatgggttaagaagtatgtgattgtaagcagcaagaagattcttttctatgatagtgaacaagataaagagcagtctaacccttacatggtgttagacatagacaagctatttcatgtccgacctgttactcagacagatgtatacagagcagatgctaaagaaattccaaggatatttcagatcctgtatgccaatgaaggagaaagtaaaaaggaaccagaatttccagtggaaccagtgggagaaaaatctaattatatttgccacaaaggacatgagtttattcctactctttatcacttcccaaccaactgtgaggcctgtatgaagccactgtggcacatgtttaaacctcctcctgctctagagtgcagtagatgccacattaaatgtcataaagatcacatggacaaaaaggaagagatcatagccccctgcaaagtttattatgatatatcatcggcaaagaatctgttgttattagcaaattcaacggaagaacagcagaaatgggttagtcggttggtgaaaaagatacctaaaaagcctccagctccagacccttttgcccgatcatcccctagaacctcaatgaaaatacaacaaaaccagtccattcggcggcccagtcgacagcttgctccaaacaaaccaagctaacttgccttctatgaaagcagttattgaaggtgatcatattcttccatccacaagactgaaatatggtttctcaaaacttaactaaaaagctatatttttactgagacacatacatacaccacatgtcgctcgttgcgtgcatgcttgcagtcccttcccccctgaaataattacaaatcatggagaggtttgtctgggctactttgaacagttgaacaaacaatggttggtgaggtaaaaaaagtgtcctacaattc

SEQ ID NO: 1851 - DNA, 664 bp, Rattus norvegicus
  Genbank Accession No. NM_013027
tgctgctagttggtcgggtcctcgctttgtgcggggatgcgacgtgcagcaatggcgctagccgttcgagtcgtgtattgtggagcttgaggctataagcccaagtatctccagctcaaggagaagctagaacatgagttccccggatgcctggacatctgtggcgaggggactccccaggtcaccgggttctttgaagtgacggtagccgggaagttggttcactccaagaagagaggtgatggctacgtggatacagagagcaagttccggaaactggtgactgccatcaaagccgccttggctcagtgccagtgagccctagaggcagggtcctgaaggctcctggccggcctttcttggcagccgcttcatgacaggaaggactgaaatgtctcaaagacctgtggtctttcttcgatgttctgcggccaccaagtcaggccagagatggattctgtgtgtgggtgccttcccagaatctacctgtgcacgcaccccgccctgccctcccgccctcttcctcacctctctctgaattcccccatgtttcctaccttccctcctgctttggtttcccgtctccccctcaagactgcaagaagacgggcagccgtgtcgccaggtgttcctggttgaataaaggttggccaaggcaacctga

SEQ ID NO: 1852 - DNA, 2440 bp, Rattus norvegicus
  Genbank Accession No. NM_013030
agcagtcgagctggagctgagccatagtcaaggactcattgtgggtgcccatcatgatgtcctacagcgagagattggggggaccggctgtctccccacttccagtccgtgggagacacatggtgcatggggcagcctttgcttatgtccccagcccacaagtcctgcacaggattcctgggacaaccacctatgccatctccagtctgagcccggtagccctcacagagcacagctgtccctatggggaggtcctggaatgtcatgacccgctccctgccaagctggcccaggaagaggagcaaaagccagagcccaggctgtcccagaagcttgcccaggttggcacaaagctcctgaaggtgccgttgatgctaggcttcctttacctctttgtctgctccctggacgtgctcagctctgccttccaactggccggagggaaagtggctggggacatcttcaaggacaatgccatcctgtccaacccagtggcagggctggtggtgggaatcctggtgacagttctggtgcagagctccagcacctcgacatccatcattgtcagcatggtctcctctggcttgttggaggtgagctccgccattccgataatcatgggctccaacatcgggacctctgtcaccaacaccattgtggccctgatgcaggcgggggacaggactgacttcaggcgggcttttgcaggggcaacagtgcatgactgctttaactggctgtctgttctggtcctgctgcccctggaggctgccacgggctacctgcaccacgtcaccgggcttgtggttgcctccttcaacatccgtggtggccgtgatgcccctgaccttctcaaggttatcacagagcccttcacaaagcttatcatccagctggacaagtctgtgattaccagcattgccgtgggggatgagtccctgaggaatcacagtctcattcggatttggtgtcaaccagagacaaaagaggcttccacttctatgtccagggtagaggccattggcagccttgcaaacaccaccatggagaaatgcaaccatatcttcgtggatactgggctgcccgacctggccgtggggctcattctgctggcgggctccctggtggtcctgtgcacttgtcttatcctcctcgtcaagatgctcaactctctgctgaagggccaagtggccaatgtcatccagaaggtcatcaacacagacttcccagcccccttcacttgggtcacaggctactttgccatggtggtgggcgccagcatgacgtttgttgtccagagcagttccgtgttcacctcagccatcactccgctcattggcctgggtgtgatcagtattgagcgggcctaccctctcaccctgggctccaacattggtaccaccactacagccatcctggcagcactggccagccccagggagaagctctccagctcctttcagattgccctctgccacttcttcttcaacatctcgggcatcctcctgtggtacccgctgccctgcacacgtctgcccatccgcatggccaaggcactgggcaaacgcactgccaagtaccgctggtttgccgtcctctacctcctcgtgtgcttcctgctcctgccctcactggtgtttggcatttctatggcaggctggcaggctatggtcggtgtgggcacaccctttggggccctgctcgccttcgtggtgcttgttaacgtcctgcagagtcgaagtcccgggcacctccccaagtggctgcagacatgggacttcctaccccgctggatgcactctctgcagcccctggatggccttatcacaagagccaccttgtgctatgccaggcccgagccccgttcaccccaacttccccccagagtcttcctggaggagcttcctcctgccacgccctctccccgcctggcactgcccgctcaccacaatgccacccggctctaggctgcaggtccagactattgcctggaggcgagggacgggatttttacagagcccacagtagaaaggcacagcatgtttgtgagtgtgtgtgcatgcatgtagatgcatgtcacttgaggtacatgattttgtgccacccttgggtacctgtccctactcagggccacagcggggtgggctttttttgcaattaagaagcagtgtgcacaaattacatgctaggtcctgagcctttgtggccatcaggacaggagtatgcgagtgcatggtgtgggtacaggggatgcagatgcatgaggagcccccaaaattttctgggaagagtcggctatgccctctcaccttctcactacccttgtcccaacaggagaggcagaagagcagctggccttctgtatacatgagcctttcctctgccaattctgctaactgtgcatagaaaaagttttaaaagttgcatctgtcctgatcat

SEQ ID NO: 1853 - DNA, 6628 bp, Rattus norvegicus
  Genbank Accession No. NM_013040
agcagctggcctcccaccaccctaaaaataatccactcgccgctgtctgctgacccgggaggaaaacttgtcatcccatggagtgtgtgagctcctcggcttgctccagagagatccccaaccgctttgaggagtcagtgactgagttctgtggacttgtttgaaatttacatcttcagactgtgcgcaggcggttggaaggtagatcaagtgcaccagtagggggactaagttcctgagccaaagtcaaggctaatcaactaagaagaaatgagcctttccttctgtggtaacaacatctcctcctacaacatctaccatggtgttctccaaaacccctgctttgtggacgcactcaacctggtccctcacgtcttcctgctgtttatcacctttccgatcctgttcattggatgggggagccaaagctcaaaagtgcaaattcatcacaacacatggcttcattttcctggacacaacctgagatggattctgacgtttgcactcctgtttgtgcatgtctgcgagatagcagaaggcattgtttcagactcgcaacgggcgtccaggcatctccaccttttcatgccggctgtgatgggatttgtcgccaccaccacatccattgtgtattaccacaacattgaaacatcaaacttccctaaattacttttagctttattcctgtactgggtcatggccttcattacaaagacaataaagttggtcaaatactggcagttggggtggggaatgtcagacctgcgcttctgcatcacgggagtgatggtcatcttgaatggactgctgatggctgtggagatcaatgtcatccgggtccgaagatatgttttcttcatgaatcctcagaaagtgaagcctccagaggacctccaggacctgggcgtgaggttcctccagccgtttgtgaatttgctgtccaaagctacttactggtggatgaacacgcttatcatatcagctcacaggaaacctattgatctgaaggcgatcggaaagttgccgatagcaatgagggcggtgacgaattatgtttgcttgaaggaggcctacgaagagcagaagaaaaaggctgcggatcatccgaatcggactccctccatatggctggccatgtacagggcttttgggagaccgatcctgctgagcagcacgttccgctacttggctgacttgctgggctttgccggccctctttgtatttccggaatcgtccagcgtgtgaatgaaccgaagaataacacgacgagattttcagagacactctcatcaaaggagtttctggaaaatgcccatgtgctggctgtcctgctcttcctggccctcatcctgcaaagaacatttttgcaggcttcgtactatgtgaccatagagaccggcatcaacctgcgtggggctctgctggctatgatctacaacaaaatccttcgactgtctacttctaacctatccatgggcgagatgaccctgggacagatcaacaacttggttgccatagaaaccaatcagctcatgtggttcttgttcctgtgtcccaatctgtgggccatgcccgttcagatcataatgggggtgatcctgctctataatctgcttgggtcaagcgcactggtaggcgcggcggtcatcgtgctcctcgcaccgattcagtacttcatcgccacgaagctggcggaggctcagaagagcactctggattattccaccgagaggctgaagaagacaaacgagatactgaaaggcatcaagctccttaagctgtatgcctgggagcacattttctgcaagagcgtggaagagactagaatgaaggagctctccagcctcaaaaccttcgcgctctacacgtcgctttccatcttcatgaacgcagccattcccatcgcagccgttcttgcaacatttgtgacccatgcctatgccagtggcaacaacctgaaacccgcagaggcctttgcctctctgtctctcttccacatcctcgtcacaccgctcttcctgctgtccacggtggtcagattcgcagtgaaagccatcatcagcgttcagaagctgaatgagtttctcttgagcgatgagattggcgaggacagctggaggactggggaggggacgctgccttttgagtcctgtaagaagcacaccggagtgcaatcaaaaccgataaacaggaagcagcctggaaggtaccacctggacaactacgagcaggcgcggcgtcttcggcctgctgagactgaagatgttgccataaaggtgacgaacggatacttctcatggggcagtggtttagccacattatccaatattgacattcgaattccaacaggtcagctaaccatgattgtgggtcaggtgggttgtggcaaatcgtctctcctccttgccatccttggtgagatgcagaccctggaaggaaaagtttactggaacaatgtaaatgaatctgagccttcttttgaagcaacccgaagcagaagcaggtactctgtggcttatgctgcccagaagccttggctcctcaatgctacggtcgaggaaaacatcacttttggaagttctttcaacagacagaggtacaaggctgtcaccgatgcctgctctctgcagccagacattgatttgttaccctttggagaccaaactgaaattggagagaggggtatcaacctgagtgggggtcagaggcagagaatctgcgtggcccgggcactctaccagaacaccaatattgtcttcttggacgatccattctccgctctggacatccacctgagcgaccacttgatgcaggaagggatcctgaagtttctccaggacgacaagaggacggtcgtccttgtgactcacaaactacagtacctgacgcacgcggactggatcatagccatgaaggatgggagtgtgttaagggaagggactttgaaagacatccagaccaaagacgtggagctctatgaacactggaaaaccctcatgaatcggcaagatcaggaattagaaaaggacatggaagccgaccaaacaacgctggagaggaagactctccgaagagctatgtactcaagggaggccaaagcacagatggaggatgaagatgaagaggaggaggaggaggaagatgaggacgacaacatgtcaactgtaatgaggctcaggacgaagatgccctggaagacctgttggtggtacctcacttcaggagggtttttcctgctcttcctcatgatcttctctaagcttttgaagcactctgtgatcgtggccatcgactactggctagctacgtggacctccgagtacagtataaacgacccagggaaagctgaccagaccttctatgtggctgggttcagcatcctctgtggagcgggcattttcctttgcctcgtcacctccctcactgtagaatggatgggtctcaccgccgccaagaacctccaccacaatctcctcaataagataattctgggcccaataaggttctttgataccacgcccctgggactgatcctcaatcggttttctgctgataccaacatcatcgaccaacatatccctccgaccttggagtcgctgacccgctctaccctgctctgcctgtcggctattgggatgatctcctatgctacacccgtgtttctcatcgctcttgcgcccctgggcgtcgccttttatttcatccagaaatacttccgggttgcctctaaggatctccaggaactcgatgacagcacccagctccccctgctttgtcacttctcagaaacagctgaagggcttaccactatccgggccttcaggcatgaaaccagattcaagcaacgcatgctggagctgacagacacaaacaacattgcctacttatttctctccgcagccaacagatggctggaggtcaggacggactacctgggagcttgcattgttctgacggcctccattgcatccatcagtggctcttccaactctggactagtgggcttgggccttctgtatgccctcacgataaccaattacctgaattgggttgtaaggaacttggccgacctcgaagtccagatgggcgcagtgaagaaagtgaacagtttcttaactatggagtctgagaactatgaaggcaccatggatccttctcaagtcccagagcattggccacaggaaggtgagatcaagattcacgatctatgcgtcagatatgaaaataacctgaagcccgttctgaaacatgtcaaggcttacatcaagcctgggcagaaggtgggcatctgtggtcgcaccggtagtgggaagtcctctctatctctggctttcttcagaatggtcgacatatttgatggaaagatagtcattgatggaatagacatttccaagctgcccttgcacacgctccgctctagactgtccatcattctccaggacccaatcctgttcagcggctctatcagatttaacttggatcctgaatgcaagtgcacagacgacaggctctgggaggctctggaaattgctcagttgaagaatatggtcaaatctctgccaggaggcctagacgccactgtcaccgaaggtggtgagaacttcagcgttggacagagacagctgttctgcctggccagggcctttgttcgaaagagcagcatactcattatggatgaggccacggcctccatcgacatggccacggaaaacattttgcagaaagtagtcatgacagcctttgcggatcgcacggttgtaaccatagctcatcgggttcacaccattctgactgctgacctggtcattgtgatgaagagaggaaacattttggaatacgacaccccggaaagcctcttggcccaggaggatggagtgttcgcctcgttcgttcgtgcggacatgtgacaggattacatcacaacagcacctgtgtctcgatgcctaccgtcgcccaccagagggttcccccaactttgcctcggaagggtggcgccggaaacttcgacagacttctgtatggaaagtagagatttctgtttcctgttttggtctgagggacactccctgtaggttcatcgtgggtgttgtactgtgatcaggccacactggaaaggtagcctatgctaaaacatgccagcgaccttaaggggtaaatctgtcgatgtctgtcaagcactggagctgaaatgaggcgtctgcgctaccacactctcattaggaagactagcactgccctgctgttgatgaagaaaattcattttctaacaaaatactcacgttcatgatccataggagagtcttttctgtgcatttaacattgttgatatttccttttaacttttccccttttaactcatttcctgtcaccacgaagctatcatatttagtacctctataaagccgacccctcacaagagaaagatcatgaaaagagattgaatatttgaaaatattatttgtttccatttgcctccatccaataaggaggaagttcaagttagcttcagtccttcagcaatgggccacctaaactaagctttctagagtttaattctttatcagccaaacaatggctctgaaccctgaaatgctatattatctagggcccaaaagaatatagatgaatggccttatctgtcacacacacacacacacacacacacacacacacacacacacacacacacatatacatacacatcttcatgccatatcttggctgtatgctaatcttggcatgtgcacattcctcgaaggtaccagatatcccctaccctacatctctgtgggaagatagaaatagttctcactctgaatttacacaggtagcaagtgtttattttcacttgggcaaatttcagtggcagacattgatgtcacacatgtggccattggtcctgttctaatttatagagtgtaccagaagtctatatgatattagtgtcacatttcatttaavtgcccattaataaagccaaactgactgaagttcacttccctgttatccagcttccacagtttctgtaacctttaaccatcagatataagcagctgctcaattccatatgagggtctccacagaaaatagatgtccatcgcccaccgttcctgtagtcatatggcgttgtttattctgtgtcaagacttatagttcttgtgcatcgagatatttcaaggtgcctttatggatatagaacgtaatgtaagaaaaacgttcatagagatatacagaaacggcccaggttacttagcctaaatagtcaccttttcttccatatcaaaaacttcattagaaaaaaataatagtattatttgcagaaagctagtaggtcacagctattagcaatgagttcaaccgcaaaagtacttcataagagaatcgactaatctactaaaatattgctggtgctgcagaaggttctgctggggctgatacccatgacgtttgttgtcagtcagtgtctccttctctcctagaaatggcattcatctacagaagtagctccctgctgctgtagcccactacgccatcctgtgcaaaagtgactttcgtttcctcgaaacttttacttacttgatttgcaaaaaacaaacaaaaaacaaacaaacaaacaaaaaaaaaaaa

SEQ ID NO: 1854 - DNA, 1666 bp, Rattus norvegicus
  Genbank Accession No. NM_013043
cggcagccgagtcggattgagctgctgcagacgccaggccactccagccagcactgccgttttcacgccccggctgcagacagctaggaggctttatctagtttgaaccaggctgctggagctcgctccttccctctctttttttccacgaggctgtttttttatttggctgcaattgcatgaaatcccaatggtgtagaccagtggcgatggatctaggagtttaccaactgagacatttttcaatttctttcttgtcgtctttgctgggaactgaaaacgcttccgtgagacttgacaatagctctggtgcaagtgtggtagctatcgacaacaaaatagagcaagctatggatctggtgaaaagccatttgatgtatgcagttagagaggaagtggaggttctgaaggagcagatcaaagaactaatagagaaaaactcccaactggagcaggagaacaatctgttgaagacactggccagtccggagcagctcgcccagtttcaggcccagctgcagactggctcccctccggctaccacgcagccacaggggaccacacagccccctgcacagccagcgtcccagggctcaggatcaaccgcatagcctgctatgccccaacagaactggctgctgctgtctgaactgaacagaccgaagagatgtgctagtgagaagccgcctccagtcacccatttcattgctgtctgcgaaagagacgtgagactcacacatgctgttctcgctttctccccagtattaagcactcatatgcttttggcttgaagaaatatactagttgagtgaattaaaggttaaacagagagtgagcatggatgtaccctgtgcaacgtggcagatgtctgaggaatggtttgattgacgctgaggaggagctctgtgccttttcaaccctccccagccgcccactctactcccaagctctggggctcgcctgcatggggctcagaaggtgggctgctcctggattttgtgttctcctctccttcccttcaaagaatttgagaggccagaaacgagactgcaaagggggggatgcagtccttttacaaaaccgacaactgtcaccaaagcttataaaacaggacagtactgtccctcttttctgaaacatcagaagacacaaaactgttagtgacacaacggtgacaggtagctgggacctaggctatcttattatgaaggttgttttgcttgttgtatatttgtgtatgtagtgtaacgaatttgtacaatagaggaccgtaactactgttaggttgtacagattgaagtttagatgttccattggctgtctgaaaaggtgtggattgtccttcctagagagatctacttaaaaactgcttcgtgacaaaaaccacacctgaagaaattttaagaatttggcacagttagtcactttgtgtcacccggaatctagctgctgagtcttgcaaagtaaaccccctgttgactgatgtcagttgagctagtgaatgaatagatggagaaacgtcagtcagttgctgaggaagtggatttcccagtaggggtttctgcagctcacctgtatagtcctgcgcatgttccccacacagaacccactgtatttacctgttctacttgtcacctttcaataaagcatatcaaatgttgatacc

SEQ ID NO: 1855 - DNA, 768 bp, Rattus norvegicus
  Genbank Accession No. NM_013046
atgccgggaccttggttgctgctggctctggctttgatcttcaccctaactggtatccctgaatcctgcgccttgccggaggcagcccaggaggaaggtgcagtgactcctgaccttcctggcctggagaatgttcaggtccggccagaacgtcgattcttgtggaaagacctccagcgggtgagaggggacctcggtgctgccttagactcctggatcacaaaacgccagcatccaggcaaaagggaggaggaggaaaaagacattgaagctgaagagaggggagacttgggagaagggggagcctggagactccacaaacgacagcaccccggccgacgtgccaaccaggacaagtattcatgggcagatgaggaggacagtgactggatgccacggtcctggttaccagatttctttctggattcctggttctcagatgtcccccaagtcaagcggcagcaccctggcaggcgatccttcccctggatggagtctgatgtcaccaagaggcaacatccaggccggaggttcatagatcccgagctccaaagaagctgggaagaaaaagagggagagggtgtcttaatgcctgagaaacgccagcatcctggcaaaagggcattgggtcatccctgtgggccccaggggacttgtggtcaaacaggcctgctccagcttctaggtgacctgagcaggggtcaggagaccctggtgaagcaaagcccacaagtggaaccctgggacaaggaacctctggaggagtaa

SEQ ID NO: 1856 - DNA, 1683 bp, Rattus norvegicus
  Genbank Accession No. NM_013057
ctcgtgtagcgtagcctccgcgcctctgctgaagccccgcgacctcgccagcagcccttggacatggctatccccatgcgcccgcgcctcctagcggccctcgcgcccacctttctcggcttccttctccttcaggtggccgttggtgcaggcactcctccagggaaagcgtttaatttaacttggatatcaactgatttcaagacaatcttggagtggcaaccgaaacccaccaactatacctacactgttcagataagcgatagatctagaaactggaaatacaaatgcactggaaccacagacactgagtgtgacctcaccgacgagattgtgaaggatgtgaactggacctatgaagcaagggtcctatctgtcccatggaggaactcaactcatggaaaggaaacactctttggaactcatggggaggaaccgccatttacaaatgcccggaagtttttaccttaccgagatacaaaaattggacagccagtaattcagaagtatgaacaaggcggtacgaaactgaaggtgactgtaaaagactcatttacattagtcagaaagaatggtacattcctcactctgcggcaagtttttggcaatgacttgggttatattcttacgtatcggaaagactcaagcacaggaaggaaaacaaacactacacataccaatgaattcttgattgatgtggaaaagggggtaagctactgcttcttcgcacaagccgtgattttctccaggaaaactaaccacaagagcccagaaagcatcaccaagtgcactgagcaatggaagagtgtcctgggagaaacactcatcattgtgggagcagtggtgttcctggtcactgtctttatcatcctgctgaccatatctctgtgcaagcgcagaaagaacagagcaggacagaaaaggaagaacaccccgtcgcgcttggcatagacgaggaggctgacgctgctgactgtcacactgcccacacggcactgttaccgagacctctgctgggaactgtggagtttgctcctagctcagaaagactcccttcatggcctgtcattccagctaatgctttgattccaacactagcatctgtcactttaggacatactgaacggtacaaattgatcaacactacagcaccttttgcacaaagcttaagattgtgtattctacacgcgggaagacactaggttgcccaggcaaagccagtggtcagatgcctttcctataacctgggtgggcttttggagaacctttgaggagtgatgccataggctctagaacaggaaagtgggatttgggtggacttttccaacagttgtacttttcgcaaatcggtatttgggttttgtttttccttctactaggtacttttggaagttcaaagtaactgccaaactgtcatatgttaaatgcaggatatttctgcttgggacatccttgtgatttgtactttattacaacttagcactttaactgacaatgatggggattgaacattggacaaccaactctatttttataagactaccatacagaagaactacatatagttttatgatctaaggtacttaaagtgtttgtggttaacattgtgtatatttatatgagttttaaaggttttgtatatgggattttctatttatatatctcctatttgtatatattgag

SEQ ID NO: 1857 - DNA, 568 bp, Rattus norvegicus
  Genbank Accession No. NM_013058
ctccaacctccaacatgaaggcgctgagcccggtgcgcggctgctacgaggcggtgtgctgcctgtcggaacgtagcctagccattgcgcgaggccggggtaagagcccgtcggcggaggagccgcttagcctcttggacgacatgaaccactgctactcgcgcctgcgggaactggtgccgggagtcccgcggggcactcagcttagccaggtggaaatcctgcagcgtgtcatagactacatcctcgaccttcaagtggttctggcagagcccgcgcctggacccccggatggtccgcatctcccgatccagacagctgagctcactccggaacttgtgatctccaaggacaagaggagtttttgccactgacccggtcgtcctggcacctcccgaacgcaggtgctggcgcccgttccgcttgggaccctgggactctgggaccctctctccagccggaagcctgaggggcatggatgagcttcgatcttgccacagccctcttcatttaccctgaactcatgcctcgaggctggacctggagcccgagagcgaaggactgaact

SEQ ID NO: 1858 - DNA, 2415 bp, Rattus norvegicus
  Genbank Accession No. NM_013059
cacggcgctccttagggccaccgctcggcgcgccgggacagaccctccccactcctgcctgcaggatcggaacgtcaattaacggctgacactgccccccacctcttcccacccatctgggctccagcgaggaacggatctcggggtacaccatgatcttgccatttttagtactggccatcggaccctgccttaccaactcatttgtgccagagaaagagaaagaccccagttactggcgacagcaagcccaagagaccttgaaaaatgccctgaaactccaaaaactcaacaccaacgtggccaagaacatcatcatgttcctgggagatggtatgggcgtctccacagtgacagctgcccgcatccttaagggccagctacaccacaacacgggcgaggagacacggctggagatggacaagttcccctttgtggctctctccaagacgtacaacaccaacgctcaggtccccgacagcgcgggcactgccactgcctacttgtgtggcgtgaaggccaacgagggcaccgtgggagtgagcgcggccactgagcgcacgcgatgcaacaccactcaggggaacgaggtcacgtccatcctgcgctgggccaaggatgctgggaagtccgtgggcatcgtgaccaccactcgggtgaaccacgccactcccagtgcagcctatgcgcactcggccgatcgggactggtactcggacaatgagatgcgcccagaggctctgagccagggctgcaaggacatcgcctatcagctaatgcacaacatcaaggacatcgatgtgatcatgggtggtggccggaagtacatgtaccccaagaacagaactgatgtggaatatgaactggatgagaaggccaggggcaccagactggatggcctggacctcatcagcatttggaagagcttcaaacctagacacaagcactcccactatgtctggaaccgcactgaactgctggcccttgacccctccagggtggactacctcttaggtctctttgagcccggggacatgcagtatgagttgaatcggaacaacctgactgacccttccctctcggagatggtggaggtggccctccggatcctgacaaagaatcccaaaggcttcttcttgctagtggaaggaggcaggattgaccacgggcaccatgaaggcaaggccaagcaggcgctgcatgaggccgtggagatggatgaggccatcggaaaggcgggcaccatgacttcccagaaagacacgttgactgtggttactgctgatcactcccacgttttcacgtttggtggctacacccccaggggcaactccatttttggtctggctcccatggtgagcgacacggacaagaagcccttcacagccatcctgtatggcaacgggcctggttacaaggtggtggacggtgaacgggagaacgtctccatggtggattatgctcacaacaactaccaggcccagtccgctgtccccctgcggcacgagacccacggtggggaagatgtggcggtctttgccaagggccctatggctcacctgcttcacggcgtccatgagcagaactacatcccccacgtcatggcgtatgcctcctgcattggagccaaccttgaccactgtgcctgggccagctctgcgagcagcccctccccaggggccctgctgcttccactggctctgttccccctacgcaccctgttctgagggcccaggtcccacaagagcccacaatggacagccggctcccctccctttgtggcctgccacctggccgcccacactcaacggggaggcccaggcaacctcgagcaggaacagaagtttgctacctgcctcacttccgcccggaaccctccgtgggtcggattcctggctctgccgttgtttctctattcactgccttttggccagcagggtgggtttctctcttgggccggcaggacacagactgcgcagattcccaaagcaccttatttttctaccaaatatactctccagaccctgcaaccatcatggaacattccagatctgaccttctctcccctaccccttctctctggaacactgggtcccatagtcacagccagtccctcaacccaaccctccttggagggaagaccaggtctgctcagggtgagactcccaggaagccacctccggggttggctgtctacccagggtggccaggctgggaagaacaacccagccggacaggacgcacacactccccacccagctccagagactcgccaacccttcactgaagcgactcccctgtttggaatagcaaaaaaaaaaagaaagaaaaaaaagaaaaaaattttaatttctctttttggtgttggttaaaagggaacacaagacatttaaataaaatgttccaaataaaaaa

SEQ ID NO: 1859 - DNA, 2706 bp, Rattus norvegicus
  Genbank Accession No. NM_013065
cgcccttgttcccgctgcggggaggagagtctggtgcctacaagatggcggacggggagctgaacgtggacagcctcatcacccgcctgctggaggtacgaggatgtcgtccgggaaaaattgtgcagatgactgaagcagaagtccgaggactgtgtatcaagtctcgtgaaatctttcttagccagcctattcttttggaattggaagcgccactgaagatttgtggagatattcatggacagtatacagacttactgagattatttgaatatggaggttttccaccagaagccaactatcttttcttaggagattatgtggacagaggaaagcagtctttggaaaccatctgtttgctattggcttacaaaatcaaatacccagagaacttctttcttctacgaggaaaccatgagtgtgctagcatcaaccgcatttatggattctatgatgagtgcaaacgaagatttaatattaaattgtggaagacattcactgattgttttaattgtctgcctatagctgctattgttgatgagaaaatcttctgctgtcatggaggactgtcaccagacctacagtctatggaacagattcggagaattatgagacccactgacgtacctgatacaggtttgctttgtgatttactgtggtccgacccagataaggatgtacaaggctggggagaaaatgatcgtggtgtttcttttacttttggagctgatgtagtcagtaaatttctgaatcgtcatgatttggacttgatttgtcgagcccatcaggtggtagaagatggatatgaattttttgctaaacgacaattggtaactttattttctgccccaaattactgcggcgagtttgacaatgctggtggtatgatgagtgtggatgaaactttgatgtgttcattccagatattgaaaccatctgaaaagaaagctaagtaccagtatggtgggctgaattctggacgtcctgtcactccgcctcgaacagctaatccaccgaagaaaaggtgaagacaggaattccggaaagagaaaccatcagatttgttaaggacatacttcataatatataagtgtgcactgtaaaaccatccagccattcgacaccctttatgatgtcacacctttaacttaaggagacgggtaaaggatcttaaatttttttctaatagaaagatgtgctacactgtattgtaataagtatactctgttataatattcaacaaagttaaatccaaattcaaaagtatccattaaagttctatcttctcatatcacagtttttaaagttgaaagcatcccagttaaactagctgcgttagttacccagatgagagcatgaagatccatctgtgtaatgtggctttagtgttgcttggttgtttctttattttgggcttgttttgttttgtttgtttttgctagaataatggcatctacttttcctatttttccctaaccattttaaaaagtgaaaatgggaagagctttaaagacattcaccaactattcttttccttcacttatctacttaaggaactgttggatcttactaagaaaacttacgcctcataataaaaaggaactttagaggccgataggttttaaaaatatacaaactatttgatccaatgattttaatcaaacagtttgactgggcaaactttgcagctgataatgactatttcgctttttacaaattgccactgatttggatttgtgcactctaacctttaatttattgatgctctattgtgcagtagcatttcatttaagataaggctcatatagtactatccaaaattagttggtaatgtgattatgtggtaccttggctttaggttttaattcgcacgaaacaccttttggcatgcttaactttctggtattatcctcacctgcattggttttgttttttggggtttttgttgttgtttgtttgtttgtttttagatccacagaacatgagaatcctttttgacaagccttggaaagctggctcttctttccctctctatgtgaaggatgtatttaaatgaacactggtcagtgggacattgtcagctctgagtattgggtgcttcactgtctaataattgccatgtgaatgttgtttttgactgtaaggctatgtcactaaagatttttactctgcgttttcataatcaaaggtcatgatgtgtatagacatgctttgtagtgaagtatagtagcaataatttctgcacatgatcaagagtttattgcagcatttctttccctgttctctcttttttaagggttagcattaacaaatgtcaaggaatagcaaagtcaacaaagactttaggaggtggaattaagaacacacagatttgtgatctttggatgtgacacttattggatgttattctaaagtcttattgaacattgtcaaatttgtaagcttcatggggatggacataatgtttatataatgcccttcttatgtgttaccatagatgtgaaaccttatattgtctttgaaaatgttaaattgagaactctgttaacattttatggattggcacattatattactgcaagaaacatttgattttcagcacagtgcaaaagttctttaaaatgcatatgtctttttttctaattcaattttgtttaaagcacattttaaatgtagttttctcatttagtaaaaagttgtctaatt

SEQ ID NO: 1860 - DNA, 1150 bp, Rattus norvegicus
  Genbank Accession No. NM_013069
gcagcagcagcagcaccagcagcacttgggggaaaagctagaggctagagtcatggatgaccagcgcgacctcatctctaaccatgagcagctgcccatcctgggccagcgtgctagagccccagaaagcaattgcaaccgtggagtcctgtacaccagtgtctctgtcctggtggctctgctcttggctgggcaggccaccactgcttacttcctgtaccagcagcagggccgcctggacaagctgaccgtcacctcccagaacctgcaactggagaaccttcgcatgaagcttccgaaatctgccaaacctgtgagcccgatgcgcatggctactcccttgctgatgcgcccactgtccatggataacatgctccaagcgcccgtgaagaatgttaccaagtatggcaacatgacccaggaccacgtgatgcacctgcttacgaagtctggacccgtgaactacccacagctgaaggggagcttcccggagaatctgaagcaccttaagaactctatgaatggtctggactggaaggtctttgagagctggatgaaacagtggctgttgtttgaaatgagcaagaactccctggaggagaagcagcccacccagactccacctaaagagccactggacatggaagacccatcttctggcctgggagtgaccaagcaggatatgggccaaatgttcttgtgaagacagaagccagctctgcacggcggcacgtcccctgctcctcagcccttcttacactccctaacatcacacccattccgtcttcctgcacctgggcttgagactggtatctgcttcaccgtccctgacacaacaaatgaaaccggaacagaatgagaacactggagggagggccttgctgcctacccccatctaaaggacccccatttctgacccattagcagtctttaatgtggggctctgagatctaggcccactgacagggataggggatgccctacccttaatctaggctggatacatttgctgtcttctcaaggaagaggccaagccctcccagcaacccttcctcatgtcctgccgacgcccctgggatccctgctcagccaagcttgtcagcagcctgtaggaccatggttcacgtgacaataaaaggtagaaggtaaa

SEQ ID NO: 1861 - DNA, 1658 bp, Rattus norvegicus
  Genbank Accession No. NM_013073
aattcgggggaccgtcgccgcgctgaaggtggctctatacctgctcgggtgtgcttcgcgatggcctggaaatccggcggcgccagccactcggagctaatccacaacctccgcaagaatggaatcatcaagacagataaagtatttgaggtgatgctggctacagaccgctcccactatgcaaaatctaacccttacatggattctccacagtcaataggtttccaggcaacaatcagcgctcctcacatgcatgcatatgcactagagctcctgtttgaccagctgcacgaaggcgctaaagcccctgacgtagggtctggaagtggaatcctcaccgcgtgttttgcacggatggttggacacagtgggaaagtcattggaattgatcacattaaagaactagtggacgactcaataactaatgtcaaaaaggatgaccccatgctcctgtcctctgggcgagtacggctggttgtgggcgatggaagaatggggtttgctgaagaagccccttacgatgccattcacgtcggagctgcagccccagttgtgccccaggcattaatagaccagttaaagcctggtggaagattgatattgccagtcggtcctgcaggaggaaaccaaatgttggagcagtatgacaagctacaagatggcagtgtcaaaatgaagcctctgatgggggtgatatacgtgcctttaacagataaagaaaagcagtggtccaggtggaagtgattttctcttctgctctttcttcctccacacattcaagggacgagctgtgagagcaacctgtagcttggccgtctgtaacactgcagtggattgctcatctcggtcctcaaagcattgagagccaacagcatcaccgcttgttttggactttgttacactctcttattttcagcatgaaaatgtgtggtttttgtagggtttcctaattcaaaacggtgcagagccagactgatagaggagggctggagagtgttaactttgtgttgtttaacatgccacatttactttacaaatattaaaagaaagggttctctaaccggaaagcttcgtttgtgacttagtttggaagagtggctttgcttttcttggacacttacttctgttccaatattaatttatgagatttcttttgtgtgtcagataacaccacattcacaagtttagcttttttttctttttttatgtgattttggctagcgagcattattagtgggaggagtcaagttgttagaatgattagtggggtggataatggatcgaggagaatataactagaaatttaggtaattttcgtcattttgtcataggagtgataagcttaataggctcactagaggaaagctgtaggaggtgacattggttcagatttttttgttggctgagagtcatgttagtgggaggagtatgatagatgggaaaataatttttaacattgtagaaggttgaggttttgtacgtagtctgttccgtaagtatttgaaatttttactagtaaggctaaacctacggtctttcgcaggctgcaaaaacatgaatggtaattgggatggttatggagattatggagttggagtttaatgtggatgttgaagttatgacaaatagtgatagtattattccttctccgaaattcc

SEQ ID NO: 1862 - DNA, 1519 bp, Rattus norvegicus
  Genbank Accession No. NM_013078
tgcaactgaaagcattcttagcttgccagtggcccccactgcctgcctgcctgcggaactctctagaccatagattcctcctccactctagcaagagaagatgctgtctaatttgaggatcctgctcaacaaggcagctcttagaaaggctcacacttccatggttcgaaattttcggtatgggaagccagtccagagtcaagtacagctgaaaggccgtgacctcctcaccctgaagaacttcacaggagaggagattcagtacatgctatggctctctgcagatctgaaattcaggatcaaacagaaaggagaatacttgcctttattgcaagggaaatccttagggatgatttttgagaaaagaagtactcgaacaagactgtccacagaaacaggcttcgctcttctgggaggacatccttcttttcttaccacacaagacattcacttgggcgtgaatgaaagtctcacagacacagctcgtgtgttatctagcatgacagatgcagtgttagctcgagtgtataaacaatcagatctggacatcctggctaaggaagcaaccatcccaattgtcaacggactgtcagacctgtatcatcctatccagatcctggctgattaccttacactccaggaacactatggctctctcaaaggtctcaccctcagctggataggagatgggaacaatatcctgcactccatcatgatgagtgctgcaaaattcgggatgcaccttcaagcagctactccaaagggttatgagccagatcctaatatagtcaagctagcagagcagtatgccaaggagaatggtaccaggttgtcaatgacaaatgatccactggaagcagcacgtggaggcaatgtattaattacagatacttggataagcatgggacaagaggatgagaagaaaaagcgtcttcaagctttccaaggttaccaggttacaatgaagactgctaaagtggctgcgtctgactggacgtttttacactgcttgcctagaaagccagaagaagtagatgatgaagtgttttattctccgcggtcattagtgttcccagaggcagaaaatagaaagtggacaatcatggctgtcatggtatccctgctgacagactactcacctgtgctccagaagccaaagttctgatgcctgcaagaggacgaaaaacccaaaagacaaaaaaatctgttctttagcagcagaataagtcagtttatgtagaaaagagaagaattgaaattgtaaacacatccctagtgcgtgatataattatgtaattgctttgctattgtgagaattgcttaaagcttttagtttaagtgctgggcattttattatcctgcttgacttgacttaagcactctcttcaattcacaacttctgaatgatatttgggtttcatattaattatcatacacatttccttccactaagcattaaacactatgcttacaatgcataccatctaagtcattaaatgtaatccatgcttattacctt

SEQ ID NO: 1863 - DNA, 2153 bp, Rattus norvegicus
  Genbank Accession No. NM_013082
cgtcccctccgttctgcatccccaaacttcagccgcagctctgtttcaacccatcggctgcttgcttcaaatcagacagcaccgcgacccagacacccgagtccgcggagtgaaagcacaacgccgagtaggaccagaccaggaaaatagactcgtgaagcagcaactctggattgggagggcagaagccaacaagtgagaaggcgcggcgtttccggggcgctgtgcgaaagctagagcaggcgccagagaagacagctcgagctcagaacccgagaccaagcctctctcccggaggcagctcagctcctatcttctctaggcccgctgcagcgtgcgctgggcttcgttttatgcgggtacgagccacgtccccggggaatatgcagcgtgcgtggatcctgctcaccttgggcttgatggcctgtgtgtcggcagagacgagagcagagctgacatctgataaggacatgtaccttgacagcagctccattgaggaagcttcaggattatatcctattgatgatgatgactattcttctgcctctggctcaggagcttatgaagacaaagggagtccagatctgacaacatcccaactgattccaaggatctccctcactagtgctgctcccgaagtggaaaccatgacgttgaagacacaaagcatcacacccactcagaccgagtcacccgaagaaactgacaagaaggagtttgaaatctctgaggcagaagaaaagcaggaccctgctgtaaaaagcacagacgtgtacaccgagaaacattcagacaatctgttcaagcggacggaagttctagcagctgtcattgctggcggtgtgattggctttctctttgccattttcctcatcctgttgttggtgtaccgcatgcggaagaaagacgaaggaagctacgaccttggagaacgcaaaccgtccagcgcagcttaccagaaggcacccactaaggagttttatgcataaaactcccacttagtgtctctatttaagagatcactgaacttttcaaaataaagctttagcatagaataatgaatatctttgttatctgttttgttcattacagagccatgctggccctttaatgatgaagatcccattgtatttaaaatttttcatatatttctttagaatgacttaaaagtaaaaatttaacatctgcagtgttctgtgaatagcagtggcaaaatattttgttacaaaaacccttgacattcatggaattgatttgaacatctatgtgcaaatacaaaatgattgtgtttgtcctctggttcaaagatgactgctgttcccctcatcagcagatctccagttgaccttaccgagttgatctttgttaatttatctcttgttcctcttctctgccctcccttcttgtctcctcccttaaaaacaaaaccttatgccttttgtagctgtcatggtgcaatttgtctttgaatgattacaataatggtaatttagtgtatatgtgatttttttcaattatgtaaactttaacctcctctttatgtaatttttttaaatgtcagactacccattttacacttgctttaatttccattccctgtagcttcaggcagatttgcaaaggcaaattataaaattggattattactacgaaactgttagtcctagttatctaagcagtcttctcttggaggatttgacatcactgacaagcctcagcaaacccaaagatgctaacagtatttgagaagttgctacagactcctttggccactgtacttgctagtttacaatttgaaggtacaaggaagagtttaaaggaaaaaaaagatcagtttttgttcttaaaaatgcatttaagttgtaaacatctttttaagcctttgaagtgcctatgattctatgtaacttgttgcagactggtgttaatgagtatatataacagtttttaaaaagttggtattttataagcacagacaattctaatggtaacttttgtagtcttatgaatagacataaattgtaatttgggaacaagcaaactactgaataaatcacatggcctaatattgaaaatgtcactgttataaatttgtacatttcttatcaaatgtacagcttccctttgctatgactgactgtctgttctcagtg

SEQ ID NO: 1864 - DNA, 1322 bp, Rattus norvegicus
  Genbank Accession No. NM_013084
cctccacccgaaaccaggatggcggtgtctgccttccagctgtggcgtgcgggcgggctgctaagaagaaacttcctgactcactcgtcttcttggaaaatccctcctcgtgtcctcaaatcctcacaaccagaagctctactcagtgtaacaaataatgccctatgtttcgcacctctgcagacatttactgatgaggatattatgatgcagaaggcagtcaaaaaatttgcacaggaacaaattgctcctttggtttcaactatggatgaaaattcaaaaatggagaaatcagtgatacaaggattattccaacaagggatgatgggcattgaagttgaagcaaaatatggaggaacagaagcctccttcttgtgctctgtcctggtgatagaggaactagctaaggtggatgcgtccgtggctctcctatgtgacatccagaacacagtcattaacaaactgtttaggaagcacgggacagaagaacagaaggccacctatttgccaaagctggttacggaaaaattagggagtttttgcctctctgaagctggagctggtagcgactcttttgctttgaaaacaagagctgataaaagtggaaattactacgtcatcaatggatcgaagatgtggatcagcaatgctgaacatgcagagctcttcctggtttttgcaaatgtggaccccccctctgggtacagaggcatcacctgcttcttagtagaccgagatacagaaggttttcaaatagggagacgagaaaacaaaatggggatcagagcttcttccacctgtcagttaacatttgaaaatgtcaaggttccagaaaccagtgttttggggaaaattgggcacggttataaatatgccataggaagtcttaacgaaggtagaattggaattgctgcccagatgctaggactggcccaaggatgttttgactacactattccatacataaaagaaaggatgcagttcggcaaacgaatatttgattttcaggggctccaacaccaagtggctcacgtggccacccagctggaagctgcgcggttgctgacgtacaacgctgctaggcttgtagaagccgggaggccatttataaaagaagcatctatggccaagtattatgcatcagaggtcgctgggctgacaacaagcaagtgcatcgagtggatgggaggggtcggctacaccaaagattaccctgtggagaaattcttccgcgatgcgaagatcggtacaatatatgaaggaacttccaacatccagctgaacaccattgcaaagcacatcgatgcagagtactgacgtct

SEQ ID NO: 1865 - DNA, 1454 bp, Rattus norvegicus
  Genbank Accession No. NM_013085
gggctgtcatcaatccagtccttgcgtgtctgccggcgccccttccgctgcagtcaccgaactgctgtctagagagagcccagcgtcagtaccatgagagtctggcttgcgagcctgttcctctgcgccttggtggcgcactctgaaggtggcagtgaacttggagcttctgatgaatcaaactgtggctgtcagaacggaggagtatgtgtgtcctacaagtacttctccagcattcgaagatgcagctgcccaaagaaattcaaaggggagcactgtgagatagatacatcaaaaacctgctatcatggaaatggtcaatcttaccgaggaaaggccaatactgacaccaaaggccggccctgcctggcctggaattcacccgctgtccttcagcaaacctacaatgctcacagatccgatgctcttagcctaggcctggggaaacacaattactgcaggaaccccgacaaccagaggcgaccctggtgctatgtgcaaattggcctaaagcagtttgtccaagaatgcatggtgcaggactgctctctcagcaaaaagccttcttctactgtagaccaacaagggttccagtgtggccagaaggctctaaggccccgcttcaagatcgttgggggagaattcactgtcgttgagaaccagccctggtttgcagccatctacctgaagaataagggaggaagccctccctcctttaaatgtggtgggagcctcatcagtccttgctgggtggccagcgccacacactgcttcgtgaatcagccaaagaaggaagagtacgttgtctacctgggtcagtcgaagcggaactcctataaccccggagagatgaagtttgaggtggagcagctcatcttgcacgaagacttcagcgacgaaactctggccttccataatgacatagccttgctgaagatacgtaccagcacgggccaatgcgcacagccatccaggaccatacagaccatctgcctgcccccgaggtttggtgatgctccgtttggttcagactgtgagatcactggcttcggacaagagagtgccactgactatttctatccgaagaacctgaaaatgtcagttgtaaagattatttctcacgaacagtgcaagcagcctcactactatggctctgaaattaattataaaatgctgtgtgctgctgacccagagtggaaaacagattcctgctcgggagattcaggaggacctcttatctgtaacatcgatggccgcccaactctgagcgggattgtgagctggggcagtggatgtgcagagaaaaacaagcctggtgtctacacgagggtctcatacttcctgaactggattcagtcccacattggagaagagaatggcctagccttctgatggtccccaggcagctgggggaagaaacggatgggtcgccactcccacgctgaccgacctct

SEQ ID NO: 1866 - DNA, 607 bp, Rattus norvegicus
  Genbank Accession No. NM_013086
ggatccgtatgaccatggaaacagttgaatcacagcaggatcgaagtgtaacacattctgtggcagagcatagctccttgcatatgcagactggccaaatttctgtccctactctagctcaggatgaggagactgaccttgccccaagtcacatggctgctgccacaggtgacatgccaacttaccagatccgagctcctactactgctttgccacaaggtgtggtgatggctgcctcaccagggagtctgtacagtccccagcaactagcagaagaagcaactcgaaagcgggagctgaggctgatgaaaaacagggaagctgcccgggagtgtcgcaggaagaagaaagaatatgtcaaatgtcttgaaaatcgtgtggctgtgcttgaaaatcaaaacaagaccctcattgaggaactcaaggccctcaaagacctttattgccataaagcagagtaactgtgtttgacttggacctggttgactgtgaactctaatcggggcaggcgatgcagcatcctcgtaatggccatatggacttgtagatgggtctcttaacccttgcttaagaatacagtctgctgtagagtgtgaattgggaattc

SEQ ID NO: 1867 - DNA, 1303 bp, Rattus norvegicus
  Genbank Accession No. NM_013087
gtggcggtctgagcgagcgcgcccttgcttcaaagcggtagcgactctagcgcctccggctaggctccaacccttctctaccctacgtctcaatagccacaccgcagtctccggcctcaagcgacccaggctatcttccagtcccgggactccgggtactgcggtccccagaaccgcccgtccagggaccaacccaagttccgcaggccgcggcggccgccaatgggggtggagggctgcaccaaatgcatcaaatacctgctcttcgtcttcaatttcgtcttctggctggctggaggtgtgatcctaggtgtagctctgtggttgcgccatgatccacagaccaccaccttgctctacctggaactgggagacaaaccagcacctagcaccttctatgtgggcatctacattctcattgctgtgggagctgtgatgatgtttgtaggcttcctggggtgctatggggccatccaggagtcccagtgcctgctggggacgttcttcacttgccttgtgatcctgtttgcctgtgaggtagctgcgggcatctggggctttgtaaacaaagaccagatcgccaaggatgtgaagcagttctacgaccaggcccttcagcaggctgtgatggatgatgatgccaacaatgccaaggcagtggtgaagaccttccatgagacgctcaactgttgtggctccaatacgctgaccacactgaccaccgccgtgctgaggaacagcctgtgtccctcaagcagcaactcattcactcagcttctgaaggaagactgccatcagaaaatcgatgagctcttttctgggaagctgtacctcattggaattgcagccattgtggtagctgtcattatgatcttcgagatgattctgagcatggtgctgtgctgtggcatccggaacagctccgtgtactgaggcccttcgcttcgcaccagagggtccctggaatgaccagagggcaccttggggggcatggcctgtgtatatactatttctgtattactctgctacacttagcctttttacttttgagtcttttttgttctgaacttttcctgtcaccttttggagccgacaccacacataggtggcgtatgtggggacgtagaggtggagctggccctagctggcagggccctgtacttctgggacccctggagagttctgcctgctgagccaaacctcctccatagctacttgtccagaggccacatagccaagctagaaggccatgtccacccactctgcccactgtgggtcacatcgctcccatctttttaatccg

SEQ ID NO: 1868 - DNA, 2130 bp, Rattus norvegicus
  Genbank Accession No. NM_013091
ttttctccgagttttctgaactctggctcatgatcgggcttactggatacgagaatcctggaggaccgtaccctgatttccatctacctctgactttgagcctttctaacccggggctcacgctgccaacacccgggccacctggtccgatcgtcttacttcattcaccagcgttgccaattgctgccctgtccccagccccaatgggggagtgagagaggccactgccggccggacatgggtctccccatcgtgcctggcctgctgctgtcactggtgctcctggctctgctgatggggatacacccatcaggggtcaccggactggttccttctcttggtgaccgggagaagagggataatttgtgtccccagggaaagtatgcccatccaaagaataattccatctgctgcaccaagtgccacaaaggaacctacttggtgagtgactgtccaagcccagggcaggaaacagtctgcgaggtgtgtgataaaggcacctttacagcttcgcagaaccacgtcagacagtgtctcagttgcaagacatgtcggaaagaaatgttccaggtggagatttctccttgcaaagctgacatggacaccgtgtgtggctgcaagaagaaccaattccagcgctacctgagtgagacgcatttccagtgtgtggactgcagcccctgcttcaatggcaccgtgacaatcccctgtaaggagaaacagaacaccgtgtgtaactgccacgcaggattctttctaagcggaaatgagtgcaccccttgcagccactgcaagaaaaatcaggaatgtatgaagctgtgcctacctccagttgcaaatgtcacaaacccccaggactcaggtactgccgtgctgttgcctctggttatcttcctaggtctttgccttttattctttatctgcatcagtctactgtgccgatatccccagtggaggcccagggtctactccatcatttgtagggattcagctcctgtcaaagaggtggagggtgaaggaattgttactaagcccctaactccagcctctatcccagccttcagccccaaccccggcttcaaccccactctgggcttcagcaccaccccacgcttcagtcatcctgtctccagtacccccatcagccccgtcttcggtcctagtaactggcacaacttcgtgccacctgtaagagaggtggtcccaacccagggtgctgaccctctcctctacggatccctcaaccctgtgccaatccccgcccctgttcggaaatgggaagacgtcgtcgcggcccagccacaacggcttgacactgcagaccctgcgatgctgtatgctgtggtggatggcgtgcctccgacacgctggaaggagttcatgcggctcctggggctgagcgagcacgagatcgagcggctggagctgcagaacgggcgttgcctccgcgaggctcattacagcatgctggaagcctggcggcgccgcacaccgcgacacgaggccacgctggacgtagtgggccgcgtgctttgcgacatgaacctgcgtggctgcctggagaacatccgcgagactctagaaagccctgcccactcgtccacgacccacctcccgcgataaggccacacccccacctcaggaacgggactcgaaggaccatcctgctagatgccctgcttccctgtgaacctcctctttggtcctctagggggcaggctcgatctggcaggctcgatctggcagccacttccttggtgctaccgacttggtgtacatagcttttcccagctgccgaggacagcctgtgccagccacttgtgcatggcagggaagtgtgccatctgctcccagacagctgagggtgccaaaagccaggagaggtgattgtggagaaaaagcacaatctatctgatacccacttgggatgcaaggacccaaacaaagcttctcagggcctcctcagttgatttctgggcccttttcacagtagataaaacagtctttgtattgattatatcacactaatggatgaacggttgaactccctaaggtaggggcaagcacagaacagtggggtctccagctggagcccccgactcttgtaaatacactaaaaatctaaaagtg

SEQ ID NO: 1869 - DNA, 556 bp, Rattus norvegicus
  Genbank Accession No. NM_013096
acattctccttctgatagactcaggaagcaatcatggtgctctctgcagatgacaaaaccaacatcaagaactgctgggggaagattggtggccatggtggtgaatatggcgaggaggccctacagaggatgttcgctgccttccccaccaccaagacctacttctctcacattgatgtaagccccggctctgcccaggtcaaggctcacggcaagaaggttgctgatgccttggccaaagctgcagaccacgtcgaagacctgcctggtgccctgtccactctgagcgacctgcatgcccacaaactgcgtgtggatcctgtcaacttcaagttcctgagccactgcctgctggtgaccttggcttgccaccaccctggagatttcacacccgccatgcacgcctctctggacaaattccttgcctctgtgagcactgtgctgacctccaagtaccgttaagccgcctcctgccgggcttgccttctgaccaggcccttcttccctcccttgcacctatacctcttggtctttgaataaagcctgagtaggaagc

SEQ ID NO: 1870 - DNA, 3072 bp, Rattus norvegicus
  Genbank Accession No. NM_013106
cagaagacgcgtctcagccggtgtgtcgcggttccccgcggtgtgtgagtgagccagggcccggtcccctctccggccgccgtcatgggctgcacgttgagcgccgaggacaaggcggcggtggagcggagtaagatgatcgaccgcaacttgcgggaggacggagagaaagcggccaaagaagtgaagctgctgctgctcggcgctggagaatctggtaaaagtactattgtgaaacagatgaaaatcattcatgaggatggctattccgaggacgagtgtaagcagtataaagttgtcgtctacagcaataccattcagtccatcattgcaatcataagagccatgggacggttgaagattgattttggggaagctgccagagcggatgatgcccgacagttatttgttttagctggcagtgctgaggaaggagtcatgacttcagaactagcaggcgtgattaaacgtttatggcgagatggcggggtgcaggcatgcttcagcaggtccagggaatatcagctcaatgattctgcttcatattacctaaatgatttggatagaatatcccagaccaactacattccaactcagcaagatgttcttcggacgagagtgaagactacaggcattgtggagacccacttcaccttcaaggagctctacttcaaaatgtttgatgtaggtggccaaagatccgaacggaaaaagtggatccactgttttgagggagtgacagcaattatcttttgtgtggctctcagtgattacgaccttgttctggctgaggacgaggaaatgaaccgaatgcatgaaagcatgaaattgtttgacagcatttgtaacaacaaatggtttacagacacttcaatcattctcttccttaataagaaagacctttttgaggaaaaaataaagaggagtccattaacaatctgttatccagaatacacaggttccaatacgtacgaagaggcagctgcttacatccagtgccagtttgaagatctgaaccgaagaaaggacaccaaggaggtctacactcactttacctgtgccactgacaccaaaaacgtgcagtttgtttttgatgctgttacagatgtcatcattaaaaacaacttaaaggaatgtgggctttactgagaggatggcatagtaaaagctactacagggaggaatgttgagaccagacatcatctactgtctcttgggtcagcgacaagcatgacaggaccaaggaatggcaacagcatgcagaatctttagcacaatcttctgtattaggaaatgtttaattggcatgagaagagatgatcgagtcagacatgaaattggacaactgtaaagtatgaccggatcatcagggcaccgcttggactttaaatctcaatgtttagggcatattgaagtcgaggtgctgcattccagaacttaaacttgtagcttactgttccccgtctttttaacaaatgaccagtagttaatttctaaggtttttctcatcaagagaacaatacctaaaaactcttacttgtttgcaaaagaatcttctggggactcagtcttaactatgcacacaatgtagccggacatcttgaaatattcctcttagtaggaactgtttgtttttaactcttggaatggtcaggagtaatattccacagctaaaaatcttcctggttattgggactatactaatagagctttttggaatgaagtttatgttactgtcctgtttaaagtatcacaatggcttctaaacagcattcacttcggagagctgtacagtaagattctagctctcgtttcttaagcttacggttggagttaaccttgtttgtgctgattaccaaattactagatgaatactgatgtaatatgataaactgctcttgggtacagacacacgcaggatagctgtcagtcagagacgcagactgctaaggtgagaagcagtgacttgctgctacagatctaccgaggtggccacactgatttgcctgctcgtctcaggcgtgtgggttgtatgcggtggccccttgttttccatctttgtggccttttttgctaggagacgtctaagagtataacaactgtgcatgcctttcctttgtaaatgtgctgccaaatccctgcttgctgtcattgtcactgtatcgatggtaactgcatagcggcccttgctgtgttctttttctaagacttgcattctgggactctgttccaccttgtcacgtgtacagactttaatctgttacagctggcagcagtattaacgcggtgagtaaagagcccaggattgctcctgtttgtaaccgatcctttctggaagccctgccttctgtttctttttgcccctgctgagtgttctttagcctttgagagtgggtttaggtagaaaagtgtttttgaaagtctagttccttgatgtaatagtgatatcaaatctagggctgggggctttatgtccagtctgtgcaagtcatacaagtgtccgatgtgtacagtttgcttgcgctgagagcttcagtcctcttgtacagactgtatcaaatgtcattaaacactgagtggaccactgagggacggcgaaacagaggatgcattttgagcatttcagatcagtagtttgatcagtgccttttgaggtccagtctttgtggattggatccgttcatcttttgatgttacctcctactcatttgaaagaaggttggtggtcagaactgctttgggaagcaagccacggtgatcagtgccttcattggcagcttttaccatttttaattcttacgtgtctttgcgaaatcattattatgcagacagtataactgttatcttacaaatatttccatagggctaagaaagtatcacttgaaagaaaagtattgatttcaatcagcgattgactcaattcccacagtgtaggggttaataagtcttactctcaatttattgttcctttgttgtattctgtaatataagaacatctgggaatgcgaactagtggaatatgttttcataatttttctatactttgggtttaataaaatggtgttgataatc

SEQ ID NO: 1871 - DNA, 2528 bp, Rattus norvegicus
  Genbank Accession No. NM_013113
gagcccgcgctccactcctttcgtccttcccggtgactttccctccttgtccctggtccatctcgccagaggtcatagcaggcagagtggtgcagctacagcttgaagcagcagctgcggggttcgctgagccccccgggaggcgatcggagcgcggggagagcaggagtgcggccacgcgcccacctctaggtgcggggctcggagccgcccagcccgcgcgcgccctcctccctcctccctcctccctccgcccccgccgcacctccccctcctcccgctctgcttaggctgctccgcggcgcgcctcgcactcggagagccgcagcggcagcggcgcgtctcgcctttggagacagagccgggccgcggggacaccgagcagtcgccgcgaggacgccagggcgcgcgcagcactcgctttccctcggcctcggccgccactgctgagcagacaccatggcccgcggaaaagccaaggaggaaggcagctggaagaaattcatctggaactcggagaagaaggagtttttgggcaggaccggtggtagttggtttaagatccttctgttctacgtgatattctatggctgcctggccggcatcttcatcgggaccatccaagtgatgctgcttaccatcagtgagctgaaacccacgtaccaggaccgtgtggccccgccaggattgacacagattcctcagatccaaaagactgaaatttccttccgtcctaatgaccccaagagctacgaggcctatgtgctaaacatcatcaggttcctggaaaagtacaaagattcggcccagaaggacgacatgattttcgaggattgtggcagtatgcccagtgaacccaaggagcggggagagttcaatcatgaacgaggagagcgcaaggtgtgcaggttcaagcttgactggctggggaactgctctggtctcaatgatgaatcctacggctacaaagaggggaagccctgtatcattatcaagctcaaccgaatgctgggcttcaaacctaagcctcccaagaatgaatccttggagacttaccctctgacgatgaagtataatccaaacgtcctacctgtccagtgcactggcaagcgcgatgaggataaggataaagttggaaacatagagtactttgggatgggcggattctatggctttcctctgcagtactatccctactacggcaaactcctgcagcccaagtacctgcagcccctgctggccgtgcagttcaccaacctcaccttggacactgaaatccgcattgagtgtaaggcgtatggtgagaacattgggtacagtgagaaagaccgttttcagggacgctttgatgtaaaaattgaagttaagagctgatcacaagcacaaatctttcccactagccatttaataagttaaagaaaaagatacacaaacctactagtcttgaacaaactgtcatacgtatgggacctacacttaatctctatgctttacactagcttctgcatttaataggttagaatgtaaatttaaagtgtagcaatagcaacaaaatatttattctactgtaaatgacaaaagaaaaaaataaaaattgagccttgggacgtgcccatttttactgtaattagactccgtaactgacttgtagtgagcagtgttctggcccctaagtatcgccgccgtctgttttatttagtgtacagtactataggtgcgcactctggtcattttccaagccatgttttatcatatctgttttctactttccgtgagcgaggtttgctgtccaaggtgtaaatactcatgggaataaaactggcatggtactttcccttcctttctcattttcttggctctgagatttcaaaggtaacggcccatcaacaagcatttttaacacactccatagtctttccctgtggtatcaggtctttactattgtttttctttgtttcctggggctggggggtgggctgtcgtgggggaactgccctttaaattctaagtgacgctgcagaaaaacaacggtgatgggttgtgttgtgctccgtgctgagtgctgtctcgccatctctccccttgtcctccagtgtgctccgaagctgtgtctgatctggatctgcccgtcactttggctagtgatggggctagttaatttgcttagtacatttccttttccttctttcctttctctggaggcatcatgtgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaaatctttattttgaactttataaaaagcaatgcagtaccccatagactggtgttaaatgttgtctacagtgctaatccatgttctagcatatgtagtgattgccaggagtacagtgctcttgttggtcttgtgtcagtcaggttaacacaatggacaataaaagaatgaacacattc

SEQ ID NO: 1872 - DNA, 3185 bp, Rattus norvegicus
  Genbank Accession No. NM_013114
gacgggtcaagagaggacatggccggctgcccaaaaggttcttggaagccaagactccggagtgtagtcctgggagcagctcagcttatctggctcagtgctttgatctctgagcttgtaaatcgaaagaaagtggcgacgtggacctataactacagcacgaaagcatactcatggaataactcacgggcattctgcaagaggcacttcacagacttagtggccatccagaacaagaatgaaatcgctcacctcaatgacgtcatcccatacgtcaactcttactactggattggtatccgaaagatcaacaataagtggacctgggtgggaaccaataagactctcacggcggaggctgagaactgggcagacaacgagcccaataacaagaggaacaaccaggactgtgtggagatctacatcaagagtaattcggcccctggcaagtggaatgatgagccctgctttaaacgaaagcgggccctgtgctacacagcctcctgccaggacatgtcttgcaacagccaaggggagcgcatcgagaccattgggagctacacctgctcctgctacccgggcttctatgggccagagtgtgaatacgtccaagagtgtggaaaattcgacatcccgcaacacgttctcatgaactgcagccaccctctgggggacttctccttcagctcacagtgcaccttcagctgtcctgagggctatgacctgaacggacccagtgagatgcaatgtttggcctctggaatctggacaaataatcccccgcagtgtaaagctgtgcagtgccagagcctggaagcccctctccatggaaccatggactgtacacacccattggctgcctttgcctatgactccagctgtaaatttgagtgccagcctggatatcggatgaggggctctgacatactccactgcactgactctggtcagtggagtgaaccattgccaacctgtgaagccattgcatgcgaaccgctggagagccccctccatgggagcatggactgcttcccatccacaggagcattcgggtacaacagcagctgcacttttcgctgcacagagggattcgtgctgatgggaaatgatgccattcattgtgctgacttggggcagtggacagccccagccccagtctgtgaagcgttgcaatgtcaggagtttccggtcccaagtaaagcccaggtgagctgctcggaccccttcggacccttgaagtaccagtcagcctgcagcttttcctgtgatgaaggctcactcttggtgggagcaagtgtgataagatgcttggctactggacactggagtgaggcccctcctgaatgtcaagctgtctcctgcacccctttgctcagccctgagaatggaaccatgacgtgtatccagcctcttgggcattccaactacaaatccacatgccagttcatgtgtgacgaaggattttatctatctggaccagaaagattggactgttctccatctggacactggacaggcagccctccaatgtgtgaagccatcaagtgcccagaaatctttgccccagaacaaggcagcttggactgctctcatgttcatggagaattcagtgtcggctccacctgtcacttctcctgcaacgaggagtttgagctcctgggatctcgaaatgtggagtgcacagtgtctggaagatggtcagcgcctccaccaacctgcaaaggtgtaacatcacttcctgtcccatcggttcgatgccccgccctcactactcctggacagggcacaatgtcctgtcgacaccacctggaaagctttggtccgaacaccacttgttactttgggtgcaaaacaggatttacactcagaggagccaactctctccgctgcggggcttcaggacaatggacagcagtgacgcccgtgtgcagagccgtcaaatgctcagaattgcacatggacacagcagtcgcgatgaactgttccaacccctggggaaactttagctacggatcaacctgtgccttccactgtccagaggggcagtcactgaatggctctgccaggacaacctgcggagaggacggtcactggtcagatgctatgccaacctgccaagcagggacgctgacgatccaggaagctctgacttacttgggtggcgccttggcttctacttctggcctggcagtgggcgggacgctactggctctgctaagaaagcgtctcagaaagaaagatgatggaaaatgccccctgaaccctcacagccacctaggaacatatggagtcttcacgaacgctgcatatgacccaaccccttaagaggcctggctcccgatgtcaattggatctctcaggattccgcatgcagataacaagtttcctggtcgacttgactgtcactccccagcatttgctgcggttctttgtggtaaataattggacaggaaccaaacgaaaggacgatgtgctccgcccaccccttcctgctccgcccctcaccttcctcgggctcagccacagaaacaggagcaaatgtttctgctgtggtctgtggcttgatgttactttgctgttactgaaaacccgagttagtccaaggcactggagcatctgcctcaccaggtgaccaggctgtggaaaaccggaagtctgtctgctttctcttgggattgaagaatggcgatgttggttgggcaggcagacctctcgtttaagggaacgctgctttaagatctctgggtcttcgtgtttcttatctctgaggttgtttacacctctgctgctgagactttcagatggtactagggggacacagaagatctgtgaacagagcattggacaccacatctgactgcagacttttcgtcacaaagcacccattggccattgtttgactgtagagtttaactcccagctatcaagctcttcacgtttgttcagtgaggtctgtgtatctcactttgtcctaccaccaatgtggtcacagttatactcctccaaatgacagctggaccctcccagtgagcccacaaatatatgttgtatgtcgcctgtccacagagagaaaaatcagaggagcagggaaggtcctcctttcggtattttggaccgcaggaaaggacagttatgttttaaacgtaacctaattcacatatttaataaacaagtcactgaaaatt

SEQ ID NO: 1873 - DNA, 3000 bp, Rattus norvegicus
  Genbank Accession No. NM_013115
ggcaatgttgcaagctgaggccccttgggggtgtgggctctgcaactggcaaagtcaactatgtctgcacttcgaggctgcacagtcgtgacagagagatgacttgagggggacggcgtttatctccacaacgatgtccataaacagttccaagcagccggcgtcctctgcagctggactcatcgccaacacgacttgccagacggagaaccggctttcagtgttcttttcaataatcttcatgacggtggggattgtatctaacagcctggccattgccatcctcatgaaggcatatcagagatttagacggaagtcgaaggcttctttcctgctcttggctagtggcctggtgatcacagacttcttcggccacctcatcaacggagggatagctgtcttcgtatacgcttctgataaagactggatccgcttcgatcaatcgaacatcctgtgcagtgtttttgggatctccatggtgttctctggcttgtgcccacttttcctgggcagtacgatggccattgagaggtgcatcggggtcaccaaccctctattccactctacaaagatcacgtctaagcatgtgaaaatgatactgagcggtgtgtgcatgtttgctgtcttcgtggccctgttgcccatccttggacaccgagattatcaaatccaagcatccagaacttggtgcttctacaacacagagcacatcgaagactgggaagacaggttctatctcttgttcttttcttccctgggactcttagctctcggcatctcattctcgtgcaacgccgtcacgggagtcacacttttgagagtgaagtttagaagtcagcagcacaggcaaggcaggtctcaccacctggagatggtcattcagctcctggccataatgtgtgtctcctgcgtctgctggagtccctttctggtgacgatggccaacattgcaatcaatggaaataattccccagtgacctgtgagacgacgctctttgctctccgaatggcaacctggaaccagatattagacccctgggtctacattctgctacggaaggctgtccttaggaacctgtacaagcttgccagtcgctgctgtggagtgaacatcatcagcttgcacatctgggaactcagctccatcaagaattccttaaaggttgctgctatctctgagtcaccggctgcagagaaggagaatcagcaagcatctagtgaggctggactgtaagtcaatgcacagctagaagaaagttatgggaacttccgaaacatcttacctgaccagactcagagcataactggaacacttggacctctgtgtgtagttcgggagtacactggtcagacaaagcttctgacttttgttatgctggctgctgcatggttgtgcattttcatttgttggtgtcaacaggagattcaacatggtggagttaagtagagtacacattttatctgcgtgacttatgtttttggaataaatgaatctgttgaggccctgtgcctttatttgacctatttttccaagcaccttaatgctacctgcaccgtgacatggccatttgaggagcactgacttgcagacaaagcttaaagtaacacaagactttttgtgtttgtgtgtgcagctctgctctgtttaccaacccacgtgtcctcaatgtctgcatgaccatgacatctgagtctcatggtgactttgatggccactatgtaggcagctcagcttgacattgtggggctgatgaggataatcattcttgtcacaactcacatgtgtggttgcttgcatttgttgttgtgaaggtcaattattttttccacattggctgtcctcctataaagtcataggttttcagtgtctaagtaatccccctttcctctgaaaattgtagaggaatacaggctttatcttagcacagattcagctcatgatagcatatcataagccctattgtggatgatgcaaacattgaaatcccacttacacatgccaagaacatggcagacattgctttacctgagctatcatttctgtgtcagagaataaaaaacgatcaagacacattcgaagtctcttggagctattgtgtttctgccttacacacacaggcataagggagttctgttaacagtaatttcactaaataagttgaaccacacttccaaaagcctgtgttatcagtgaggagtggaaagatctgaaattagccaggagttgggatcactgttgtggttaacccgaggctaagggacaagattctgtcgccaagtttcccaatcttaattcacacttctcctttgtataatttaacacaaagatactcaatttcagtaatcactctaaacattagttccatcagtggctacggttagtggttatattttataaagaaatgtattttcatatttaaaaaattcctttcttttatcgtttgtctttatttaaaaatttctatttttttctttgctatatgtatgagtgtttcacccgaatgtatttccgagcattacgtaccttcctagaacttacttaaaccagaaaaggacatcgggtccttacagatggttataagctaccatgtggatactaggaattgagcccaggttctctggaagagcagctgtagagagaattttaatccagcaatttgtgaattcaatagacttaaaatagtacctccaacatggtttctctggcaaaagatcacatccgaagagcttctaggtttatatgatctggcttgaatgcagacattctctggattatagtacaatctggctgtaacacagacacacccttagtacacacctttaatccctaacagtgaaggaaagttagtttgtagaaggaagtagtcacttttgaaatcgatgtccagttgagggtcagacagagtgacgaatcagagaaagttttgacagaatgagttagagaaaagatgtgctcaattcacgtgagaacagtacggaaagagaggatgccgaaaaggg

SEQ ID NO: 1874 - DNA, 2248 bp, Rattus norvegicus
  Genbank Accession No. NM_013127
caggagcccaatggccaactatgaattttcccaggtgtctgaggacagacctggctgccgcctcactaggaaagcccagatcggtcttggagtgggtctcctgctcctggtcgccttggtagtggtcgtggtcatagttctgtggccgcgctcacccctggtgtggaaagggaagcctaccacgaagcacttcgctgacatcatcttgggacgctgcctgatctatactcaaatcctccggccggagatgagagatcaggactgcaagaagatactaagtacattcaaaagagggtttatttccaagaatccttgcaacatcaccaatgaagactacgcaccactggttaaattggttactcaaaccataccatgtaacaagactctcttttggagcaagtccaaacacctggcccatcagtatacttggatccaggggaaaatgttcaccctggaggacacactgctgggctatattgcagatgatctcaggtggtgtggagaccccagtacttccgatatgaactatgactcttgcccacattggagtgaaaattgtcccaacaaccctgttgctgtgttctggaatgtgatttcccaaaagtttgcagaagatgcctgtggtgtggtccaagtgatgctcaatgggtccctcagtgagccattttacagaaacagcacctttggaagtgtggaagtctttaatttggacccaaataaggttcataaactacaggcctgggtaatgcatgacattaaaggaacttccagtaatgcatgttcgagcccctccataaatgagctgaagtcgattgtgaacaaaaggaatatgatatttgcctgccaggataactaccgacctgtaagatttcttcagtgtgtgaagaatcctgagcatccatcatgtagacttaatgtgtgaaggacttggatctcagaatccccacacacactccgcagcacgcaatgaggtgaaagattcagaagcaacactgtcgggaaagcagcagttgtcagggagaggtctctactacaatgctaacatcagagatggaagagcttcccaatacattatgacagaacgacacgatcagctcagtgcgtcctgtgtactaccagtaatagtcaagaaaagtcactccataaaccagagttaaggttctatattgttatttcaatgtggtgcttttatattgtttatattttgctagcatccttttttcctctcttttaatgaggtctctctttctctcttaatgaggctgagaatcagacctgagaacttgcacacatggtggataagcctatataccactgagctaactcctcagcatggctggatttttattgaaaaatgccaatccaacttcccattggacaaagaaaatcaaacatcaagtttatcgaaatgaataaccttatttttttatgtttttgcattctccccacaaatattcaaatggtaaacatgaggtcatagggtcattatagagaaggtgctctgtggaaactacccacatgccctgtgctttagtcgatttttaacccatccaacatgtccttgttaactttgagttttattgggggggattggggggggttaacgtgagaaaatggagtttagagagataatttattttcctaaagtcacattcttaggatcatggttacatctgaaattaaatcagttctgtcaaagtcaacaacataagtttttttttttcttttctgagcttttattgccaaattgatagtagcctgtgttatcgtctagcaatagactctgcaatgtgatctttatgggtgatttcgaaactaattacttgcactctctttctcttcttcctcattcttggtgccttctgtaggtagtcaggagttagcttacatttgttgctgatatcggcaatttatgttttttatcctttttttcttacatctgtcttgctcggagtcactaatttggttgttattttgttgttgttggttgtctttttcaaagctccactctttacccttcctcatttatttatttaattgagcttttgtctatttttagaaacatagaaatttcttctgtcttcaatatctccatttagcttttttgaggcaaatgtttagaccattgctatttcagcctgttctcttttttcttttttataggatattttatgtatttacatttcaaatgttatcccctttcccagttcccccgccctgattctatgaggatacttccccttccaca

SEQ ID NO: 1875 - DNA, 2092 bp, Rattus norvegicus
  Genbank Accession No. NM_013128
agacgagaggaggctggtgctgagctcgccaactccacccgggcccgggcagacaaaagagaccggcggtacagctcgcggggacgcgatggccgggcgcggaggacgggtgctgctggcgctgtgtgccgcgctggtggccggcgggtggctgttagcggctgaagcccaggagcccggggcgccagcggctggcatgcggcggcgccggcggctgcagcaggaggacggcatctccttcgagtaccaccgctatcccgagctgcgcgaggcgctggtgtcggtatggctgcagtgcaccgccatcagcaggatctacacggtggggcgcagcttcgagggccgggagctcctggtcatcgagctgtctgacaaccccggggtccatgagcccggtgaacctgagtttaaatacattgggaacatgcatggtaatgaggcggttggacgggagctgctcattttcttggcccagtacctgtgtaacgaataccagagagggaatgagacaattgtcaacctgatccacagcacacgaatccatatcatgccctccttgaaccccgatggctttgagaaagcagcatctcagcccggtgagctgaaggactggttcgtgggccgcagcaatgcccagggaatagatctgaaccggaacttcccagacttggataggatcgtgtatgttaatgagaaagaaggcggtcccaacaaccacctgctgaagaatctgaagaaaattgtggaccaaaattcaaagcttgcccccgagaccaaggctgtcattcactggatcatggacatcccatttgtgctctctgccaacctgcacggaggagacctcgtggctaattacccgtatgatgagacgcggagtggtactgctcacgaatacagttcctgccctgatgacgcaattttccaaagcttggctcgcgcatactcttctttcaacccagtcatgtctgaccccaatcgacctccctgtcgcaagaatgatgatgacagtagctttgtagatggaacaaccaatggtggtgcatggtacagcgtccccggtggaatgcaagacttcaattacctgagcagcaactgctttgagatcactgtggagcttagctgtgagaagttcccacctgaagagactctcaaaagctactgggaagataacaaaaactccctcatcaactacctggagcagatacaccgaggtgttaaagggtttgtccgtgaccttcaaggtaatccgattgccaacgcaaccatttccgtggatgggatagaccatgatgtcacctcggctaaggatggggattactggcgattgcttgcgcctggaaactataaacttacagcctcagctcccggctacctggcaatcacaaagaaagtggcagttcctttcagccctgctgttggggtggactttgagctggagtctttctatgaaaggaaggaggaggagaaggaagaattgatggagtggtggaaaatgatgtcagagactttgaatttttaagaaaggctcctaactaatggctttaatatatccatagactatagtaagatgcaacgtggctcttttattttaggttgtgtgcagttaatatttaacatcggtttatttttgatcatttaagtagtagttgctaatcacttaaatacacttggacagaacctgtagtgtctggatcgacttcattctttcatgaacattcgctttaaaatctaggaagatcctttaacctagttggtgacaatgtcacatgacagatgccatgaaaaagtcaaccgatgtagcttggatctgtgagcactgtgtgtatggcgagaatcacatagttccatataagttgtccttagtctcttgtgctgatccactgtataagcatgatcctgttaatgcgcttctgagggaaggaaaacgtacgtgctttgcaaaggggctctgagcagaaggaaaacctagttcttgcgtgtactttgaagaacagaactgtattagtcagcctgttagtgcaacttcagagtttggggttttgtcttgattgcagattggcccagaattgcattctaaatgaataaaggatta

SEQ ID NO: 1876 - DNA, 1417 bp, Rattus norvegicus
  Genbank Accession No. NM_013132
gtcctgctctcaaccgcagcctgcgccctaccttctgcagctccagcctactcctgaccgacagcatcatggctctcagaggcaccgtgactgacttctctggattcgacggcagggctgatgccgaagttcttcggaaggccatgaaaggcttgggcaccgacgaggacagcatcctgaacctgttgacagcccggagcaacgctcagcgccagcagattgctgaggagtttaagactctgtttggcagggaccttgtgaatgacatgaagtctgaactgaccggaaagtttgagaagttaattgtggctttgatgaagccctcccggctctacgacgcctacgagctgaaacacgctcttaagggagctgggacagatgagaaagtgttgactgaaatcattgcctcaaggacacctgaagagctcagggccataaaacaagcttatgaagaagaatatggttccaacctggaagatgatgtggtgggggatacctcagggtactaccagaggatgttggtggtcctccttcaggccaatagagaccctgacactgcaattgatgatgctcaagttgaactggatgctcaggcattgttccaggctggagagctgaagtgggggacggatgaagaaaagttcatcaccatccttgggacacgcagtgtgtctcatttaagaagagtgtttgacaagtacatgacaatatcaggatttcagattgaggaaaccattgaccgagagacctcagggaacttggagaacttactcctggctgtcgtgaagtctattcggagcatacctgcctaccttgcagagaccctctactatgctatgaagggtgctgggacggacgatcacaccctcatcagagtcatagtgtcgaggagtgagattgatctgtttaacatcaggaaggagtttaggaagaacttcgccacgtccctgtactctatgatcaagggcgacacatctggagactataagaaggccctgctgctcctctgtggaggcgaggatgactgaggagctgcctggagtgccctgggcccgcctgctgcccaccatcagcttccttcagcaccacgcctacttacgttcaatgcctgcctgcctgccacgctgccttactcacacgagtgtgtgctaatgaccaaagctgtctcgaatgaaagcagtgttctgctgttctgtctgacagaccttcccacgtctctcagtctagtatctctaagttgcgttttctatcctcttctaaagcttcatttatattaagttaataaccatattaccttgaacggaaccttagccatgaaattgtgaactcttggaagtgctgtcaatcaagcttagtgctctagctgacctgaaaaattaagatggtcgtaatatcagaaacgttgccgacaaataaa

SEQ ID NO: 1877 - DNA, 2928 bp, Rattus norvegicus
  Genbank Accession No. NM_013143
gaggttctgccaaacgcagttcacttgcaacaatgctgtggacactacctgtgtgtcttctctcactgagtttttctgcccacattgcagctgtgtccattcagcatctttcgactggacatgaccacgatgatgtagacgttggtgaacaacagaaggacatttcagaaatcaactcagctgcaggcctgaacctttttcaaggggacatccttctgcccagaaccagaaatgccctgagagatccgtcaagcagatggaagccccccattccatacattctggctgacaatctggatctgaacgccaaaggagccatcctcaatgcctttgagatgttccgcctcaagtcttgtgtggacttcaagccctatgagggggagagctcgtacatcatcttccagcagttttctgggtgctggtctatggtcggtgatcaacacgtgggacagaatatttccattggtgagggctgcgactataaggccatcattgaacatgagatcctgcatgctctgggattcttccatgagcagtcaaggactgaccgggatgattatgtgaacatctggtggaatgaaattatgacagattatgaacataatttcaacacgtatgatgacaagaccatcacagacctcaacacaccctatgattatgagtccttgatgcactatgggccattttcatttaacaagaatgaaaccatcccgaccatcactaccaagatccctgagttcaacgccatcattggacagcgcctggatttcagtgccactgatttaacgagactgaatcggatgtacaactgcaccagaacacataccctgctggaccactgtgcgtttgagaagaccaacatctgtggaatgatccaggggaccagagatgatgctgactgggttcatgaggacagcagtcagcctggacaagtggatcacaccttggtgggacggtgcaaagctgctggctacttcatgtacttcaataccagctcgggggtgaccggagaggtagcccttctggagtctcggatcctttaccccaagaggaagcagcagtgtttgcagtttttttataagatgacaggaagcccttcagacagactcctcatctgggtgagaagggacgacaacacgggcaacgtgcgccagctggccaagatccagacttttcaaggagattctgatcacaactggaaaattgctcacgtgacactcaacgaagagaagaaatttcgctatgttttccagggtaccaaaggtgaccctggtaactcagatggcggtatttaccttgatgacatcactctgacagaaaccccctgccctacaggggtttggaccatccggaatatctcccaggtccttgagaacacagtgaaaggggacaggctcgtgagccctaggttctacaattccgagggttatggttttggggtgaccttgtaccccaatggtagaatcaccagtaactctggctacctgggactcgctttccacttgtacagtggggataacgatgtgattctggagtggccagtggagaacgagcaggccataatgaccatcctggaccaggaacctgatgccaggaacaggatgtccttgagtttgatgttcactacctccaagtaccaaacatcttcagctataaatggctctgtcatctgggacaggccaaccaaggttggagtctatgataaggactgtgattgttttagaagcattgactggggttggggtcaggccatttcccaccagatgctgatgagaagaaatttccttaaagatgacaccctcatcatcttcgtggactttaaagaccttacccacttgaggcagactgaagtccccatttccagcagaagcgtgataccccgaggactccttctgcaaggccaggagcctcttgccttgggagactccagaatagccatgatggaggaatccctgccaagaaggctggaccagagacagcccagcagaccaaagcgctcagtggaaaatactggtcccatggaggaccacaactggccacagtacttcagagacccatgtgacccaaacccttgccagaatgaaggcacctgtgtgaacgtaaagggaatggccagctgcaggtgcgtctctgggcatgcctttttctacacaggggagcgctgtcaggctatgcatgtgcacggaagcttgctgggcctgctcattggctgcatcactgctttgatcttcttgaccttcatcacattctccaacacttaccaaaagctgaggcagtgagctgatgtccactagactgcagaagggcctccttcacctagactttccttccagtagtcagtataatttggggatattcttcatcaaacatgtttgaaagagcctccaaaaccaaagccccaaacctcatgtggggctcttgccactccatttctgtacagttctgctatccttctatgagtttctggtgaatccattatgtcctaagataacagtcattgcattttactataaacactttgcttgcttgaccttctccccttaaatcaccaagtctagttgggtaggagcatgttatcctctgctaccacattgaccccagtgctagaagcataccttactggtgtattgtgggtactcagtaagcattaaatgaatgaaccaataagcaagtgaatagctgtggtataataagtctttttttcttcctcatattgtaaaacatatgattaagtctatttgcaggtgtatcagaaccaaatacccagtttacactagatgggaaaactactgtcttattgctcatgtagtttcttgtgaaatgatttcacagattcctctggtcagctgagtttccatggcatgtacttttttcttgttctgattttaaggaaaaggcttaataaaaccattaaatatgaaaaaaaaa

SEQ ID NO: 1878 - DNA, 1954 bp, Rattus norvegicus
  Genbank Accession No. NM_013148
ggactctcactgggtggagactgaggtcaggttcttggctcttggcagaatcctctccactggccagcggttgcaaacatctaaattgacttcagtgaactcggtgactgcattgagtctaaacgcaggtgtgctgggccagcaatggatctgcctataaacttgacctccttttctctctctactccctccactttggaacctaaccgcagcttggacacggaagccctgcgcactagtcagtcttttctctcagctttccgagtgctagtcctgactttgctgggctttctagctgccgccacgttcacttggaacctgctggtgctggccaccatcctcagggtacgcaccttccaccgagtaccacacaacctggtagcatccatggctatctcggatgtgctagtagctgtgctggttatgcctctgagcctggtacatgaactgtctgggcgccgctggcagctgggccggcgtctatgccagctgtggattgcgtgtgacgtcctctgctgtactgccagcatctggaatgtgacagcaatagctttggaccgctactggtcaataacgcgccacctggagtacacactccgtgcccgcaagcgtgtctccaacgtgatgatcctgctcacttgggcactctccgctgtcatctctctggctccgctgctctttggctggggagagacttactcggagctcagtgaagaatgccaggtcagtcgcgagccttcctacaccgtgttctccactgtgggcgccttctacctgccgctgtgtgtggtgctctttgtatactggaagatttacaaggctgcgaagttccgcatgggctccaggaagaccaacagcgtctcccccatacctgaagctgtggaggtgaaggacgcttcacaacatccccagatggtgttcactgtccgtcacgccaccgtcaccttccagacagaaggggacacgtggagggaacagaaggagcaaagggcagccctcatggtgggcatcctcattggggtgtttgtcctctgctggttccccttctttgttacggagctcatcagtccgctgtgctcctgggatatccctgccctctggaagagcatcttcctgtggctgggctattccaactccttcttcaacccgctcatctacacggcgttcaacaggagctacagcagtgcttttaaggtcttcttctccaagcagcagtgagaggccacatgggagtgccttcttcccgtagcttgtagctcggtggactgtcctgcctcacaaacccctgtagtctgcccagctgtccagaggaacaagatccatctgccaagggcaccagggtcacatcagagctcagctcacttcagttctgtgcccgtgtgctggaaggtgtctcctataggctctggtagcttgtgtccccagtctgggcactcttcctcacactgtaccagcagccacaggcctggcccacaacgtgcccatttctcctccaactccactccagcgggaccatgagaagtttgatcagaacgaacaggaggaaggaagagagacaataaggcaggcagagagaggcagaaagaacaaggctgaaagccagtgggatcacatacctggaaccctcacaccaaggagacttaggcaggtagaacaggaatttggagccatcctgggctacatagtaagttcataaatcagtctgagctgtctgacacagacttagcaacagcaatgcactagagaggctatttgaaaagcagagaccataagggcaaacttccataacagcctcacttcacagttctgctctgtggtcctgcagtgtatggcccaattctgggtccttctgaatatctgatcacaagattctgtccccaaacatatcaaagcaccatcccatttgtgataacagtgattcctgtctttaccatttgttcattgtgaacccaaa

SEQ ID NO: 1879 - DNA, 2445 bp, Rattus norvegicus
  Genbank Accession No. NM_013151
ggcacgggacacggaagaaacggggagcaaaatgaagggagagctgttgtgcgtcctgctgctttgtggagtggcgttcacgttgcctgaccagggaatacacaggaggttcagaagaggagctcggtcctacagagcgacctgcagagatgaacagactcagacaacttaccaacagcatcagtcatggctacgtcccatgctcagaggcaatcgggtggaatactgccggtgcaacagcggcctggcacagtgccactcggtgcccgtccgaagttgcagtgaaccgagatgcttcaatgggggtacgtgtcagcaggccctgtatttctctgacttcgtctgccagtgccctgacggatttgttgggaaacgctgtgatatagataccagagcaacctgcttcgagggccagggcatcacctacagaggcacatggagcacagcagaaaatggggctgaatgcatcaactggaatagcagtgccctgtcccagaagccctacagtgcaaggaggccaaatgccatcaagctgggccttgggaatcacaattactgcagaaacccagaccgagacgtgaagccctggtgctatgtctttaaggcagggaagtataccacggagttctgcagcacgccggcttgccctaagggaccaactgaggactgctatgttggaaaaggtgtgacttaccgtggcacccacagctttaccacatccaaggcctcctgcctcccatggaattccatgatcctgataggcaagacttacacagcgtggagggccaactcccaggcacttggcctgggcagacacaattattgccggaacccagatggggatgccaaaccttggtgccacgtgatgaaggaccgaaagctgacatgggaatattgcgacatgtccccatgctccacctgcggcctgaggcaatacaaacagcctcagtttcgaattaaaggaggactcttcacagacatcacctcacacccttggcaggccgccatctttgtcaagaacaagaggtctccaggagagagattcctgtgtggaggggtgctgatcagttcctgctgggtgctatctgccgcccactgctttgtagagaggtttccaccccatcatcttaaagtggtcttgggcagaacatacagagtggtccctggaaaggaggagcagacattcgagatcgaaaagtacatagtccataaggaatttgatgacgacacttatgacaatgacatcgcattactgcagctgaggtcagattccagtcagtgtgcccaggagagcagttctgtcggcactgcctgcctccctgaccccgacgtacagctccctgactggacagagtgtgagctttctggctacggcaagcatgaggcatcctctcctttcttctctgaccggctgaaggaggctcacgtcagactgtatccgtccagccgctgtacctcacagcatctgtttaacaaaaccatcacgagcaacatgctgtgtgcaggagacacccgaactgggggcaaccaagacgtccatgacgcgtgccagggtgactcaggaggccctctggtgtgcatgatcgataagcggatgactttactgggcatcatcagctggggcctcggctgtgggcagaaggacgtgccagggatatacacaaaggtcactaattacctgaactggatccaagacaacatgaagcaatgacaaagaaagcccagctccttaaacccagaggacctgccttcctcttcctcttccacagaagatacgcctgaaaggccaagcgttcttcgcaggctcgtcctcctgagctgccgctcagcagagggagtgacagtctttaggcacagacagagtttactttgtgacaggtacttcacaaacttgtacgttttaagggtgaaggtctgactttagaatcagttctgtcagatgagatgacagggaaatgccaaccttcctataactctaagattttaaaaagagaagtagaccaaagtccacccttcctggaccactattttgtacactgaaccacaagatcgtgtctcaacagtgaaatacaacttgatctttcaggagtaaaagtctgcactgaggacaagaatgtgtttttatagttacacaggggcccagcatggcctccaagagaaggaaggggttagctgatcagaccacagccccctaaaacccttgaaatcaaatattccccatcctcccacaatcctcaactcttggggcatatccctttgtacacagtgtagatgtctttttctttataaactttccagatggctgggagaactgtatgattttaatattcgatgaaatgacactagtatatttatatttgaatctatttagtttttactgtgttactagaactctgtattatgctgtactgaaataataaattccaaggtatttttcacactttt

SEQ ID NO: 1880 - DNA, 1200 bp, Rattus norvegicus
  Genbank Accession No. NM_013154
catgagcgccgctcttttcagcctagacagcccagcacgcggcgcaccctggcccacagagcccgcggccttctacgagccaggcagggtgggcaagccaggacgagggccggagcctggggatctgggggagccgggctccacgacccctgccatgtatgacgacgagagcgccatcgacttcagcgcctacattgattccatggctgccgtgcccaccctagagttgtgccacgacgagatcttcgccgacctcttcaacagcaatcacaaagcggccggcgcgggcagcctggagctgctgcagggcggccctacgcgacccccgggtgtggggtcaatcgccaggggcccgctgaagcgcgaacccgactggggcgacggcgacgcgccgggctccctgctgccggcgcaagtggcagtgtgcgcgcagacagtggtgagcttggcggccgcggcacagcccacaccacccacttcgcccgagcctcctcgaggcagccctggaccgagccttgcgcctggccccgtccgagagaagggcgccggcaagaggggtccggaccggggcagccctgagtaccggcagcgacgcgagcgcaacaacatcgctgtgcgcaagagccgggacaaggccaagcgccgcaaccaggagatgcagcagaagctggtggagctgtcggccgagaacgagaagctgcatcagcgtgtggagcagctcacccgggacctggccagcctccggcagttcttcaaagagctgcccagcccgcctttcctgccgcccaccggcaccgactgccggtaacgcgcggtgtgggccttagagactccgaacgaccgatacctcagaccccgacggcggggagcagacgccgcccgaattgctacagtttcttgggcactggactgcgagagaagctatatgaatcccccttaaattatttttttataatggtagcgttttctacgtcttattaccattgcagctaaggtacattgtagaaaagacttttccgacagacttttgtagataagaggaagagactgcgcatgctttttatattcatttttacagtatttgtaagaataaagaagcatttaaattgcaaaaaaaaagaggcaccagctctgactggcctctttctaggctacggtgatcctgagcatcttttgttacctgctggtagaaatgatcct

SEQ ID NO: 1881 - DNA, 2952 bp, Rattus norvegicus
  Genbank Accession No. NM_013155
gagaaggggtgcccgctccttgcgtcgtctccgtgctcccggctcctcactccttccccctcctcctcgcctcctccctccccgcccccacctccttcctcctctccgaagggctggtaacttgttgtgcggagcgaacggcgacaacgacgccgcgacggaggcaccatccgggcgggcagcatgggcacgtccgcgcgttgggcgctgtggctgctgctcgcgctgtgctgggcgccccgggacagcggcgccactgcaagcgggaagaaagccaaatgtgacagctcccaattccagtgcacaaatggtcgctgcattactctgctgtggaaatgtgatggagacgaagactgtactgatggcagtgacgagaagaactgtgtgaagaagacatgtgctgagtcagacttcgtgtgcaaaaacggccagtgtgttcccaacagatggcagtgtgatggggaccctgattgtgaagatggttctgatgaaagcccagaacagtgccatatgagaacatgccgcataaatgaaatcagctgtggcgcccgttctactcagtgtatcccagagtcctggagatgcgatggtgaaaatgattgtgacaatggagaagatgaagaaaactgtggcaacattacatgtagcgcggatgagttcacttgctccagtggccgctgtgtctccaggaactttgtgtgcaatggacaggatgactgtgacgatggcagtgatgagctggactgtgctccaccgacctgcggtgcccacgagttccagtgcaggacctcctcctgcatcccgctcagctgggtgtgtgacgatgacgcagactgttccgaccaatcagacgagtctcttgagcagtgtggccgtcagcctgtgatacacaccaaatgtcccaccagtgagatccagtgtggctctggcgagtgcattcacaaaaaatggcggtgtgacggagacccggactgcaaggacggcagcgacgaggtcaactgtccttctcgaacctgcagacctgaccagtttgaatgtgaggacggtagctgtatccatggcagcagacaatgcaacggcatccgagactgtgttgacggctctgatgaagtcaactgcaaaaacgtcaatcagtgcctgggccctggaaagtttaagtgcagaagtggggaatgcatagacatcaccaaagtatgtgaccaggaacaggactgcagagactggagcgacgagcccctgaaggagtgccatatcaacgaatgcttggtcaataacggtggctgttcccatatctgcaaagacctagtcataggttatgaatgtgactgtgcagctgggtttgaactgatagacaggaaaacctgtggagatattgatgaatgccaaaatccggggatctgcagtcaaatttgtatcaacttaaaaggcggttacaaatgtgaatgtagtcgtggctatcaaatggatcttgccactggcgtgtgcaaggcagtaggcaaagagccaagtctgatcttcactaatcgaagagacatcaggaagattggactagagaggaaggaatacatccaacttgtagaacaactaagaaacacggtggctctcgatgctgacattgcagctcagaagctattttgggctgatctaagccaaaaggccatcttcagtgcctcaattgatgacaaggttggtagacattttaaaatgatcgacaatgtctataatcctgcagccattgctgttgattgggtgtacaagaccatctactggactgatgcggcttctaagactatttcagtagctactctagacggaaccaagaggaagttcctgtttaactctgatttgcgagagcctgcctccatagctgtggatccgttgtctggctttgtttactggtcagactggggtgagccagctaaaatagaaaaagcaggaatgaatggatttgatagacgtccactggtgacagaggacatccaatggcctaatggaattaccctcgaccttgtcaaaagccgcctctactggctggattccaagttgcacatgctctctagtgtggacctgaatggtcaagatcgtaggatagtgctcaagtctctggagttcctagctcatcctcttgcactcaccatatttgaggatcgtgtctactggatagatggagaaaatgaagcagtgtatggtgccaataaattcactgggtcagagctggccactctagtgaacaatctcaatgatgcccaagacatcattatctaccatgaactcgtccagccttcaggtaaaaactggtgtgaggaagatatggagaatggaggatgtgaatatctctgcctgccagcaccacagatcaatgatcactctccaaaatatacctgttcctgtcccaatgggtacaatcttgaagaaaatggacgcgagtgtcaaagtacttcaactcctgtcacttacagtgagacaaaagatgtcaacacaacagacatcctacgaactagtggacttgttcctggagggatcaatgtgaccacagcagtatcagaagtcagtgttcccccaaaagggacttcagctgcctgggccatccttcctctcttgctcttagtgatggcagcagtaggtggctacttgatgtggaggaattggcaacataaaaacatgaaaagcatgaactttgacaatcccgtgtacttgaagaccactgaagaggacctctcaatagacattggtagacatagcgcctctgtaggacacacatacccagcaatctcagttgtaagcacagatgatgatttggcttgagttctggaacaagtcttgctctatgaggtctacacccataacaccctactccggaatggtaacagagccagcagctgaagtttctttttcttcctcccatctggaagaacatcaagatatcttttcgtggatcaagcttgtgtactt

SEQ ID NO: 1882 - DNA, 1386 bp, Rattus norvegicus
  Genbank Accession No. NM_013156
aattccgcggcgacctccggggatccgagtttgcagactacgtgtgtgcgcagctagccacctcaggtgtttgaaccatgacccctttactcctcctggctgtcctctgcttgggaacagccttagccactccaaaatttgatcaaacgtttaatgcacagtggcaccagtggaagtccacacacagaagactgtatggcacgaatgaggaagagtggaggagagcagtgtgggagaagaacatgaggatgatccagctacacaatggggagtacagcaacgggaagcacggctttaccatggagatgaacgccttcggtgacatgaccaatgaggaattcaggcagatagtgaatggctatcgccaccagaagcacaagaagggaaggttatttcaggaacctctgatgctgcagatccccaagactgtggactggagagaaaagggttgtgtgactcctgtgaagaatcagggccagtgtggttcttgctgggcttttagcgcatcgggttgcctagaaggacagatgttccttaagactggcaaactgatctcactgagtgaacagaaccttgtggactgttctcacgatcaaggcaatcagggctgtaatggaggcctgatggattttgctttccagtacattaaggaaaatggaggtctggactcagaggagtcttatccctatgaagcaaaggatggatcttgtaaatacagagctgagtatgctgtggctaacgacacagggtttgtggatatccctcagcaagagaaagccctcatgaagcctgtagcgacggtggggcctatttctgttgccatggatgcaagccatccgtctctccagttctatagttcaggtatctactatgaacccaactgtagcagcaaggacctcgaccatggggttctggtggttggctatggttatgaaggaacagattcaaataaggataaatactggcttgtcaaaaacagctggggtaaagaatggggtatggatggctacatcaaaatagccaaagaccggaacaaccactgcggacttgccaccgcagccagctatcctatcgtgaattgatggacagcgataataaggactgacggacactacatccgaaggagttcatcttaaaactgaccaaacccgtctctgagtgagaccatggtacttgaatcgttcaggatccaagtcacgatttaaattctgttgacatttttacatgggttaaatgttaccactacttaaaactcctgttataaacagctttataatattggacacttaatgcttaattctgattctggaatatttgttttataaaagttgtataaaactttctttaccttttaaaaataaattttagctcagtgcaaaaaaaaaa

SEQ ID NO: 1883 - DNA, 4276 bp, Rattus norvegicus
  Genbank Accession No. NM_013159
gcggctgcgcggggtatgcggaacgggctcgtgtggctgctgcaccccgcgctgcccagcaccttgcactccatcctcggcgctcgcccgcctcccgtgaagcgactgtgtggattcccaaaacaaatttacagcacaatgaataatccggccatccagagaatagaagaccatattgtcaagtctcctgaagacaaacgggaatatcgtggactagaactggccaatggtatcaaagtgcttctcatcagtgatcccaccacggacaagtcatcagcagcactcgacgtgcacatagggtcactgtcagaccctccaaatattcctggcttaagccatttttgtgagcatatgctgtttttgggaacaaagaaatatcctaaggaaaatgaatacagccagtttctcagtgaacatgctgggagttcaaatgcatttaccagcggagaacacaccaattattatttcgatgtttcccatgaacacttggaaggagccctggacaggtttgcccagtttttcctgtgccccttgtttgatgcaagttgtaaggacagagaggtgaacgctgtcgattcagagcatgaaaagaatgtgatgaatgatgcctggagactcttccagctggaaaaggctacagggaatcccaagcaccccttcagcaaattcgggacaggaaacaaatatactctagagactcgacccaaccaagaaggcatcgatgtaagggaagaactcttgaaatttcactctacgtattattcgtccaatctgatggcgatttgtgttttaggtcgagaatctttagatgacctgactaatctggtggtgaagttattttctgaagtagagaataaaaatgtccctttgcctgaatttcctgagcaccctttccaagaagaacatcttaaacaactttataaaatagtacccattaaggatattaggaatctttatgtgacatttcccataccagaccttcaacagtactacaaatccaatcccggtcattatctcggtcatctgatcgggcatgaaggtcctggaagcctgttgtcagagctcaagtcaaagggctgggtaaacaccctggttgggggacagaaggaaggagcccgaggttttatgttttttatcattaatgtggacttaactgaagaagggttattacatgttgaagatataattttgcacatgtttcaatacattcagaagctacgtgctgaaggacctcaagaatgggttttccaagagtgcaaggacttgaacgctgtcgctttcaggtttaaagataaagagaggccacgaggctacacatctaagattgcagggaaattgcactattatcccctaaatggagtgctcacagctgaatatttactggaagaatttagacccgacttgatagacatggttcttgataaactcagaccagaaaatgtccgggtggcaatagtttctaaatcatttgaagggaaaactgaccgcacagagcagtggtatggaacccagtacaagcaagaagctatcccagaggacgtcattcagaaatggcaaaatgctgacctgaatgggaaatttaaacttccaacaaagaatgaattcattcctacaaattttgagattttggcattagaaaaagatgcaacaccataccctgctcttattaaggatacagccatgagtaagctgtggttcaaacaagatgataaatttttcttgccgaaagcttgtctcaactttgaatttttcagcccgtttgcttatgtggaccccttgcactgtaacatggcctatttgtaccttgaactcctcaaagactcactcaacgagtatgcatatgcagcagagctagcaggcctgagctatgatctccaaaacaccatctatgggatgtatctctcagtgaaaggttacaatgacaaacagccaattttgctaaagaagatcaccgagaaaatggctacttttgagattgataaaaaaagatttgaaattatcaaagaggcgtacatgcgatctcttaataatttccgggctgagcagcctcaccagcacgccatgtactacctccgtctgctgatgactgaagtggcctggaccaaagatgagttaaaagaagccctcgatgatgtgaccctcccccgtcttaaggccttcatacctcagctgctgtcccggctgcatattgaagcccttctccatggcaacataacaaagcaggctgccttaggagttatgcagatggtagaagacacccttattgagcatgctcacaccaaacctctccttccaagtcagctagtccggtacagagaagttcagctccccgaccgaggatggtttgtttaccagcggaggaacgaagtccacaataactgtggcattgagatttactaccagacagacatgcagagcacctcggagaacatgttcctggagctcttctgccagattatctctgagccttgcttcaacactctgcgtaccaaggagcagcttggctatattgtcttcagtggacctcgtcgggccaacggcatccagggcttgcgattcatcatccagtcagaaaaaccacctcactacctggaaagcagagtggaagccttcttgatcaccatggaaaaggccatagaggacatgacagaggaggctttccaaaaacacattcaggcgttagcgattcgccgactcgacaaaccaaagaaactctctgcagagtgcgcgaagtactggggggagatcatctcccagcagtacaattatgacagagataacatagaggttgcatatttaaagacactcagcaaggatgatatcatcaaattctacaaggaaatgttggctgtggacgcaccaaggagacataaagtatccgtccacgttcttgccagggaaatggattcttgtcctgtggttggagagttcccctctcagaatgatataaacctttccgaagcgccacccttgccacaacctgaggtgattcataacatgactgaattcaagcgcggcctgccgctgttcccccttgtgaagccacacattaacttcatggcggcaaaactctgaagaagcagctgcgcccctgtgccttccggggccaggaaagcagtctcagctttgagtagtttctggcttgcaattagagagacaaacagaaaagagttatcaggcattattatgtagaatgttaaaaacccaaagtaataaaattataaagtcttatagatgtagaatatttttaaaatctcttaaatattttaatgtttttctttttattcctaaaagaaatttccttatattaactgcttaatctgaagaaagatatctcagtacaatctttcttccttattctgtaaaatagtcacttgtctgaaaaaaaaataagagcttttttttcttaaaggcttcagaacacttagaaaggattacctttttaagacgcgatcaagctcagatctgcttctgtcgatggttcctgtgaaccagcagagcatcgcggtgggcagatagtgcacaaagcggttccgcgttcctttactagtgaacctgctgattaactaaggcatggttttaatgtttttataaaacttgggtatgttttttaaccttcttagtcaaatgctagaaaacccagaatacccaatttacagtgctagaaatgcagattaaccttgaatcaagttcggaatttctcaggattcctgtgggttctctctcatcgaattctgttgacatttctgtttctcgtagttggtctgctgggttccatcagcagacacatactgctgtacagcgtgtgagacatgctgtgctgacatcagctgttgtgactccccgtaactcctagggtgaagttgtgatccgtgtgtgaactaaaacatttgcccctttagggactcaaaaggcagcaaatacaaagccacctccttggaggatacaaaactgtggcgttcttaaacagccagtctccgtaagactctaaactccccactgcttccggtctcatcttgccttaagtgttattttttgaatatatgaatataaacatacagatgatgactggagtggacttttaaaaaatatttttttcacaagatactattttaggtgaaaatgttactgtagatttaacagctgttttaaagtatttgctattattaaaacttcttcaagaacaagcgtggctatgctcccacacacaggcaatagtaacagaaagtgctcctgtttgtccaccagctcaggcaaagtacagaatggcgtttcc

SEQ ID NO: 1884 - DNA, 922 bp, Rattus norvegicus
  Genbank Accession No. NM_013160
atggagcgggtgaagatgatcaacgtgcagcccatgctggaggccgcggagtttttggagcgcagggagcgagagtgtgaacatggctacgcttcatcattcccctccatgccgagcccccggctacagcactcaaagcccccacggaggttgagccgggcacagaaacacagcagtgggagcagcaacaccagcactgccaacagatctacacacaatgagttggaaaagaatcgacgagctcacctgcgcctgtgtttagaacgcttaaaagttctgattccgctgggcccagactgcaccaggcacacaacacttggtttgctcaacaaagccaaagcacacatcaagaaacttgaagaagccgaaaggaagagccagcaccagcttgagaacttggaacgagaacagagatttttaaagcggcgactggaacagctgcagggtcctcaggagatggagcgaatacgaatggacagcattggatcaacgatctcctcagatcgctcggattcagagcgagaggagattgaagtggatgtggaaagcacagagttctcccatggagaagtggacaacatcagtaccaccagcatcagcgacatcgatgaccacagcagcctgcagagtattgggagtgacgagggctactccagtgccagtgtcaaactctccttcacgtcctagaacccagcatgacataacagtgcagggcgaagtgctcactggccagttcaataccgtctctcaaattgggttcatgacgcagtctcctctttaaaactaaaaactatacttgaacaaaaggtcagaagacctgtatttaagcaaatacttaaaaagtggggtagagcctccccggtagaacaaatactcctgtatttggaaagatacagtttctaacagcagcaaaaaaaaaaaa

SEQ ID NO: 1885 - DNA, 1492 bp, Rattus norvegicus
  Genbank Accession No. NM_013161
ggtccatagaacccgacggatccgccacgatgctgatgctgtggacatttgcagtgctgctgggagcagtagctggaaaagaagtttgctttgacaaactcggctgcttcagtgatgatgccccgtggtcaggaaccatagacagacccctgaaagcactgccctggagcccagcacagatcaacacccgctttctcctctacaccaacgagaaccaagacaactaccagaaaattacttcagatgcatcgagtatcagaaactccaatttcaaaacgaacagaaaaacccgcatcattatccacggcttcattgacaagggagaggagaactggctatctgacatgtgcaagaacatgttcaaagtggagagtgtgaactgcatctgtgtggactggaaaggtggctcccgggctacatacacccaggctacccagaacgtccgggtcgtgggtgcagaagtggcattattggttaacgttctgaagtctgacctcggtcatccacctgacaacgtccacctgattggccacagcctgggttcccacgttgctggggaggcaggaaagaggacattcggagctattgggaggatcacagggttggacgcggctgaaccttacttccagggcacacctgaagaagtccgtctggaccccaccgatgcccagtttgtggatgcaattcacacagatgctgcacccatcatccccaacttaggatttggaatgagccagactgtgggtcacctagatttctttcctaatggagggatggaaatgcctggatgtcagaagaatatcctttcccaaatcgttgacatcgacgggatctgggaaggaactcgcgactttgctgcctgtaaccacttgagaagctacaaatattacaccgacagtatcgtcaacccgactggcttctctggcttctcctgtagctcttacaatgttttttctgcaaataagtgcttcccatgtgggagtgaaggatgcccacagatgggtcactatgctgacaaataccctgggaagacaaaagaactctaccagaaattttacctgaacactggtgacaagagcaacttcgcacgttggcggtaccaggtgactgtcaccctctctggacagaaggtcactgggcacattctagtttctttgtttggaaatggaggaaactctaaacagtatgaagttttcaagggctctctgcatccaggtgacactcatgtcaaggaatttgactctgatatggatgttggagatttgcagaaagttaaatttatttggtacaacaatgtgatcaacccaactctacccaaagtgggagcatcaaggatttcagtggaacgaaatgacggcagagtgttcaacttctgtagtcaagatacagtgagggaggatgtcctgcttacactgtctgcatgttagaaggctgctgatgtgtgaccaccaagtcccactgtaataaagtctagtatcaaagccacccggaa

SEQ ID NO: 1886 - DNA, 4409 bp, Rattus norvegicus
  Genbank Accession No. NM_013173
ccacgcgtccgatggggaagaagcagccgagggcagcagcaagtgctgctccaaactgtgagctaaaatcctattctaagagcacagatcctcaggtatctaccatggtgttggatcctgaagaaaagattccagacgatggtgcttctggggaccatggagactcggccagcctcggtgccatcaaccctgcttacagcaactcttccctcccacattccaccggggattctgaggagcccttcaccacctactttgatgagaaaatccccattcctgaggaggagtactcttgttttagtttccgtaaactctgggccttcacaggacctggttttcttatgagcattgcctacctggatccaggaaacattgaatctgatttacagtctggagcagtggctggatttaagttgctctgggtgctcctgctggccactattgtggggctgctgctccagcgtctcgcagctcgactgggagtggtcaccggcttgcaccttgctgaagtgtgtcaccgtcagtatcccaaggtcccacggatcatcctgtggctaatggtggagttggcaatcattggttctgatatgcaggaagtcattggctcagccatcgccatcaatctcctgtctgccggaagggttcccctgtatggtggagtcctcatcaccatcgcagatacttttgtatttctctttttggacaaatatggcttgcggaagctggaagcattttttggctttctcatcactatcatggccctcacatttggatatgagtatgttacagtgaaacccagccaaagccaagtactcaggggcatgttcgtgccatcctgttcaggctgccacacccctcaggtggagcaggcggtgggcatcgtgggagctgtgatcatgccacacaacatgtacctgcactctgccttagtcaagtctagacaagtgaaccgggccaataagcaggaagttcgagaagccaataagtacttcttcatcgagtcctgcattgcactctttgtttccttcatcatcaatgtctttgtcgtctccgtctttgctgaagcattttttgagaaaaccaatgagcaggtggttgaggtctgcagaaatagcagcagcccccatgctgacctctttcctaacgacaactctaccctggctgtggacatctacaaagggggtgttgtgcttggatgttacttcgggcctgcggccctctacatctgggcggtggggatcctggctgctggacagagctccaccatgactggaacctattctggccagtttgtcatggagggattcctgaacctaaaatggtcgcgctttgcccgcgtgatcctgaccaggtctattgccatcatccctaccctgcttgttgctgtcttccaagatgtggagcatctgacagggatgaatgatttcctgaatgttctgcagagcctacagctcccctttgccctcatccctatcctcaccttcacaagcctgcggccagtgatgagtgagttctccaacggaataggctggaggatcgcaggcggcatcttggtccttctcgtctgctccatcaacatgtactttgtcgtggtctacgtccaggagctagggcatgtggcactgtatgtggtggctgcagtggttagcgtggcttatctgggctttgtgttctacttgggttggcagtgtttgattgcgttgggcctgtcgttcctggactgtgggcgctcggtaagcatctctaaagtcctgctgagcgaagataccagcggtggcaatactaagtaaacactgggtcagcctgtctgtctgtctttgcagggagccatcagagccagtgtgtttctatggtttactgtgtgaacatagccacaagtatgtgccgttgcacagactgcatttagggaccaactgttagttgggaaacactggggtgggtgtgtggtgtgtgtgtgtgtgttgtttccttctgtctttgtcaaatagcatgctgctattaaatgcttggtggcctaaaactctgtgtagcctaggctgccttcaaacttacagcaatcctcctggctcagcctcctgggtgctgggattccaggcatgtctaccgctcctggctgtcacgagtgcttacaagatgactggttttgtcaggggaggtcttaccctgtagcattaggcagcaccttgaaaaggtgagccttgagctgttttgaacactaaattcctaaatagctgtccaaggccatggctcggttttagttctgagaaacccaaccagactgttgtcatcatttgaattgcagaattagagaccgctatttttgagttcaggatttctgtttgtttggtgcatttcattttgtttttcaagacaagggtttcttccttgttgtcctggaacttactctgtagaccagcctggctttgaactcacagagatcctcctgcctctgcctctgcttcccgactgctaggattagaggcatacaccaccactgccctgctaagctcagagttttttatttctactttggaattcctcagtggaaagaaaggtagagcaggagagggggtgtggtcaagtgatggctcccctccaggtccttgcaggtttaccttaaggagtggagcttagcagggcttcatctgtagtcctgaggctagtgacttccctgttaatagcaagcatcccgatagtgtttcatctcgagtacacacagtcctggaatctccgccttcctctcctgagagagtgcggatggcaaaagactactgtagcacttgtgaactggctcacagcaaatcccagagctgaccgcactactcccgaaagtacccttcaccaaatcttggctctgacccaccgctgtttcatgcccaagataactcagaaggcaacctcaggagctctggacccaaaccttgcaaagtcagtagttgtcactgtgatgcaaagtcctctccctgcaaggtgggactaggctgcctcctcacagcccttccctcggagagaaagcctcttgagaccaggctgcggagctctggagattcagcacgggactacagaactgctgctctcagttcagccacttctgtcctggcacgtgggagacatgattctgtcacatcaagtcctgtctgtttgctggaaaggaataatacaagtttgtataatcattgccttggtggcaacaggagctacagtgacttcgaaggatgtcgtcctctttgccgctttcccagttcgactgtcccgacaaatgacctgcattgtggtgccactgtggcattagtgctagcatttcacacagtcagaagctcagcctgcatagagtcctgtgaggcatgaagggtaaatgcagtttcactcagcctggttgacctcagccccacagctaacacaacacagtcaggccgcgggtccctcactgcggcattctcaacccctgggttgccacccatttgcagcccctatatccaaaaccatttacattatgatttataacagtagcagcattagttgtgaaatagcaaagattttatggttgggggttaccaccacaaagggtcgcagcagcaggaagtttgagaaccctgcaccacagggtccatctcacacctgcctctgccaccattgttcccaaaactgactggaaactgagcttttgaaactgtctcgatgtggtgcttgagggccagattgacagtagcagaattactggaatggatgctctagtgacatctgcatttgtacaggggcggggttgggcggggcggggcggggttgggcagggtgtgttcagagtcactgtacttacagtccagcccagagctgctggcagtcatgcccaggggtctgccttgtgcgtgctagcaaggctgtgctgcagatctcacttcctgccccagagttctgctgtagtatgttcgtttacagtgatagacggttccattgtgtacgacggtctctgactctatgcctacagtatttacagtgtcaaagattaaaagtgtcgcctgtccatttggccgtcactgggaaacagtgcttccaacagtgctctgtacgtaacctgtaagcatttcaaccccgccacgccagtgtggcctggcgttacgttggcgagccatcttgtacgttctcacttggtcctcgttcttctgcgacctgaaatagttgttccctctgctctgggagctggcggctggggaacagcagcagcttgtcttgtaaggtcctgccaggagggcaacaagtgactataaggaggctgttagtgagcctctgacagcttgtgaacttgctgtaattaaaacaaaaacttccctgttaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1887 - DNA, 2633 bp, Rattus norvegicus
  Genbank Accession No. NM_013174
gccaagcagcgttgggcgatatcagatatccgttctatttatttttacctaaggaaaaactccagctctcttcccactcccagctgccttgccacccctcccaaccctcggcttgccctccacctggcctgctgggagtcagagcccggcagaacctgtttagacatatggacaagaatcccagcgctacacagcacacagtccgctacttcgtcccggggttgccagcgcttcctgggagtcctgaagctcacacagcgcagtgagttcatgcaccctcttgccaagcctcagtctttgggatctggggaggacgcctggttttcctccccctttctactggggtctcctccttgccaggcctccccagtcccctggcctcgttcctgggttcacacatgaagatgcacttacaaagggctctggtggtcctggccctgctgaacttggccacagtcagcctctctctgtccacttgcaccaccttggacttcggccacatcaagaagaagagggtggaagccattaggggacagatcttgagcaagctcaggctcaccagcccccctgagccgtcggtgatgacccacgtcccctatcaggtcctggcactttacaacagcacccgggagttgctggaagagatgcacggggagagggaagaaggctgcactcaggaaacctcggagtcagagtactatgccaaagagatccataaattcgacatgatccaggggctggcggagcacaatgaactggcagtctgccccaagggaattacctctaaggttttccgtttcaatgtgtcctcagtggagaaaaatggaaccaatctgttccgggcggagttccgggtcttgcgggtgcccaaccccagctccaagcgcacagagcagagaatcgagctcttccagatacttcgacctgatgaacacatagccaagcagcgctacataggtggcaagaatctgcccacgagaggcaccgcagagtggctgtccttcgatgtcactgacactgtgcgcgagtggctgttgcggagagagtccaacttgggtctggaaatcagcatccactgtccatgtcatacctttcagcccaatggagacatactggaaaatgttcacgaggtgatggaaatcaaattcaaaggagtggacaacgaagatgaccatggccgtggagacctggggcgtctcaagaagcagaaggatcaccacaacccgcacctgatcctcatgatgattcctccacaccgactggacagcccaggccagggcgggcagaggaagaagagggccctggacaccaattactgcttccgcaacttggaggagaactgctgtgtgcgccccctctacattgacttccggcaggatctaggctggaaatgggtccacgaacctaagggttactatgccaacttctgctcaggcccttgcccttacctccgcagctcagacacaacccacagcacggtgcttggactatacaacaccctgaacccggaggcatcggcctcgccatgctgtgtgccccaagacctggagcctctgaccatcttgtactatgttggcagaacccccaaggtggagcagctgtccaacatggtggtgaagtcgtgtaagtgcagctgaggccagtctgcaacagaggaggggaaactgccaccaccgactgctgctccttggaaaaccaaagcaacagacctcaccctagagcctggagcccacaagccctggctcccgatggcgaaaggccgagagggaggcttccttctggaacatttctttctgctagctctgagaatcactgtggtaaagaaagtgtgggttggttaggggaaggcaaactggtgagaacatggatttctgtggtgcaggcagaggtggtggggtagagaagagataatgagtggacgttgtgagtggcaaggctccggctaccctagggaagatgaagggcagagtggtcaggtgaaggccagactggaaggcacttcagatatgaggtcagctttgctcatggcagtacatctgctctagggaatcgggatgttgttaaaggcaacagcatttttcttcagtttaccaagccaaagtcccctggaattgtatcttgaactgcctggaattaaggacaatctgttcttttgcaaacagtcttttcacctcgatcagcatcatgagtcattacagataatgtaattagtttctgggccagcaactagctatctcaggtccctcagagatgctggactcaaaggcagaggtcagaattggttctctcatgtattccctcgggccccctccttctgccttccttcttggccgtatttccccttggacatttggctagacaccttccgggtcagggtgcattctctggattctggatcccacacagcctggggcatcagacatcgtttccctcctaccctagaccccgtgcctccccgggtgttcctggaagcaggtgctacatgcaggagttatccggggagcctcccatgtctgacatgatgactcggccccagatgcacagactgaagtatacagacaaatacaaatattactctcagaatctttgtataaataaatatttttggggaatcaaaaaaaaaaaaaaaaaaa

SEQ ID NO: 1888 - DNA, 585 bp, Rattus norvegicus
  Genbank Accession No. NM_013179
ggctcggcggcctcagactccttgggtatttggaccactgcaccgaagataccatctctccggattgcctctccctgagctccagacaccatgaaccttccttctacaaaggttccctgggccgccgtgacgctgctgctgctgctactgctgccgccggcgctgctgtcgcttggggtggacgcgcagcctctgcccgactgctgtcgccagaagacgtgttcctgccgtctctacgaactgttgcacggagctggcaaccacgccgcgggcatcctcactctgggaaagcggcgacctggacccccaggcctccaaggacggctgcagcgcctccttcaggccaacggtaaccacgcagctggcatcctgaccatgggccgccgcgcaggcgcagagctagagccatatccctgccctggtcgccgctgtccgactgcaaccgccaccgctttagcgccccggggcggatccagagtctgaacccgtcttctatccctgtcctagtcctaactttcccctctcctcgccggtccctaggcaataaagacgtttctctgctaaaaaaaaaaaaaaaaaaaaaaa

SEQ ID NO: 1889 - DNA, 1433 bp, Rattus norvegicus
  Genbank Accession No. NM_013181
ggcgttgagggaggcagacgcgaggaggaacggaggagaggcggagatcaccgaacagcagaacaatctagaggatccctcgacacctgagaaccatggcgtctggcagtatggcagccagtgaggaagagcggagtctccgggaatgcgagctctatgtgcagaagcacaacatccaggccctgctgaaggactccatcgtgcagctgtgcactgctcggcccgagaggcccatggcattccttcgggaatactttgagaggctggagaaggaggaggcaagacagattcagagcctacagaaatccggcattcgtacagactcgagggaggatgagatctctcctccacccccaaatccggtggtgaagggccgtcggcgccgcggtgctatcagcgctgaggtttacactgaggaagatgctgcgtcctacgttagaaaggttataccaaaagattataagacaatggctgctttagccaaggccatcgaaaagaacgtgttattttcacaccttgatgacaatgagagaagtgacatttttgatgcaatgtttccagtctcctttattgctggagagacagttattcagcaaggggatgaaggggataacttctatgtgattgatcaaggagaaatggatgtgtatgtcaataatgaatgggcaaccagtgttggggaaggagggagctttggagagctggctttgatttacggaacacccagagcagccactgtcaaagcaaagacaaacgtgaaactgtggggcattgaccgagacagctaccggagaatcctcatgggaagcactctgcgaaagaggaagatgtatgaagaatttcttagtaaagtgtctattttagagtctctggacaagtgggagcgtctcacagtagctgatgcactggagcctgtccagtttgaagatggacagaagattgtggtgcaaggagaaccgggggatgagttcttcattattttagagggcacggccgctgtgctgcagcgtcggtcagaaaacgaagagtttgttgaagtgggacgcctggggccttctgactattttggtgaaattgccctgctgatgaatcgtcctcgggctgccactgtggttgcgcgtggccctttgaagtgcgttaagttggaccgacctcggtttgaacgcgtccttggcccatgctcagatatcctcaagcgaaacatccagcagtacaacagctttgtgtcactgtccgtctgagatccgcctcctgtgcctctcctccccagtctatgcttcactcacgcagactgctttctcctccctctctgcagcgccaagtggccactggcttcacagcttcttgtctctgtatactaaaggttgctttattgcaccattttccattggagcgttactgaatgctcactcacaataaatagagttgtatgg

SEQ ID NO: 1890 - DNA, 1911 bp, Rattus norvegicus
  Genbank Accession No. NM_013185
gaattccggtcgccggtaaaggcggctctgacccgctcggagcgccaacgcagcctccgtagcccgcaagtcttcgtcgcttgctccgggctctcgagtccgggccaccaggggcgcgcgctggggggtcgttcgagctgcgaggatccgggctgcccgcgaggcgaagggcgggtgcccaggatgggatgtgtgaagtccaggttcctccgagaaggaagcaaggcctcaaaaatagagccaaatgccaaccagaaaggccctgtgtatgtgccggatcccacgtcccctaagaagctgggaccgaacagcatcaacagcctgcccccggggttcgtggagggctctgaggacaccattgtggtcgcactgtacgactatgaggccattcaccgtgaagacctcagcttccagaagggagaccagatggtggttctggaggagtctggggagtggtggaaggcccgttccctggctaccaagaaagaaggctatatcccaagcaattatgtagctcgagttaactctttggagactgaggagtggttcttcaagggtatcagccggaaggatgcagagcgccacctgctggctcccgggaacatgctgggctccttcatgatccgggacagtgagaccaccaaagggagctactcactttctgttcgagactttgacccccagcacggagacacggtgaagcattataaaatccggacactggacagtggagggttctacatctctccgaggagcaccttcagcagcctgcaggaacttgtcgtccactacaagaaggggaaggatgggctctgccagaagctgtcagtgccctgtgtgtctccgaaaccccagaagccatgggagaaagatgcctgggagattcctcgagaatccctgcagatggagaagaaactgggagccgggcagtttggagaagtgtggatggccacctacaacaagcacaccaaagtggcggtgaagacaatgaagccagggagcatgtctgtggaggccttcctggcagaggccaacctgatgaagacgttacagcatgataaactggtgaagctacacgctgtggtctctcaggagcccatctttattgtcaccgagttcatggccaaaggaagcctgctggactttctcaagagtgaagaaggcagcaagcagccactgccaaaactcattgacttctcagcccagatttcagagggcatggctttcattgagcagaggaactacatccaccgagacctccgggctgccaacatcttggtttctgcatcactggtgtgtaagatcgctgactttggactggcacggatcatcgaggacaatgagtacacagctcgggaaggagccaagttccccatcaagtggacagctcctgaagccatcaactttggctccttcaccatcaagtcagatgtctggtcctttggtatcctgctgatggaaatcgtcacctacggccggatcccttacccaggtatgtcaaacccagaggtgattcgagcactagagcatgggtaccgtatgcctcgaccagataactgcccagaggagctctacagtatcatgatccgctgctggaagaaccgtccagaggaacggcccactttcgaatacatccagagcgtgctggatgacttctacacggccactgagagccagtatcagcagcaaccttgatgggccggaagaacatgagcacagccagaagccccatcagggccttgacatgctcgacctgctgggcccactctcagacgccccctcccccacattccagctgtcgagtggagggagaggacttcacaatctctttttgactctagtcatctgcaatctgccattctcagggcctccaagttagtgtttctcatttgcctggaatgaactgaattc

SEQ ID NO: 1891 - DNA, 5106 bp, Rattus norvegicus
  Genbank Accession No. NM_013187
cgctcgcctcccgggccgccgccgccgcctccgcctccgcctccgcctccgccgccccgggcccgccggcttgcgtcgccgaggtcgctgcagcatggcgggcgtcgggaccccctgcgccaacggctgcgggcccagcgcgccctccgaagcggaggtgctgcacctctgccgcagcctcgaggtgggcaccgtcatgactttgttctactccaagaagtcgcagcggccagaacggaagaccttccaggtcaagttggagacgcgccagatcacatggagccgcggtgcggacaaaatcgaggggtccatcgatatccgagaaatcaaggagatccgcccagggaagacttcccgggactttgaccgctaccaagaagaccctgccttccggccagatcagtcacactgttttgtcatcctctatggaatggaattccgcctgaagaccctgagcctgcaagccacatctgaggatgaagtgaacatgtggatcaagggcttaacttggctcatggaagatacgctgcaggcggccacacccctgcaaattgagagatggctccggaagcagttctactcagtggatcgtaaccgagaggatcgtatatcagccaaggacctgaagaacatgctgtcacaggtcaactaccgggtccccaacatgcgcttcctccgagagcggctgacggactttgaacagcgcagcggggacatcacctatgggcagtttgctcagctttaccgcagcctcatgtacagcgcccagaagacgatggaccttccgttcttggaaaccaacactttgaggactggagagcggccagagctttgccaggtgtccctttctgagttccagcagttccttcttgagtaccagggggagctgtgggctgtcgaccggcttcaggtgcaggaatttatgctcagcttccttcgagaccccttgcgagagattgaggagccatacttcttcttggatgagcttgtcacctttctgttctccaaagagaacagtgtgtggaactcacagctggatgccgtgtgcccagaaaccatgaacaacccactgtctcactattggatctcttcctcgcataatacgtatctgactggggaccagttctccagcgagtcctccctggaagcctacgctcgctgcctgaggatgggctgtcgctgcatcgagttggactgctgggatgggccagatgggatgccagtcatttaccatgggcacaccctcaccaccaagattaagttctcagatgtcctgcacaccatcaaggagcacgcgttcgtagcctcagagtaccctgtcatcctgtccatcgaggaccactgcagcattgcccagcagaggaacatggcccagcacttcaggaaggtgctcggtgacacgctcctcaccaagcccgtggacattgccgctgatgggctcccttctcccaaccagctcaagaggaagatcctgattaagcataagaagctggctgagggcagtgcctatgaggaggtgcctacctctgtgatgtactctgagaatgacatcagtaactccatcaagaatggtatcctctacttggaggaccccgtgaatcatgagtggtacccccactactttgttctgactagcagcaagatctactactctgaggagaccagcagtgaccagggaaatgaggatgaagaggagccgaaggaggccagtggcagcacagagctgcactcgagcgagaagtggttccacgggaagctcggggctgggcgcgacgggcggcacattgctgagcgcctgctcaccgagtactgcatagagactggggctcccgatggctccttcctagtgcgagaaagtgagaccttcgtgggggactacacgctgtctttttggcggaatgggaaagtccagcactgccgtatccactcccggcaggatgctgggactcctaagttcttcttgacagataaccttgtctttgactctctctatgacctcatcacacattatcagcaagtgcccctgcgctgcaatgagtttgagatgcgcctttcagagcctgttccacagacgaatgcccatgagagcaaagagtggtaccacgcaagcctgactagagctcaggctgaacacatgctgatgcgagtaccccgtgatggggccttcctggtgcggaagcgcaacgagcccaactcctatgccatctctttccgggctgagggaaagatcaagcactgccgagtacagcaggaaggccagactgtgatgctggggaactctgagtttgacagcctggtcgacctcatcagctactatgagaagcatcccctgtaccgcaaaatgaaactgcgctaccccatcaacgaggaggcgctggagaagattgggacagctgaacccgattatggggcactgtatgagggccgcaaccctggtttctatgtggaggccaaccctatgccaactttcaagtgtgcagtaaaagctctcttcgactacaaggcccagagagaggatgagctgacttttaccaagagcgccatcatccagaatgtggaaaagcaagatggtggctggtggcgtggggactatggtgggaagaagcagctgtggttcccctcaaactatgtggaagagatgatcaatccagcaatcctagagccggagagggagcatctggatgagaacagcccactgggggacttgctgcgaggggtcttagatgtgccagcctgccagatcgccattcgtcctgagggcaaaaacaaccggctcttcgtcttctccatcagcatgccgtcagtggctcagtggtccctagacgttgccgctgactcacaggaggagttgcaggactgggtgaaaaagatccgtgaagttgcccagactgcagatgccaggcttactgaggggaagatgatggagaggaggaagaagatcgccttggagctctccgagctcgtggtctactgccggcctgttccctttgacgaagagaagattggcacagaacgcgcttgttaccgggacatgtcctcctttccggaaaccaaggctgagaagtatgtgaacaaggccaaaggcaagaagttcctccagtacaaccggctgcagctctctcgcatctaccctaagggtcagaggctggactcctccaattatgaccctctgcccatgtggatctgtggcagccagcttgtagctctcaattttcagaccccagacaagcctatgcagatgaaccaggccctcttcatggctggtggacactgtggctatgtgctgcagccaagcaccatgagagatgaagcctttgacccctttgataagagcagtctccgaggtctggagccctgtgtcatttgcattgaggtgctgggggccaggcatctgccgaagaatggccggggtattgtgtgtcctttcgtggagattgaagtggctggggcagagtacgacagcaccaagcagaagacagagtttgtagtggacaatggactgaaccctgtgtggcctgcaaagcccttccacttccagatcagtaacccagagtttgcctttctgcgctttgtggtgtatgaggaagacatgtttagtgaccagaacttcttggctcaggctactttcccagtaaaaggcctgaagacaggatacagagcagtgcctttgaagaacaactacagtgaagacctggagttggcctccctgctcatcaagattgacattttccctgctaaggagaatggtgacctcagccctttcagtggtacatccctaagggaacgggcctcagatgcctccagccagctgttccatgtccgggcccgggaagggtcctttgaagccagataccagcagccatttgaagacttccgcatctcgcaggagcatctcgcagaccattttgacagtcgggaacgaagggccccaagaaggactcgggtcaatggagacaaccgcctctagtcatgcccctaccttgttggagagcagcagcgctgccacctgtggaatgccatgaactgggttctctgggagcggtctactgtaaagccttcctggtctcacagcctggagcctggattccagcggtgaaggctagacaaaaccaagccattaatgagatgtactgttttgggcctccatgcccagctctgggtgaaggcaaaaaactgtactgtgtctcgcattaagcacacacatctggccctgaatgtggaggtgggtccctccatcttgggccaggactagggctgaagccccttggaaagagaagttgcctcagttggtggcataggaagcttcaaggagctgctgacacattcctgaaagaggaagaggaggaggaggaagagccttgctgggccaggggaacaaagtttacattgtcctgtagctttaaaaccacagctggtcagggtgaaagagtagatgccctgaggcttggccctggagccaggtcagaggaatgcagggcctgtaaggagaaggctctgctctgcctgaggaggaagacagcacaagggcacattgccaccgtgggtatactacccagcctgaaagatacaggggatcatgataaatagcagtattatttttttttttcttctcagtggtattgtgactaagttattctgtcctgctcctcaccttggaagggaagacccagcacagagcctttaggaacagcagctctatggggtgttgttactggaagagggcactgtccagaagggtggaggggcagaaagagagaaaatcgatgtctaccctggtgagcgtttttgtttttatggcaaggaaggctcattatgctctcccaaaggaatggagacatgggtaagtggagtcaggcagtaggcaccaaatgaagctgctgcttggtagtctctgtgtggttggtaaaaagatgcaaaggagatgggaaggtaagcctcacctctgaggacagggtggggtccaggcctgtgggtgcaaaggtgcctcagcatagccagcattcagcacacgcaaacccactgcccacatttgggctcagggttggccatttgctagttctgctgccctcttaagatctgactgccaaataaatcatcctcatgtcc

SEQ ID NO: 1892 - DNA, 6060 bp, Rattus norvegicus
  Genbank Accession No. NM_013194
tcctggctataagtcaccatggcccagcaggctgcagacaagtacctctatgtggataaaaacttcatcaataacccgctggcccaggccgactgcggtgccaagaagctggtatgggtgccttccaccaagaatggctttgaaccagccagccttaaggaggaggtgggagaagaggccattgtggagctggtggagaatgggaagaaggtgaaggtgaacaaggatgatatccagaagatgaacccacccaagttctccaaggtggaggacatggcagagctcacgtgcctcaacgaagcctcggtgctgcacaacctcaaggagcgatactactcagggctcatctatacctattcaggcctgttctgtgtggtcattaatccttataagaacctgcctatctactcagaggagatcgtggacatgtacaagggcaagaagaggcacgagatgccgccccacatctatgccatcacagacactgcctacaggagcatgatgcaggaccgagaagatcagtccatcctttgcacgggtgagtctggagcaggcaagacagagaacaccaagaaagtcattcagtacctggcacatgtggcctcctcacacaagagcaagaaggaccagggggagctggagcgccaactgctgcaggccaaccctatcctagaggcctttggaaacgccaagacggtgaagaatgacaactcttcacgatttggtaaattcattcgtatcaactttgatgtcaacggctacatcgttggggccaacattgagacttatcttctggagaaatctcgtgctatccgccaagccaaggaggaaagaaccttccacattttttactacctgctgtctggggccggagagcacctgaagactgatctcctgttggagccatacaataaataccgcttcctgtccaacgggcatgtcaccatcccagggcagcaggacaaggacatgttccaggagacaatggaggccatgaggattatgggtatcccagaggatgagcagatgggcttgctgcgggtcatctctggcgtccttcagcttggcaacattgtcttcaagaaggaacggaacactgaccaggcgtccatgccagataacacagctgctcaaaaggtgtcccacctcctggggatcaatgtgaccgacttcaccagaggcatccttaccccgcgcatcaaggtgggcagagactatgtgcagaaggcacagactaaagagcaggctgactttgccatcgaggctttggccaaggctacctacgagcggatgttccgctggctggtgcttcgcattaacaaagctctggacaagaccaagaggcagggcgcctcatttatcgggatcctggacatcgctggcttcgagatctttgatctgaactccttcgagcaactttgcatcaactataccaacgagaagctgcagcagctgttcaaccacaccatgttcatcctggagcaggaggagtaccagcgagagggcatcgagtggaacttcatcgactttggccttgacctgcagccttgcatcgacctcattgagaagccggcgggtcccccaggcatcctggccctgttagatgaggaatgttggttccctaaagccactgacaagagcttcgtggagaaggtggtgcaggagcagggcacccaccccaagttccagaagcccaagcaactgaaggacaaggctgatttctgcatcatccactatgcaggcaaggtggactataaggccgatgagtggctgatgaagaacatggaccctctgaacgacaacattgccaccctgcttcaccagtcctcagacaagtttgtctctgagctgtggaaggatgtggatcgaatcattggcttggaccaggtggctggaatgtctgagacagcgctacccggtgccttcaagactcggaagggcatgttccgtactgtggggcagctgtacaaggagcagctggccaagctcatggccacactgaggaataccaaccccaactttgtctgctgcatcattcccaaccacgagaagaaggccggcaaactggacccacacctggtgctggaccagttacgctgcaatggcgtccttgaaggcatccgaatctgccgccagggctttcccaacagagtggtcttccaggagttccggcagaggtatgagatcctcacacctaactccattccgaagggcttcatggatgggaagcaggcgtgtgtgctcatgatcaaagccttggagcttgacagcaacctgtaccgcatcggccagagcaaagtgttcttccgttccggagtcctagctcacctggaggaagagcgggacctgaagatcactgatgtcatcattggcttccaggcctgctgcagaggctacctggccaggaaggcctttgccaagaggcagcagcagctgactgccatgaaggtcctacagaggaactgtgctgcatacctcagactccggaactggcagtggtggaggctcttcaccaaggtcaagcccctgctgaactcaataaggcatgaggatgagcttttagccaaggaggcggaactgacaaaagttcgagagaagcatctggctgcagagaacaggctgacagagatggagactatgcagtctcagctcatggcagagaagttgcagcttcaggagcagctgcaggcgaaaaccgagttgtgtgctgaggctgaggagctccgggcccgcctgacagcgaagaagcaggagttggaggagatctgccatgacctggaggccagggtagaggaggaggaggagcgctgccagtatctgcaggcagagaagaagaagatgcagcagaacatccaggaactcgaggagcagctggaggaggaggagagtgcccggcagaagctgcagcttgagaaggtgaccactgaggccaagctgaagaaactggaggaggaccagatcatcatggaggatcaaaactgcaaactggccaaggagaagaagctgctggaagacagagtagctgaatttactacagacctcatggaagaggaggagaagtccaagagcctggccaagctcaagaacaagcatgaggcgatgatcaccgacctggaagagcgccttcgtagggaggagaagcaaaggcaggagttggagaagacccgccgcaagctagagggagactccacagacctcagcgaccagattgctgagctccaggcgcagatcgcagagctcaagatgcagctggccaagaaggaggaggaattgcaggctgccttggccagagtggaagaagaagctgctcagaagaacatggccctgaagaagattcgagaactggaaactcagatctctgagctgcaggaagacctggagtcggagcgtgcctgcaggaacaaagctgagaagcagaaacgggatcttggagaagagctagaggctctgaagacagagctggaggacactctggactccaccgctgcccagcaggaactgaggtcaaagcgtgagcaggaagtgagcatcctgaagaagactcttgaggatgaggccaagacccatgaggcccagatccaggagatgaggcagaagcactcgcaggccgtggaggagctggccgagcaattggagcagactaagcgggtaaaagctacccttgagaaggctaagcagaccctggagaatgagcggggagagctggccaatgaggtgaaggccttgctgcagggcaagggcgactcggagcacaagcgcaagaaggtggaggcgcagctgcaagaactgcaggtcaagttcagcgagggagagcgtgtacggaccgagctggctgacaaggtctccaagctgcaggttgaactggacagcgtgaccggtctccttaaccagtcggacagcaagtccagcaagcttacaaaggacttctctgcgctggagtcccagctccaggacacacaggagctgctccaggaggagaaccggcagaagctgagcctcagcaccaagctcaagcagatggaggatgagaaaaactccttcagagagcagctggaggaggaagaggaggaggccaagcgcaacctggagaagcagatcgccaccctccatgcccaggtgactgatatgaagaagaagatggaggacggtgtagggtgcctggagacagcagaggaggcaaagcggaggcttcagaaggacctggaaggcctgagccagcggcttgaggagaaggtggctgcctatgataagctggagaagaccaagacccggcttcagcaggagctggatgacctgctggtggacctggaccaccagcggcagagcgtctccaacctggaaaagaagcagaagaagtttgaccagctcctagctgaggagaagaccatctcagccaagtatgctgaggagcgagaccgagctgaagctgaggcccgtgagaaggagacaaaggcactgtcactggcccgagcacttgaggaggccatggagcagaaggcagagctagaacggctcaacaagcagttccgcacggagatggaggacctcatgagctccaaggatgacgtgggcaagagtgtccatgagctggagaagtccaacagggcattggagcagcaggtcgaggagatgaagacccagctggaggagctggaggatgagcttcaggccactgaggatgccaagctccgtctggaggtgaacctgcaggccatgaaggcccagtttgagcgggatctgcagggccgggatgaacagagcgaggagaagaagaagcagctggtcagacaggtgcgggagatggaggcggagctggaggatgagaggaagcagcggtccattgccatggctgctcgcaagaaactagagatggatctgaaggacctggaggctcacatagacacagccaacaagaaccgggaggaggccatcaaacagctacggaagcttcaggcccagatgaaggactgcatgcgggacgtggacgacacgcgagcctcccgggaggagatcctggcccaggccaaggagaatgagaagaagctcaagagcatggaggccgagatgattcagctgcaggaggaactggcagccgccgagcgtgctaaacgccaggcccagcaggagcgggatgagctggccgatgagatcgccaacagcagtggcaaaggggccctagcattggaggagaagcggcgactagaggccctcattgccctgctggaggaagagctggaggaggagcagggcaacacagaactgatcaacgaccggctgaagaaggccaatctgcagatcgaccaaataaacaccgacctgaacctggagcgcagccacgcccagaagaacgagaatgcgcggcagcagctggaacgccagaacaaggagctcaaggccaagctgcaggagatggagagtgctgtcaagtccaaatacaaggcctccatcgctgccttggaggccaagattgcacagctggaggagcagctggacaacgagaccaaggagcgccaggcagcctccaagcaggtgcgccgggcggagaagaagctgaaggatgtgctgctgcaagtggaagacgagcggaggaacgcggagcagttcaaggaccaggccgacaaggcatccactcgcctgaagcagcttaagcggcagctagaggaggccgaggaggaggcccagcgggccaatgcctcccgccggaagctgcagcgtgagctggaggatgccacagagactgccgatgctatgaaccgagaggtcagctccctgaagaacaaactgaggcgtggggacatgccatttgttgtgacccgccgaattgtccggaaaggcactggcgactgctcagacgaggaggtcgacggtaaagcagacggggctgatgccaaggcgaccgagtagggacttctgctacccaagacggatggacagacggctccacctcccttccccagccctccacacccctgccttgagactgctctgcccatgcccctcttcctcccaggccttcttgagggcattggcttcctctgctgcatccccttccagctccct

SEQ ID NO: 1893 - DNA, 2598 bp, Rattus norvegicus
  Genbank Accession No. NM_013195
ggagcaggagatggccgtggacccagtctccagtaggactgcagggaacatatcgtcacaactccatgttgcagccagggcttgtgtcctcagctctgcctctcggatgtgatggccaccgtagacctttcgtggcgtctgcccctctacatcctcctcttgctcctggctacaacttgggtgtctgcagcagtgaacgactgttcccatcttaagtgcttctacaactcaagagccaatgtctcctgcatgtggagccctgaagaggccctgaacgtcacatcctgtcacatccatgccaagtcggatatgcgacactggaataaaacctgtgagctaacccctgtgaggcaggcatcctgggcctgcaacctgattctcgggcccctcccagattcccagtcactgacctccgtagacctcctcagcctaagtgtggtgtgctgggaagagaaggggtggcgtagggtgaagacctgcaccttccatccctttgacaaccttcgcctgattgcccctcattccctacaagtcctgcacattgaaacccggagatgtaacataagctgggaggtgtcccaggtctctcactacgttaatccatacttggaatttgaggcccgtagacgtcttctggaccgtagctgggaggatgcatccgtattcagcctcaagcagaggcagcagtggatcttcttggagacgctgacccctgacacctcatatgagctccaggtgagggtcatagctcaacgtggcaaaaccaggacctggagcccctggagccagcccatggcctttcggacaaggccagcagatcctaaggagatcttccccctgccatggctcagatgccttctactggtcctcggctgcttctttggcttcttgtcctgcgtctgcgttttggtcaagtgccgctaccttgggccatggctgaagacacttctcaagtgccacatcccagatccgtctgagttcttctcccaactgagctcccagcatgggggagaccttcagaaatggctctcctcgcctgtcccccaatccttcttcagccccactggctctgcacctgagatctccccactggaagtgcttgacagagattccaagaccatgcagatgctcctgtttcagaaggagaaggcctcttcaccctcgcccagtggccactcacaggccagctgcttcaccaaccaaggttacttcttcttccatttgtccaatgccttggagatcgagtcctgccaggtgtacttcacctatgacccctgcatggaggaggatgtggaggaagatgggccaaggctgcccgaggaatctcccctcccacctctgctgcctttcactggagaacaggatgactactgtgccttcccgcccagggatgacctgctgctcttctccccaagcatgagcacccccaacactgcctatgggaacagcataaccccggaagaaaggcctcccctctccctgcaggaggggctgccctccctagcatcccctgacctgatgggcttacagcaccctctggagctggagctgggagatgatggagaagggatgtctaccaatagctctgggcaacaggccagtgtcccggaagcagctctcatgggcacgaccaagacagaggccaggcctgtcctgactctaaacactgatgcctatctgtctcttcaagaactacaggcccaagattcagcccacctaatataggaggggtgaccaggactgggatctagctacctgaggtcaggtcaggcttgagggagattgcttaaggagtctcttgaggacagtccactattaagggatgtctctggttatccccacccgcaaacttagtcatccacttctgacctccacttgatgcttcctggtctaaccagggtttggggtggggagcggtggtcagttccaccctctatttagtcatgaggtctatagcttcctgtacctgcctcactctctcgtcgtgaccttcacagggcagccagaacttgcttcccaaatacaaatgcaaccttgctctcttctatcctgagcttgctgtggctccctaccactctctgccccatttctggtcccaactcttgccccgtcagcactgctgtgggtcagctgtcctcaggatgtgatctggctgtacactgtcttaatcagggcggctttgacaagccaaacgaagagatcctgataagactgggtgcagcctgttgacggttgagggtccctgatagaaggaggggatgggaaggatcataaatccaccacctgagaaatcttagccactttcctgcacccacccccaaacagtgtaactcgtcccctggtgcagtcattattttatgtgttcttggaagatgctggtatatgtagaggggatgaattgaagtgagggctccatctatgttgctttggggaccttgtcgtctactctgggcgggttttctgtgaagcagcttctttggatttattcacctgtcagtaagcctgacagactcagaggttcaccaagatggacttgagtgtacttgtgcctttgatgtcgtatctgggagaagtacttacttgttaatgtatctcccg

SEQ ID NO: 1894 - DNA, 1899 bp, Rattus norvegicus
  Genbank Accession No. NM_013197
gactttgggctcaggatggtggcagcagctatgttgctacggtcctgtccagtgctctctaagggccccacaggcctcctaggcaaagtggctaaaacttaccagttcctatttggtattggacgctgccccatcctggccactcaaggaccaacctgttctcaaatccatcttaaggcaaccaaggctggagcagactctccgtcttggactaagagccattgtcctttcatgctgtcagaactccaagacaggaagagcaagattgtgcagagggcagctccagaagtccaagaggatgtcaagactttcaagacagacctgctgagcttcatggagtcaactacccgaagccaatcagtgcctcgtttccaggatccagagcagactggaggggcacctcccctgctgattcagaataatatgactggaagccaggcttttggttatgaccaattttttagagacaagatcatggaaaagaagcaggaccacacataccgtgtgttcaagactgtgaatcgctgggctaatgcctacccctttgcccaacacttctccgaggcatctatggactcaaaggatgtttctgtctggtgcagtaatgactatttgggcataagcaggcaccctcgtgtcttgcaggccatagaggagaccctgaagaatcatggagctggagctgggggcactcgcaatatctcaggtacaagcaagtttcatgtggagcttgaacaggagctggctgaactacatcataaggactcggctctgctcttctcctcctgttttgtggccaatgattctactctctttacactggccaagcttctgccagggtgtgagatctactcagacgcaggcaatcatgcctccatgatccaaggcattcgtaacagtggtgcagtcaagtttgtcttcagacacaatgacccaggccacctgaagaaacttcttgagaagtccgatcccaagacaccaaaaattgtggcttttgagactgttcactccatggatggtgccatctgtcctctggaggaattgtgtgatgtggcccaccagtacggggccctgaccttcgtggatgaagtccatgccgtaggactatatggaacccggggtgcagggatcggggagcgtgatggaattatgcacaagcttgacatcatctctggaactcttggcaaggcctttggctgtgtcggtggctatatcgccagcactcgggacttggtggacatggtgcgctcctacgctgcaggcttcatctttaccacttcactgcctcccatggtgctctctggagctctagagtctgtgcgtctactcaagggagaggagggtcaagccctgaggcgtgcacaccagcgcaacgtcaaacatatgcgccagctactaatggacaggggctttcctgttatcccctgtcccagccacatcatccccataagggtgggtaatgcggcactcaacagcaagatctgtgatcttctgctcgccaagcacagcatctatgtgcaggccatcaactacccaactgtgcctcgtggtgaggagctgctgcgcttggccccctccccccaccacagccctcagatgatggaaaactttgtggagaagttgctgctggcctggactgaggtggggttgcccctccaagatgtgtctgtggctgcatgcaacttctgccgtcgtcctgtgcactttgagcttatgagcgagtgggagcgatcctactttgggaacatgggaccccaatatgttactacctatgcctaaggagccagctgccttagatgccaaccccacctgcactccccctggggatggtcttcctcctactctctgctttgctgtgtgcttctagctgacttgattctaaaaataaagagcaacctg

SEQ ID NO: 1895 - DNA, 3463 bp, Rattus norvegicus
  Genbank Accession No. NM_013199
cggtgaggggagccgggcgggtggcagagcagagcaggaggaagcaacggccacagacgcatcgggaccgcgagtcgtagtcgggggatccgcggggcggaggcgggcaccatgggcaaccgcgggatggaagagctcatcccgctggttaacaagctgcaggacgccttcagctccatcggtcagagctgccacctggacctgccgcagatcgccgtggtgggcggccagagcgccggcaagagttcggtgctcgagaacttcgtgggccgggacttccttccacgaggatcaggaattgtcacccggaggcctctcattctgcagctcatcttttccaaaacagaatatgcggagtttttgcactgcaagtccaaaaagtttacagactttgatgaagtccggcaggagatcgaagcagagactgaccgggtcacaggcaccaacaaaggcatctccccggtgcccatcaaccttcgggtctattcaccacacgtgttgaacttgaccctcatcgacctcccaggcatcactaaggtgccagttggggaccagccaccagacatcgagtaccagatcaaggacatgatcctgcagtttatcagccgggagagcagcctcattcttgccgtcacacctgccaacatggacttggccaactcggatgccctcaagctggccaaggaggtggacccccaaggcttgcggaccattggtgtcatcaccaagctagacctgatggatgaaggcacagatgccagggatgtcctggagaacaagctcctgcccttgagaagaggctacatcggcgtggttaaccgcagccagaaagacatcgagggcagaaaggacatccgggcagctctggcagctgagaggaaattcttcctctcccacccagcctaccggcacatggctgaccgcatgggtaccccacacttgcagaaaacactgaaccagcaactgaccaaccacatccgggagtcactgccaaccctgcgcagcaagctgcagagccaactgctgtccctggagaaggaagtggaagagtacaagaatttccggcctgacgaccccacacgcaagaccaaagccctgctgcagatggtccagcagtttggagtggactttgagaagcgaatcgaaggctctggagatcaagtcgacaccctggagctgtctgggggcgcccgcatcaatcgcatcttccacgagcgctttccctttgagctggtgaagatggagtttgacgagaaagacctccgaagagagatcagctacgccattaagaacatccacggagtcagaactgggctcttcacgccggatttggcgttcgaggccattgtgaaaaagcaggtggtcaagctgaaagagccctgtctgaaatgcgtggacctggttatccaggagctaatcagtacagttaggcaatgcaccagcaagctcagttcctacccccgccttcgagaggagaccgaacgcattgtcaccacctacatcagggagcgagaagggagaaccaaggaccagatccttcttctgattgacattgagcagtcctacatcaacacaaaccatgaagacttcattggatttgccaatgcccagcagaggagcacgcagctgaacaagaagagggccatacctaaccagggggagatcttggtgatccgcaggggctggttgaccatcaacaacatcagcttgatgaaaggcggttccaaggagtactggttcgtgctgactgctgagtcgttgtcttggtacaaggatgaagaggaaaaagaaaagaagtacatgctgccactagacaacctcaaaatacgggatgtggagaagggcttcatgtccaacaagcatgtgtttgccatcttcaacacagagcagaggaacgtctacaaggacctgcgacagatcgaactggcttgtgactcccaggaagatgtggacagctggaaggcttcgttcctgcgagctggggtctacccagagaaggaccaggcagagaacgaggatggagcacaagagaacaccttctccatggacccgcagctggagcggcaggtggagaccatccgcaacttggtggactcctatgtggccatcatcaacaagtccatccgggacctcatgccaaagaccatcatgcacctcatgatcaacaacacaaaggccttcatccaccatgagctgctagcctacctgtactcatcagcagaccagagcagcctcatggaggagtcagctgagcaggctcagcggcgggacgatatgctgcgcatgtaccatgcactcaaggaagcgctcaacatcattggggacatcagcaccagcaccgtgtccacgcctgtgcccccacctgtcgatgatacttggctccagaacaccagcagccacagccccactccacagcgcagacctgtgtccagtgtgcacccgccgggccgcccacccgcagtgcggggccccacaccggggcctcccctcattcctatgcctgtgggggccacatcctccttctcggcaccccccatcccatcccggcctggaccacagaatgtgtttgccaacaatgaccccttctctgcgccacctcagataccgtctcggccagcacggattccccctgggatccctccaggagtgcccagcagaagagcgcccgctgcgcccagccggcccaccattatccgcccagccgagccgtccctgctcgactaggctgcaggggacagtgttctgggggggtcctcgtgtacctacagtggtctgggccctgctactgccccccatgctgggaccaggctccccgtgggcaagcctgccctctcctccctagccctagtgcacatgataaggagggagagggtgggaaggaggcccaaacaaacagaacttgggggctttgcactttggggcgagggggagctctggttagcagaacagaaactgcacccttgggaccatctggaaagaaaggtctaggctagtggtggggaactctacatgggctcctccatactgtaagcctttgctctttctgaggtacagaactgtccacctttccctaaggactcctcaggagttagccaggcccaggaggtccagtgctggccacccacctggctcaagttgtatatatatatatagcttctttggccacattaaccacacagcctgagcccagcccagtctccacacccagaggtgcctttgtgccttccaggcctggagtgcctcagctctggcctgcctctctcctcagcccctgttgtggtttgggctgtaagaactctggagacatcaggacctcttggcttccaaccagatgtctcctacagggtgggccctggtgcctctgtacagattctgctcccaacgcttggattgaccactgttaagtgcctgcctctgtatatcctattaataaactaaaataaagggaagccctctcgtggct

SEQ ID NO: 1896 - DNA, 2826 bp, Rattus norvegicus
  Genbank Accession No. NM_013200
gacagaagcaaacctgagctgtgctgactaaaccccaggatggcggaagcacaccaggcagtagctttccagttcactgtgaccccagacggggtcgacttccggcttagtcgggaggctctgagacacatctacctgtctggaatcaactcctggaagaaacgccttattcgaatcaagaatggtatccttaggggtgtgtaccctggcagccctaccagctggctggttgttgtcatggcaacagttggttccaactactgcaaagtggacatctccatggggctggtccattgcatccagagatgcctcccgacaaggtatggctcctacgggaccccacagaccgagacacttctcagtatggtcatcttctccaccggagtctgggcgacaggcatttttttattccgacaaaccctgaagctgctgctttcctatcatgggtggatgttcgagatgcacagcaagaccagccatgccaccaagatctgggctatctgtgttcgtctcctgtccagccggcggcccatgctctatagcttccaaacatcactgcccaagcttcctgtccccagtgtgccagccacaattcaccggtacttggattctgtgcggcccttgctggatgacgaagcctatttccgcatggagtcgttggccaaagaattccaggacaagattgcccccagactgcagaaatacctggtgctgaagtcatggtgggcaaccaactatgtaagtgactggtgggaagagtacgtctacctccgaggcaggagccccatcatggtggacagcaactattacgccatggattttgtgcttattaagaacacgagccaacaagcagcacgtttgggaaacaccgttcacgccatgatcatgtatcgccgcaaactggaccgagaagagatcaagccggtgatggcactgggtatggtacccatgtgctcctaccagatggagaggatgttcaacactacacgcatcccaggcaaagagacagacttgctacagcacctctcagagagcaggcacgtggctgtctaccacaaaggtcgcttcttcaaggtttggctctatgagggctcgtgcctgctcaagccccgagacctcgagatgcagttccagagaatcctcgatgacacctccccgcctcagcctggagaggaaaagctggcagccctcaccgcaggaggaagggtagagtgggcagaagcacgtcagaagttctttagctctggcaagaacaagatgtccctggataccatcgaacgtgctgctttctttgtggccctggacgaagactctcactgttacaaccctgatgacgaggccagtctcagcctctacggcaaatccctgctgcacggcaactgctataacaggtggttcgacaaatctttcactctcatctcctgcaagaatggccagctgggcctcaacacagaacactcatgggcagatgctcccatcatcggtcacctctgggagttcgtcctggccactgatacctttcacctgggctacacggagacaggacactgtgtgggtgaacccaacaccaagttgccgccgcctcagcggatgcagtgggacattcccgagcagtgccagacagccatcgagaattcgtaccaagtagccaaggccctggctgatgatgtggagttatactgcttccagttcttacccttcggcaaaggcctgatcaagaagtgtcggaccagccctgatgcctttgtgcagattgccctgcagctggctcatttccgggacaaaggcaagttctgcctgacctatgaggcctccatgacaagaatgttccgagaggggcggacagagactgtgcgttcctgtactagcgagtccacggcctttgtgcgggccatgatgacggggtcccataaggaacaagacctccaagacctcttccggaaagcctccgaaaaacaccaaaacatgtaccgcctagccatgacaggggctgggatcgacaggcacctcttctgcctctacatcgtctccaagtacttaggggttaggtctcctttcctggacgaggtgctttcggaaccctggagcctctccaccagccagatcccccagttccagatctgcatgtttgacccaaagcagtaccccaatcatctgggtgctggaggtggctttggtcctgtggccgaccacggatacggggtttcctacatgatcgcaggcgaaaacacaatgttcttccatgtttccagcaagttatcgagttcagaaacgaacgccctgcgcttcgggaaccacatccgtcaagcactgttggatatcgccgaccttttcaaaatttccaagactgacagctgagaccaggagacacaccagctgccctttggtccccacctggtggaggaagaggtctgtggccagttcacaggcataaggggtggcatgcacacgtgcccagttctgagaccagctccagcgcaggggctccccaggcagacactgctcctccaggcccggtcgaggtgggattggagtggtgagggaactttgatctttttttttcccccggtcttggtagatgctaataaaaataaggctgtataattctctctcagcccttaggtgcctatgtttggttagagaactagaaggcctttcccctgcccctgctcaggttagggtggtggcgactgaagggccgggtgaatgttcataatggctttttacctgctttgaaatgtgtgcttttcctgaataatgcggacttcgagagtgctgtccaacctctcatgtgcacttggaataaattcttactttagaaccttt

SEQ ID NO: 1897 - DNA, 1272 bp, Rattus norvegicus
  Genbank Accession No. NM_013215
gaattcgactgctggaaccaacgtcctctcttaccctccaccttcttctgccacctctaccacggtcaccatgtcgcaagcccggcctgccactgtgctgggtgccatggagatgggtcgccgcatggatgtgacctccagctccgcgtcggtgcgcgccttcctgcagcgcggccacacggagatagacaccgccttcgtgtatgcgaacggtcagtctgagaccatcctaggagacctggggctcggactgggccgcagcggctgcaaagtaaaaattgccaccaaggctgccccaatgtttgggaagacactgaagccagccgatgttcggttccagctggagacgtcactgaagaggctgcagtgtccccgggtggacctcttctatttacactttccagaccacggcactcctatagaggagaccctgcaggcctgccaccagctgcatcaggagggcaagtttgtggagcttggtctgtccaactatgtctcctgggaagtggctgagatttgtaccctctgcaagaaaaatggctggatcatgccaactgtgtaccagggcatgtacaacgccatcaccaggcaggtggagactgagctcttcccctgcctcagacacttcggactaaggttctacgccttcaaccctttggctgggggcctgctgactggcagatataaataccaggataaggatgggaagaatcctgagagccgcttctttgggaatccattttctcaactgtacatggaccgctactggaaggaggaacacttcaatggcatcgccttggtggagaaggctctgaagactacctatggccccactgcccccagtatgatctcagctgccgtacggtggatgtaccatcactcacagctcaagggcacccaaggggatgcagtcattctgggcatgtccagtctggaacaactggagcagaacttggccttggtcgaggaagggcctctggagccagctgttgtggatgcctttgaccaagcctggaacctagttgcccacgagtgtcccaactatttccgctaagatacatctgccttggggatggcgcagcttactgcctgccccgccttgtcctgggctcgatctgatctggttctttcctttttagacaggtcactgtctttttcttccctgctttctatacagccagttgctttcaaagtgagagctggctgagccccaatacctcctgctgaataaaactgttccctgtcacagcctgggctacaactggcggccga

SEQ ID NO: 1898 - DNA, 1088 bp, Rattus norvegicus
  Genbank Accession No. NM_013216
gcgcccgccgccgcgctctgtatgccgcgttcccccggcgcacccgccgccgatagtctgagccggaggagtcgccgccgctgcggttgatgtggttgggccggggctgaccaggctaccaagatgcctcagtccaagtcccggaagatcgccatcctgggctatcggtctgtgggaaagtcctcattgacaattcagtttgttgaaggtcaatttgttgattcctacgatccaaccatagaaaacacattcaccaagctgatcacagtaaatgggcaagagtatcatcttcagcttgtagacacagcagggcaggatgaatattccatttttcctcagacatactccatagatattaatggttatattcttgtgtattctgttacatcaatcaaaagctttgaagtaattaaagttatccacggcaagctgttggacatggtggggaaagtgcagataccgattatgttagtcggaaataagaaggacctgcatatggaaagggtgatcagttatgaagaaggaaaggctttggcagaatcttggaatgcagcttttttggaatcttctgcaaaagaaaatcagactgctgtggatgtttttagaaggataattttggaagcagaaaagattgacggagcggcttcacaagggaagtcttcgtgctcggtgatgtgacgcgcctgctgcagagcctgagtgtattccacctgaggaagcaagctgcctgtcatccttgaagataaaactaggcttctgttttcttctgttaacctgaacgatgtcatttgggtcagaggtcctcccctctcagattatgttaacgtctgactctgtccaaatgagttcacttccattttcaaattttaaacaatcatattttcaatttatatattgtatttcttaatattatgaccaagaattttatcggcattaatttttcagtgtagtttgttgtttaaaataatgtaatcatcaaaatgatacacgttacactactattagctaggcttcagtctatcagtgtttatctccttgtgttaaatgtatacttgtaaataaagtagctgcaaaccttaaaaaaaaaa

SEQ ID NO: 1899 - DNA, 5957 bp, Rattus norvegicus
  Genbank Accession No. NM_013217
cttgcacactgccgtggtttggaagaagcgaacactgaagacgctactgttgttaatgaccatcttcctgctgtcagggtaacctggtccctgacataaggagaccccaggcagggaacgtctccctagagggcagttccccttctggaaggcagaaagcgagcggctgaacgcccgggacacgcagcgggaccgggacagcatcgcggagccagcgggatggagggcgggaggacgcgcggcggctgcggcggcggcggtggtggtggtgaggcggcctgaggtgttccggcccagcgggtcgcggagaggagccgccgcgatcatgtcggcgggcggccgcgacgaagagcggcggaagctggccgacatcattcaccactggaacgccaaccggctggacctgttcgagatcagccagccgaccgaggatttggagtttcatggagtcatgagattttattttcaagataaagctgctggaaactttgcaacaaaatgtattcgggtctctagcacagcaaccactcaagatgtcattgaaacactggcagagaagttccgccctgatatgcgcatgctctcctctcccaagtactccctctatgaagtgcatgtcagtggagaaagaagattggacattgatgagaaacctctagttgtacagttgaattggaacaaagatgatcgggagggtagattcgtccttaagaacgagaatgacgccattcctgccaagaaggctcagagtaatggacctgagaagcaggagaaagaaggtgttattcagaacttcaaaagaactctgtcaaagaaagaaaagaaggaaaaaaagaagagagagaaggaggctttgagacaagcctctgataaggaagaaaggccttctcaaggggatgacagtgagaattctcgtctggctgctgaagtttacaaagacatgcctgaaaccagctttactcgaacgatttctaatcctgaagttgttatgaaacggcggcggcagcaaaaactggagaagagaatgcaagagtttcggagctcagatgggcggcccgactcgggtggaacactgagaatctatgcagacagtttaaaaccaaatattccatacaagacaatcctgctgtctactacagatcctgcagactttgctgtagcagagtccttagagaagtatggtctggaaaaagagaaccccaaggactactgcattgctcgggttatgcttcctcctggagcccagcattctgatgagagaggtgctaaggaaataattcttgatgacgatgaatgccctttacaaatcttcagggaatggccaagtgacaaagggattttagtctttcagttgaagaggagaccaccggactacattccaaagaaaatgaagaaacatgttgaaggcaagccattgaaggggaaagatagagctgacgggtctggctacggctctgctcttcctcctgagaagctgccctacttagtagagctcagcccagggagaaggaatcactttgcctactacagctatcacacttacgaagatggctctgactccagagacaagccaaagttataccgccttcagttaagtgtgactgaagttgggacagagaagttcgatgacaattctattcagctgtttggtcctggaattcagccccatcactgtgatctcaccaacatggatggagtggtcactgtgacacccagaagtatggatgcagagacctatgtggatggtcagcgcatctcagagaccacaatgctacagagtggcatgagactgcagtttggcacctcgcatgtgtttaagtttgtggaccccatccaggaccacgttctttccaagagatctgtggatggaggcctgatggtcaagggcccaagacataaacctggagccgttcaagagacaacctttgaattgggaggagatatccacagtgggacagcattgccggcaagcaggagcactactagattggacagtgacagggtgtcctctgcctctagcacagctgagcgagggatggtgaagccaatgatccgactggaccaggagcaggactaccggcgaagagaaagcaggactcaggatgctgctgggcctgaactgatgctgcctgccagcattgaattccgggaaagctctgaagactcttttttatctgccattataaactataccaatagctctacagttcattttaagttgtcacctacatatgtgttatacatggcatgccggtatgtattgtccagccagcacaggcccgacatcagtcctacagagcggacacataaggccattgctgttgtgaacaagatggtgagcatgatggaaggggtcatccaggaagtagaccaggttgatcagaaacagaagaacattgcaggagcacttgctttctggatggcaaatgcatctgagcttctcaacttcatcaagcaggaccgagaccttagtcggattactctggatgcccaggatgttctagcacacttggttcagatggcatttaagtacttggttcactgccttcagtcagaacttaataactacatgccagcctttctggatgatcccgaggagaacagtctgcagagaccaaaaatagatgatgtgctgcatacgctcacaggagccatgtccttgttgcggcgctgcagagtcaatgccgccttgaccatccagctgttctctcagcttttccacttcatcaatatgtggctattcaacagactggtgactgacccagattcaggcctgtgttcccactactggggcgcaattatccgccagcagctggggcatattgaagcttgggcagagaagcagggactagagttggcagctgactgtcacttgagcaggatcgtgcaggctactacgttgcttacaatggataagtatgtacctgatgacattccaaatataaacagcacatgctttaagttaaattctctgcagcttcaagccctcttacagaattaccactgtgcacctgatgagccttttattcctacggatctcatagaaaatgtcgtggctgttgctgagaacacagctgatgagcttgcccgcagtgatggcagagatgtgcagttagaggaggaccctgatctacaactgccctttcttctgccagaagatggctattcctgtgatgttgtcagaaacattccaaatggtttacaagaatttttagaccctctgtgccagagaggattttgcaggttggttcctcacacacgttctccaggtacctggacaatatattttgaaggagcagattatgaaagtcacctcatgcgtgagaacacagaactgacccagcctctgaggaaggagcctgaggtaatcactgtgaccctgaagaagcagaatggaatgggcctcagcattgttgcagcaaagggtgctggccaggataaactgggaatctacgttaagtccgttgtcaaaggaggtgctgcagatgtggatggacgcctagctgctggtgaccaactccttagtgtggatggacgaagtctggttggactttctcaggaaagggcagcagaactcatgacaagaaccagttccgtggtaacactggaagttgcaaagcaaggcgctatctatcacggactggccactctccttaaccagccatcacccatgatgcagagaatttcagatcgtcgtggctcaggtaaacccagaccaaagagcgaaggttttgagctctataataattcagctcaaaacggctccccagagagtcctcagatgccttggacagagtacagtgagccaaagaagctgcctggtgacgacaggctgatgaaaaacagagctgaccaccgttccagccccaatgtggcaaatcagccccctagtcctggagggaagagtccatatacctctggaacagcagctaaaataacatctgtctctactggaaacctctgcactgaggagcagacccctccacctagacctgaagcctatcctatccctactcagacatataccagagagtattttacctttccagcttcaaagtcgcaggatcggatggctcctgttcaaaaccagtggccaaattatgaggaaaaaccacacatgcacacagaaagtgatcatgccagtattgcaatccagcgtgttacccgttcccaggaagagcttcgggaagagaaggtttaccaacttgagcgtcatcgagtagagtcaggcatggatcgcaagtgtgacagtgatatgtggatcaatcagagctcctcagtggaatctagcacgtctagccaggagcacctgaaccattcctccaagtcagttacccctgcttccactctgaccaagagtggtcctggtcgttggaaaaccccagcagctgtgctccccacccctgtggctgtctcccaacccattcgaacagacctccctccaccaccacctccaccacctgcccactacaccagtgattttgatggtatttcaatggatttgcccctcccacctcctcctgccaaccaagcagctccccagtctgctcaggtggctgctgcagagaggaaaaagagagaggagcatcagaggtggtatgaaaaagagaaggcccgcctggaggaggaacgagagagaaagcgcagggagcaagagaggaagttggggcagatgcgcactcagtccctgaaccctgcttccttctctcctttggccacacaggccaagccagaaaagccttccacactgcagaggccccaagaaacggtcattcgggagctgcagccccagcagcagccccgtactattgagcgcagggatctgcagtacataaccatcagtaaagaggagctgtcctctggggatagtctgtctccagacccatggaaacgagatgccagggagaagctggagaagcaacagcaaatgcacattgtagacatgctaagcaaggagatccatgagctgcaaaacaagggggaccgtactgcagaggagagtgaccgcctgcggaagcttatgctggagtggcagttccagaagagactacaggagtccaagcagaaggatgaggatgatgatgaagaggaagatgatgatgttgacaccatgctgatcatgcagcgactggaggcggagcggagagccaggttgcaggatgaagagcgcaggcgccagcaacagttggaagagatgcgcaaacgagaagttgaagacagagtaagacaagaggaagatggacgccatcaggaggaggagcgagtaaagagagatgctgaagaaaagaggcgacaggaagaagggtattacagccgcctagaagctgagaggcgcagacagcatgaagaggcagcacgcaggttgctggagcccgaagaacccgggctgagccgacctccacttccacaggactacgagcccccatcccagtcctcagcacccagtgcccctcctcccccacctcagcgaaatgcctcctacctcaaaacacaggtcctctccccagactcgctgttcactgccaagtttgttgcgtatgatgatgatgatgaggaggagaactacgtcccagcaggaccaaactcttattcgggatctgctggcacaactgctggaacttatgatgctcctcgggacacaagagaaaaactcagtagaagccaagatgcagacttacctggcagttctggagcccctgaaaacctgacatttagagagcgtcagcgcctcttttcacaaggtcaagatgtgtcagacaaagtgaaagcttctcgtaaattaacagagcttgagaatgaactcaacaccaagtgagaagagagaggtcacctgtactcaagcaggtctgaccttggcagtggatttgtggggtgggcctgaagaggaaggaacaattgtacttctaagtgatgtttaatttctttctgaaatggttgcaattgagagatgttccaaa

SEQ ID NO: 1900 - DNA, 1749 bp, Rattus norvegicus
  Genbank Accession No. NM_013220
cccgggcaggtccaggggttcagccacaagagggaaaaacatagactaacggctgccaacatgatggtttttcgagtagaggagctggtaacgggcaaaaagaacagcaatgggtcctcaggggagttccttcctggcgagttcagaaatggagagtatgaagctgctgttgccttggagaaacaagaggacttgaagacacttccagccaacagtgtgaacctgggggaagaacaacggaaaagtgagaaagttcgagaggcagagctcaaaaagaaaaaactagaacaaagatcaaagcttgaaaacttagaagaccttgaaataattgttcaactgaagaaaagaaaaaaatacaagaaaactaaagttccagttgtgaaggaaccggagcctgaaattattactgaacctgtggatgtgccaaggtttctgaaagctgcactggagaacaaactgccagttgtagagaaattcctgtcagacaagaacagccccgacgtctgcgatgagtataaacggaccgctctccatagagcatgcttagaaggacacttggcgatcgtggagaagttaatggaggctggagcccagattgaattccgagatatgctggaatccacagccatccactgggcatgtcgtggaggaaacctggatgtcctgaaactgttgctaaacaaaggtgccaaaatcagtgcccgagacaagctgctcagcacagcgctgcacgtggcggtgaggaccggtcactacgagtgtgctgagcacctcatcgcctgcgaggcggatctcaatgccaaggacagagaaggagacacccctctgcatgatgcggtgaggttgaatcgctacaagatgatccggctcttgatgaccttcggtgcggacctcaatgtcaagaactgtgctgggaagatccctatggatctggtgttgcactggcagaatggaaccaaagcgatattcgacagcctcaaggagaatgcctacaaaaactcgcgcatagctacgttctgaggaaagagactcgacaggagctgttctcagccgttttcaaaacatttcccagcagcggagcaaccagctataacacccagcttttgtttgccagccaaatagggagataagctttaaagacgcttcatggaaggaccctgggttagagatgctaacatgtcctctagcgatgctcaccatttttatctgctcctatttatttatttatttatttcatagcactggtagtcaggttttcatgagcatcattttgggggagcaagacttaatctgtgtgtaacattcggagtcttcccgtggctctaaaaccgcgtgggtgaatggtgtctaatctcccttttgtgtcctcacttgcattaaagctactcaaggtatttttgaaagccaagggttggtcggtcgctgcagcccttctctggattctcactgctgatatccgaatgaagcagcagaaggtgtacaggaatgcagaaggggatgggagcagttctgcaggacctaagccgtggctcgccaggcacccacaggtgtggtttgccggatcacacagtgccgaggtgaaggccacgtcaggagcgtgtgtggagggggatggagggagtaggcaatggggcctcactaacctgaggtcgatgagaggaaaaagtccaaaaggacatgccctgtaaatgtgtaaatggtattgtgttgtatgcatattttatattcctaataaatgcaaactaattc

SEQ ID NO: 1901 - DNA, 2642 bp, Rattus norvegicus
  Genbank Accession No. NM_013221
agtgtgctctaaaggcgacgggtttgtcggagcaccataatatggtgtgggaagtgaagacgaaccagaggcctcatgcagtacagagactcctgctggtgatggacgagagagctacaggagtgagtgactcattggagttgctgcagtgtaatgagaatgtgccgtcctctccaggatacaactcctgtgatgagcacatggagcttgatgaccttcctgaacttcaggctgttcaaagtgaccctacccaatctgccatataccagctcagttcagatgtatctcatcaagaatatccaagaccatcttggagccagaatacctcagacataccggaaaatactcaccgtgaagatgaggtggactggctaacagagttagcaaatattgccactagtccacaaagtccactaatgcagtgctcattttataacagatcatctcctgtacacatcatagctactagcaacagtttacattcctatgcacgcccaccaccagtgtcctctgcaaagagcggaccagccttccctcatgaccactggaaggaagaaacaccagtaagacatgaaagggcaaacagtgagtcagagtcaggaattttctgcatgtcctccctgtcagatgatgatgatctgggctggtgcaattcctggccatcaaccgtttggcattgctttctcaaaggcacacgactgtgcttccataaggaaagcaaaaaggagtggcaagatgttgaagactttgctagagccgccacctgtgatgaggaggagatccaaatgggcactcacaagggctatgggtctgatggtctaaagttgttatcccatgaagagagtgtgtcattcggtgagtctgtactgaagttgacatttgatcctggtacagtagaagatggcttgcttactgtggagtgcaagctggaccaccctttctatgttaaaaataaaggctggtcatcattttatccaagcttgactgtggtacagcacggcattccatgctgtgagattcatattggtgacgtatgtctacctcctggacaccctgatgccattaatttcgatgattcaggtgtttttgatacatttaaaagctatgacttcacacctatggactcttccgcagtctacgttttgagtagtatggctcgccagcgccgcgcatctttgtcttgtggaggacctggtactggtcaagagtttgcaggatctgaattcagtaaaagctgtggttcaccaggatcatcacagctctcctctagttctttatacactaaagctgtcaaaagccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaaaaaaatgaagaacgaggaaaggaggatgtatacattagaagcaaaggctttggctgaagaacaaaagcgtttaaatcccgactgctggaaaaggaaaagaaccaattcaggctctcaacagcactaaacctgatgcttctgtctgtaagtctgtaccttgcatcagtactgactctgtacctgcataaggactgactctggacggaaaagcttggaagaccttggtctcaccatttgtcctacatttgtgtgaccataaaatgctgggagcattgagttttgtaatgatttaatgggtgaggaggatctgctttctccattagagcattaagtaagctaaaactatcaacattgtaaaccaaattgccttattttccttccaaacttcatatatgtctatcaggtaatataggcttgaaaattgatatcctgtggtgctaaagtacagtagaaagagagatgtgtatacatgtcttattttaaattgtacgaaggggaatttaaaaatatgtaactgctgtttatacatcagctccttactgcttattaatctgtattgtacccacgatatcaggaatgaagtagaagctggcctttccatgaatagccaccacatggcccagtgtctctgccaaacacagttgcttctagtctggccagtgccaagagacaacataacatggcaggtggatggtgtcattgtctcagctgagagccacctgcttcagataccatgggcgtgtgctgagtggatgcaccagggggcagcacagctccatgattcccagtgggggccaagccaggctaaggtgcagtcagttagcattgggacagtcattgtaatggtgctgttatcagttgaaaccatgctccctgtctcctcagccacatcccctccgtctctgctgtcatcttctctgtggtggggcagactttgcacttactgcagtgcaacacttgcactttacccctccggcttctacagtagagcaagtccttcggcagccctgctgctttcgctctgcgctacaatcatggcttctcatgttacttaccaagtggtatttttggttaggaatcacagctgtaaagttgatttcagttcattacacttcttaaacatattgcccctcaattttgcacactatattcttgtatattatttcaaataaaatgaaaaaagtct

SEQ ID NO: 1902 - DNA, 1226 bp, Rattus norvegicus
  Genbank Accession No. NM_013222
cgcgcgctggcggtggcatgcgcgctgctctgtcccgtctcctgcacgccctcttggccccgctgctcgtacgccagcaatatggcggcgcccagcgaacccgcaggtttccctcgcggcagtcgcttctccttcctgccgggcggcgcgcactcggagatgaccgacgacctggtgactgacgcgcggggccgcggcgcaaggcatagaaaagacaacgcccctgccgcggccccggcgccgaaaggtttggagcacgggaagcgaccgtgccgggcctgcgtggacttcaagtcgtggatgcggacccagcagaagcgggacatcaagtttagggaggactgtccacaggatcgggaagaattgggtcgcaacacctgggctttccttcatacgctggccgcctattacccggacatgcccacgccagaacaacagcaggatatggcccagttcatacatatattttccaagttttacccctgtgaggagtgtgcagaagacataaggaagaggatagacaggagccagccagacacaagcactcgagtgtccttcagccagtggctgtgccgccttcacaatgaagtgaaccggaagctgggcaagcctgattttgactgctcaagagttgatgagcgatggcgtgacggctggaaggacggctcctgtgactaaggattaccacagaccgtgcagggcaacgccgggttctatgggcaacagcctgactgacgattaaagtgcatctgagccaaagcttgtttctgtggtgggggtgggatcccctagaacactgcctatgggaaccctacccacagactcagaaacggaggtgcccactatagacagttgggtggcttcctcaggtcttaaagccccatgggactgaagatgagaggcaggagtggtccagggcaccccataccccttatgatacccattatacatttgggacatagttgcctcaaaggaaggtgggctagaccattgccttcctactacatatccccagctgcctacagaactgtgacccaggcaactctgccatttcagaattgaagcagggttccagctctagttgggtttttctcttagggtaaaccaaccatggtgcccactgtcagcctggcacatggtcttctgcagccaggacaaacatgtcagcagaggatcctgggaagggcttccttagcgtttgagaccaaaataaaatgaagtgactt

SEQ ID NO: 1903 - DNA, 435 bp, Rattus norvegicus
  Genbank Accession No. NM_013224
ctctttcgagtcttggctccaatatgaccaaaaaaaggagaaacaacggtcgtgccaaaaagggccgcggccatgtgcaaccaattcgctgcacgaactgcgcccggtgcgtgcccaaggataaggccattaagaagtttgtcattcggaacattgtagaagccgctgcagtcagggacatatctgaagcaagcgtcttcgacgcttacgtgcttcccaagctctatgtcaagctgcactactgcgtgagctgtgccattcatagcaaggttgtcaggaatcgatctcgtgaggcccggaaggaccgaacacccccaccacgattcagacctgctggcgctgcaccacgacctccaccaaagcccatgtaaagaggtgatttcatgaagacagaaagaaaaataccatggaaaaataaaactgaagttatacttt

SEQ ID NO: 1904 - DNA, 465 bp, Rattus norvegicus
  Genbank Accession No. NM_013226
ggcatcatggctgcccttcggcctctggtgaagcccaagatcgtcaaaaagaggaccaagaagttcatcaggcaccagtcggaccgatatgtgaaaattaagcgaaactggcggaaacccagaggcatcgacaacagggtgcggagaagattcaagggccagatcctgatgcccaacattggttacgggagtaacaagaaaaccaagcacatgctgcctagcggcttccggaagtttctggtccacaatgtcaaggagctggaagtgctgctgatgtgcaacaaatcttactgtgctgagattgctcacaatgtgtcctctaagaaccgaaaagccatcgtagaaagagcagcacagctggccatcagagtcaccaatcccaacgccaggctacgcagcgaagagaatgaatagatggcttgtgtgcctgttttgtgttcaaataaaaccacaaaaactgccaaa

SEQ ID NO: 1905 - DNA, 2681 bp, Rattus norvegicus
  Genbank Accession No. NM_016989
tttattggatatgaattttacaaatattacgtcaattagcggtaacggtggagctgaagagtgttgcgccttctccaggctgcacggcgagacccaccaatggtgtggtggaacttgtggccctttccaaggccacggctcttgcggccagcagatgtcagcccacgcatctccctgtgcttgtggactggtttggtaatccattgggtgtcgggatttcttctgatagctttatggaatggatcaatgaggataacctcaaaaaatttatatgtggaatcttcaccaacccagtaggaattcaggactctcaaagctccacaatggcgcccagctctctcctcagcaacagactgaaggcttcggctagttttgtgcgtctacaaagctttgagcggaattttagcttcggcaaacaagtccccccagctcctccagctaattcccgcgacttctctccagacaccagctccagacagtgactgatgcctctctggttgtgattccagcgcagaaactcgaaggagccctttgcccgccgtcctatttagtcaactctttcctagccgcgaatgaccatgtgtagcggagcaaggttggccctgttggtctacgggataataatgcataacagcgtctcctgttcacctgccgccggactcagcttccctgggatcagaccagaagaagaggcttacgatcaggacggaaacccgctgcaagacttctacgactgggaccctccgggcgcagggagccccgcctccgcgctgcgtgacgcctacgccctttactacccagccgacaggagagatgtcgcccacgaaatccttaacgaagcctaccgcaaagtcttggaccagctgtccgccaggaagtacctgcagtccatggtggccaggggcatgggcgagaacctcgccgccgccgcggtggacgaccgggcaccccttaccaaacgccactcggacggcatcttcacagacagctatagccgctaccgaaaacaaatggctgtcaagaaatacttggcggccgtgctagggaaaaggtataaacagagggttaaaaacaaaggacgccgaatagcgtacttgtagcgatgagttgccagctaccgtgtgtataaaatgaaaagtcgttttccaaattgactgaccagtcatcactcatgtgttctttccaaacatgtatttatgtatcaagtaaagccattaaatgactattttgataataatattgtttttctttttacgaagcactggagaatgcacagatatactttgtggaccaattattgatatatattataagtatatattaagaatatatataggtatagcagagagcaattcataagcgtgcacaaagattgaaaattcgcctgagctgtttatgtttttatataaaatgaatagagaaaatagacaaccattgttttgaatattactcctatttttgtaaactggaattaaaggatagtatttttatccacaaccggcttgaagataccaataatggccatttgtacaaaaaaatgatgccctgctccaggagaattctgaggtaatgacttcccaaattgctgaagggctttctttccttgtgagtctctggggcaggctgcttgaaccccagcctaactaactcaagtgggcattgtcccactggttgcgggacaattccaacactttcattttctttgactatacctttatgtgtatctgtctctcctcagagtcccagcccataaggaaattctaattactgaacagctcgatccaaattgtgcttctccccaaaattcatgtcatttccttggagaagagtcgaggaactgtacagaagagaccagcttggagagaaagcgctcttttttgtacttcctgattcttcagggaactgactatcctaaagctagggcaattggaacaaagtgaaagataaagagaggactggaaggggcagagcatggggtgtggaggaggaccctgtagagggactgatttgagagttgcctcaggtctgagaatctgggggcaagtctagtccctctgcaggttccactgcctgacagatcaggtgctggtgttggaatgaatgaatgcaaagtacaatgtgtttttctccagtgctgtccatgcttttcatgtcgtgaaatgaccaggatcctcccctttgaacactgctctgcagaagccacccctattctttgtggtttttctggagaacctccttcctacccttgccctcctgcactgtttaagaatctcgtatgccattttccactcacttatcttaaatttgtgaatgctagttattttttgttgttgtttgatgcaagcagttactgtgaagtttaggaacccctgtttagctaccacagagtgagtatgcactaaatatgaaccttttgtttcttgtttattgagtttgtaggtaaaatgtatttttctatattatggcttattgcttagtaaagcaagcccagcttcctgaggggccttttgtcctgttagcaattgaggcatttgcagaacactgtacagaccccgctctcccctgtacattcctccctggtggtgcccggtccccacttggggatgggagttttgtagactgtacagaaatcggcaccctattttcttgcagctctcagattttgttaatctggattatac

SEQ ID NO: 1906 - DNA, 2108 bp, Rattus norvegicus
  Genbank Accession No. NM_016991
gggcggactttaaaatgaatcccgatctggacaccggccacaacacatcagcacctgcccactggggagagttgaaagatgacaacttcactggccccaaccagacctcgagcaactccacactgccccagctggacgtcaccagggccatctctgtgggcctggtgctgggcgccttcatcctctttgccatcgtgggcaacatcttggtcatcctgtcggtggcctgcaaccggcacctgcggacgcccaccaactactttatcgtcaacctggccattgctgacctgctgttgagtttcacagtactgcccttctccgctaccctagaagtgcttggctactgggtgctgttgagtttcttctgtgacatctgggcagcggtagatgtcctgtgctgtacggcctccatcctgagcctatgtgccatctccattgaccgctacattggggtgcgatactctctgcagtaccccacgctggtcacccgcaggaaggccatcttggcgctcctcagtgtgtgggtcttgtccacggtcatctccatcgggcctctccttggatggaaagaacctgcgcccaatgatgacaaagaatgtggggtcaccgaagaacccttctacgccctcttttcctccctgggctccttctacatcccgctcgcggtcatcctggtcatgtactgccgggtctacatcgtggccaagaggaccaccaagaatctggaggcgggagtcatgaaggaaatgtccaactccaaggagctgaccctgaggatccactccaagaactttcatgaggacaccctcagcagtaccaaggccaagggccacaaccccaggagttccatagctgtcaaactttttaagttctccagggaaaagaaagcagccaaaaccttgggcattgtagtcggaatgttcatcttatgttggctccccttcttcatcgctctcccgcttggctccctgttctccaccctaaagcccccggacgccgtgttcaaggtggtgttctggctgggctacttcaacagctgcctcaatcccatcatctacccgtgctccagcaaggagttcaagcgcgccttcatgcgtatccttgggtgccagtgccgcggtggccgccgccgccgccgccgtcgccgtctaggcgcgtgcgcttacacctaccggccgtggacccgcggcggctcgctggagagatcacagtcgcggaaggactctctggatgacagcggcagctgcatgagcggcacgcagaggaccctgccctcggcgtcgcccagcccgggctacctgggtcgaggaacgcagccacccgtggagctgtgcgccttccccgagtggaaacccggggcgctgctcagcttgccagagcctcctggccgccgcggccgtctcgactctgggccactcttcaccttcaagctcctgggcgatcctgagagcccgggaaccgaaggcgacaccagcaacgggggctgcgacaccacgaccgacctggccaacgggcagcccggcttcaagagcaacatgcccctggcgcccgggcacttttagggtcccttttcatcctccccctcaacacactcacacatcggggtgggggagaacaccatcgtaggggcgggagggcgcgtggggggagtgtcagccctaggtagacacagggtcgcaaggggacaaggggggaggggggcggggagaggggcagctgcttttctggcaggggcatgggtgccaggtacagcgaagagctgggctgagcatgctgagagcgtggggggcccccctagtggttccgggacttaagtctctctctcttctctctctgtatatacataaaatgagttcctctattcgtatttatctgtgggtacacgtgcgtgtgtctgttcggtgtacgtgtgggctgcatgggtgtgagtgtgaggcctgcccgcacgcgcgtgccggggcagagcgagtgcgccccctggtgacgtccaggtgtgttgtttgtctcttgactttgtacctctcaagcccctccctgttctctagtcaatgctggcactttgataggatcggaaaacaagtcagatattaaagatcatttctcctgtg

SEQ ID NO: 1907 - DNA, 602 bp, Rattus norvegicus
  Genbank Accession No. NM_016992
gctgcacgcagtgcccacctatgctcgccatgatgctcaacactacgctctctgcttgcttcctgagcctgctggccctcacctctgcctgctacttccagaactgcccaagaggaggcaagagggccacatccgacatggagctgagacagtgtctcccctgcggccctggcggcaaagggcgctgcttcgggccgagcatctgctgcgcggacgagctgggctgcttcctgggcaccgccgaggcgctgcgctgccaggaggagaactacctgccctcgccctgccagtctggccagaagccttgcggaagcggaggccgctgcgctgccgcgggcatctgctgcagcgatgagagctgcgtggccgagcccgagtgtcgagagggttttttccgcctcacccgcgctcgggagcagagcaacgccacgcagctggacgggccagcccgggagctgctgcttaggctggtacagctggctgggacacaagagtccgtggattctgccaagccccgggtctactgagccatcgccccccacgcctcccccctacagcatggaaaataaacttttaaaaaatgcaaaaaaaaaaaaaaaaaa

SEQ ID NO: 1908 - DNA, 1310 bp, Rattus norvegicus
  Genbank Accession No. NM_016998
accttctcaccatgaagagactactgattctgagtctgctgctggaagcagtctgtggcaatgagaactttgtgggacaccaggttctccgaatctctgcagccgatgaagcccaggtgcagaaagtgaaggagttggaggacctggagcacttgcagttggacttctggcgggacgctgcccgggccggtatccccattgatgtcagagtgcccttccccagcatccaatctgtgaaagcattcttggaatatcatggtattagctatgagatcatgattgaagatgtgcagttactgctcgatgaggagaaacagcagatgtctgccttccaggccagggccttgtccactgactctttcaattatgccacctatcatacgctggatgagatctacgaattcatggacctgctggtggctgagcacccacagcttgtgagcaagatccagatcggcaacacctttgaaggtcgccccatccatgtgctgaagttcagcactggagggaccaatcgcccagcaatctggatcgacactggcatccattctagggagtgggtcacccaggctagtggggtctggtttgcaaagaaggtcaccaaagactatggccaggaccccaccttcacagccgttcttgacaacatggacatcttcttggagattgtcaccaaccctgatggttttgcctacacccacaaaacgaatcgcatgtggcgcaagactcgatcacacacccagggctccctctgtgttggtgtggaccccaacaggaactgggacgctggcttagggaaggccggagcaagtagcaacccctgctcggaaacttaccgaggcaaatttcccaactctgaggtggaggtcaagtccatcgtggactttgtgacgagccatgggaacatcaaggccttcatctccatccacagctattcccagctcctgctctacccctacggctacacgtcggaaccagcccctgaccaggcagagctggatcagctagctaagtctgctgtgacagccttgacgtctctacacgggaccgagttcaagtatggcagcatcatcgatacaatctatcaagccagtgggagcactatcgattggacctacagccagggcatcaagtactctttcacttttgaactgagggacactgggcttagaggattcctgctgcctgcctcccagatcatccctacggcggaggagacatggctggcccttttgaccatcatggaccacacagtcaaacacccctactgaaagcagcccttatcccccacctctttcttctccttagtc

SEQ ID NO: 1909 - DNA, 1920 bp, Rattus norvegicus
  Genbank Accession No. NM_016999
ccatggtcctcaatttcctctccccgagcctttcccggctcggcttgtgggcttctgtagtgatcctgatggtaatcgttctcaagctcttcagcctgctgcttcggaggcagaagctggccagggctatggacagtttcccagggccccccacacactggctttttggtcatgcccttgagatccagaagttagggagcctggacaaggtggtatcctgggcccaacagttcccccatgcccacccactttggtttggacaattcgttggtttcctgaacatctatgagcccgactatgcgaaagctgtatacagccgcggggatccgaaggctgcagatgtgtatgacttcttcctccagtggatcgggaaaggcctactagttctggatgggccaaaatggttccagcaccgcaagctgctcacacctggcttccattatgatgtgctgaagccctatgtggccatatttgctgagtccacacgtatgatgctggacaagtgggagaaaaaggctagtgaaaataagagctttgacatcttctgtgacgtaggccacatggccctggacaccctcatgaagtgcaccttcggcaaaggagacagcggcctaggccacagagacaacagctactacctggcggtcagtgacctcacactgctgatgcagcagcgcatcgactccttccagtaccataatgacttcatttactggctcactccacatggccgccgcttcctgcgggcctgcaagatagcccatgaccatacagatgaggtcatcaggcagcggaaggcagcactgcaggatgagaaagagcggaaaaagattcagcagcggaggcacctggacttcctggacattctcctgggtgtccgggatgaaagtgggatcaagctgtcagatgcagagctccgggctgaagtggacacattcatgtttgaaggccatgacaccaccactagtggtatctcttggtttctctactgcatggccctttaccctgagcaccagcagctatgtagggaggaggtccgtgggatcctaggagaccaagactccttccaatgggatgatctggccaagatgacctacctgaccatgtgcatgaaggagtgcttccgcctctacccacctgtaccccaagtataccgccagctcaacaagccagtcaccttcgtggatggccgctctctacctgcaggcagcctgatctctctgcacatctacgccctccacaggaacagtactgtgtggcctgatccagaggtctttgacccactgcgcttttctcctgagaatgctgcaggacggcatccctttgccttcatgcctttttctgcagggcccaggaattgcatcgggcagcagtttgccatgaacgagatgaaggtggtcacagccctttgtttactgcgctttgagttctccctggatccctcaaagatgcccattaaggtcccccagctgatcttgcgctccaaaaatggtatccacctctacctgaagccgctggcttctaggtctggaaagtaggtcttcagagaactaggcctgggcagcacaagccgtgactcttcctgggatgttgccctcctagatagaatgtggagtcatcatggatccctgcctgtgggaggctttggaggcaaaagcatggacactgacagtctcctggaagacattctcttgtaaacatgtgtgtggaatgattcaacgcccaggctccagaacttatttcttcactccacaacatttgctgaacgttttgctgccttgagaaactccattgatttcacatagctacatttatttaaccatcttggtgtgtatttggaatacgatggacatgaggaaaattgctcaaactaaaactgtacaaaataaataatactttaaaaagcaaactcccaccacc

SEQ ID NO: 1910 - DNA, 1233 bp, Rattus norvegicus
  Genbank Accession No. NM_017008
ggtcagtgccggcctcgtctcatagacaagatggtgaaggtcggtgtcaacggatttggccgtattggccgcctggtcaccagggctgccttctcttgtgacaaagtggacattgttgccatcaacgaccccttcattgacctcaactacatggtctacatgttccagtatgattctacccacggcaagttcaatggcacagtcaaggctgagaatgggaagctggtcatcaatgggaaacccatcaccatcttccaggagcgcgatcccgctaacatcaaatggggtgatgctggtgctgagtatgtcgtggagtctactggcgtcttcaccaccatggagaaggctggggctcacctgaagggtggtgccaaaagggtcatcatctccgccccttccgctgatgcccccatgtttgtgatgggtgtgaaccacgagaaatatgacaactccctcaagattgtcagcaatgcatcctgcaccaccaactgcttagcccccctggccaaggtcatccatgacaactttggcatcgtggaagggctcatgaccacagtccatgccatcactgccactcagaagactgtggatggcccctctggaaagctgtggcgtgatggccgtggggcagcccagaacatcatccctgcatccactggtgctgccaaggctgtgggcaaggtcatcccagagctgaacgggaagctcactggcatggccttccgtgttcctacccccaatgtatccgttgtggatctgacatgccgcctggagaaacctgccaagtatgatgacatcaagaaggtggtgaagcaggcggccgagggcccactaaagggcatcctgggctacactgaggaccaggttgtctcctgtgacttcaacagcaactcccattcctccacctttgatgctggggctggcattgctctcaatgacaactttgtgaagctcatttcctggtatgacaatgaatatggctacagcaacagggtggtggacctcatggcctacatggcctccaaggagtaagaaacccctggaccacccagcccagcaaggatactgagagcaagagagaggccctcagttgcctgagagtccccatcccaactcagcccccaacactgagcactctccctcacaattccatcccagaccccataacaacaggaggggcctggggagccctcccttctctcgaataccatcaataaagttcgctgcaccctc

SEQ ID NO: 1911 - DNA, 4213 bp, Rattus norvegicus
  Genbank Accession No. NM_017010
aatattggtttgttaaggcagtttctgtagaggtttctaagagaccagtcgcgcagtccgcgctgctgtcctttccgccttttccgcgcgggtgttcgagcagcgccaaacacgcttcagcacctcggacagcatccgccgcgctcgcccggggctcctagagaacccgggggcgcttgaccgcgcgcgggcggcccgcgggtcgtacatcgcgaggtcgtcgcactcgcgcaacccagagccaggcccgctgtgcccggagctcatgagcaccatgcacctgctgacattcgccctgcttttttcctgctccttcgcccgcgccgcctgcgaccccaagatcgtcaacatcggcgcggtgctgagcacgcgcaagcatgaacagatgttccgcgaggcagtaaaccaggccaataagcgacacggctcttggaagatacagctcaacgccacttctgtcacccacaagcccaacgccatacagatggccctgtcagtgtgtgaggacctcatctctagccaggtctacgctatcctagttagccacccgcctactcccaacgaccacttcactcccacccctgtctcctacacagctggcttctacagaatccctgtcctgggactgactacccgaatgtccatctactctgacaagagtatccacctgagtttccttcgcacggtgccgccctactcccaccagtccagcgtctggtttgagatgatgcgagtctacaactggaaccacatcatcctgctggtcagcgacgaccacgagggacgggcagcgcagaagcgcttggagacgttgctggaggaacgggagtccaaggcagagaaggtgctgcagtttgacccaggaaccaagaatgtgacggctctgctgatggaggcccgggaactggaggcccgggtcatcatcctttctgcaagcgaggacgacgctgccacagtgtaccgcgcagccgcaatgctgaacatgacgggctctgggtacgtgtggctggtcggggaacgcgagatctctgggaacgccctgcgctacgctcctgatggcatcatcggacttcagctcatcaatggcaagaatgagtcagcccacatcagtgacgccgtgggcgtggtggcacaggcagttcacgaactcctagagaaggagaatatcactgacccaccgcggggttgcgtgggcaacaccaacatctggaagacaggaccattgttcaagagggtgctgatgtcttctaagtatgcggacggagtgactggccgtgtggaattcaatgaggatggggaccggaagtttgccaactatagtatcatgaacctgcagaaccgcaagctggtgcaagtgggcatctacaatggtacccatgtcatcccaaatgacaggaagatcatctggccaggaggagagacagagaaacctcgaggataccagatgtccaccagactaaagatagtgacaatccaccaagagcccttcgtgtacgtcaagcccacaatgagtgatgggacatgcaaagaggagttcacagtcaatggtgacccagtgaagaaggtgatctgtacggggcctaatgacacgtccccaggcagcccacgccacacagtgccccagtgctgctatggcttctgcatagacctgctcatcaagctggcgcggaccatgaattttacctatgaggtgcacctggtggcagatggcaagtttggcacacaggagcgggtaaacaacagcaacaaaaaggagtggaacggaatgatgggcgagctactcagtggccaagcggacatgattgtggcaccactgaccatcaacaatgagcgtgcgcagtacatagagttctccaagcccttcaagtaccagggcctgaccattttggtcaagaaggagattcccaggagcacactggactcatttatgcagccttttcagagcacactgtggttgctagtaggactgtcagttcatgtggtggctgtgatgctgtacctgctggaccgcttcagtccctttggccgattcaaggtgaacagtgaggaggaggaggaagatgcactgaccctgtcctctgccatgtggttttcctggggcgtcctgctcaactccggcattggggaaggtgccccccggagtttctctgcacgtatcctaggcatggtgtgggctggtttcgccatgatcatagtggcttcctacactgccaacttggcagctttcctggtgctggatcggcctgaggagcgcatcacgggcatcaatgaccccaggctcagaaacccctcagacaagttcatctacgcaactgtaaagcagagctccgtggacatctacttccggaggcaggtggagttgagtaccatgtaccggcacatggaaaaacacaattacgagagcgcagctgaggccatccaggctgtgcgggacaacaagctgcacgcctttatctgggactcggccgtgctggagtttgaggcttcacagaagtgcgatctggtgaccacgggtgagctgttcttccgctcaggctttggcatcggcatgcgcaaggacagcccctggaagcagaacgtttccctgtccatactcaagtcccatgagaatggcttcatggaagatctggataagacatgggttcggtatcaggaatgcgactcccgcagcaatgctcctgcaaccctcacttttgagaacatggcaggggtcttcatgctggtggctggaggcatcgtagctgggattttcctcattttcattgagatcgcctacaagcgacacaaggatgcccgtaggaagcagatgcagctggcttttgcagccgtgaacgtgtggaggaagaacctgcaggatagaaagagtggtagagcagagcccgaccctaaaaagaaagccacatttagggctatcacctccaccctggcctccagcttcaagagacgtaggtcctccaaagacacgagcaccgggggtggacgcggcgctttgcaaaaccaaaaagacacagtgctgccgcgacgcgctattgagagggaggagggccagctgcagctgtgttcccgtcatagggagagctgagacgccccgcccgccctcctctgcccctcccccgcagacagacgcacgggacagcggcctggcccacgcagagccccggagcacgacggggtcgggggaggagcactcccagcctcccccaggccgtgcccgcctgcccaccggtcggccggctggccggtccaccctgtcccggccccgcgcgtgcccccgacgtcggagctaacgggccgccttgtctgtgtatttctattttacagcagtaccatcccactgatatcacgggcccgctcaacctctcagatccctcggtcagcaccgtggtgtgaggccccccggaggcgcccacctgcccagttagcccggccaaggacactgatgagtcctgctgctcgggaaggcctgagggaagcccacccgccccagagactgcccaccctgggcctcccgtccgcctgctctgctgcctggcgggcagcccctgcaggaccaaggtgcggaccagagcggctgaggatgggccagagctgagccggctgggcagggccacagggcgctccggcagaggcagggccctgaggtctctgagcagtggggtgaggggcctaagtggccccggtcggaggagtctggagcagaaatggcagccccatccttcctccagccactaccccaagctacagtgggggcctatggccccagcttgctaggtcacccccgacccttcctccagcgcctgctctctgcaacttgatttccacctctctcctgctgcaccaccctcccacgacatttccccaccccattcactgggttgtctctgacctttcccagggctagccttcactgccctagtggcagtgcttcaggggtgctttctggctcccagacatctagggctccagactccaagagggctgagccttctcttctgtccgcagccacaataggcttcctcagacgctggctcgtgatgagtcccgcaccttgggcaccagggagcgccatctgcctcccagtccggtgtcactcaccccactaccttgtacatgaccagctctcccagtgtcccagtgtctgccccagggacaccgggcgcgcacagccacccctaatcccggtattcagtggtgatgcctaaaggaatgtcag

SEQ ID NO: 1912 - DNA, 1055 bp, Rattus norvegicus
  Genbank Accession No. NM_017014
gctgaagcaaattgagaagaccacagcgccagaaccatgcctatgatactgggatactggaacgtccgcgggctgacacacccgatccgcctgctcctggaatacacagactcaagctatgaggagaagagatacgccatgggcgacgctcccgactatgacagaagccagtggctgaatgagaagttcaaactgggcctggacttccccaatctgccctacttaattgatggatcgcgcaagattacccagagcaatgccataatgcgctaccttgcccgcaagcaccacctgtgtggagagacagaggaggagcggattcgtgcagacattgtggagaaccaggtcatggacaaccgcatgcagctcatcatgctttgttacaaccccgactttgagaagcagaagccagagttcttgaagaccatccctgagaagatgaagctctactctgagttcctgggcaagcgaccatggtttgcaggggacaaggtcacctatgtggatttccttgcttatgacattcttgaccagtaccacatttttgagcccaagtgcctggacgccttcccaaacctgaaggacttcctggcccgctttgagggcctgaagaagatctctgcctacatgaagagcagccgctacctctcaacacctatattttcgaagttggcccaatggagtaacaagtaggcccttgctacactggcactcacagggaggacctgtccacattggatcctgcaggcaccctggccttctgcactgtggttctctctccttcctgctcccttctccagctttgtcagccccatctcctcaacctcaccccagtcatgcccacatagtcttcattctccccactttctttcatagtggtccccttctttattgacaccttaacacaacctcacagtccttttctgtgatttgaggtctgccctgaactcagtctccctagacttaccccaaatgtaacactgtctcagtgccagcctgttcctggtgggggagctgccccaggcctgtctcatctttaataaagcctgaaacac

SEQ ID NO: 1913 - DNA, 2472 bp, Rattus norvegicus
  Genbank Accession No. NM_017015
ccccgcatgtccccaagacggagtgtgtgttggttcgtactgggccagctgctgtgcagctgcgccgtggcgctgcagggcgggatgctgttcccgaaggagaccccttcgcgggaactcaaggtgctggacggcctgtggagcttccgtgccgattactcgaacaatcggttgcagggcttcgagaagcagtggtaccggcagccgctacgggagtcgggcccaaccttggacatgccggtcccttccagcttcaatgacatcacccaagaagcagagcttcggaacttcattggctgggtgtggtatgaacgggaagcagtgcttccacagcgatggacccaggacaccgacaggagagtggtgttgagaatcaacagcgcccattactatgcagttgtgtgggtgaatgggattcatgtggtggaacatgagggaggtcacctcccctttgaggctgacatcaccaagctggtccagagtgggcccctgaccaccttccgggtcaccatcgccatcaacaacacactgaccccttatacccttccaccggggaccattgtctacaagactgatccttccatgtatcccaagggttacttcgtccaggacataagcttcgacttcttcaactatgcggggctgcaccggtctgtggtcctgtacaccacccctaccacctatatcgatgatatcactgtgaccactgacgtggaccgggacgttgggctggtgaactactggatttctgtccagggcagtgaccatttccagctagaagtgcgtcttctggatgaggatggcaaaattgtggcccgtggaacagggaatgagggtcaacttaaggtgccgcgtgcccacctctggtggccttacctgatgcatgagcatccagcctacctgtactccttggaggtgacgatgacaacacctgagtctgtgtctgacttctataccctccctgtcgggattcgaacagtggctgtcacaaagagcaagttcctcataaatgggaagcctttctacttccaaggcgtcaacaagcatgaggattcagatatccgagggagaggcttcgactggcctctgctgataaaggatttcaacctcctccgttggctcggggcaaattcctttcgtaccagccactatccctactcggaggaggtacttcagctctgtgaccgatatggaattgtggtcatcgatgagtgtcccggtgtgggcatcgtgctgccccagagttttggcaacgtgtctcttcggcaccacctagaggtgatggacgagctggtgcgcagggacaaaaatcaccctgcggtcgtgatgtggtctgtggccaatgagcctgtctcttctctgaaacctgccggatattacttcaagacgctgatcgcccacaccaaagccctggaccccacccgtcctgtgacctttgtgagcaataccagatatgacgcagacatgggggccccgtacgtggacgtgatttgtgtgaacagttacttatcctggtatcatgactacgggcatctggaggtgattcagctgcagctgactagccagtttgagaactggtataagatgtaccagaagccaattatccagagcgagtatggagcagacgccgtctcggggcttcatgaggatccacctcgcatgttcagtgaggagtaccagacagctctcctggagaattatcatttgatcctggatgagaaacgaaaagaatatgtcatcggagagctcatctggaattttgctgacttcatgacgaaccagtcaccactgagagtaacaggaaacaagaaggggatcttcactcgacagagaaaccccaagatggcagccttcattttgcgagagagatactggaggattgccaacgaaaccagaggttacggttcagtgccgaggacccagtgtatgggaagcagaccgttcacattctaaagctacgactacctcaccgcagacagggcctgatgaagtgaaaggtattctctcagcagaagagtttttcctctggagtttgtgaaccaacacaaggaggactttagaagtgacatggaagttttccttgtgtggggataatgacttgcagtgccttaggctcagtaatgtgtcctgctgagaagtgtcccaggtcatttctgtcaggttttttttggccttggctttgtgtactcttgaaaacctactgtgtgaatactcacactaagagctcctggttaccggctaagggacggctcacaatttaagaatactgactgttctaccaggggttccagattcgattcctagcacccacgtggtcgttaactatgagctgttgccccatttctcaggtgatgtacgaacatacatgtggggggaggggaatagtcatacgtgtaaaatgaaaataaatctaaataaaactgttttctttcattataaaaaaaaaaaaaaaaaaccaactaatagaaacgt

SEQ ID NO: 1914 - DNA, 4614 bp, Rattus norvegicus
  Genbank Accession No. NM_017020
aattccgtgggcggcgggcggcggagaagctccgagcggggccgggcggcggcagattggagtcgcgacacagccgccgtccgcttcgggctccacgtagaaggaaccatgctggccgtcggctgcaccctgctggtcgccctgctggccgcgcccgcagtcgcgctggtccttgggagctgccgcgcgctggaggtggcaaatggtacggtgacgagcctgccaggggccactgttaccctgatctgccctgggaaggaagcagcaggcaatgctaccattcactgggtgtactcaggctcacagagcagagaatggactaccacgggaaacacactggttctgagggccgtgcaggtcaatgacactgggcactatttgtgcttcctggatgatcatctggttgggactgtgcccttgctggtggatgttcccccagaggagcccaagctctcctgcttccggaagaacccccttgtaaatgccttttgtgagtggcatccaagcagcactccctctccaaccacgaaggctgtgatgtttgcaaagaaaatcaacaccaccaatgggaagagtgacttccaggtgccttgccagtattctcagcagctgaaaagcttctcctgcgaggtggagatcctggagggtgacaaagtgtaccacatagtgtcactgtgcgttgcaaacagtgtcggaagcaggtccagccacaatgtagtatttcagagtttaaaaatggtgcagccggatccacctgccaaccttgtggtatcagccatacctggaagcctcgttggctcaaagtcagttggcaagaccctgagtcctgggacccaagttactacttgttgcaattcgagcttcgataccgacctgtatggtcaaagaacgttcacggtgtggccgctccaggtggcccagcatcaatgtgtcatccatgatgccttgcgaggagtaaagcatgtggtgcaggtccgagggaaggaggagtttgacattggccagtggagcaaatggtccccggaggtcacaggcactccttggctagcagagcccaggaccactccggcagggatcccggggaaccccacacaggtctctgttgaagactatgacaaccacgaggatcagtacggaagttctacagaagcaacgagtgtcctcgccccagtgcaaggatcctcgcctatacccctgcccacattcctggtagctggaggaagcctggcgtttggattgcttctctgtgtcttcatcatcttgagactcaagaagaaatggaagtcacaggctgagaaggaaagcaagacgacttctcccccaccgtatcccttgggaccgctgaagccgaccttcctcctggttcctctcctcaccccatcagggtcccataacagctctgggactgacaacaccggaagccacagctgcctgggtgtcagggacccacagtgccctaatgacaacagcaacagagactacttattccccagataattgtctggagggtacctggcagctggcacgcaagtttctcactgccggccccgtccaccagggctgggggcggggtgggcggggctgcagcttcacgatcccacaggagccttgcaaaggttctgagtgggagaagactggtgtgctgcacgggcttcgaaagaaggggctgtgaggagcacgagccatcatgaagagagcctgtgatgactctgaatagagacgcccgcccatcagctacacacctgatggtggctctcaagctatcctctcaggaagcctctgggaggggcgacaaaggctgccccagttgcctagctctggctcactggcccaagctgccttttagcttgaactcctaaaatccaagcaccttggccattctcttcctaggccaccgaggccgcggggaagcttggttctactttccttctcaacacctggagaagcagctgcccggtggtggtgactaacgtatcagggcctgatggcttatgaggaatgacaattaattcctcataagcagtttttaaatgtgaatagtaatcctaggcactgctgacttgaggttttattttcttcgatctcaggacttcaggagagaagcagagcagaagtagagagaggatgggtgtccattgtccgtgtggtacttgagggggatacagcctggaaaacacgtttcctgtccccctactctcccagaagaggtagggggtggcgcctcttccagggcagagagtataactactttacctggccttgcccatactggtttcaactggacttgagctactaggaaaaatgacattcatgcaaaaagaaaactttaactagcaagaatgcacttccactttggtttctagaggactgttgctcctcttgagacgctggaagaggccgctcactgtaccctggtgtatgagccctcaccccccaccccagggtaagtgcagtaactttagtctaaacaccgagtcaggtaaaaatcgaggaaaaaacaaccctgtttcctgtaacagaaaagcctttggtttcgttttgtattttgattttttttttgtcttaaaaagtgtaaaaatagtctgtccatactctgcttcagggaatgacctgtgaatactccccaggcgtgggcaggaagggtgtctgcttcctgctacacctcactgccacctcggccttccttgctttacattcaactgagttgcctcagctgctttcccctggggcgctgaaaaagccagtgatgttggtggtcaccgagaagaccacagagccacagagtaatgctgtgattgaagcgagttacgcaaccacagcaccccacatttgctgtattatagaactatgctaggagcttgccttttcacaaaataccaccaccacgagacgtggcagagctcggaagctgtcaccttgtgccatctgcttgccagctccaaggggccactgacttaagcagttattttctttgtgggctttgttcatttcagggcctgttgctgtcttagaaaaagctctgtcggttgacaaaaacatcagacaggtagtcatgtttatttattttttttccttctttgctaagtctttgggactcaagggtagtaaaaaatgctgtgaaaagggaaacattagaaacagcgatcttcggggaataggtgactgtgcccacgcactgttcttcagtccctcacgtggctctgcccgagtgctgttccaagccaggcagagcaggctggcggaagattgaaatccagatagctcgttatctctgagagctaaatagctttgatctccaagctgttattgctttcactattgtaacaggatagcctccccccccatgtcaaaaggatgcttttcccttttgactttttataagctaagtcagtgaagtctgtttcatctgagctccagcttcgttcagttcgcacaggtgtatgccctcagctgcttcgggcctcagatctgtgctagttgaatggttgtcccatccttgggtcatccttaccagagtttctgcagcccacaggtctgccttgtcaacagtaccacttaacaccagcattcagtgcccaggcagccagatgtggagggtttacccagagatgatttaaacatgaccttaaacgtgtatggtagaacgaggggaacccataccagctcaggttctaaagagatctttgattcttctggcattagtgaaatagctttaaactatttcaaggaagaagccttggccacacccacgacatttggtgacaatcctttctctccatgagccttgtctttacaccttctcacctggctgaaagctcacactgaatctttcctatgtccctggtgtcttgggagaaaggaaactggtatgggcttcactgctggaattggcttggagccagcgtgtggcgcagccctggcagggtgggccaggcttagttatggtgtgctggtttaaggaatgcctggcttgcctggttgcttgggttctgagctgcagagtttcctagcagttctttatggctgacctagttggggaagattcccacactcaactgcaggtggaggtggtgagaaagctgttttcatttggagaggcaggatcagcccaagaagctttcagtgggagagcctacagtgaggctgtacctcactgtgggaggaggcaggccagctggctcaggtcctgggactggcactggggagggtctgccaaaggtccctccagcctgtagtcctagcatagtcgggtgccagttccaggaagtttctatggcaaccttagtgctcattaaggaacattgtcagttttgtgaacatatgctcagatggagatcttgttttcagagaaaggactggtacagtgtgtaacaagctggagcagacagagagactttttggcaagagatcacatccgttaagcagaatacctcagtgctacatgtttttgtctttgagacaatgtttttaaggtttttatgctctgttacctgtaagctgatacctaaaactttctgcaaagtcagggtttttcaatgccttttttttttttttgccattgtttgctttaaagtgaagattgtaactgtttgaaataaataatttctaaaactg

SEQ ID NO: 1915 - DNA, 1609 bp, Rattus norvegicus
  Genbank Accession No. NM_017025
gtgtgctggagccactgtcgccgatctcgcgcacgctactgctgctgctcgcccgtcgtcccccatcgtgcactaagcggtcccaaaagattcaaagtccaagatggcagccctcaaggaccagctgattgtgaatcttcttaaggaagaacaggtcccccagaacaagattacagttgttggggttggtgctgttggcatggcttgtgccatcagtatcttaatgaaggacttggctgatgagcttgcccttgttgatgtcatagaagataagctaaagggagagatgatggatcttcagcatggcagccttttccttaagacaccaaaaattgtctccagcaaagattatagtgtgactgcaaactccaagctggtcattatcaccgcgggggcccgtcagcaagagggagagagccggctcaatttggtccagcgaaacgtgaacatcttcaagttcatcattccaaatgttgtgaaatacagtccacagtgcaaactgctcatcgtctcaaacccagtggatatcttgacctacgtggcttggaagatcagcggcttccccaaaaacagagttattggaagtggttgcaatctggattcggctcggttccgttacctgatgggagaaaggctgggagttcatccactgagctgtcacgggtgggtcctgggagagcatggcgactccagtgtgcctgtgtggagtggtgtgaacgtcgccggcgtctccctgaagtctctgaacccgcagctgggcacggatgcagacaaggagcagtggaaggatgtgcacaagcaggtggttgacagtgcatacgaagtgatcaagctgaaaggttacacatcctgggccattggcctctccgtggcagacttggccgagagcataatgaagaaccttaggcgggtgcatcccatttccaccatgattaagggtctctatggaatcaaggaggatgtcttcctcagcgtcccatgtatcctgggacaaaatggaatctcagatgttgtgaaggtgacactgactcctgacgaggaggcccgcctgaagaagagtgcagataccctctggggaatccagaaggagctgcagttctaaagtcttcccagtgtcctagcacttcactgtccaggctgcagcagggtttctatggagaccacgcacttctcatctgagctgtggttagtccagttggtccagttgtgttgaggtggtctgggggaaatctcagttccacagctctaccctgctaagtggtacttgtgtagtggtaacctggttagtgtgacaatcccactgtctccaagacacactgccaactgcatgcaggctttgattaccctgtgagcctgctgcattgctgtgctacgcaccctcaccaaacatgcctaggccatgagttcccagttagttataagctggctccagtgtgtaagtccatcgtgtatatcttgtgcataaatgttctacaggatattttctgtattatatgtgtctgtagtgtacattgcaatattacgtgaaatgtaagatctgcatatggatgatggaaccaaccactcaagtgtcatgccaaggaaaacaccaaataaaccttgaacagtg

SEQ ID NO: 1916 - DNA, 3133 bp, Rattus norvegicus
  Genbank Accession No. NM_017031
gaattcgcgcacgagagcacatgctggatggactctggttccgccctttgtgcagacaaaagtgactgggtggccaggctttgcttactgtctgagttaatgaagcttgtttgataaggttttctttcaaaaaaaaattacatataaaggatttatcaaaagccctcatgaatatttcatgagttgatacattcggctgaatggattcagtgagtctcagtgtgtaacttgcacacaagccccatccacaaggaggctggtgacagaggaagcactttggcgcattttcagaggcaaaggcagcctgataaagctcctgtgacaggctgacttgccattctcccagtatgctgctcttgctctgaagtgctccaggattggaaccatcacggcttcccaaattagcctaggacgagtgtgcggacccagcagccttttaacctgcggcagtgcctttgctatgttcaagactgttgttgtggatggtgaaagctagcgcgccacacgagacatgacagcaaaaaattcttccaaagaacttccagcttctgaatctgaggtttgcataaagactttcaaggagcagatgcgcttggaacttgagcttccaaagctaccaggaaacagacctacatctcccaaaatttctccacgcagttcaccaaggaattcaccatgctttttcagaaagttgctggtgaataaaagcatccgacagcggcgtcgcttcactgtggctcatacatgctttgatgtggaaaatggcccttctccaggtcggagcccactggaccctcaagccagctcttcttcaggactggtacttcatgccgccttccctgggcacagccaacgcagagagtcttttctctacagatccgacagcgactatgacttgtcaccaaaagcgatgtcaaggaactcctcacttcccagcgaacaacacggcgatgacctgattgtcactccttttgcccaggttcttgccagcttgcgaatcgtaagaaacaatttcaccctgctgacaaaccttcacggagcaccgaacaagaggtcgccagcggctagtcaggctccagtcaccagagtcagcctgcaagaagaatcatatcagaaactagcaatggagacgctggaggaactagactggtgcctagaccagctagagaccatccagacctaccgctctgtcagcgagatggcttcaaacaagttcaaaaggatgctgaaccgggagctgacacacctctcagagatgagcagatcagggaaccaagtgtctgaatacatttcgaacacgttcttagacaagcagaacgatgtggaaatcccatctcccacccagaaggacagggagaagaagaagaagcagcagctcatgacccagataagtggagtgaagaaactgatgcacagctcaagcctgaacaacacaagcatctcacgctttggagtcaacacggaaaatgaggatcatctagccaaggagctggaagacctgaacaaatggggccttaacatcttcaacgtggctgggtactcccataatcggcccctcacatgcatcatgtacgccattttccaggaaagagaccttctaaagacgtttaaaatctcctccgacaccttcgtaacctacatgatgactttagaagaccattaccattctgatgtggcgtatcacaacagcctgcacgctgctgacgtggcccagtcaacgcacgttctcctctctacgccagcactggatgctgtcttcacagacctggaaatcctggctgccatttttgcagctgccatccatgatgttgatcatcctggagtctccaatcagtttctcatcaatacaaattccgaacttgctttgatgtataatgacgaatctgtgctggaaaaccatcacctcgctgtgggattcaagctccttcaagaggaacattgcgacatctttcagaatcttaccaagaagcaacgccagacactcaggaaaatggtgattgacatggtgttagcaactgatatgtccaagcacatgagcctcctggctgaccttaaaacgatggtagaaaccaaaaaggtgacgagctccggtgttctcctcctggacaactatactgaccggatacaggttcttcgcaacatggtacattgtgcagacctgagcaaccctaccaagtccttggagttgtatcggcaatggactgatcgcatcatggaggagtttttccaacagggagacaaagaacgggagaggggaatggagattagcccaatgtgtgataaacacacagcttctgtggaaaagtcccaggttggtttcattgactacattgtccatccattgtgggagacctgggcagacctggttcagcctgatgctcaagacattttggacacactagaagataacaggaactggtaccagagtatgattccccagagcccctctccaccactggacgagaggagcagggactgccaaggccttatggagaagtttcagttcgaactgacccttgaagaagaggattctgaaggaccggaaaaggagggagaaggccccaactatttcagcagcacaaagacactttgtgtgatcgatccagagaacagggattctctggaagagactgacatagacattgccacagaagacaagtctctgatcgacacataatctccctctgtgtggaggtgaacattctatccttgacgagcatgccagctgagtggtagggcccacctaccagagccaaggcctgcacaaaacaaaggccacctggctttgcagttacttgagtttggagccagaatgcaaggccgtgaagcaaatagcagttccgtgctgccttgccttgccggcgagcttggcgagacccgcagctgtagtagaagccagttcccagcacagctaaatggcttgaaaacagaggacagaaagctgagagattgctctgcaataggtgttgaggggctgtcccgacaggtgactgaactcactaacaacttcatctataaatctcacccatcctgttgtctgccaacctgtgtgccttttttgtaaaatgttttcgtgtctttgaaatgcctgttgaatatctagagtttagtacctccttctacaaactttttt

SEQ ID NO: 1917 - DNA, 1816 bp, Rattus norvegicus
  Genbank Accession No. NM_017037
gagttacagggagctccaccagagaacatctcagggagcctggctggaagcagcagagctccgagtctggtctgctgtgagcatccgctgtcctgcggggagggctcccatccctggctctcgattgcaaagaaatccaagcggaggaagggcgtacaccattggtctggcacgctccaccgagcccgagcccaactcccagccaccatgcttctactcttgttggggatcctgttccttcacatcgcggtgctagtgttgctcttcgtctccaccatcgtcagccaatggctcgagggcaatggacacaggactgatctctggcagaactgtaccacatccgccttgggagccgtccagcactgctactcctcatctgtgagcgaatggcttcagtctgtccaggccaccatgatcctgtctgtcatcttcagcgtcctgtccctgttcctgttcttctgccagctcttcactctcaccaaaggcggccgcttttacatcactggagtcttccaaatccttgctggtctgtgtgtgatgagtgcagcggccatctacacagtgagacacagtgagtggcatgtcaacaacgactactcctatggctttgcttacatcctggcctgggtggctttcccgctggccctccttagtggcatcatctacgtgatcctgcggaaacgcgaatgaggcgcccgacgcaccatccgtctaggctctgagcgtgcatagggtacacagggagggaggaaggaaaccagaaaaccaaaccaaccaacccaaaagagctagcccccaaacccaaacgcaagccaaaccaaacagaacacagttgagtggggattgctgtcgattgaagatgtatataatatctatggtttataaaacctatttataacactttttacatacatgtacataggattgtttgctttttatgttgaccgtcagcctcgtgttgaatcttaaacgactctacatcctaacactataaccaagctcagtattttcgttttgtttcgtttttttcatctttttgttttgctcagacataaaaaaaaaaaaatccacgtggccccctttcatctgaaagcagatccctccctcccattcaacctcataggataaccaaagtgcggggacaaaccccagatggccagaggttcacactatgggtgacccagtgaatttagcaggaataatccgctgcccgaatcaatgtgtgaagccctaagcactcacagacgaaacgccctgaccagagccctctgcgaaaccaatagctggtggctgcggaacacttgaccctgaaggcggagtactggggccacatgtttaaatgagacgtcagagacaagcaatctgtgaaatggtgctatagatttaccattccttgttattactaatcatttaaaccactcactggaaactcaattaacagttttatgacctacagcagaacagagacccgatacaaacggttcgtaactgctttcgtacatagctaggctgttgttattactacaataaataaatctcaaagccttcgtcactcccacagttttctcacggtcggagcatcaggacgagcgtctagacccttgggactagcaaattccctggctttctgggtctagagtgttctgtgcctccaaggactgtctagcgatgacttgtattggccaccaactgtagatgtatatacggtgtccttctgatgctaagactccagacctttcttggttttgcttgctttttctgattttataccaactgtgtggactaagatgcattaaaataaacatcagagtaactc

SEQ ID NO: 1918 - DNA, 1804 bp, Rattus norvegicus
  Genbank Accession No. NM_017039
ctggggccgcaggaagcaccccggggagcggcggcggcgtgtgcgtgtggcccgggtgcgggcggcggcgcgggagcagcgcagagcggcagccggttcgggcgggcggcatcatggacgagaagttgttcaccaaggagctggaccagtggatcgagcagctgaacgagtgcaagcagctctccgagtcccaggtcaagagcctctgcgagaaggctaaagaaatcctgacaaaagaatctaatgttcaggaggttcgatgtccagtcactgtgtgtggagatgtgcatgggcaatttcatgacctcatggaactctttagaattggtggtaaatcaccagatacaaattacttgtttatgggagactatgtggacagaggatattactcagttgaaacagttacactgcttgtagctcttaaggttcgttaccgagagcgtatcaccatactccgagggaatcacgagagcagacagatcacacaagtttatggtttctacgatgagtgtttaaggaaatacggaaatgcaaatgtttggaaatacttcacagacctttttgactaccttcctctcactgccttggtggatgggcagatcttctgtctacatggtggtctttcaccatccatagacacactggatcacatccgagcacttgatcgcctacaagaagttcctcatgagggtccaatgtgtgacttgctgtggtcagatccagatgaccgtggtggctgggggatatctcctcggggagctggttatacctttggccaagatatttctgagacatttaatcatgccaatggcctcacgttggtgtccagagctcaccagctggtgatggagggatataactggtgccatgaccggaatgtagtaacaattttcagtgctccaaactattgctatcgttgtggtaaccaagctgcaatcatggaacttgatgacactcttaagtattctttcttgcagttcgatccagcacctcgtagaggcgagccacatgtcactcgtcgtaccccagactacttcctgtaatgaaagtttaaccttgtacagtattgccatgaacaccgtctgttgacctaatggaatcgggaagagcagcagtaactccaaagtgtcagaaatagttaacattcaaacttgtttccacacggaccaaaagatgtgccatataaaatacaaagcctcttgtcatcaacagccgtgaccactttagaatgaaccagttcattgcatgctgacgcgacattgttggtcaagaatccagtttctggcatagcgctatttgtagttacttttgctttcttgagagactgcagatctaggatgtaacattaacacctgtgagtccagttgacttccacttagctgtagcttactcagcatgactgtagatgaggatagcaaacaatcattggagcttaatgaacatttttaaatgagtaccaaggcctcccctcttgttgtgttctttcagggatactattaatttaattgtatgatttctctgcactcagtttctcccttctcaaatctcggccccgcgttgttctttgttactgtcagaaaacctggtgagttgttttgaacagaactgtctccctcctgtaagatgatgtactgcacaagtcaccgcagtgttttcataataaacttgagaactgagaaagtcaggtttgaattgtatcagtgggcacgactggtgctgtttattaaacaagataaatctattgatcaatttcagaatttgtagaattccaggtaaagaaaaataaagatcaaggccactatat

SEQ ID NO: 1919 - DNA, 1843 bp, Rattus norvegicus
  Genbank Accession No. NM_017040
ggcacgagcgccgagagaaccgcggccagagcgcggagaggcctgcgggcggcgacggcagcgggagggcgggcgccgtcgggccggagcctcccccgagccgcgccgcgctctggctccgagccgtgagccctttttgccgcgccccgagcgcgtggccgggggccgggcggggcgggcgctcccggaggccggggccggcggctgcccgctgggcttgggcggggcgcgggctgcccgctccgcggctcggtggtcccgccgggggccggcggcgggggaggcggcggggacgcgcggctcgccgccatggacgacaaggcgttcaccaaggagctggaccagtgggtggagcagctgaacgagtgtaagcagctgaacgagaaccaagtgcggacgctgtgcgagaaggctaaggaaattttaacaaaagaatcaaatgtacaagaggttcgctgtcctgttaccgtctgtggagatgtgcatggccaattccatgaccttatggaactcttcagaattggtggaaaatcaccagacaccaactatctattcatgggtgactatgtagacagaggatattattctgtggagaccgtgactcttcttgtagcattaaaggtgcgctatccagagcgtatcacaatattgcgaggaaatcatgaaagccggcagatcacacaagtatatggcttttatgatgaatgcctacgaaagtatgggaacgccaacgtgtggaaatactttacagatctctttgattatcttccacttacagctttagtagatggacagatattctgcctccacggtggcctctctccatccatagatacactggatcacataagagccctggatcgcttacaggaagttccacatgagggcccaatgtgtgatctcttatggtcagatccagatgaccgtggtggctggggcatttctccacgtggtgctggctacacatttggacaagacatttctgaaacatttaaccatgccaacggcctcacactggtgtcccgtgctcaccagcttgtaatggaaggatataattggtgccatgatcggaatgtggtcaccatttttagtgcacccaattactgctaccgctgtgggaaccaggctgctatcatggaattagacgacactttaaaatactcttttcttcagtttgacccagcacctcgtcgtggagagcctcatgtgacccggcgcaccccagactacttcctataaattcctccccaggacctgtctttgtatgttgaagtatacctggctttttaaaaaatatatatacatatatatatttaaaaacaacagttatctgtgtgtctctgtaacaaattgtgctatgtcttgacgttaaaacacatcatggaccaaaacgtgccatactaatggtgagccatcagcacggtgtgaacttgagtccactgtcctagccgagtcaaccaggcagccgcctgcccgcctgcctgctgtagtagccgtccttcgtgactggttaagggaaagggtcactggtggcttcatctcctttgcgcttacttggaaatttagttacaagtttaactggcatggattatagagttggagttttatttttaagaattgacaagctgacttccacttaaattcataaccctttattttgttgaaatgtatgactaactgaagaagagattcttggagtatgttgtcataacactaagatttcctttcaagtttcctgaactgaattactgttggatgttgacctgcacattctgtatatttgtcctgacagtgttgcatcctccttgctgtactgaacaaataaacttcccaatttagagag

SEQ ID NO: 1920 - DNA, 4057 bp, Rattus norvegicus
  Genbank Accession No. NM_017048
aaaagagttgggagaagttgggagcggcgggggcgcgccccggggtgggcaccgggaaatcgtcgggagcgcgcgagggttccggaggatcaggggagacccggagacccccgggacacgaaatctagagctagcgggttatgcctccaccttgttgccctgaaagccgaagcgacagtgagaagggctaagatttggccatgagcagcgcccccaggcgccccgcctcgggcgcagattctttgcacacgccagagccagagagcctgagccccggaacacctgggttccctgagcaagaggaggaagatgaacttcgtaccttaggtgtggagcggttcgaggagatcctccaggaagctggatccagaggaggagaagagccaggccgcagctatggggaggaagactttgaataccaccgccagtcctcccaccatatccatcatccactctccacccacctgcctcctgacgcccgccgtcgcaagactccccagggcccaggacggaaacctcggaggcgccctggagcctctcccactggagagacccccactattgaggaaggggaggaagatgaggatgaagtcggtgaagctgaagggttcagagctcccccgcaacaaccatctcctgcctcttcaccctctgcagttcagttttttctccaagaggatgaaggtacagataggaaggcagagagaaccagcccatctccccctacacagacgccccaccaggaagcagctccccgggccagcaaaggggcacagacaggaactctggtggaggagatggtggccgtggccagcggcacggctggaggtgacgacggaggtgctgcagggcgccccctgaccaaagcccagcctggacatcgaagttacaaccttcaggagagaaggcgaattggcagtatgacaggggtggagcaggccctgctgcccagggtccctactgatgagagtgaggctcagacgctggccacagctgacctcgacctcatgaaaagtcaccggtttgaggacgttccgggggtacggcgacatttggtgaggaagaatgccaaagggtctacacaggctgcccgggaaggccgagagcctggccccacacctcgggcacgaccacgggccccccataagcctcatgaggtgttcgtagagctgaatgaattgcagttggacaaaaaccaggagcctcagtggcgggagacagcccggtggataaaatttgaggaggacgtggaagaggagactgagcgctggggcaagcctcacgtggcatcactgtccttccgcagcctcctggagctccgcaggacactggcccatggagctgtgctcttggacctcgatcagcagaccctgcctggggtggcccatcaggtggtcgagcagatggttatctctgaccagatcaaagcagaggacagagccaatgtgctacgagcccttctgctgaaacacagccacccaagtgatgagaaagaattctccttcccccggaacatctcagcgggctctctgggctctctcctggggcatcaccacgcccaggggactgagagtgatcctcacgtcactgagcctctcatcggtggtgttcctgagacccggctggaggtggatagagagcgtgagctgccgcccccagccccacctgcaggtattacccgctccaagtccaagcatgagctgaagctgctggagaagatccctgagaatgcagaggccacagtggtcctcgtgggctgtgtggagttcctctcccgccccaccatggcctttgtgcgcctgcgggaggctgtggaactggatgcagtactggaggtgcctgtgcctgtgcgcttcctcttcctgctgctggggcccagcagcgccaacatggactaccatgagattggccgatccatctccaccctcatgtctgacaagcaattccacgaggcagcctacctggcagatgaacgggatgacttgctgactgctatcaatgccttcctggactgcagtgttgtgctaccgccttctgaagtgcagggcgaggagctgctgcgttctgttgcccatttccagcgccagatgctaaagaagcgagaggagcagggccgcctgctgccccctggtgctgggctagagcccaagtctgcccaagataaggcactcctgcagatggtagaggtggcaggtgcagctgaagatgatccccttcggaggacaggccggccctttggggggctgatccgtgacgtgcggcggcgctacccgcactacctgagtgacttccgagatgcactagacccccagtgcctggctgctgtcattttcatctactttgccgccctgtcgcctgccatcacttttggggggctactgggggagaagacacaggacctgataggagtgtcagagctgatcatgtccacagcgctccagggagtgatcttctgcctgctgggcgcccagccactgctggtgatcggcttctcggggcctctgctggtcttcgaggaggccttcttctcgttctgcaagagcaaccagttggagtacttggtgggccgagtttggattggcttctggctggtgctcctggccctgctcatggtggctctggaggggagcttcctggtccgctttgtctcccgattcacccaggagatctttgccttcctcatatcactcatcttcatctatgagaccttctataagctgatcaagatctttcaggagcaccccctccatggctgctcagtctccaacgactcagaggcagacagcagcagtaacaatatgacttgggcagcaaccacactggcaccagacaacagcagtgcgtctgggcaggagaggccccggggccagcctaacactgccttgctatcactggtgctgatggccggcactttcttcatcgccttcttcctgcgcaaattcaagaacagccggttcttccctggccggatccggcgggtaattggggactttggggtgcccatcgcgatcctcatcatggtgcttgtggattacagtattgaggatacctacacccagaagctaagtgtgcccagtgggttctcagtgacagccccagacaagcggggctgggtcatcaacccccttggagagaagactcctttccctgtgtggatgatggtggccagcctgttgcctgccgttctggtgttcatcctcatcttcatggagacacagatcaccacgttgatcatctccaagaaagagcggatgcttcagaagggctctggcttccaccttgatctgttgctcattgtagccatgggtggcatctgtgccctctttggcctgccttggttggctgctgccactgtccgctctgtcactcatgccaatgcactcactgtcatgagcaaggctgtggcacctggtgacaaacccaagattcaggaagtcaaggagcagcgggtgaccgggctgctggtggccctgcttgtgggactctccatggtcattggggacctactgcggcagatccccctggctgtgctctttggcattttcttatacatgggagttacttcccttaatgggatccaattctacgagcggttgcacctgctactcatgccgcccaaacaccacccagatgttacctatgtcaagaaggttcggaccatgcggatgcacctgttcactgccttgcagctgctctgtctggccctgctttgggcggtcatgtccacagctgcttccctggccttccccttcatcctcatcctcacagtgcctttgcgcatggtggtacttacccggatcttcactgagcgagaaatgaaatgtctggatgctaatgaggcagagccagtgtttgatgagtgtgaaggtgtggacgagtacaacgagatgcccatgcctgtgtagctgctgtccagaggcatagcagagggactaaggggcaggggctggggggctggggagctggggctcccctcctcctgtccctcctcatttttatttaagtgaataatttaaagcccccttgtccccaccctgcagtaaagtgcttcaacccc

SEQ ID NO: 1921 - DNA, 3877 bp, Rattus norvegicus
  Genbank Accession No. NM_017049
tagtgactgagactcctaagtcttcagcccaaccatggctaatggggtgatcccaccgcccggggggccctcccccctaccccaggtccgggtgcccttggaggagcccccactgggtccagatgtagaagaggaggatgatgacttgggcaagaccttggctgtgagcaggtttggggacctcatcagcaagaccccggcctgggaccctgagaagcctagccgcagctacagcgagcgcgactttgagtttcaccggcacacatcccaccacacccatcacccgctctcagcccgcctgcctccaccccacaagctacggcgactgccccccacctctgctcggcacgccaggaggaagaggaagaaagagaaaacctctgctcccccctcagaagggacaccccctatccaggaggaggggggagctggagcagaagaggaggaggaggaagaggaggaagaagagggagagtctgaggcagagcctgtggagcctccacccccagggccaccacagaaagcaaagttctccattggaagtgatgaggatgacagcccaggtctttctatcaaggctccctgtgccaaggccctgccttccgtgggcctgccgtctgaccagagtccccagcgctccggcagctcccccagtccccgggcccgggcttcccgaatctctacagagaagagtcgaccctggagtccatcagccagctatgacctgcgggagcgattgtgcccaggcagtgccctgggcaaccctgggccagagcagcgggtgcccactgatgaggcggaggctcaaatgctgggttctgccgatctggacgacatgaagagtcatcggctggaggacaaccccggagtgcggcgacacttggtgaagaaaccatcccggatacagggtgggagaggcagccccagtggcctggcgcccatcttgcgcaggaaaaagaagaagaagaagctggatcggaggcctcatgaggtgttcgtggagctgaatgaactgatgttggaccggagccaggagccacactggcgggagacagcacgctggatcaagttcgaagaggatgtggaggaggagacagagcgctgggggaagcctcatgttgcttcgctctccttccgtagcctcctggagcttaggaggaccattgcccagggagcggctctcctggacctggagcagaccaccctgccgggcatcgctcaccttgtggtggagaccatgattgtatctgaccagatccggcccgaggacagggctagcgttctgagaactctgctcctgaaacacagccatcccaacgatgacaaggacagtggctttttccctcgaaatccgtcaagctccagtgtgaactcagtcttggggaatcaccacccaactcctagtcatggccctgatggtgcagtacccaccatggctgatgacctaggggagccagccccattgtggccacatgaccctgatgcaaaggagaagcccctccacatgcctgggggagacggtcaccgggggaaaagcctgaaactgctggagaagatccctgaggacgctgaggccactgtcgtgcttgtgggcagcgtgcctttcttggagcagccagcagcagcttttgtgaggctcagcgaggctgttctcttggagtctgtgctggaggtccccgtgcctgttcgcttcctcttcgtgatgctggggcccagccataccagcaccgactatcacgagctagggcgctccattgccacgctcatgtctgacaagctgtttcacgaggctgcctaccaggcagatgaccggcaggaccttttgggtgccatcagcgagtttttggacggtagcattgtgattcccccatcggaggtagagggccgagacctactccgttccgtggctgccttccagcgagagctgctgaggaagcgacgggagcgggaacagaccaaagtggagatgaccacccggggaggctatgtggcccctggcaaagaactgtctttggagatgggaggctccgaggcaacctctgaagatgatcccctgcagcggacaggctcagtgtttggggggctagtacgggatgtgaagcgccggtacccacactaccccagtgacctacgggatgcactgcactctcagtgtgtggctgccgtgctgttcatttatttcgcagccctcagccctgctattacctttgggggtctgctaggagagaagactgaggggctgatgggtgtgtcagagctgattgtgtccacggctgtgcttggggttctcttctctctgctgggggcccagccgctgctcgtggtgggcttctctggccctctgctggtcttcgaagaagctttcttcaagttctgccgagctcaggacctggaatacctcaccggtcgagtgtgggtgggcctctggctggtggtcttcgtcctggccctggtggcggctgagggcagcttccttgtccgctacatctcgccatttacccaggagatcttcgctttcctcatctcactaattttcatctatgagactttccacaagctctataaggtgttcacagagcatcctttgctgcccttctacccaccggaggaggccctggagcctggcttggaactgaatagtagtgccctgccccccacagagggaccaccaggtccccggaaccagcccaatacagctctgctgtccctcatcctcatgctggggactttcctcattgccttcttcctgcgaaagttcaggaacagccgcttcctggggggcaaggctcggcgcgtcatcggggacttcggcattcccatctccatcctggtgatggtccttgtggattactctatcacagacacctacacacagaagctgacggtgcctacagggctctcagtgacttccccgcataagcgcacgtggttcatcccacccttgggcagtgcccgccccttcccaccatggatgatggtggctgctgctgtccctgcactcttggtcctcatcctgatattcatggagactcagatcactgcgctcatcgtcagccagaaggcacggaggctactcaagggttccggcttccatcttgacctgctgttgattggctctttgggtggcctctgtgggctcttcggcttgccctggctcacagccgccactgtccgctctgtcacccatgtcaacgcgttgacggtgatgcgtactgccattgcacctggtgacaagccccagatccaggaggtgcgggagcagcgagtcaccggggtgctcattgccagcctcgtgggtctgtctatcgtcatgggagctgtgctgcgcaggatcccgttggccgtgctctttgggattttcctgtacatgggagtcacatcactgtctggtatccagttgtcccagcgtctgctgctcattttcatgccagccaagcatcaccccgagcagccctacgtgaccaaggtgaagacatggaggatgcacctgttcaccttcatccagctgggctgcatcgcgctcctctgggtggtcaagtcaacggtggcctcactggcctttcccttcctgctcttgctcacggtgcctctgaggcgttgccttttgccccggctcttccaggacagggagctgcaggcgctggactctgaagacgcagagccaaactttgatgaggatggtcaggatgagtacaatgagctccacatgcctgtgtgaccctcaagatggtggccctccgagaccccaccttggtgactcacctcaggacccagggatgtgcctggagtcactgcccatgccaggacagtggccccttgactttcacagcccagacggcaccggctttgaagtcattataacacactccttgtcttg

SEQ ID NO: 1922 - DNA, 650 bp, Rattus norvegicus
  Genbank Accession No. NM_017050
gttttgcaccttcgtttcctgcggcggcttctgtcgtctccttgctttttgctctcccaggttccgaggccgccgcgcgtctcccggggaagcatggcgatgaaggccgtgtgcgtgctgaagggcgacggtccggtgcagggcgtcattcacttcgagcagaaggcaagcggtgaaccagttgtggtgtcaggacagattacaggattaactgaaggcgagcatgggttccatgtccatcaatatggggacaatacacaaggctgtaccactgcaggacctcattttaatcctcactctaagaaacatggcggtccagcggatgaagagaggcatgttggagacctgggcaatgtggctgctggaaaggacggtgtggccaatgtgtccattgaagatcgtgtgatctcactctcaggagagcattccatcattggccgtactatggtggtccacgagaaacaagatgacttgggcaaaggtggaaatgaagaaagtacaaagactggaaatgctggaagccgcttggcttgtggtgtgattgggattgcccaataaacattccctatgtggtctgagtctcagactcatctgctgtcctgctaaactgtagaaaaaaaccaaaccattaaactgtaatcttaacagtt

SEQ ID NO: 1923 - DNA, 1358 bp, Rattus norvegicus
  Genbank Accession No. NM_017052
cgacctcaaagcaagagagcgacatggcagctcctgctaagggcgagaacctgtccctggtggtgcacggacctggagacattcgcctggagaactacccaatccctgagctgggcccaaatgatgtgttactaaagatgcattcggtggggatctgtggctcggatgttcactactgggagcatggccgaattggggacttcgttgtgaaaaagccaatggtgcttgggcatgaagctgctggaacagtcacaaaagtgggaccgatggtgaaacatctaaaaccaggagatcgggtggccatcgagcctggcgttccccgagaaatagatgaattctgcaagatcggccgatacaatctgacgccatccatcttcttctgtgccacgcccccagatgatgggaacctctgccgcttctacaagcacagcgctgacttctgctacaagcttcctgatagtgtcacctttgaagaaggggccctgattgagcctctctctgtggggatctatgcctgccgtcgaggttcggtttccctggggaacaaggtccttgtgtgtggagctgggccaattgggatagtcactttgcttgtggccaaagcaatgggagcttctcaagtagtggtgattgacctctctgcttctcggttagccaaggccaaggaagttggagcagactttaccatccaggttgccaaagagacccctcacgacattgccaagaaggtggaaagtgtgctggggagcaagccagaggtcaccatcgaatgcacgggagcggagtcctctgtccaagacggcatctatgccactcactctggcgggaccttggtggttgtgggaatgggccccgagatgatcaatttacccctagtgcacgcagctgtgcgggaggtggacatcaaaggcgtgtttcgatactgcaacacgtggccgatggcagtttccatgcttgcatcgaagactttgaatgtaaagcccttagtgacccataggttccccctggagaaggctgtagaagcctttgaaacagccaaaaagggactggggctgaaagttatgatcaagtgtgaccccaatgaccagaacccctaaatgtgattgctctatgcccttagcccactctctcagcatctaagggctaaatggaccagaaggggaagccattaatgcagaaccttctttttgaatggtaggaataataaactcataagccgagagccttagaggagctggcgtgccttaaagacagaagtaggggcaccttgggggacctcgtagccagaatgagatgcgtatactgagtaaagtctagaaccaagagtctggcagagaggtcccgaaatgccctttctc

SEQ ID NO: 1924 - DNA, 579 bp, Rattus norvegicus
  Genbank Accession No. NM_017059
atggacgggtccggggagcagctcggaggcggcgggcccaccagctctgaacagttcatgaagacaggggcctttttgttacagggtttcatccaggatcgagcagagaggatggctggggagacacctgagctgaccttggagcagccgccccaggatgcatccaccaagaagctgagcgagtgtctccggcgaattggagatgaactggacaataatatggagctgcagaggatgattgctgacgtggacacggactccccccgagaggtcttcttccgggtggcagctgacatgtttgctgatggcaacttcaactggggccgcgtggttgccctcttctactttgctagcaaactggtgctcaaggccctgtgcactaaagtgcccgagctgatcagaaccatcatgggctggacactggacttcctccgtgagcggctgcttgtctggatccaagaccagggtggctgggaaggcctcctctcctacttcgggacccccacatggcagacagtgaccatctttgtggctggagtcctcaccgcctcgctcaccatctggaagaagatgggctga

SEQ ID NO: 1925 - DNA, 966 bp, Rattus norvegicus
  Genbank Accession No. NM_017060
  misc_feature (1)..(966): n = a or c or g or t
ggcgtgaggaggttggagagttttttctgggacctaaacaaaggcacccncggccctnctaanctgaagttgagcctcacatatcctggaaaggaaaatgcccataccagaacccaagcctggagatctgattgagattttccgccctatgtacagtcactgggccatctatgttggtgatggatatgtgatccacctggctcccccaagtgaaatcccaggagctggggcagccagcatcatgtctgctttgacggacaaggccatagtgaagaaagagctgctgcgtgatgtggctgggaaggacaagtaccaggtcaacaacaagcacgacaaggagtacactccgctgcctctgaacaagatcatccagcgagctgaggagctggtggggcaggaggtgctgtacaggctgaccagtgagaactgtgagcacttcgtgaacgaactgcgttatggagtccctcggagtgaccaggtcagagataccgtcaaggtggcgaccgtcactggagtgggcttggcggccttgggcctcattggagtcatgctctcaagaaacaagaaacagaagcagtgagctgaatgactatccagctttagggctcttcttttgctagagggntggagtttgatttatagattctactgctttataattaggtatattttcacaatatacaataaaccacaagaagggaattttcatggagtacactgtagctatcttcagacacaccagaagagggcaccagatcccattacagatggttgtgagccatcatgtggttgctgggatttgaactcaggacctccggaagagcaatcagtgctcttaaccgctgagccacctctccagccctgaagggctctttcaaaggtttattctttctcctttcacaagtcggcatcgaaacttccaagtgtcctcaaagtccagggctccttggactccataacgtttct

SEQ ID NO: 1926 - DNA, 4557 bp, Rattus norvegicus
  Genbank Accession No. NM_017061
cttctacttcagacactgtgcgctctcccggaccgtcgtgcgccgctccccgtcgccttccaggactgggaaaggggagaggaggacggtgccacgtccgacggcctcctgggctgggggcagggtctgccgctcgcccttggcaccagtccctgcgacccatccccgagcctcgccctcctcctccctgctcgaagaggtctccctccttcgcgggatctgagtccctgtcttcatttttctcctagccacgtccctccccgagaagggacgagccgggagcatcatgcgtttcgcctggaccgtgctctttctgggacagctgcagttctgtccccttctccgctgcgccccgcaggccccgcgcgagcctcccgccgcccccggtgcctggcgccagacaatccaatgggagaacaacgggcaggtgttcagtctgttgagcctgggggcgcagtaccagcctcagcgacgccgcgactccagcgccactgccccgagagccgacggcaacgctgcagcacagccacgcacgcccattctgctgctgcgtgacaaccgcactgcctctgcccgtgcgaggactccaagcccatctggggtcgccgcgggtcgtccccggcccgcagcccgccactggttccaagttggtttctcgccgtcgggggccggcgatggagcctcaaggcgcgcagcgaaccggactgcgtcgccacagcctccgcagctcagtaatctgaggccacccagccacgtagatcgcatggtgggcgacgacccctacaatccctacaagtactccgacgacaacccctattataactactatgacacttatgagagaccccggtccgggagcaggcaccgacctggatatggcaccggttacttccagtacggtctcccggacctggtacccgatccctactacatccaggcatccacgtacgtacaaaagatgtctatgtacaacctgagatgcgctgcggaagaaaactgcctggccagttcagcatatagggcggatgtcagagactatgaccacagggtactgctacgatttcctcagagagtgaaaaaccaagggacgtctgacttcttaccaagccgcccccgctactcctgggagtggcacagctgccaccaacattaccacagcatggatgaattcagccactacgacctgctggatgccagcacacagaggagagtggccgagggccacaaagcaagcttctgtctggaggacacttcctgtgattatgggtaccacagacgatttgcctgtactgcacacacacaggggttgagtcccggatgttatgatacttatgcagcagacatagactgccagtggattgatattacagatgtacaacccggaaattacattctaaaggtcagtgtaaaccccagctacctggtgcctgaatcagactacagtaacaatgtcgtacgctgtgaaattcgctacacaggacatcacgcctatgcctcaggctgcaccatttcaccgtattagaaagaagctcaccttcccaaaggatgaagcagtacctggtgtttggacctatgaaaaccgtagattagcttaagtaggaagacttagatattttaaaaggcaaacggaaaaacaacaaagaaggttttgtttggactctttcacaacaaatcacataactggattttgagtgtttaaatcagcattagattggcacattttaaatacttattcatgttgctttatgaagtaatggtgtttcaattctgtgggtgcatagtgggctctttcaaagaattctgaatttcttaccttcttttgaaattatagtgcaaaaagaagaggatattttaatgaatgagccacaatttgaactgattactttctaaattgccagacccatgagacaatgatgatgggtttgtatttgcctcaacatagattcgctttttaaaaagggtgttcctattgtataggcaaaaatggatacacttggtgctgaggaagggtcaaatactaactattgttgtcacgaaatataggtctacagcagagagatggtgagtatatattcagatagttacatccctatataaactatgtttacattttagatgcttttctttctgttaattgcttaatctcactctgacttgaggtacaacttctgttttggaatgaattagataattccagattctggtttgataattgttgacattcccccatgctactttttctgagggcagaaacgtctaatgtgacgactcttcacattaccattacgaggatacacagcacagcgaaatcattccgatgacaggtgtgatagatggagagctaacatgcaactgccgagtgtttcactgttagccagaactaagtcactgcccacacagcaattacaccatgaatctctaacatcacaaccttctttcaaatactgtaaaaaaaaaaatactggaaaacctttttagatttgtttcaatctaccacgcttctgaaatgttcagctattaaggggaatgtcaatatatatatacagcccaaattagcgaagcccaaattagggaagcacatagcatggcatacttgagaggttggcaaacaagagggaagcaggtactttctgcaaaaacagggactgtgcgccacaatgagaccgctgtgaccttacttcaaactgtgaaactgtgtgcagcagtaggatttggagtcttaaattcagaaggagcagaaagaaagagagttagacgtttgaattcctggtgcttatgctgacgttttctctcatttgccagcattaaaatctcaagtaaggtgtctcctgtgccaggacgtgtcaggtagacctttctcagtgagctggaatcctgccttctgtgtcatagagttgtaagagcagcagtttctacccatcatgctgtgtactcactgctgcagagcaagtgggaggggccagagatgggccgtccccaggggcggatagcgcggtacacttaattctcttctgcctgaaagcacacttccccgtaagcgaatacagacagaactttgattgagctggtatctgaccgataggattgcttctttgatgtacctctttgacctagctagcatttcagctttgatactgcagaacgatcttttcaaattataatcattctgatagagatatcttaatagacgtgcttttaaaaacaaaacggaaactactgtcagtatgaatactgagccagactggcattcatagatttaacaacttgtatttctaagattcttaactctataaaagtaatatggcttttagatatataggataataatttcagtgagaccgttatctctttactcaacattatgttagggacagtataagccaagcacttacctgttacacattggagactaaaacgactgcccccaaccttagtaagtatgaaaactagactcacattatttcatttttaactgctaaaagtatgtctatagaatttaaaatttaagcactactatttgtcctggccacatttttcaaaaattaagttaaaagttattaattatatacaggtgtgtatttctaataattaaaatacctttcaaatccatggaatgtctgccttttaaatgtaatttgggcttttttgtttgattctttttcacttaactagctgtttatttgtaaacatttctttccacgatttaaaaacacttccaatcggctttacttcctgatttagcacttcctattttgacccttgggcatctgttcttcgtttaattggtgtagaataatgataaaaatcccaagctagtctaaccaaactgcattcttaagagtactaagtgggaatgatgcaaagttcatcaagaattgaaaagaagccggtctttgcactaaggaagacagcataattaagtcttctcgttgccatctgagtaatatcatgatatggggaccgcagaatccatctccggtgggatgatggtatagctttcctagttccagaaaaaatctccttcacattttatataataatttaatcacaatgtccatcgaattcttccttaggcattctttgtaacagtagtgtgctgctctttaaaatattaacctctgacacatgtgtgaacctcattccctgtggtcactaaaatttcttccccactgagcatcaatctttagcagattttaggaaaatactgaattcttagtcaggaaatattttaggaataatcttgctaacagtatattaagtaataaaattacccactctatgtgtgtttcattttttttaatttacatagacaatggtttttataaagcaatgatttcaatttttcccagctacccaaagtcctggttaatttgtgaacacaaattttgttagccttcaagtttaaacggtgctgaattgtcttaacttgaatgtaaaaatggattaaggcttatctcatgggacacaaacatgtcccatatgactgcttgctgcgtactaggggacatgccatttggtgttaaattgtctataataaagttcggtttctcccaaaaa

SEQ ID NO: 1927 - DNA, 2991 bp, Rattus norvegicus
  Genbank Accession No. NM_017063
tgcttcccacccgacccccaacccccatccccagttggagccgccgcccgagaggccgggccgtcgtcttgggaggagtccccgccgccgtcacctccgccatggagctcataaccatcctcgagaagaccgtgtctccggatcggctggagctggaagcggcgcagaagttccttgagcgtgcggctgtggagaatctgcccacgttcctggtggaactgtccagagtgctggcaaatcccggaaacagtcaggttgccagagttgcagctggtctacaaattagactcttgacatcgaaggatccagatatcaaggcacagtaccagcagaggtggcttgctattgatgctaatgctcggcgggaagtcaagaactatgttttgcagactttgggcacagagacttaccggcctagttcagcctcacagtgtgtggctggtatcgcttgtgcagagatcccagtaagccagtggccggaactaattcctcagctggtagccaatgtcaccaaccccaacagcacggagcacatgaaagagtccacactggaagccatcggttacatttgccaagatatagacccggagcagctgcaggataaatccaatgagatcctgactgccataatccagggcatgcggaaggaagagcctagtaacaatgtgaagctggccgctaccaacgcgctcctgaactcactggagttcaccaaagcaaacttcgacaaagagtctgaacggcactttatcatgcaagtggtctgtgaagccacacagtgtccagatacaagggtaagagtggctgctttacagaatctagtgaagataatgtccttgtattaccagtacatggagacatacatgggccctgccctctttgcaatcacaattgaagcaatgaaaagtgacattgatgaggtagctctccaagggatagagttctggtccaatgtctgtgatgaggaaatggatttggccattgaggcttcagaggcagcagaacaaggacggcccccggagcacaccagcaaattttacgccaagggagcgctgcagtacctggtgcccatcctcacacagacactaactaaacaggatgaaaacgatgacgacgatgactggaacccttgcaaagcagctggggtgtgcctcatgctcctgtctacctgctgtgaagatgacattgtgccacatgtccttccctttattaaagagcacatcaagaaccctgactggcggtaccgggatgcagcagtgatggcttttggcagcatcttggaaggaccagagcctaaccagcttaaaccattagtcatacaggctatgcccaccctgatagaattaatgaaagaccccagtgtagttgttcgagatacaacagcatggactgtgggcaggatctgtgagctgctgcctgaagctgccatcaatgatgtctacttggcaccccttttacagtgtctgattgagggtctcagtgctgaacccagagtggcttcaaatgtgtgctgggctttttccagtctggctgaagctgcttacgaagctgcagatgtagctgatgatcaggaagaaccagccacctattgcttgtcttcttcctttgaacttatagttcagaagctgctggagaccaccgacagacctgatggacaccagaacaacctgagaagttctgcatatgaatctctaatggaaattgtaaaaaacagtgccaaggattgttaccctgcggtgcagaagaccaccctggtcattatggaacggttgcagcaggtgcttcagatggagtcccacatccagagcacgtcggacaggatccaattcaatgacctccagtctctactctgtgcaactcttcagaatgttctctggaaagtgcagcatcaagatgctttgcagatctctgatgtggtcatggcctccctgttaaggatgttccaaagcacagctgggtctggcggagtgcaagaagacgccctgatggcagtcagcacactggtggaagtgttgggtggtgaattcctcaagtacatggaggcctttaaaccattcctgggcattggattgaaaaattatgctgaatgccaggtgtgtttggcagctgttggcttagttggagacttgtgccgagccctgcagtctaacatcttacctttctgtgatgaggtgatgcagctgctcctagagaacttagggaatgagaatgtccacaggtctgtgaaaccacagattctgtctgtgtttggtgacattactcttgccattggtggagaatttaagaaatacttggaggttgtactgaatacactgcagcaggcctcccaagcccaagtggacaagtcagactttgacatggtggattatctgaatgagctaagagaaagctgcttggaagcttatacgggaatcgtccagggattgaagggagaccaggaaaacgtacaccctgatgtaatgctggtgcaacccagagtagaatttattttgtcttttattgatcacattgctggagatgaggatcatacggatggagtggtagcttgtgctgctggactgataggggacttgtgtacagcatttggaaaggatgtactgaaattagtagaagctaggccaatgatccatgaactattaactgaagggcggagatcgaagactaacaaagcaaagacccttgctacgtgggcaacaaaggaactgaggaaactgaagaaccaagcttgatctggtaccattgggatgatgacctgagacccccactggaaatctccaatcttttgaaagaacccggaagtgaggagtgtgcacggatgctgaatgtttgggaatgagaggatgagtgagtgaggcttgaaaacaccacactgaaaatcctgccacagccaacagcagcagcgctgttagtgagctaagtaagcactgactttgtagaaaacacaacatcagccatcttggaacagagaaacaatggatttacttacttact

SEQ ID NO: 1928 - DNA, 1548 bp, Rattus norvegicus
  Genbank Accession No. NM_017068
gtcggtggtcgcccgtgctttcgctttctcagggctgtgagggtgttcgttggaattgtcggtccagtcgtcacttgtcctgagggatcacgatgcgccttcctctctccggttacggctcgaagctcgtcctgctctttctgttcctgggagcagttcggtccgatgcattgaaacttaatttgacagattcaaagggtacttgcctttatgcagaatgggagatgaatttcacaataacatatgaagctctaaaagtcaatgaaactgtaaccattacagtgcctgacaaggtgacatacaatggaagcagttgtggcgatgataagaatggtgccaaaataatgatacaatatggatccactctctcttgggctgtgaatttcaccaaggaagcatctcagtattttattaacaacatcacgctttcttacaacactaatgataccaaaacatttcctggtgctgtacctaaaggaatccttactgttatcattcctgtgggatcccagcttccattgggtgtcatctttaagtgcagtagtgttttaactttcaacctgagtcctgttgttcagcactattggggcattcacctgcaagcttttgtccaaaatggtacagtgagtaaacatgaacaagtgtgtaaggaggacaaaactgctaccactgtagcacccatcattcacaccaccgtgccatcgcctactacgacactcactccaacttcaatacccgttccaactccaacggttggaaactacaccatttctaatggcaatgctacctgtctgctggctaccatggggctgcagctgaacatcaccgaggagaaggtgcctttcatttttaacatcaaccctgccacaaccaacttcaccggcagctgtcagccccaaacagctcaacttaggctgaacaacagccaaattaagtatctcgactttatctttgctgtgaaaaatgaaaaacggttctatctgaaggaagtgaatgtcaacatgtatttggctaatggctcagctttccatgtttcaaataacaaccttagcttctgggatgctcctctgggaagttcttatatgtgcaacaaagagcaggtggtttccgtgtctcgaacatttcagataaatacctttaacctgaaggtgcaaccttttaatgtgacgaaaggagagtattctacagctcaagactgcagtgcagatgaagacaacttccttgtgcccatagcggtgggagcagccctgggaggagtacttattctagtgttgctggcttattttattggtctcaagcgccatcatactggatatgagcaattttagcacctacaatctgattgaatatattacaaaatacatacaaataacaaagttgtcttacctgtcagtttatgaaacactttgctacttaagacagactccttggaacttttatttggaaatcagtccccacaatttgagataaggctttttttgaaaaaaaacaaaaaacaacaaaaaaacaaaaaacaaaaaaatcattctctgatctgcttaaaatgca

SEQ ID NO: 1929 - DNA, 2793 bp, Rattus norvegicus
  Genbank Accession No. NM_017073
acagccgagaatgggagtagggcggagtgtttgagcagcacacccatttcctctccgctcttcgtctcgttctcgtggcctgtccacccatccatcatctgccggccaccgctctgaacaccttccaccatggccacctcagcaagttcccacttgaacaaaggcatcaagcagatgtacatgaacctgccccagggcgagaagatccaactcatgtatatctgggttgatggtaccggggaagggctacgctgcaagacccgtactctggactgtgaccccaagtgtgtagaagagttacccgagtggaactttgatggttctagtacgtttcagtctgaaggctccaacagcgacatgtacctccatcctgtggccatgtttcgagaccccttccgcagagaccccaacaagctggtgttctgcgaagtattcaagtataaccggaagcccgcagagaccaacctgaggcacagctgtaagcgtataatggacatggtgagcagccagcgcccctggtttggaatggaacaggagtatactctcatgggaacagacggccaccctttcggctggccttctaatggcttccctggaccccaaggaccctattactgcggtgtgggagctgacaaggcttatggccgagatatcgtggaggctcactaccgggcctgcttgtatgctggaatcaagatcacagggacaaatgccgaggttatgcctgcccagtgggaattccagataggaccctgcgaagggatccgcatgggagatcatctctgggtagcccgttttatcttgcatcgggtatgcgaagactttggggtgatagcaacctttgaccccaagcccattccagggaactggaatggggcaggctgccacaccaactttagcaccaaggccatgcgggaggagaatggtctgaggtgcattgaggaggccattgataaactgagcaagaggcaccagtaccacatccgtgcctacgaccccaaggggggcctggacaacgcccgccgtctgactggattccacgaaacctccaacatcaacgacttttccgctggcgttgccaaccgcagcgccagtatccgcattccccggattgtcggccaggagaagaagggttactttgaagaccgtcggccttctgccaattgcgacccctatgcggtgacggaagccatcgtccgcacgtgtctcctcaacgaaactggcgacgagcccttccaatacaagaactaagcggactcgacttccagtgatcttgagcccttcctagttcaccccactcccaactgttccctctcccactggtccccactgtaactcaaaaggatggaataccaaggtctttttattccttgcgcccagttaatttttgcctttattggtcagaatagaggggtcaggttcttaatctctacacacccaaccccttctttcctagctagctttccagtgggggaacgggagggggtggggaagggtaacccaccgcttcatctcagcgggaatgcatgtcctgtaggcatagctgtcacaaatcgggtgtacttgtggtgagggaggactggttttttttttccttcaggataattgaaagggcaggcccaacagcttagattaacattttctctgtcagtagagagctgttatttcttccggtgaaaccagctttctattgaagtctggtgaggagttggaggttggtctcttggcttccttagcttagggaaggggagttcaccctcccttcatgaaacacagttcacctgacaaatggccctactgtaaaggaagaaaaaagtttcttggtcctccatttataactcaaagcagagtagtatttttatatttaaatgttaaaaacaaaaaagttatatatatgggtgtgtggatatatatgtcttttctaattgagaaaaccatcctattccctgggtgccaagtttgagtgaggagctcggtgtagaagtgaggcactcttgaggtaggggtggggatgcagtactgggaaagttggttatcttgggggttcagcttcattactacttagggtttccctgcccactctgcaggagcagatgttggacaggtagccagtgggatgccactgcttgccgccactgtccctgggcttagtttaaggggacgtgtatacctaatccacacacgagttagaagtatgagttggctggtcaacttgaacattgttacaggcgggtgggtgttagtggggggttattttttggtgggactagcatgtcactaaagcgggccttttgatatattaaattttttaaagcaaaacaagtttagattttaatcaagttcgtagggtttctaactttacagaattgcctgtttgtttcaatgactccttccacttggctcttaggggaactgaggacaggcctggagttaatacacttgtcattctgtgtcctagtgtcctcttcctccggcagactgtccccttccttctgaaaaagccgatagagtcttgttttatttttcttttataataaacacaccccacctccatcccagcttgttgccttgcagttttctggatgtttgtgtcggcagcaggcagctgtggtttttttctcttgccacgatgactctaattaccatgtatagtatgttcagttagataactcactgtaaacagactgtaactgagagcagagcttgtaaatcaacctaacgtttataagatttcctctgacttgtttctttgtggttccaaaaaaaaaaaaaaaaaaaaaaacctcaaaaact

SEQ ID NO: 1930 - DNA, 1715 bp, Rattus norvegicus
  Genbank Accession No. NM_017075
gacaagcttttccggtctccatggctgccctggcggttctacacggcgtcgtccgcaggcctctgctccgcgggctgctgcaggaagtaagatgcctgggacgaagttatgcatccaaacccactttgaatgatgtggttatagtgagtgctacacgaactcccattggatccttcctgggcagccttgcctctcagccagccaccaagcttggtactattgcaattcagggagccattgaaaaggcagggattccaaaagaagaagtgaaggaggtctacatgggcaacgtcatccaagggggagaaggacaggccccgaccaggcaagctacactgggtgcaggtctacccattgccactccgtgcaccacagtaaacaaggtgtgtgcctcaggaatgaaagccatcatgatggcctctcaaagtcttatgtgtggacaccaggatgtgatggtggcaggcggaatggagaccatgtcaaatgtcccgtacgtaatgagcagaggagcaacaccatacggtggggtaaaacttgaagacctgattgtgaaagacgggctaaccgatgtctacaataaaattcatatgggcaattgtgctgagaacaccgcgaagaagctgagtatctcgcgggaggagcaggataagtacgccatcggctcttacacccgaagtaaagaggcgtgggatgcagggaagtttgcaaatgagattacgcccatcaccatctcagtgaaaggtaaaccagacgtggtggtgaaggaagatgaagagtacaagcgagttgacttcagtaaagtgccaaagctcaagacagtgttccagaaagaaaacggcacagtaacagctgctaacgccagcacactgaacgacggagcagctgctgtggttctcatgactgcagaggcagcccagcggctcaaggttaagccactggcacgaatcgcagcatttgctgatgctgctgtagaccccattgatttcccactcgcacctgcatatgctgtacctaaggttcttaaatatgcaggactgaaaaaagaagacattgccatgtgggaagtaaatgaagcattcagtgtggttgtactagccaacattaaaatgctggagattgaccctcaaaaagtaaatgtccatggaggagctgtttctctgggccatccaatcgggatgtctggagctcggattgttgttcacttggctcatgccttgaagcaaggagaattcggtctggctagtatttgcaatggaggaggaggggcttccgccgtgctgattgagaagctgtagacatcttgttttaggagacagttccacgtgacccgctgaagtgaactaccccttgggccagattatattcaggataagctatttcattttttattattttctactaaaaatttttaaaaatcacatccaaaaacccattgaaattgcaaataaaaatttctcctcctttaatattttgtaaacagtcggatactctactattgaaatatactgtaggtactagaggcatggctcagccgttaagagcacttgttgctacctgtgtggtgcatggctttaatcccagcacttggagacagaggcaagtgcatctttctgagttaaagttagcctggtccacagagctagtgccctgacagccaagactacacagagtagtagaaactctgggggaaaaaaaaaaaacaaataaaaaaaaaa

SEQ ID NO: 1931 - DNA, 2171 bp, Rattus norvegicus
  Genbank Accession No. NM_017076
ccttgccgctcgctgctagcttggatccgcgtggactacagggactgaatcggacccggaaccacatggccccactcgccggtgcctctcgctcccgggtgtggtcagcggggctactgaggctgctgctgctgtcctgctttacgctccagaaagcgggtggggagatagctgtgcaggtgctctccaattcgaccggcttcttgggagggtctacagtcttgcactgtagtctggcttccaaagacaatgtgacaatcactcagctaacatggatgaagagggatccagatggatcccacccttccgtgcctgtcttccaccccaagaaggggcccagcatctctgatccagagagggtgaagttcttggttgccaaggtgtacgaggatctgaggaacgcatctctggccatctcgaacttgcgtgtagaagacgaaggcatctatgagtgtcagattgccacgttccccacaggcagtaagagcgccaatgtctggctgaaggtgttcgcccgacctaaaaacacagcagaggccctggagccctctcccaccttgatgccgcaggacgtggccaaatgcatctctgctgatggtcaccctcctggacgaatcacgtggtcctcgaatgtgaatggaagctaccgtgaaatgaaggaaacagggtcccagccgggcaccaccacagttatcagctacctctccatggtgccttctagccaggcagatggcacgaacatcacctgcacagtggaacatgaaagcttccaggagccggaccagcagccattgatcctttccctaccttatccacccgaagtgtccatctctggctatgaaggcaactggtacattggcctcactaacgtgaacctgacctgtgaagctcgcagcaaaccaccgcccaccaactatagctggagcacggccacgggtccccttcccaactccactcatttccaggaaaacggcagtcacctgctaatctccaccgtggatgacctcaataacacgatctttgtgtgcaaagccatcaatgccctagggtctgggcagggccaagtgaccatcctagttaaagaggcatctgagattctgccgccaaagacaagcttaggcactggctacatcattgccatcgtcttttgtgtcctgatcatcggagtagtagcaggcattgtattctggaaatacaggcgtggttgtggtcggcagtccaggaccttagacagggagaacgtccgctattcagcagcgaatggcgtctctgtcccaaacgtggagacgaacaacttgaggtgatggtgctggggtagacagaactaaggaacttgaagacataacaactggaaccctacttccacaaaagaaaaagcctccagagagacttgactgtccagtgtggcgaacatagcaaggttgggggtctccttggccgctgccgaattccgcattgtcgaaaggactcatggaacccggtgtgctgactcacacttgacatctcagcaagcgagggccacataaagcaaggttgagtctagcacggctgtagagagaagccctgtctatacacaggcaagctaaggggctttgagacagtcagaaactgaagtctttctttgggtaaggtaaatcctctacctcgtgtatgtgacaaacttgaaagacttctacctctgagactcaagtgcggactctctttatagctgactcagctggggctaacccctctctcctctctggacaaggtctcagagtgtagccaaagctagaccgaaactcacagaggtccgtctgtctctacctcccaagtgctgcagttaaaggtttgtgtgtgccacactcctttgctaggtctttttaataaagtaaatatttaataaagtaatatatttataaaaaaactagttataatatatattttttgagacagtgtttcctgtagcccaggctgacctcaaacttactatgtagccaagaatgatagtaaactaatttattttaatttgtcttcaagcttaaacatagcccaacccctgctcctttccctctcttctctcaatccattttcgtcttctttttcttcccagacactattctgatgtatgtcttcattgcaaacattttattgaccttcgtaaaaatgtgtgaaccacagataaaaaaaag

SEQ ID NO: 1932 - DNA, 1835 bp, Rattus norvegicus
  Genbank Accession No. NM_017079
ggtaggctcagtgcctaaaagccacagagccccatcaggcggggagcagggtaaagtgcagaagtcggagcccagggctgtgtagaccgccggcactatgctgtacctaccgtgcctgttgctgtgggcattcccacagttctggggacaatccgaagtccagcagaattacaccttcggctgcctgcagatctcttccttcgccaaccgaagctggtcccgcacagacagtgtggtctggctgggggatctgcagacacaccgttggagtaatgactcagacaccatcagcttcacaaagccgtggtcccagggcaaattcagtaaccagcagtgggagaagttgcagcatatgtttcaagtgtatcgaaccagctttaccagggacatcaaggaaatagtcaaaatgatgtcacctaaagaagactatcctatcgaggtccaactgtctgctggctgtgaaatgtaccctgggaatgcttcagaaagctttttacacgtagcatttcaaggagaatatgtcgtgagattccatggaacatcctggcagaaggtcccagaggccccatcttggttagatttgcccatcaaaatgctcaacgctgatgaaggaacgagagaaacagtgcagatactcctgaacgacacctgcccccagtttgtccgtggcctcctagaagcagggaagccagacctagaaaagcaagagaagccagtggcctggttatcccgtggccccaaccctgcccatggccatctgcagctggtatgtcatgtctctggcttccacccaaagcctgtgtgggtgatgtggatgcggggtgaccaggagcaagggggtactcacagaggtgacatcctgccaaatgcggatgagacatggtatcttcaagcaaccctggatgtggaggctggagacgaggctggcctggcctgcagggtgaagcacagcagtctagaggggcaggacatcatcctctactggggtggcagacaagtatccccggtgttgatcttcttgatagtaggcgtactggttctagtggtgtgtgctgtggcctactatatcatcaggaaaaggagacgctcctatcaagacatcatgtgagatttttacccctgcctctcctgaagttcagaccttccaggttctaggacttcagtccttgtctgctcagaaactgaggataaaaaagaggaatcctgaagaaatgaagagcaaccagtacacccttttaatattaattataagaaatcaattatttaaatgatttttataagcttgggtagttcagaacaaacacaactgcacatgtgtgtacctgccagaaacaagctgtgagcagtgtctcgtgggatttgtactgaactagacagcacgcttcctgcccaaacagacactttgggggttgttggcaagtgtaaagtccaacaccaacacgactgtactctgtatttttcaagataacgagaaaaatggatttgtgtgtgtgtgtgtgacatatagctttggggtttgttggcaagtataaagtccaacaccaacacgactgtactctgtatttttcaagataactagaaaaatagattttgtgtgtgtgtgtgtgtgatacaagtattttaaaaagtaaactcaaatatttacaaatgattactaccttaaatacaaagctgctgactgatgattaccccaaaggcttcttccagtgtgtggtctttttacaatgtttgttctaattgtcataatggccactttagggcacagtctccattgaaaatgtgcattaatgactgaaaggtggtttctctttaaaataaaattaggatgtacgatg

SEQ ID NO: 1933 - DNA, 2446 bp, Rattus norvegicus
  Genbank Accession No. NM_017087
ccaggagtgagcagctgctcccggttggccctgacggacagacaaaccgacagcctgacatcctagtccaccaactaaccagcctgtacctggctgcttccccctccccaggaacattgaccatgcgtcccctgtggctactcaccttgctgctggctctgagccaggccttgccctttgagcagaagggcttctgggacttcaccttggatgatgggctgctcatgatgaatgatgaggaggcttcaggctcagacaccacttcaggtgtccctgacctggactctctcacacctaccttcagtgccatgtgtccttttggctgccactgccacctgcgggttgttcagtgctctgacttgggtctgaagactgtgcccaaggagatctcacctgataccacactgctagacctgcagaacaatgacatctctgaactccgcaaggatgacttcaaaggcctccagcacctctatgctctggtcctggtaaacaataagatctccaagatccatgagaaggcctttagccctctgcggaagctgcagaaactctacatctccaagaaccacctggtggagattcctcccaacctgcccagctccctggtagagctacgaatccatgacaaccgtatccgcaaagtgcccaagggcgtgttcagtgggctccggaacatgaactgcattgagatgggtgggaatcccctggagaacagtggctttgaacccggagcctttgatggcctgaagctcaactacctgcgcatctcagaggccaagctcactggcatccccaaagatctccctgagaccctgaatgaacttcacttggaccacaacaaaatccaggctatcgagttggaggatctacttcgctactccaagctgtacaggctgggcttaggacacaatcagatccgaatgattgagaatgggagcctgagttttctgcctaccctgagggaacttcacttggacaacaacaagctgtcccgggtgcctgctggcctcccagatctcaaactcctccaggttgtctatctgcactccaacaacatcaccaaggtgggcatcaacgatttctgccccatgggctttggagtcaagagggcctactataatggcatcagcctcttcaacaaccctgtgccctactgggaagtgcagcctgccaccttccgctgcgtcactgaccgcctggccatccaatttggaaattataagaagtagaagcagtggtagccaccatggctcgttggtgagagtctctgaggaacatagccagttgttccacaggggaaggggaacaaagaagcaacacctttgttccccaatattaactcactgcccaccacagcttcctctggctcctaagcatgcacatatgcacatggcctggcctctcccattcccctcagcctttgagatttaacactcacccaccatgtccactcagagactccctataaatcttttttcttgctcatcctgaaactcagatgtttgtgggaagaatggacagagcacatggccacagttactgttccatccgggcatgtattcctcctcttccttacccatgtctgacttctagctctcctgggctctgctgctgcccttatcctctggtgatctctcttcaacaagttcactacctgtccatccaagccgccacctggctctactaactcctggatccttccctctctccaactctgttatgcttcctggcacttttcttccttctggggttatagatctgtccctgccatctctggacctggttcatatctttctgtctttgtctctttctgtatttctttgcctatatctctgtctgtctctatttctgtttctgtctctctgtctttatatctgcctctctctctctctctctctctctctctctctctctctctctctcacacacacacacacacacacacaaacacacaaacacaaacacacacacacacacacacacacacacacacacacacacacacacacacacaccgtcttctccaggctgctttctgtttcacaggtctctggccagtccctgcacaaacaaatatagggaaactattttcctgactgccctacctggcacttgatctcccatccctggaggaagctggaagctggaggcccagaatcctatccatattgtccaggaaagggtccatactctgttatcaagatgaggatcaggaagcttcctagcccctggagaggctcagcaggccaccagaggcccccaccccgaaccagtttgcattggcccctgccctctccccaagatggctaggtcccctccctcacccctgggtccctgctgtggcaggaggtggtggtcagttgtacccagcaggagggagtgctgcttatgaggtcagttgtctctcaattaaagaaacactgtgcaataaaaaaaaaaaaaa

SEQ ID NO: 1934 - DNA, 1390 bp, Rattus norvegicus
  Genbank Accession No. NM_017088
tctagaaataattttgtttaactttaagaaggagatataccatggacgaggaatatgatgtgattgtgctggggacaggtcttaccgaatgcatcctgtctggcatcatgtctgtgaatggaaagaaggtgttgcacatggaccgaaacccctactatgggggtgagagctcttctatcacaccccttgaggagctatataagcgctttcagttgctggaagggccccctgaatcaatgggccggggccgagactggaatgttgacttgatccccaaattcctgatggccaatggtcagctggtaaagatgctactgtatacagaagtgactcgttatctggacttcaaggtggtagagggcagctttgtatacaaagggggcaagatctacaaagtgccatctactgagactgaggccttggcttctaatctgatgggcatgtttgaaaaacgacgcttccgaaaatttttggtgtttgtggcaaactttgatgagaatgaccccaaaacctttgagggtgttgacccgcagaccaccagcatgcgtgatgtctaccggaagtttgacctgggccaagatgtcattgatttcactggccatgccctggcgctctaccgcactgatgattacctggatcagccatgtcttgagactattaaccgcatcaagttgtacagtgagtccctggcccggtatggcaagagcccatatttgtacccactctatagcctgggtgagctgcctcagggctttgccagattgagtgccatctatgggggaacatacatgctgaacaaaccagtggatgacatcatcatggaaaatggcaaggtggtgggcgtaaaatctgagggagaggtggcccgctgcaagcagctgatctgtgatcccagctacatcccagaccgtgtgcgaaaggctggccaggttattcgcatcatctgcatcctcagccaccccatcaagaataccaatgatgccaattcctgccaaattatcatccctcagaatcaggtcaacaggaagccagacatctatgtgtgcatgatctcctatgcacacaacgtggccgcacaaggcaaatacatcgccattgccagcaccaccgtagagactgcagaaccagaaaaggaggttgagcctgcattggagctgttggaacctattgaccaaaagtttgtggctatcagtgatttatatgagcccattgatgacggttcagagagtcaggtgttctgttcctgctcctatgatgctaccacacactttgagacaacctgcaatgacatcaaagatatctacaaacgcatggctggttctgcctttgattttgagaacatgaagcgcaaacagaatgatgtgttcggggaagctgaccagtaggatcc

SEQ ID NO: 1935 - DNA, 3726 bp, Rattus norvegicus
  Genbank Accession No. NM_017092
ccggcatggtgcggcgtcgccgccgatggcgctgaggcggagcatggggcggccggggctccggccgctgctgctggcggggctggcctctctgctgctcccagggtccgcggccgcaggcctgaagctcatgggagccccagtgaagatgacagtgtctcaggggcagccagtgaagcttaactgcagtgtggaagggatggatgaccctgacatacactggatgaaggatggcgctgtggtccagaatgcaagccaggtgtccatctcaataagcgaacagaactggattggcttactcagcctaaagtcagcggagcggtctgatgccggcctgtactggtgccaggtgaaggatggggaggaaaccaagatctctcagtcagtatggctcactgttgaaggtgtgccattcttcacggtggaaccaaaagatctggcggtgccacccaatgtcccttttcaactgtcttgtgaggctgtgggtccaccagaacccgtaaccattttctggtggagaggacccactaaggttgggggacctgcttcctctccctctgttttaaatgtaacaggagtgacccagcgcacagagttttcttgtgaagctcataacataaaaggcctggccacttcccgaccagccattattcgccttcaagcaccgcctgcagctcctttcaacatcacagtaacaacgatctccagcagcaacgctagtgtggcctgggtgccgggtgctgatggcttagctctgctgcactcctgtactgtacaggtggcacatgccccaggagaatgggaggcccttgctgtcgtggttcccgtgccaccctttacttgcttgcttcggaacttggcccctgccaccaactacagccttagggttcgctgtgccaacgccttgggcccttctccctatggcgactgggtgccctttcagacaaagggcctagcgccagccagagcccctcagaatttccacgccattcgtactgactcaggccttatcctggaatgggaagaagtgattcctgaggaccctggggaaggccccctgggaccttataagctgtcctgggtccaagaaaatggaacccaggatgagctgatggtggaaggaactacggccaatctgactgactgggatccccagaaggacctggttttgcgtgtgtgtgcctccaatgcaattggtgatgggccctggagtcaaccactggtggtgtcttctcatgaccatgcagggaggcagggccctcctcacagccgtacatcctgggtgcctgtggtcctgggtgtgctcaccgccctgatcacagctgctgccttggccctcatcctgcttcggaagagacgcaaggagacgcggttcgggcaagcctttgacagtgtcatggcccgaggggagccagctgtacacttccgggcagcccggtctttcaatcgagaaaggcctgaacgcattgaagctacattggatagcctgggcatcagcgatgaattgaaggagaagctggaggacgtcctcatcccagagcagcagttcaccctcggccggatgttgggcaaaggagagtttggatcagtgcgggaagcccagctgaagcaggaagatggctcctttgtgaaagtggcagtgaagatgctgaaagctgacatcattgcctcaagcgacatagaagagttcctgagagaagcagcttgcatgaaggagtttgaccatccacacgtggccaagcttgttggagtgagcctccggagcagggctaaaggtcgtctccccattcccatggtcatcctgcccttcatgaagcacggagacttgcatgcctttctgctcgcctcccgaattggggagaacccttttaacctgcccctccagaccctcgtccggttcatggtggacattgcctgtggcatggagtacctgagctcccggaacttcatccaccgagacctagcagctcggaattgcatgctggcagaggacatgacagtgtgtgtggctgactttggactctcccggaaaatttatagcggggactattatcgtcagggctgtgcctccaaactgcctgtcaagtggctggccctggagagcttggctgacaacttgtatactgtacacagcgatgtgtgggccttcggggtgaccatgtgggagatcatgactcgtgggcagacgccatatgctggcatcgaaaatgctgagatttacaactacctcatcagcgggaaccgcctgaagcagcctccggagtgcatggaggaagtgtatgatctcatgtaccagtgctggagtgccgacccaaagcagcgcccaagcttcacatgcctgcgaatggaactggagaacattctgggccacctatctgttctgtccaccagccaggaccccttgtacatcaacattgagagagctgggcagcctgctgagaatggcagtcccgagctgccctgtggagagcagtctagcagcgaggcgggggatggcagtggcatgggggcaataggtggcatccccagtgactgtcggtacatcttcagccctggagggttggccgagtcaccagggcagctggagcagcagccagaaagccccctcaacgagaaccagaggcttttgttgttgcagcaagggctactgcctcacagtagctgttaacctgcaggcagaggacagctggggccccctggctctgccggccattgcgctggcttactaggccccgtctgatcacagcccaggcagcaaggtatggaggctcctgtggtagtcctcccaagctgtgctgggacctggactgaccaaattgcccaatcccagttcttcctgcagccgctctggccagcctggcatcagttcaggccttggcttagaggaggtgagccagatctggttgcctgaatgcaggcagctggcaggaggggagggtggctgtgtttccatgggtaccatgggtgtggatggcagtaagggagggtagcagcagccctgtgggcccctaccctcctggctgagctgctcctactttagtgcatgcttggagccgcctgcagcctggagctcagcactgcccaccacacctgagtttaaatgccaggtttgcccctctacgtcacaaagagatgtccttgtattgttcccttttaggtgacgattaggaagggattggcacacttaggtccttaagccccatgacaggaaatggtgggatattctcaggtccgaatcctcatcaccttcctgattccccaccctgccatggcctggaactgactgggtggctgagggatgcacgaggacaaagactaccgagatccgactcctaaaggcagggtctgagtctgccagatggagggggtgctaagaggttggcccaggagtcaggcatttcaggacccctctaagcttctacagtctgtctgagcatgctaccaagcccccaaacatcccagaactaacaggcagttttgtctgagcccagcccttccacatggtgacccttaggtctaccatcctctctgaatggatatcacttgtcccaagtcttaagagagagatacacctgatggctgatgtgggtaagaaaagttcctggaaccagggctggggtctaggcaccgcactgcaaacctcctggaatgcagaggcaggctcttgggctgttaggaacatttccaagctattaagttgctgtttcaaaacaataaaattgaaac

SEQ ID NO: 1936 - DNA, 2950 bp, Rattus norvegicus
  Genbank Accession No. NM_017094
gaattccggagagaccacaagatagaggattattaatttatggggattttttggagatttatatacccaagcaacaactcctagatgctacagaccaagacaccaagaaataaccacgaaattctactttcaaccctagcttctctaccagattttaactaaacaagatcttcttgcaaaggtctcaggtatggatctttggcgggtgttcttaaccctggcactggcagtctccagcgacatgtttcctggaagtggggctacaccagctactcttggcaaagcttccccggttctgcaaagaattaatccaagcctgagggaaagttcctctggaaagcctcgattcaccaagtgtcgttcccctgaactggagaccttttcatgctactggacagaaggggatgatcataatttaaaggtcccgggatctattcagctatactatgctagaagaattgctcatgaatggaccccggaatggaaagaatgccctgattatgtctctgctggagcaaacagctgttacttcaactcatcgtatacctccatttggataccctactgcattaagcttactacaaatggtgatttgttggacgaaaagtgtttcactgttgatgaaatagtgcaacctgatccgcccattggcctcaactggactttactaaacatcagtttgcctgggatccgtggagatatccaagtgagttggcagccaccgcccagtgccgatgttctgaagggatggataattctggagtatgaaattcagtacaaagaagtaaatgaaacaaaatggaaaacgatgagcccgatatggtcaacatcagtcccactgtactcactgagactggataaagagcacgaagtgcgtgtgagatccagacaacggagcttcgaaaagtacagcgagttcagtgaagtactccgtgtaacgtttcctcagatggacacactggcagcatgtgaagaagatttccggtttccatggttcttaattattatctttggaatatttggagtagcagtgatgctatttgtagttatattttcaaagcagcaaaggattaagatgctgattttacccccagtaccagttccaaagattaaagggattgatccagatcttctcaaggaaggaaaattggaggaggtgaacaccatcttgggcattcatgataactacaaacccgacttctacaatgatgactcctgggttgagttcattgagctggatattgatgatgcggatgagaagactgaagagtcagacaccgacagacttctaagcgatgaccaggagaaatcagctggtatccttggagcaaaggatgacgattctggacgtaccagctgttatgaccctgacattttggataccgatttccacaccagtgacatgtgcgatggtacctcggagtttgctcagccgcagaagttaaaagcagaagctgatctcttgtgccttgaccagaagaatctgaagaactcgccttatgatgcttcccttggctctctgcacccctccattaccctgacaatggaagacaaaccacagccacttctgggcagtgaaactgagtcaacccaccaactcccctctacaccaatgagcagtcccgtgtcactggcaaacattgacttttatgcccaagtaagcgacattacaccagcaggtggtgtagtcctttctccaggccaaaagattaaggcagggttagcccagggcaacacccagctggaggtggccgcgccctgccaagaaaattacagcatgaacagtgcctacttctgtgagtcagatgccaaaaagtgcatcgctgcggcccctcacatggaggccacgacatgtgtaaaaccaagctttaaccaagaggacatttacatcaccacagaaagccttaccactactgcccgaatgtccgagacagcagataccgctccagatgctgagcctgtcccagactacaccacggttcacaccgtgaagtccccaaggggccttatactcaacgcgactgctttgcctttgcctgacaaaaagaagtttctctcctcatgtggctatgtgagcacagaccaactgaacaaaatcatgcagtagcctttcctatctttaatggcaaaagaaatgactgggcacgaacgcctaaaccaaaactatgttttaaatctgtgttgggagagcgtgagagtgaatgtggattcaaaaataccttttctggaaacgtcgaaacattatcataacgtggaaaatcaagaatatgtaatcagatagatactcccattgtgaattttaaatattttaagatcgtctttaagactgtttgtggcagtgattgtctgtgctgtgggtcttaactttgtgatactaagttattaaatagctacgtttttcatgtatgtagatcattgctttttttgaaaaagcaaaacaatcaggtggcttttgcagttcaggaaattgaatgcagattttagcacagactgatttctttttcctttttaaatagctaggagctaaaactctaggggagaaggtaaaactagtttggatatgcaaaacatttattttgacataaaattgataaagatatttttaataatttacactgtaagcatgagtattttataatacactacagatatattgttagttcacaacaatccatctacggatgtaacaactacaatgtgtagaggggttgatgctttggtcaatgaacctaaagaaaaatgaacaagttagatttttacaaagcccttttttataactcccaaaacttcttaaatctaaaaatgtctgcattattggaacaaacccattttaaatttgtaaatgaatatttttttaattttgaaaactttaattttttatacaaattaacgtatcatacaccaaacagtaacagaagtgattataataatggaagaaacagtttcttcc

SEQ ID NO: 1937 - DNA, 1850 bp, Rattus norvegicus
  Genbank Accession No. NM_017097
gaattccggttctagttgttgttttctctgccatctgctctccgggcgccgtcaaccatgggtccgtggacccactccttgcgcgccgccctgctgctggtgcttttgggagtctgcaccgtgagctccgacactcctgccaactgcacttaccctgacctgctgggtacctgggttttccaggtgggccctagacatccccgaagtcacattaactgctcggtaatggaaccaacagaagaaaaggtagtgatacacctgaagaagttggatactgcctatgatgaagtgggcaattctgggtatttcaccctcatttacaaccaaggctttgagattgtgttgaatgactacaagtggtttgcgtttttcaagtatgaagtcaaaggcagcagagccatcagttactgccatgagaccatgacagggtgggtccatgatgtcctgggccggaactgggcttgctttgttggcaagaagatggcaaatcactctgagaaggtttatgtgaatgtggcacaccttggaggtctccaggaaaaatattctgaaaggctctacagtcacaaccacaactttgtgaaggccatcaattctgttcagaagtcttggactgcaaccacctatgaagaatatgagaaactgagcatacgagatttgataaggagaagtggccacagcggaaggatcctaaggcccaaacctgccccgataactgatgaaatacagcaacaaattttaagtttgccagaatcttgggactggagaaacgtccgtggcatcaattttgttagccctgttcgaaaccaagaatcttgtggaagctgctactcatttgcctctctgggtatgctagaagcaagaattcgtatattaaccaacaattctcagaccccaatcctgagtcctcaggaggttgtatcttgtagcccgtatgcccaaggttgtgatggtggattcccatacctcattgcaggaaagtatgcccaagattttggggtggtggaagaaaactgctttccctacacagccacagatgctccatgcaaaccaaaggaaaactgcctccgttactattcttctgagtactactatgtgggtggtttctatggtggctgcaatgaagccctgatgaagcttgagctggtcaaacacggacccatggcagttgcctttgaagtccacgatgacttcctgcactaccacagtgggatctaccaccacactggactgagcgaccctttcaacccctttgagctgaccaatcatgctgttctgcttgtgggctatggaaaagatccagtcactgggttagactactggattgtcaagaacagctggggctctcaatggggtgagagtggctacttccggatccgcagaggaactgatgaatgtgcaattgagagtatagccatggcagccataccgattcctaaattgtaggacctagctcccagtgtcccatacagctttttattattcacagggtgatttagtcacaggctggagacttttacaaagcaatatcagaagcttaccactaggtacccttaaagaattttgcccttaagtttaaaacaatccttgatttttttcttttaatatcctccctatcaatcaccgaactacttttctttttaaagtacttggttaagtaatacttttctgaggattggttagatattgtcaaatatttttgctggtcacctaaaatgcagccagatgtttcattgttaaaaatctatataaaagtgcaagctgccttttttaaattacataaatcccatgaatacatggccaaaatagttattttttaaagactttaaaataaatgattaatcgatgct

SEQ ID NO: 1938 - DNA, 1580 bp, Rattus norvegicus
  Genbank Accession No. NM_017099
ccgcgacatcccccggatatgcacttcgggaggcccctgctcccgggatgcgagagctagggacctgtccgccctgtgcggagctccagccgccgccgggcgcgcaaccctgagtctaggacgcgttgtggaggaaaggagtcagggcaggtgcctaggcgggctatgctgaaaggaagatgctggccaggaagagcatcatcccggaggagtatgtgctggcccgcatcgcggcggagaacctgcgcaaaccgcgcatccgcgaccgcctccccaaagcccgcttcatcgccaagagcggagcctgcaacctggctcacaagaacatccgagagcaaggtcgcttcctgcaggacatcttcaccaccttggtagacctgaagtggcgtcacacgctggtcatcttcaccatgtccttcctctgcagctggctgctcttcgctatcatgtggtggctggtggccttcgcccacggggacatctatgcttacatggagaaaggcatcacggagaagagtggcctggagtctgccgtctgtgtgaccaatgtcaggtcattcacttctgcgtttctcttctccatcgaggttcaagtgaccattgggtttggagggagaatgatgactgaggagtgccctctggccatcacggttttgattctgcagaacattgtgggtctgatcatcaacgcggtcatgttgggctgcatcttcatgaagacggcccaggcccacagaagggcagagacgctgattttcagccgccatgctgtaattgcggtccgtaatggcaagctgtgcttcatgttccgggtgggtgacctgaggaaaagcatgatcattagcgcctcggtgcgcatccaggtggtcaagaaaaccacgacgccagaaggagaggtggtgcctattcaccagcaggacatccctgtggataatcccatcgagagcaataacatcttcctagtggcccctttgatcatctgccatgtgattgataagcgtagccccctgtacgatatctcagccactgaccttgtcaaccaagacctggaggtcatagtgattctcgagggcgtggtggaaaccacgggcatcaccacgcaagcgcggacctcctacattgcagaggagatccagtggggacaccgcttcgtgtcgattgtgactgaggaggagggagtgtactctgtggactattctaaatttggtaatactgtgagagtggcggcgccaagatgcagtgcccgggagctggacgagaaaccttccatcttgattcagaccctccaaaagagtgaactgtcgcaccagaattctctgaggaagcgcaactctatgagaagaaacaactccatgaggaggagcaactccatccggaggaataactcttccctcatggtgcccaaggtgcaattcatgactccagaaggaaaccagtgcccatcagaatcatgagggcaggacgaccctagacagccactcactgagtcccgatgactgacagaccatcctgagacagtttgctgagttctggtgatcgaagtatcggacctgtcgccaattcagggcaggaacacaaca

SEQ ID NO: 1939 - DNA, 743 bp, Rattus norvegicus
  Genbank Accession No. NM_017101
ctttgcagacgccgctgtctcttttcgccgcttgctgcagacatggtcaaccccaccgtgttcttcgacatcacggctgatggcgagcccttgggtcgcgtctgcttcgagctgtttgcagacaaagttccaaagacagcagaaaactttcgtgctctgagcactggggagaaaggatttggctataagggttcctcctttcacagaattattccaggattcatgtgccagggtggtgacttcacacgccataatggcactggtggcaagtccatctacggagagaaatttgaggatgagaacttcatcctgaagcatacaggtcctggcatcttgtccatggcaaatgctggaccaaacacaaatggttcccagttttttatctgcactgccaagactgagtggctggatggcaagcatgtggtctttgggaaggtgaaagaaggcatgagcattgtggaagccatggagcgttttgggtccaggaatggcaagaccagcaagaagatcaccatctccgactgtggacaactctaatttctttgacttgcgggcattttacccatcaaaccattccttctgtagctcaggagagcacccccaccccatctgctcgcaataccctgtaatctctgctctcactgaagttctttgggttccatattttcctcattccccttcaagtctagcaggattgcaaagttaagtttatgattatgaataaaaactaaatgagaagtgtt

SEQ ID NO: 1940 - DNA, 3715 bp, Rattus norvegicus
  Genbank Accession No. NM_017108
ctgctggggcctacgaacctgggccgggcatagccccccgacggctactctagggggcgcggggcccggcggggggcggccgagccaggcgccctcccccggcgctgagtccccgcgccccggagggatggggcgggcggtccccgccgcctaagatgccggccatgcgggggctccttgcgccgcagaacaccttcctggacaccatcgccacccgcttcgacgggacgcacagtaacttcgtcctgggcaacgcccaggtggcagggctcttccctgtggtctactgctccgatggcttctgtgacctcacgggtttctccagagctgaggtcatgcagcgaggctgtgcctgctccttcctctatgggccagacaccagtgagttggtccgccaacagatccgaaaagccctggatgagcacaaagaattcaaggctgaactgatcctgtaccggaagagcgggcttccattctggtgtctcctggatgtgatacctataaaaaacgagaagggggaggtggccctcttcctggtctctcacaaggacatcagtgagaccaagaaccgaggaggccctgacaactggaaggagagaggtggtggccgacgcagatatggtcgggcaggatccaaaggctttaatgccaatcggaggcgcagccgggcggttctctaccacctctctggtcacctgcagaaacaacccaagggcaagcacaaactcaataagggtgtgtttggagagaagccaaatttgcccgaatataaagtcgctgctatccggaagtcaccctttatcctgctgcactgtggggctctgagagccacctgggatggcttcatcctgctcgccacgctctacgtggctgtcactgtgccatacagcgtgtgtgtgagcacagcacgggagcccagtgctgcccgtggcccacctagtgtctgtgacctggccgtggaagtcctcttcatcttagatattgtgctgaattttcgtactacatttgtgtccaagtcaggccaggtggtattcgccccaaagtccatttgcctccactacgtcaccacctggttcctgctggatgtcatagcagcactgccctttgacctactacatgccttcaaggtcaatgtgtacgttggggctcacctactgaagaccgtgcggctgcttcggctgctgcgcctactaccaagactggaccggtactctcagtatagcgctgttgtgctcaccttgctcatggctgtgtttgccctgctcgcccactgggtggcctgcgtttggttctacatcggccagcaagagattgagaacagcgagtcagagctgcctgagatcggctggctgcaggagctggcacgcaggctggagacgccctattacctggtgagccggagtccagatggagggaacagctctggccagagtgaaaactgcagtagcagtggcggcggcagcgaagccaacgggactgggctggagctgctgggtggcccatccctacgcagcgcctacatcacctccttgtacttcgcgctcagcagtctcaccagtgtgggcttcggcaatgtgtccgctaacacagacactgagaagattttctccatctgcaccatgcttattggagctctgatgcatgcagtggtgtttgggaatgtgacagccatcatccagcgcatgtacgctcgccgctttctgtaccacagccgcacccgtgacctgcgagactacattcgcatccaccgcatccccaagcccctcaagcagcgcatgctcgagtacttccaagccacctgggccgtgaacaacggcatcgataccactgagctgctgcagagccttccggatgagcttcgagcagacatcgccatgcacctgcacaaggaggtcctgcagctgccattgttcgaggcagcgagccgtggctgcctgcgggcactgtctctggccctgaggcccgccttctgcacgccgggcgagtacctcattcaccaaggcgatgctctccaggctctctactttgtgtgctcaggttccatggaggtcctcaaaggtggcaccgtcctcgccattctagggaagggtgacctgatcggctgtgagctgccccagcgagagcaagtagtgaaggccaatgccgacgtaaaggggctgacatactgcgtcctacagtgcctgcagctggctgggctgcacgagagcctcgcactgtaccctgagtttgccccacgctttagccgtggcctccgaggggagctcagctacaacctgggagctggaggagtgtctgcagaggtggataccagctcactgagtggtgacaacaccctcatgtccacactggaggagaaggagacagatggggagcaaggacacacgatctcaccagccccagcagatgagccctccagccccctgctgtcacctggctgtacctcctcctcctcagcggccaaactactctccccacgtcgaactgcaccccggccgaggctgggtggcagagggcggccaagtagggcaggggttttgaagcctgaggctggtccttctgctcatccacggacacttgatgggttgcagctgccccccatgccatggaatgtacctccagacctgagccccagggtcgtagatggcattgaggatggctgcggctctgaccagcacaagttctctttccgggtgggtcagtctggcccagaatgtagcagcagcccctccccaggaacagagagtggcctgctcactgtccccttggtgcccagtgaggcaagaaacacagacacactggacaagctacggcaggcggtgacggagctgtctgaacaggtgctgcagatgcgagagggactgcagtcacttcgccaggctgtgcagctcatcctggtgccccaaggggaaggccagtgtccccgggtatcaggagaggggccatgcccagccactgcctctgggctcctacaacccctgcgtgtggacactggggcatcatcctactgcctgcagcccccagcaggttcagtcttgagtgggacctggcctcacccccgtccagggcatccccctcccctcatggcaccctggccctggggccccccagcatctcagagctccccctggcctcgagccacagctttatggacctccacctcagactcagagccccctggctctggagacctctgctctgagcccagcaccccagcctcaccccctcctcctgaggaaggagctaggactgggactcctgcacctgtgagccaggctgaggctaccagtactggagagccccctccggggtcagggggccgagccttgccctgggatccccacagcctagagatggtgctcatcggctgccatggccctggctcggtccagtggacccaggaggagggcacaggagtctgaccacaggcagggagaggggttctgcaaacacccgccacctgctgaccgcccagcctcacagggctgccctctggctcagggcagggaacctaaggaaggaggagggtgagctggagcctcaggccccaggccagggatccacgggttctgctccactgacctgacccaatgggggcagaggcctgaggacgaggaggggttctgccattccttgcatgtgcccatctccactgtcctctgtcctcatgttttttatattaaaaaacataaaaaaaaaccaataaagaaactacttt

SEQ ID NO: 1941 - DNA, 2113 bp, Rattus norvegicus
  Genbank Accession No. NM_017113
gcgcaggcaagaccatgtggatcctggtgagctggctggccttagtggcaaggctggtggctggaacacagtgcccagatggtcaattctgccctgttgcctgctgccttgaccagggaggagccaactacagctgctgtaaccctcttctggacacatggcctataataacgagccgtcgtctagatggctcctgccagatccgtgaccactgtcctgatggctactcttgtcttctcactgtgtctgggacttccagctgctgcccgttctctgagggtgtatcttgtgatgatggccagcactgctgcccccggggcttccactgtagtgcggatgggaaatcctgctctcagatatcagatagcctcttgggtgctgtccagtgtcctggtagccagttcgaatgtcctgactccgccacctgctgtattatgattgatggttcctgggggtgctgccccatgccccaggcctcttgctgtgaagacagagtgcattgctgtccccacggggcctcctgtgacctggttcacacgcgatgcatttcacccacgggcacccaccccttactaaagaaattccccgcacaaaggaccaacagggcagtggcttccttttccgtggtgtgccctgatgctaagacccagtgccctgatgactctacctgctgtgagctacccactgggaagtatggctgttgtccaatgcccaacgccatctgctgttccgaccacctgcactgctgcccccaggacactgtatgtgacctgatccagagcaagtgcatatccaaggactacaccacagatctcatgaccaagctgcctggatacccagtgaatgaggtgaagtgcgacttggaggtgagctgtcctgatggctacacctgctgccgcctcaacactggggcctggggctgctgtccattcaccaaggctgtgtgttgtgaagaccacattcactgctgcccagccgggtttcagtgtcacacagagacaggaacctgtgaactgggagtccttcaggtaccctggatgaaaaaggtcacggcctccctcagcctgccagacccacagatcttgaagaatgatgtcccctgtgatgacttcagtagctgtccttctaacaatacctgctgcagactcagttctggggactggggctgctgtcccatgccagaggctgtctgctgcttagaccaccagcattgctgccctcagggtttcaaatgtatggatgaggggtactgtcagaagggagacagaatggtggctggcctggagaagatgcctgtccgccagacaactctgctccaacatggagatattggttgtgaccagcataccagctgcccagtagggcaaacatgctgcccaagcctgaagggaagttgggcctgctgccagttgccccatgctgtgtgctgtgaggaccggcagcactgttgcccggctgggtacacctgcaacgtgaaggcgagaacctgtgagaaggatgcaggctctgtccagccttccatggacctgacctttggctctaaggttgggaatgtggaatgtggtgccggacatttctgccatgataaccagtcctgttgtaaagacagccaaggaggctgggcctgctgtccctatgtaaagggtgtctgctgtagagatggacgtcactgttgtcccattggcttccactgttcagccaagggaaccaagtgtttgcggaagaagacccctcgctgggacatacttttgagggatccagccccaagaccgctactgtgaggaagggctaacgactaaagaactccacagtcctgggaaccctgttctgagggtatccaccactcaggcctccctggcacctcttcctttagtctccccggcctactcattctgagtcaccccatcaccatggaaggtggggcctcaaactaagaccttctcttatggaaagaaggctgtggcaaaagccccgtatcaaactgccatttcttatgatttctgtggaccttgtggccaggtgctcttctcgatccacaggtgttgtgtgagcttgcttttgtgtgtgtgtgtgtgcgcgcgtgcgagcgtgttgctccaataaagtttgtacc

SEQ ID NO: 1942 - DNA, 1561 bp, Rattus norvegicus
  Genbank Accession No. NM_017122
gagtgtgtggtctggggccacctctctctttttgggtcaaatgagagtttggggtatcttgtgtctgagggcccttctggagtagtgtcaagggactaaaaggatgtaaccattgctctctcctttcacttcctttggttggggggaacccaggtgggacttggctcttctgccatgggcaagcagaatagcaagctgcggccagagatgctgcaggacctgcgagagaacaccgagttctctgagctggagcttcaggagtggtacaagggcttcctgaaggactgcccgactggcatcctcaacgtggatgagttcaagaagatctacgccaacttcttcccctacggcgatgcctccaagttcgccgagcatgtcttccgcacttttgacaccaacagcgacggcaccatcgacttccgggagttcatcatcgctctgagcgtgacctcgcgtggccgcctggagcagaagctcatgtgggccttcagcatgtacgacctggacggcaatggctacatcagccgggaggagatgctagaaattgtgcaggccatttacaagatggtttcgtccgtgatgaagatgcctgaggatgagtctaccccggaaaagaggactgagaaaatcttccgccaaatggacacaaacaatgacggcaagctgtcactggaggagttcatccgcggggccaaaagcgacccatcgatcgtgcgcctgctgcaatgcgatcccagcagcgcttcccagttctgagctgagaggagccagctcgcctccctgccttcaccggccctccggctctcagcttcctctccctcgtgtctatccaggctggggaatccccttctgggtctgcactgtgggggggcctctggagaagcgaaccctgcaaggaaggggctaagcaaggcagccgttagtccccacggcctaagaggcagaatctcccttagtggaccgagattacccccgggtcaggttctgtatctttccccagacagctgatcaccttccacgccacccacaacccgaggctcttccacaacacgggaagaggggctaggtccttcttgggtggtcctcagcctggagggaggtggggatttgtgccaaggtgaagagtctttttgtttgttttggtggggaagaccggaggattactgggctgtgggactttgaagaagttccctgatctacttccctgcagaagaacacttcctgtcccagctcttgctgctggaggcatggtaaaaagaagatctcccaggattccaactgggggtccccaaacccagcctgcctctttgcacttggataacacagatttacccgtctgtcctctgtatttctctctccttccccacctcacacacgcacggggccgcgcgacatgcgcgcgcaacacacacacacacacacacgcacgatatgcacgcacacatgcacagcacccgcgcacacagaggccggcagacagatgagcagagcccctccacagcgttctgtgtgggaaagaagtgcagcccctgccaagccccatgtccctctgcatgcgccg

SEQ ID NO: 1943 - DNA, 860 bp, Rattus norvegicus
  Genbank Accession No. NM_017125
ggctgctgagccgcggtaggagagcatcaagaagcgtcggggagcgcaggcccagcagccatggcggtggaaggaggaatgaagtgtgtcaagtttttgctctacgttctcctactggccttttgcgcctgcgcagtgggattgattgccattggcgtagcagttcaggttgtcttgaagcaggccattacccacgagactactgctggctcgctgttgcctgtggtcatcattgcagtgggtgccttcctcttcctggtggcctttgtgggctgctgtggggcctgcaaagagaactactgtctcatgattacatttgccatcttcctgtctcttatcatgctcgtggaggtggcggtggccattgctggctatgtgtttagagaccaggtgaagtcagagtttagtaagagcttccagaagcagatgcagaattaccttacagacaacaaaacggccaccattttggacaaattgcagaaggaaaataaatgctgtggagcctctaactacacagactgggagcgcatccccggtatggccaaggacagggtccccgattcttgctgcatcaacatcactgtgggctgtggaaacgatttcaaggaatccaccatccatacccagggctgcgtggaaactatagcggcatggctgaggaagaacgtactgctggtggctggagcagccctgggcattgcttttgtggaggtcctgggcattatcttctcctgctgtctggtgaagagtatccggagtggctacgaagtaatgtagggtgggggcgtgtctgagctcgtctgtcttttcatggagtggactctccaggttttcaattaaacggattattttttcagacc

SEQ ID NO: 1944 - DNA, 838 bp, Rattus norvegicus
  Genbank Accession No. NM_017126
gggacccaggggacccttggcactgcgcaggaccccgcgggacccggaaccttccgacagggttatggcggccgctccgggcgcccgactcctgcgcgctgcctgcgcctccgtcgcttttcgtggtctggactgccgtcggctgctggtctgcgggacccgtgcgggacctgccgtccctcagtggaccccgagcccccacacgcttgcagaggccggacctggccggccactgagcgtgtctgcgcgcgcgcggagtagctcagaagataaggtaacagtccacttcaagaaccgagatggtgaaacgctaacgaccaaggggaaagttggtgactctctgctagatgttgtgattgagaataacctagatatcgatggatttggtgcgtgtgaggggactttggcttgctctacctgtcatcttatctttgaggaccatatatatgagaagttagatgccattactgatgaagagaacgacatgcttgacctggcttttggactaacaaacaggtcacggctgggctgtcaagtttgtctgaccaaggctatggacaatatgactgtccgtgtgcctgaagcagtggcagatgtccgacagtctgttgacatgagcaagaattcctaagctacaataaaaagaatattttcattaaatttttacctatttttataattatttcttagcataattgattatatggccaaaatatgtagctgtgctgtcttagttcagttttgtagtactgaaaatttgcagtttttattttgattaaattattaaaatatcagtctattagaagacagctgatacaataaactccttatgtatttt

SEQ ID NO: 1945 - DNA, 1660 bp, Rattus norvegicus
  Genbank Accession No. NM_017130
gtcggacagctgcagagagccacttagcaagctcctctactctcctcagggttagcagctgaaggttgtcacacatctgttgtgaggggaactggttatggcaggaatctatacaaaacccactttttcgattcttgggtagaagactgccaggacgctacagcagcactggcgaacgatctcaggcccatggagacctgccccgtcctccagaaagagacgctgttccacacagaagtctatgcttacagaatccctgctctgctctacctgaagaagcagaagaccctgctggcctttgcagaaaagcgagccagcaggacggatgagcatgctgagttgattgtcctgcgaagagggagctacaatggagccaccaaccatgtcaagtggcaacctgaggaagtggtgacccaagcccagctggagggccaccgctccatgaatccatgtcccttgtatgacaagcaaacaaagaccctcttccttttcttcattgctgtccctgggcgtgtatcagaacagcatcagctccaaactagggttaatgtcacacggctatgccgtgtcaccagcaccgattatgggatgaactggagccccgtccaggacctcacagagaccaccattggcagcacccaccaggactgggccacatttgctgtgggtccagggcactgtctgcagctgcggaacagagctgggagcctgctggtacctgcttatgcctaccggaagctgcaccctgtccataaacctaccccctttgccttctgcttcatcagccttgaccacggacacacgtgggaactagggaactttgtgtctgagaactcactggagtgtcaggtggctgaggttggcactggtgctcatagggtggtatatctcaatgctaggagcttcataggagctagagtccaggcacaaagtcctaacgatggcctggatttccaggacaaccaggtagtaagtaagcttgtagagcccccccacgggtgtcatggaagtgtggtcgccttccacagccccacctctaagccagattgccttagacatgtggctgcttatacccaccctacggactccaggaatagaaccaacctgggcgtgtacctcaaccagacgccactagatcccacagcctggtcagagcccaccctgctagccacgggcacctgtgcctactcagacttgcagatatggggccttggccctgatgggtccccacagtttgggtgcctgtacgaatcaggtaactatgacgagatcattttcctcatgttcaccctgaagcaagcttttcccacagtacatggtgctcagtgacctcattgcatgtggcttccaaagggcttcctgtgcttcagaacacccgtctctctttccttccagcatcctctggactcttgaatccagctcttgggtctgttccttgggagtatacagagagtttggtctcttgactcttagcaagttttgttctttcagcctccgaaagtgggttctattttcagcccagaaatcaaaggagcctgactttcctcagcctgtatgtataaaggctgccactctgcatgttggctgtcactatgttagcttaacctgcctgtttccccatgcctagtttttggatgaatattaataaattaattatcct

SEQ ID NO: 1946 - DNA, 1681 bp, Rattus norvegicus
  Genbank Accession No. NM_017131
gaattccgcgcaggaccaaggaggtgagatcagcctctttgttccctaaccaagcttagcagcgtctccaagaaccttccatctgtcttccatgatctccgttctggggactgagaaacaagactcttcccaaatgaagaggatttacctgctcgtggtggggctttatctgctgtcctttagcagggcagaagaggggctgaacttccccacgtacgatgggaaggaccgagtggtcagcctttctgagaagaacttgaagcaagtgttgaagagatacgatttgctctgtctctactaccacgagcctgtgtcttcagacaaggtcgcacagaagcagttccaactgaaggagatcgtactggagcttgtggcccaggttctggaacataaaaacataggctttgtgatggtggattcaaggaaagaggccaagcttgccaagaggctgggcttcagtgaagaaggaagcctgtatgttctgaagggtggtcgcaccattgagtttgacggggaatttgcagcagatgtcttggtggaatttctcttggacctcattgaggacccagtagagatcgtgaacaacaagttggaagtccaagcctttgagcgcatcgaggaccagatcaagctgcttggctttttcaagaatgaggactcagaatattacaaagcgttccaagaggcagctgaacacttccagccttacatcaagttctttgccacctttgacaagggggtggcaaagaagttgttccttgaagtgaatgaagttggcttctatgagccatttatggatgaacccagtgtcatccctaacaagccctacacagaagaggagcttgtggagtttgtgaaggagcatcaaagacccaccctacgtccgttgcgcccagaggacatgtttgaaacatgggaagacgacttgaatggaatccacattgtggcatttgcggagaagagtgacccagatggctatgagttcctggagatcctaaaacaggttgcccgggacaacactgacaaccctgacttgagcatcttgtggattgacccagacgactttcctctgcttgttgcttactgggagaagactttcaagattgacctgttcaagccacagattggggtggtgaatgtaaccgatgctgacagtgtctggatggagatcccagatgatgacgacctgcccacagctgaggagctggaagactggattgaggatgtgctttctggaaagatcaatactgaagacgatgacaatgaagatgaagatgatgatggcgataatgacaatgacgatgacgatgacgacgatgataattctgatgaggataatgatgacagtgatgatgacgatgatgacgatgaataactccagccccgggtacttctgatgagagtgacatcacaaccaccccgtaccccattacagacagcccaaggggcagcaagcagtggtgcccacacctagtcagctctttttccttctccagcatcttttccaagtccgttcttggcaggagcagtacatttccgtgaatgcctttccaaacccagctgtcccactctgcagggacagaagggggaggggggcggtgattcccatgctgactccttttaactattgaggaacaaacagctcttgttctttgttagataatcaggggtcatggaattc

SEQ ID NO: 1947 - DNA, 2019 bp, Rattus norvegicus
  Genbank Accession No. NM_017132
cgctccgccgacgcgacagaggggcggcgtgcatgtggggaacgcagtagtcgccagacttcaggctgtgactgtggcgccccggccgtcgccaccgcagccgctgacgccccccgctccccacatgcagcgccgcccctctgtggcctccggtgaagcaaggctgccaagcccgggctccgcctgcctccctcctcgcggctttccgcgtcctcggcgggcgggcgcgatgcggctgggcccaaggcccgcggtgctggggctgctgctgctgctgtacgccgcggtggccggcgccagcaaggcggaggagctgcattacccgcagggcgagcaccgggcggactacgaccgcgaagcgctgctaggtgtccaggaagacgtcgacgagtatgttaaacttggccacgaagagcagcaaagacgattgcagtcgatcataaagaaaattgactcggactctgatggctttctcactgaaaatgaactcagtcagtggattcagatgtcgtttaagcattacgccatgcaagaagccaagcagcagtttgtggagtatgacaagaacagcgacggcactgtgacgtgggatgagtacaacgtccagatgtatgaccgcgtgattgactttgacgagaacactgctctggatgacaccgaggaggagtcctttaggcagctccatctaaaggataagaagcgatttgaaaaagctaaccaggattctggccctggtctgaatcttgaagagtttattgcatttgaacacccagaagaagttgactatatgacggagttcgtcattcaggaggctttggaagagcatgacaaaaatggtgatgggtttgttagtctggaagaatttcttggcgattacaggcgggatccaactgcaaatgaagacccagaatggatacttgttgaaaaggacagatttgtgaatgattatgacaaagacagcgatggccgccttgatccccaagagctgttgtcctgggtggtgcccaataaccagggcattgcccaagaggaagctcttcatctgattgatgagatggatttgaatagtgacaaaaagctctcggaagaagagattctggaaaaccaagacttgtttctcaccagcgaagccacggattatggcagacagctccacgatgactatttctatcacgatgagctttaaagcaggaagggccttttgtagtttgctaccagctttacatttatgataaaatatggatgttgtgttttacactcctaagtcttaccacatcagatgacctaaacatagattataacttttggccttttagaagaaaaacaagaacttgtcatttatttcaagacgtattgaaggagtaaacattgatattgtgccatatgaccacacagtctctcctaagtactccatctatgtagtgctgtgttgtggaatgtttgagccctgtttccatacttgaagacatggaggactttaaacatgtctgaacaatagtatttaagtagcacgtgatgaagctgtcagttttcgttcttgtactcgtagacttccttttgaaactgacgaaggacagtgtgtttagctttagtgttatatcttaaaacctttaaaggaaccttcagaaggacttaaacctcacatagatgtcgagaaggttctactaatttaaaatggtttctaaaaagggttttgttgtatgaaatagaactttatatttttgcatatgtataaatagtaattatatttaatgtataacaatagcattatggtgagtgggaattgacattgtccagaactcttcaattttgattgattaaaaataaactgtcctatctttttatatgtttgggttttttttaatttttccagataaatcttaaattcagcatgggtttcattatattcaacattattcattcctttattaggtagtgaatgttcttgagattgttaattattgttggtacatagtcttacttgcctttttttttttaaataaaaagaattatgctata

SEQ ID NO: 1948 - DNA, 2199 bp, Rattus norvegicus
  Genbank Accession No. NM_017136
ccggaaggagttcggcaggtctcccggaccccctttgtgaactacattttgggtagaacattttaatcaccgaaacccttctgaggaaaaaaagactcccactgccccctgcaaaaaaacaaaagcaaaaacaaaaaaaccaaaccccaaacccccaaatctcagtcttagctggtgccaccaaagaagcttttgagccatgtggacttttcttggaattgctactttcacctatttttataagaaatgcggggatgtcaccctggccaacaaggagctcctgctgtgcgtactggtgttcctgtcgctgggcctggtgctctcctaccgctgtcgccatcgaaacgggggcctccttggccgccatcagagcggctcccagttcgctgccttctcagatattctctctgctttgcctcttattggcttcttctgggccaaatcaccccctgaatcagaaaagaaagaacagctggagtccaagaggcgcagaaaagaagtcaatctgtcagagacgacgttaacgggagcagctacctcagtatcgacatcatctgtgacggacccagaagtgatcatcatagggtctggtgtacttggctctgctttggcaacagtactctctagagatggaagaacggtgacagtaatcgagagagatttaaaagagcctgacagaatacttggagagtgtctgcagcccggtggctatcgagttcttcgagagctgggccttggagatacagtagaaagtcttaatgcccatcatatacacggctacgtaattcatgactgtgaaagcaggtctgaagttcaaattccatacccggtgtcagaaaacaaccaagtacagagtggggttgctttccaccatggcaagttcatcatgagtctccggaaagcagctatggcagagcccaatgtaaagtttatagaaggtgttgtgcttcggttactagaggaagatgatgctgtgattggtgtgcaatacaaggacaaggagactggggacaccaaggagctccatgccccgctcactgttgttgccgacgggctcttctccaagttcaggaagaacctcatctccaataaagtctctgtttcctcccacttcgttggcttcattatgaaggatgcaccacagtttaaagccaatttcgcggagcttgttctggtcgatcccagtccagttctcatctaccagatttcacccagcgaaactagggtgcttgtcgatattcgaggagaattgccaagaaacttaagagaatacatgacagaacaaatttacccacagatacctgatcacttgaaggaatcatttctggaggcctgtcagaatgctcgtctgcggaccatgccagcaagcttccttcctccttcctcagtgaacaaacgaggcgtcctacttctgggagatgcgtataacctgaggcatcctcttactggtggaggaatgacagtcgctttaaaagatataaaaatatggagacaactgttaaaagatattcctgacctttatgatgatgccgctattttccaggccaaaaagtcattcttttggtcaagaaaaaggagccattcctttgttgtgaacgtgctggctcaggcgttgtatgaactattttctgctacagatgattccttgcgtcagctccgaaaagcttgctttctttattttaaacttggtggagaatgtttgactggtcctgttgggttgctttctatattgtctcctgaccctctcctattgattcgacacttcttctccgttgcagtctatgccacgtatttctgcttcaagtcagagccatgggctacaaaacctcgggctcttttcagtagtggtgctatactgtacaaagcgtgctctataatatttcctctcatctattcagaaatgaagtatctggttcactgaaagggaaaccacatggaagtcattgggacttgaggaggatgtacatagcctaggactgtgtgtgtgacttctgcagtggtgactcaaggaccaagcttgtgtataagcatgtaaatatatgccttaattcacaattgagaatgaagggtcaataagctagatgtttaaaagaatgattgtttccacaaattaatgttaacactcaagtgtttggatttcagtattggggtgattcaattggggacaatgccaaataaaatgaaggagtggaactcctt

SEQ ID NO: 1949 - DNA, 1018 bp, Rattus norvegicus
  Genbank Accession No. NM_017138
gctggaacgggtccgtacggcgttgttcttggttcccatcgtaacttaaaagggaaacttacacaatgtccggaggccttgacgtcctgcagatgaaggaggaggatgtcctcaaattccttgctgcaggaacccacttaggtggcaccaaccttgactttcagatggagcagtacatctacaaaaggaaaagtgacggtatctacatcatcaacctgaagaggacttgggagaagctgttgttagccgctcgagctattgttgccattgagaaccctgctgatgtcagcgtcatctcctccaggaacactggccagcgagctgtgctgaagtttgccgctgccacaggagccactccaattgctggccgcttcacacctgggaccttcactaaccagatccaagcagccttcagggagccccggcttctagtggtgactgatccccgggctgaccaccagcccctcacagaggcctcttacgtcaacctgcccaccattgctctttgtaacacagattctcccctgcgctatgtggacattgccatcccatgcaacaacaagggagctcactcagtgggtctcatgtggtggatgctggccagggaagtactccgcatgcgaggaaccatctcccgggagcacccatgggaggttatgcctgatctttacttctacagggacccagaggagattgagaaggaggagcaggctgccgctgagaaggctgtgaccaaggaggaattccagggtgaatggacggcaccagcgcctgagttcactgctgctcagcctgaggtggccgactggtctgagggtgtgcaggtgccctctgtgcccattcagcagttccccacagaagactggagtgcacagccggccactgaggactggtcagcagctcccacagcacaggctactgagtgggttggagccaccactgagtggtcctgagctcctctgcaggtgcctgagcgaagggaaaaaaggtggaaggaaaataaagttcctgaaagctg

SEQ ID NO: 1950 - DNA, 1481 bp, Rattus norvegicus
  Genbank Accession No. NM_017140
ctctgaagagcctgatttagcccacattgctgtctgtcttttcctaggaacattttggagtcgcgttcctctgtgtgggccatggcacctctgagccagataagcacccacctcaactccacctgcggggcagaaaactccactggcgtcaaccgggcccgtccgcacgcctactacgccctgtcctactgtgctctcatcctagccatcatctttggcaacggcctggtatgtgctgctgtgctgagggagcgtgccctgcagaccaccaccaactacctagtggtgagcctggctgtggccgacctgctagtggccacgttggtgatgccgtgggtggtgtacttggaggtgacaggtggagtctggaatttcagccgcatttgctgtgacgtttttgtcaccctggatgtcatgatgtgtacagccagcatcctgaacctctgtgccatcagcatagacaggtacacagcggtggtcatgccagttcactatcagcacggcaccgggcagagctcctgtagacgtgtggcactcatgatcacagctgtgtgggtgctggcttttgctgtgtcctgccctctcctctttggtttcaacacaacaggggatcccagcatctgctccatctccaaccctgattttgtcatttactcttcagtggtgtccttctacgttcccttcggggtgactgtcctggtctatgccaggatctacatagtcctgaggcaaaggcaaagaaaacggatcctcactcgacagaacagccagtgcatcagtatcagacctggctttcctcagcagtcttcctgtctgaggctgcatcccattcggcagttttcaataagggccaggtttctgtcagatgccacaggacaaatggagcacatagaagacaaacaatatccccagaaatgccaggacccccttttgtcacacctgcagcccccctcacctggtcagacacatggggggctgaagcgctactacagcatctgccaagacactgccttgagacacccaagcttggaaggcggggcagggatgagccccgtggaaaggactcggaactccttgagccccaccatggcacccaagctcagcttagaggttcgaaaactcagcaacggcaggttatccacgtccctgaggctggggcccctgcagcctcggggagtaccacttcgagagaagaaggccacccagatggtggtcattgtgcttggagccttcattgtctgctggctgcccttcttcctgactcacgttcttaatacccactgtcaagcatgccacgtgtccccagagctttacagagccacaacgtggctaggctatgtgaacagtgccctgaatcctgtgatctataccaccttcaatgtggagttccgcaaagccttcctcaagatcctgtcctgctgaaggaggagaagagaccgcactcctttaccacttcgagatgccaggcagtttgaaccctg

SEQ ID NO: 1951 - DNA, 3298 bp, Rattus norvegicus
  Genbank Accession No. NM_017141
cggcaccatgagcaaacgcaaggccccgcaggagaccctcaacggcggcatcacggacatgctcgtggaactcgcaaactttgagaagaacgtgagccaggcgatccacaagtacaatgcatacagaaaagcagcatctgtgatagcaaagtacccacacaaaatcaagagtggagcagaagctaagaaattgccaggagtaggaacaaaaattgctgaaaagattgatgaatttttagcaactggaaaattgcgtaaactggaaaagattcgtcaggatgatacaagttcatccatcaacttcctgactcgagttactggcatcgggccatctgctgcaaggaagcttgtagatgaaggaattaaaacattagaagatctcaggaaaaatgaagataaattgaaccaccatcagcgaattgggctgaaatattttgaggactttgaaaagagaattcctcgtgaggagatgctgcaaatgcaggacattgttcttaatgaagttaaaaagctggatcccgagtacatcgctacagtctgcggcagtttccgaagaggcgcagagtccagtggagatatggacgttctgctgacccacccaaacttcacgtcagaatcaagcaaacagccaaagttgttacatcgtgttgtggaacagttacaaaaagtccgtttcattacagatactcgttcaaagggtgagacaaagttcatgggtgtttgccagcttcccagcgagaatgatgaaaacgaatatccacacaggagaatcgatatcaggttgatccccaaagatcagtactactgtggtgttctctacttcactggaagtgacatctttaataagaatatgagagcgcatgccctggaaaagggcttcacaatcaatgagtacaccatccgccccctgggggtcactggggttgctggggagccccttccggtggacagcgagcaggacattttcgattacatccagtggcgctaccgggagcccaaggacaggagtgaatgacgcctgccccacccaggcctatcccacgaggagtcctaagttattgcttaacctttgctatgtaagggttgggtgttttaggtgattgcctcttctctgtgcttcccatggactatcgtcaatgaacctcttgagcagctattcagtattttcttagcacatgtgtttaaacttagatatgtttgtgatcgcagtaccatggtttactagagaaacgtaagagccgatgtgataagcagtgtttaatgacctttcacttccacctcacattgcagccacagtcggccccacttgtccctatccaccctttatgggtcagctggtctcccagagccatctccagaagtcacttcattatccttagaaacaaggggcttccaggcatggtggtgcacatccttaatcccaggacttgggaggcagagacaggcagatctctgtgagttcaaggccagcccagactacatactgaattcagggtgccagagctacatagtgaggccctatctaaaaagaaaggggccttcatagctgtaagacttctgtgaccatttcccatttgcagtgtatactgataactagaagacagtgtgtgctttacctcaggggcagccttcccctcacagctcaatggcacctaactagcattcatcagtcgtctggtggacagtccactgtttatcaaataacattctgtgacacgaacaaagaacttcaagtttaagaaagatttatttgagcagattgagccactgtgtctggatggctttattgtagagtcctgtcatgttgtagatggtagtcacaaagtcagaagtaactcatcacagcgtctggtcactgtcagttgctagaagattcagctttatttatgtgctgggtataatgtacttgcctgtaatcccaagactcactcgaggcaagaggaacatgagttcgaagcccaccctgggctatatagcttactctgagaccctgtctcagaacccttacccctccccccaaaaattatccaggaggcagaggcaggtgggtctctatgagtgtaaggccagccagggctacacagcgagaccactgtctcagaaaacaaaataaaaaatagaataaaattagtgccagggattctgtgtgaacacgagggacaagtcccatgtctgtacaacttatattctttggcatactcttagccttgtatgttgtcggttaccagtcacctgacttcgacaggacagtccagggaccacagtcacagcgctggaagatttctggggcttgggcagtgtctttgtgccccctcctggaacacacttgtccctctagtagaactggcttgcaaattttggtccaaaaatggcgagcacagcaaagtccagggccgcagtcggaggttctgagacagctttctccctcctgtcctgtaacaaggtaggctcaggctctagaggtggcagatgggttaagggtgtgtgtgtgtgtgtgtgtgtgtgtgtgtgtgtgtgtgtgttatactaatgggttgagattgggatctaggaatgaaggcctatatagcctatatataaactagcaaagccaacaggacacaggtctcacagaataagggaaattagagccctactgaacaaagacatcaaggaatgattatctaccctgagaaataggtagcactccacaaagtttgctaatacagtttttcgtgagcatcgattcctttacttataaaggggccagctagtccaatatgtgagtaggagcggctgttgtacctctccactttcaaatactctgttattcaagactttaactcgagactcctatttttgtttaaaagaatttttgtaaatccccaagtgtggtggcagacacctttaatcccagcagaagccgtcgggtctctgagttcctgaacagtctggtctacacagtgagttctaggatagcagagctacagacccttttgtactatgtacaagtctggagtgaatgcatcttctttaatccactctgtatgctgaggctataggaaaggtacgtggcacttggtacaccccagcttagggaaagccatcggttggaggtttccttcctaagctgtcatcactagggtcttgccctggcctggccaatagagtcccttgaattgctccaagagctcacagacatgaggtaaaggagtttagcttcagcctgtggggctgggagggagaaaatggtttttaaaataaaatatgctctccttaaaaaaaaaaaaaaaaaaaaaaaaaaaaaaaaaaaaaaaaa

SEQ ID NO: 1952 - DNA, 1039 bp, Rattus norvegicus
  Genbank Accession No. NM_017147
gaaacatggcctctggtgtggctgtctctgatggagtcatcaaggtgttcaatgacatgaaagttcgcaagtcttcaacgccagaagaagtgaagaaacgcaagaaggcagtgctcttttgcctgagtgaggacaagaagaacatcatcctggaggagggcaaggagattctggtaggagatgtggggcagactgtggacgacccctacaccacttttgtcaagatgctgccagacaaggactgccgctatgctctctatgacgcaacctatgagaccaaggagagcaagaaggaggacctggtattcattttctgggcccccgagagtgcaccccttaagagcaaaatgatctatgccagctccaaggatgccatcaagaagaaactgacaggaatcaagcacgaattacaagctaactgctacgaggaggtcaaggaccgctgcaccctggcagagaaactaggtggcagcgccgtcatttccctggagggcaagcctttgtgagccacctccagccccctgcctggagcatctagcagccccagacctgctcttgggtgttgcaggctgcccttttcctgccagaccggaggggctgggggggttccagcagggggagggttttcccttcaccccagttgccaaacatccctcccaccccctggaccgtccttttccctccatccctgacggttctggccttcccaaactgcttttgatcttctgattcctcttgggttgaagcagaccaagtcccgtcctaggcacccagtttggggggagcctgtatttttttttttaacgacacccctactcctgatctgtcccatcccatgctgccaacttctaaccacaatagtgactctgtgcttgtctgtttagttctgtgtgtaaatgaactgtggaaatgaccctccctgcaccagctggttgccctcccctttccctttgatcttggccactcatggaagcaggaccagtaagggaccttcaatttaaaaaaaaaaaaaaacacaataaaaaggctaattaacaaa

SEQ ID NO: 1953 - DNA, 1403 bp, Rattus norvegicus
  Genbank Accession No. NM_017148
gctgtcgcccgtgcgcctcctagcagctgccagaatgccaaactggggaggaggcaagaaatgcggggtgtgccagaagacagtctactttgctgaggaggtccagtgcgagggcaacagcttccacaaatcctgcttcctgtgcatggtttgcaagaagaatctggacagcaccactgtggcagtgcatggagaagagatctattgcaagtcatgttatggcaagaagtatggaccaaaaggctacggctacgggcagggtgcaggcacgctgagcatggacaagggggagtctctgggcatcaagcatgaggaagcccccggacacaggcctaccaccaaccccaatgcatccaagtttgctcagaagatcggcggctctgagcgctgtccgcgatgcagccaggcagtctatgcagcggagaaggtgatcggtgccgggaagtcctggcataagtcctgcttccgatgtgccaaatgtggcaaaggcctcgagtcgaccaccctggcagacaaggatggtgagatctattgcaaaggatgctatgccaaaaactttgggcccaaaggttttggctttggacaaggagctggcgccttggtccattcagagtgaggctgccgctgcgtaccctgcctactcctgcactctcataagcagtccgttcctggaagccatggacacctccaagatcctctctctcactcagccctgctgcacatcactaatgccttggacttgggtgttctttggcttaggggtctgcctgagttccttccccactaagggcttcctcctgcctggcattcgatacccttatctttaggagacatctgtctagtcaccccttcccagataccaggtccctctcccccacaccttacccctacagacctctgtggccaggacactctctactggccaggacacctgaccccacatctttggagcccaaaagagcaaggcggaagacctgcgctagggaaggctgtggtctattgtatccagagtctctctctgggtaggatgctgagcttcttggtgcctctcagtctggaagtccccgtgagaggcagagaggtgcggataggattgtggggtcatcagaaggagcttgttctctgacctcttgcctttgaatgtggaaataataacttttcacttagggatgaagaagaacgcaggtcagaggaccccaaaatctagaggttgcctgacctcaagttccctgttccatgggcaagggagagcctaatgcataccttgaacaaggcattgacatggatcagtggtccagatcttagagtggtcagttctggttctaagcttgggtctggtggctgggatggacagcttctgttgcagcatagcccagggtagagctgtgttctagccactcctg

SEQ ID NO: 1954 - DNA, 2244 bp, Rattus norvegicus
  Genbank Accession No. NM_017149
gtcaagtgtttatacgtgcaggagactggccgctcggctcaggactgggattagcgggctctgctcaaacccgcgcggcttttacattaggagtgagtgggggagagtcctaggatttctagtgaaaagtgacagcgcttggtggactttgggaccttcgtgaagtcttctgcttggaagctgagacttgcatgccatggaacaccccctctttggctgcctgcgcagcccccacgccacagcgcaaggcttgcaccccttctcgcagtcttctctggccctccatggaagatctgaccacatgtcctaccccgaactctccacatcttcctcgtcttgcataatcgcgggataccccaatgaggagggcatgtttgccagccagcatcacagggggcaccaccaccaccaccaccaccaccatcaccaccaccagcagcagcagcaccaggctctgcaaagcaactggcacctcccgcagatgtcctccccgccaagcgcggcccggcacagcctttgcctgcagcctgattccggagggcccccggagctggggagcagccctccggtcctgtgctccaactcttctagcctgggctccagcaccccgaccggagccgcgtgcgcaccaagggattatggccgtcaagcgctgtcacccgcagaagtggagaagagaagtggcagcaaaagaaaaagcgacagttcagattcccaggaaggaaattacaagtcagaagtgaacagcaaacctaggaaggaaagaacagctttcaccaaagagcaaatcagagaacttgaggcagagttcgcccatcataactatctgaccagactgagaagatatgagatagcggtgaacctagacctcactgaaagacaggtgaaagtgtggttccagaacaggagaatgaagtggaagcgggtcaaggggggacaacaaggagctgcagcccgagaaaaggaactggtgaatgtgaaaaagggaacacttcttccatcagagctgtcaggaattggtgcagccaccctccagcagacaggggactcactagcaaatgacgacagtcgcgatagtgaccacagctctgagcacgcacacttatgatacatacagagaccagctccgttctcaggaaagcaccattgtgatggcaaatctcacccaaacatcgtttacatggcagatgactgtggcagtgttgcttaatataattaaacgcaggcatctcaagtctgtttctcatgattgatagaaggtttacactaagtgcctcttattgaagatgcttccacagtgaaattggagaaagtgaacatatctaaatatacttgttccttatatgacagagagggagatgaatgtttgctttggcttgcactgaaaattaaattgctaccaagagcaaactcggtaagacattttgactcaagttgtctccagagtgaagatgttatagaaatgctttgaacattccagttgtaccaggtcatgtgtgtgacactgggcaggtatttgcttttgcttgcactgaaacttaaactgctatcaagttaacccatgaaatagtttatcttgaacagccacagtgcctgaaatcaccaagtggatataaaatgaactgaaattctgtatatattactcctaagtcattttcctgtcttcactaattttagcaaatgcattcatattagctgatgaaaataggctttcccgtggacaaatgcagccagcttcttgtatttttatacatttttttgtcagtcagagacatcagtatgtgcttacttgtgttcaagtagaggaaatgcagtagagtctgataggacatattcttggtaccacagacaaaacaaatcttctgttgcattgactatcaactgctgcagatacattagagaacacacctagcccccctccagcctccctctgttatcgctcgaagacattagcgtcataggcaagtagttaccttgccaaatgagtcttgtgtggcagatgtctgattttgtatctttaaactgttaatggtatgtgtctgcttcagttaacagggaaaaagatttcttcctcattgtttatgatacaaaacccaagtgccaaacaaagctagttcttcaagggatagatgagaaactgaatgtctgacaagtagactcagcgaaaatacattatttttcagaggctgtgtattcatgcagtacaagtccttgtattttgtaaaaaaaaaagttaaataaatg

SEQ ID NO: 1955 - DNA, 487 bp, Rattus norvegicus
  Genbank Accession No. NM_017151
tttttcccagcagccgccaagatggccgaagtggagcagaagaaaaagcgaaccttccgcaagttcacctaccgtggcgtggacctcgaccagctgctggacatgtcctatgagcagctgatgcagttgtacagcgcccggcagagacggcgcctgaaccgaggcctgcggaggaagcagcactcactgctcaagcgcctgaggaaggccaagaaggaggcgccacccatggagaagccggaggtcgtgaagacccaccttagggacatgatcattctgcccgagatggtcggcagcatggtgggtgtgtacaacggcaagaccttcaaccaggtggagatcaaacccgagatgatcggccactacctgggcgagttctccatcacctacaagcctgtgaagcacggccggcccggcattggtgccacccactcctcccgatttatccccctcaagtagtggggacaataaagactcgttttcagcc

(The sequence listing continues in the following parts.)

We claim:

1. A method for determining whether a test compound is a cardiotoxin, comprising:
   (a) exposing heart tissue or heart cells to the test compound;
   (b) preparing a normalized gene expression profile of at least ten genes for said heart tissue or heart cells, wherein the gene expression profile contains the differential gene expression values for said at least ten genes upon exposure to the test compound, and wherein said at least ten genes are listed in one of Tables 5A-5LL;
   (c) comparing the gene expression profile to a cardiotoxicity model, the cardiotoxicity model comprising information from one or more of Tables 5A-5LL, and comprising:
      (i) the normalized mean expression levels of said at least ten genes in heart tissue or heart cells exposed to a known cardiotoxin, and
      (ii) the normalized mean expression levels of said at least ten genes in unexposed heart tissue or heart cells; and
   (d) scoring the comparison to determine whether the test compound is a cardiotoxin.

2. The method of claim 1, wherein the gene expression profile contains the differential gene expression values for at least 100 genes that are listed in one of Tables 5A-5LL, and wherein the cardiotoxicity model comprises the MeanTox and Mean Nontox gene expression values in said one of Tables 5A-5LL.

3. The method of claim 1, wherein said gene expression profile is generated by hybridization of nucleic acids to a microarray, and is normalized for hybridization conditions, label intensity, and reading efficiency prior to comparison.

4. The method of claim 1, wherein the cardiotoxicity model comprises all the information in any one of Tables 5A-5LL.

5. The method of claim 1, wherein the heart tissue or heart cells are exposed to the test compound in vivo and the cardiotoxicity model is generated by exposure of heart tissue or heart cells to the known cardiotoxin in vivo.

6. The method of claim 1, wherein the known cardiotoxin is associated with at least one of myocarditis, arrhythmias, tachycardia, myocardial ischemia, angina, hypertension, hypotension, dyspnea, and cardiogenic shock.

7. The method of claim 1, wherein the known cardiotoxin is selected from the group consisting of cyclophosphamide, ifosfamide, minoxidil, hydralazine, BI-QT, clenbuterol, isoproterenol, norepinephrine, epinephrine, adriamycin, amphotericin B, epirubicin, phenylpropanolamine, and rosiglitazone.

8. The method of claim 1, wherein the heart tissue or heart cells exposed to the test compound are rat heart tissue or rat heart cells, and the cardiotoxicity model is generated by exposure of rat heart tissue or rat heart cells to the known cardiotoxin.

9. The method of claim 1, wherein the gene expression profile contains the differential gene expression values for at least 20 genes that are listed in one of Tables 5A-5LL, and wherein the cardiotoxicity model comprises the MeanTox and Mean Nontox gene expression values in said one of Tables 5A-5LL.

10. The method of claim 1, wherein the gene expression profile contains the differential gene expression values for at least 30 genes that are listed in one of Tables 5A-5LL, and wherein the cardiotoxicity model comprises the MeanTox and Mean Nontox gene expression values in said one of Tables 5A-5LL.

\* \* \* \* \*